United States Patent 6,812,339 (POLYMORPHISMS IN KNOWN GENES ASSOCIATED WITH HUMAN DISEASE, METHODS OF DETECTION AND USES THEREOF) - sequence listing, part 14

SEQ ID NO: 12191 - DNA, 129778 bp, Human
  misc_feature (1)...(129778): n = A,T,C or G
gagaaacaatgccttaatctttgggtgtattctgctctctccctaagttcccactaccccttcatcccactccccaatttagcagaacaaatgtagagagaaataagtttatgcagagatatttctttttgtatgcatactgtttatcatacttttttcttttatcaaaccattgcaggctgggcgtggtggcccatgcctgtaatcccagcacttcgggaggccgaggtgggcggatcacttgaggtcaggacttcgagactggcctggccaacatgctgaaaccccgtctctactaaaaatacaaaaaattagccgggcgtggtggcgcatgcctgtaatcccagctactcggaaggctgaggcaggagaattgcttgagcccagggaacgaaggttgcagtgagcagagatcatgccactgcactcaaacctgggcaacagggtgagactctgtctcaaaaaacaaacaaacaaacaaacaaaaaaccaaaaaaaaccccatttcttcaatgttcttcttgcccatattatcacctgtggcttctaaaagatgaaagcaacacaaggccagctatctggtcaccctagcaaaaaggcagtggtgaaaatggaattttgaagtgctggcctgggagtcagcagacttgggctctcactgtggctctttagctgcctttgactttggcacatcacttaacattggtgagcttcaatgttcaacatacttctattgaatcacatctggaacactttaaaatttaatatttatactcctcccttattttgaaaaggatttgaataactagcaagaggtagagaggtgacctgtctagtcttatcactgtctttggctgtcagacaagtagatgattaaatggattagggtattttaggtctttgattagtgccttctaaaaggcgtcacaaccacagcctcttcaccctgtccttactttctgtcctgtgacagcttcttctattgcctaggaagttaagatctatcttctttgagggtcatctgaagagtattttgccaaggaagtagttgtcgagatccaggtcaaaaggaaagaggaattttagcatctaggaattggaagaaatactagaaacttcagtcaaaatacctttttcaaatagtgaccttgaggcctggagaagagaaatgacctccctagatcatatggtagagctaagcctagatttcaggctcttcctattgtgtgcatcattcagactaggtgttttccaggcttgtaagagaggactaggtgtcacagaaagagctaaggtggcctaggctcttgtgctggttttactgctacatggacatgtaatggtaggcagaagaaactgtatcccagaccacctaaggtgttgtatcagatgagctcgggaccttcagatatctaaaaaatatttgcctgatataactgtctatgagaaggcatgagatgtgagaggtttccccagtcaatggctgaccttatatgtatcagcactgacaaaatgaacaaaaaggaaaattacacatcatttgggcactgggactaattggctgttgttctgtttccagaaagattatgttgatttacatttgtgtatttggctgattaaaaataatagctcaattgaatatgtatttctttgattactaatgaggccaaattttttcctgtgttcattggctatttatgttttctctcatttgtgagttactgattcacattcttgtctagatcccagtatactcccagtcctatgcaagacttccctgccaagaaactattagggtgataaagcattgtccttgtgggggagctcagcattttcttggggagacagttacagtctagatgaaacacctctgtcactgtacaagtagccagttaagtgcctacatgaggagtcagatgctagaagctaaggatgctgacacaggtgggtgataggttctgggtggcagctctgagtaattttgtctcttgcttttcttacacagagttttgccgaattgacaagcccctgtgtcacagtgaggatgagaaactcagcttcgaggcagtccgtaacatccacaaactgatggacgatgatgccaatggtgatgtggatgtggaagaaagtgatgaggtgagctctcccatcctgctatgtctctcttttcttcctgtgtgaattagtctttgaaagctacttagacagcctcttccctggggagagatgttctctgctggcttgttctttaggaactcatccctatcagggaagatggctcccagaagagcagccctctaggagtcagcctgtcagagtgtaggctttatgcttgtgtctgtgcctgggctggctgccccctgcctactggctagttgtgtaacactgactaagctgtgttgtttgggagggagagagatccctgaggctggtctctatggtttccttgcatccttcttgcaatcctgctatagatggagggcatcagtctgttctcagccctgtgttggcatgagggatagaagataagacacccagatcctgccctctgggagtttatactctatatgggaagaagaaacaaattgttttagaaagatcattctgaattccaggctgaagtttttgggagccagttgagtggtctagatagtaagagttaaaggagtctctaaatggaaaaaagctctattgttgtttcatcttttggcattattgtacctgtggctcagcagatcccagagaataaggtcattatgtgtgaaaagatttaaaagtttgttcatttaaagctcaacatataccagtagtttggtgaagctaccaagttatgccaaatcttcaatagtgatgtagttatatcacgatgggggagatatccccattctctctttcctgccagcctacctttgagttttgagttcaattttggatcccacattgtcagatccaatgtgaggaacaatgagggcctatacagagaggagtgacatgagtgatgaagagtttggaaagtatgaaacaaagagcattcaacacaattatgtttattaagcgtctatgtaccatgcactgtgctaggcatggagatgggactgtaaataaaacagatacagtctgtctttatataacttaaagtctagtgaagagactttagcctggagaagaggagactcaggtaatataatttctatctttaaatacataagaagtaaatcaatcagacttaagtaatgatgatagtaaagtgaaaaccatgatactagctctcattgattgaactcttaccttatgccagtcacagtgttaagctttttgcatagttactcttttaacttcaacagatttatgaagttggtattattactagggtatggagccttagaaaggttaagcattttcttcagggacacagtgaatatcagtgcagatctgatttcaaagcccatgctcttaagtactgctgtattgtttctcctattctaagagcagaaccaggtccaaagtaaagtggggaaagtaaaaagtaggcattttcttttagaataaagaattgactaatagtgagagctatcttgtcatagaagaggcttccttggtagacagtgaactccctatcactgaagatgggcaagtagcatacagaactccactgaatctgggtgtggtggctcatgcctgtaatcccagcacttcgggaggccaaggcaggaggatagcttgaggccaagaatttgagactagcctggacaacacagcgagaccctgtctctacaaaaaaaaaaaattggctgggtgtggtggcatacacctgtagtctcagctactctgaggctgaggctggaggatcacttgaacctaggaggtcgaggctgtggtgcactatgatcatgccattgcactccagcctgggcaacagagcaagaccctgtctctaaaacaaaacaaaacacaaaacaaaacacaaaattcactgattggtcaacagaggggatttgtctgtaaggatgaaccagataatgtttaaggaatttaaaggaagagaaaaaatagacttcctgtataaaaagtaaaatttggatagaatggaaagggttgggcttactgagtagtggagaatcagtgtgagcaaagctgtagaggtagtaagaaatatagtgggttggtttggttagacagggactgtggtagaaaaccacagaacaaaaagttggaaaggaaagtggggcccaggctgagatatgtatacttgttgaaccaggcaactgtaggttcttgagcaaagacaacgaccatgatgtaagtatctgaaatttggttacatccagaagtgtcactgacctgtaaaggatcaaaattttatttgtctaacctgagaatacagccatgttcctgggggtgaatgaggcctagtggcatcctgatcactgtcccagggcctggccagaaaactggggaatggatgaagaaggtgatgtaacccaagatctataaattcttggatatctttgttatatgctcctcatccttttttttttttttttgttacatcctgctgagttgctttgtcaatgaggggaggaataaaatgttctttttagaggaatgttaccacaacaaaaagctcatcagcacaaactgttccgaaataacacaaaaactgttaccctgctcttctctgcgccagtggtgagctgttctttttcagtatagtttttgccttgccttggtttccactgctctccctgcaatctcaggcctcacatggttagagaggcctgctggtctaggtttgcatgatcaatcacaagctaccttcctgagagagaaagtaccaaaatgtgtgtgcctaagtcacttcaaacatgtataagatagccttagagttcaggatctaactagaaagttgggtagatatctcagggtttagaatgttgtgtaatggatggtggggtaccagaaaccctggttcttttggccattgaggacctgaagggttttttttttttcattcataaaacttttattccacttacatgaatttaatacacgtgttcttaacaattatgcttggattattaatgaaaatttcataagatattaaacaaagctagccatcatctcaagttatttccttgttaactatttttacagcacatgcatgttaggcaagtatcaaaaaaaatcacaacagcaaaaaaactaaaaaaaaagaagttaaatacatgggtttttctttttttgttttactgctgtgcttgatatacgtgaagtaatgaatatcaagcaattcatttttactgcatctttacttttacatttgtttttaggttgcctaaaacatttaaatacaaataaaatgagtgtagcaaaaataatgaaagccaacagcaggtaactttacaaataatggaatgtgaactgtttctgcccttatccagagtaaaatgggtcacaactttgtctaaaggaacacttctgcagccgtagtcaaaggtgtgcacagtgagattgaatattccatagatatacaagatgtaacatgtgggccaggtgtggtggctgacacctataatcccagcactttgggaggccaaggcaggaggactgcttgaggccaggagttcaagaccagcctagtcaacatagtgagaccttgtctctataaaaaaataaacaagtatgaaaaaaaaaaaaaaagggccgggcacggtggctcacgcctgtaatcccagcactttggaaggccgaggcgggtggatcacgaggtcaggagattgagaccatcctggctaacacggtgaaaccccgtctctactaaaaatacaaaaaattctccgggcgtggtggcgggcgcctgtagtcctagctactctggaggctgaggcaggagaatggcgtgagcctgggaggcggagcttgcagtgagccgagatcgcaacattgcactccagcctgggtgacagagcaagactctgtctcaaaaacaaaaaaaacaaaaaaacaaaacaaaacaaaaaagatgtaacgtgatatccatgggatatctgtttctaccacagccgtttaagtgctccaaaccttaaagtacccacagttactacacctgtgactggaaccaatgatcccttttactccctgccaggacaaaccaatgtgtaggcagttttctttgcttagacatgaagcagttttaacactggcccttgtgaagccacaatgtaccaaaagtactatgccaaacatttataacctttagaaaaattccacatttccatattggccacctcaaaatggaaacagataactccctaaatgttaaccggccctgctctcctaatattaaacataaaaaccacatgggaaatatagatattcaagtagaagtagcataaacctgtcataaatcataaacaaaaactctttgtgggacagcatggatgacaaatggtctactatgtaacttttagaatgaggcagacaaagttggaaggctggttaattttccccttgttctcctgcttcagcttcatttccttgggttctgatgaaggacctgagatttttataagtcatcttaaaagccttgctgattactcaagagccttagtagaagtctgaaggggtgctctattgaggcctcatgtattcagcctcctactggtaacttttctgcataactggactgtaaccccagttacagatcttttaaaatttttgccatttctgaagtaagtctttattcctacagattattgtgactagagtgttaacttttcgttgtatgaatcaaagcatgtcttcagggcctcttgcactattaccccagtacctagattcctatatacattcttatgattgcctcttatagttatcttcttatagttttatctcttctttgattcattttcatttcttttttttatagacacatttattcagcatcacgatcaaactattacatttagcaatcaacagcatgagtaaaaaaaattatctacactaaaactctttgttggcatgctttacattttccacagaaaagaaactaaaataacctgttatacaattagtcacaaatacagtcctacttttttttttgcctatacacattaatattgtctaaaacatgtcttctttgtagcagctaggccctgccaccactgtgcttggctgagttcacaaatctgttgtaacctgtagcttctttgtcacttctctggctctcttctgctaagtatttttctggcagtaattaaaatctgccactgccatagctactgactggaaccaccatagctgccttggttttgtgttttggccagtatagaatccagagcttctgcctccaaagtttcctcctttcgtgcatccaaaatttgaggactgattgttataattgccaaaattattgtagcttccaccacctccaaaattgctttcactgccaccaacaaagctgcttctgcctccatcgttgttatagctgtgagagctgacactcctgctgtagccactgccctgatttccataatcctgcctccacttccatagcctctgcttccttcagcgtaaccagggctgcccctctataaccactgttgttaccaaatccattatagccatccctgttgctaccagatcaccaccagcatggctgctaccaaagtcaccacaaccactgaagtttctcctccatgaccaaagttgtcattcccaccaaaaccacctccacgaccatcaccagagtttccagaaccatttcgacctctttggctagatgaaacactagccatctctttcttcgacagggcatccctaacttcatagttgtggccattcacagtatggtatttctttttttttctctcgagacaaggtcttgctctgttgcccaggctggagtgcagtggtgtgaacacagctcactgcagcttggacctccggggctcaagtgatcctcccatctcagcctcccgagtagctgggactacaggcgcgcaccactgcacctagctaatttttgtattttttgtagagatgaggtcttgccatgctgcccaggctggtcttgaactcctgggcaagtgatcccctgcctcggcctcccaaagtgctagaattacaggcatgagccactgcacccagccagtatttcttttaaaaatatttgtttatttattttgagacaaagtctcacactgtcggccaggctggagttcagtggtgtgcgcatggctcactgtagcctttacctcccaggctcaaacgatcttcctgtctcagcctcttgaatagctgggactataggcacatgccaccatacccagctaatttaaaacaaatttttttaaatttaaaatgtatcttttttaaagcccccaacaaatatccttttcatagttaagtgggcatgtggtctttgagaatcttctcttgatacagctcttctgtccaccttatgtagccttgcattcacggctgcatccacctcctccacagtggcatatgtgacaaacccaaagcccctggagcacttggtatttggatctctcattaccacagtctgtgagtgctccctgttgctcagaatggctcattggaccctcactggtcatttcaaagctcaactctctgatgaagaacttctacagctgttgggactacttaagagactctgtcttagacatgatagcagtgggaagagagactttaatgatgttttcagcggcatccatgggtagaaaaagccattctcgtttctaattgctgaatatactctgctgtgaaattagacttagggcaaactgagactcagtaggcatgttatagaaaaatatataatcaggccagttgtggtggctcacagctgtaatctgagcaccttgggaggctgaggcaggaggattgcttgagcccaggagttcaagaccagcctggacaacatagggagactctatctctaccaaaaaaaaaaaaaaaaagccagatattggcacagagaccctaaaagagactttttaagagtctcttaaaagaaaagaaaaatatataatcatttgtgtaggggcagctagtttggttaagtgccatctttgcttgcttctcttctggatagcagaggctatgtattgtgggcccttcagatgtgcaagatggctctattggtgatggtgcccttcttgcagagctggcagggagttctaccaggctggcagtatgagaattcatgacctgtgttctgttcaaacttctggtggggtttgctccatgggcaaaagatttgttgcagtgggatggtactgttaggttgtccttaacagtatgagttgggcagacaagggcctacctaagaccattgtccccttgactggaccagactttttgagagcagtgctattttcttttctggagcctacatggcaaatcagggcatttattcagtcattaaacaaattcttatttaatacatattaaagccaggcactattcgaaggctagggattccacagtgtacaaaacagataagatccctgcttttagggagcttgcgttctagtgatctgtatgtcacaggtgattaagtgataagaaaactttgaaattaggcagaactgtgatcagattatagtagtctagtgactttgcctttggttttctcagggtaaagtggtagttaatgattcctaccattgcagcgttgttgtcaggattaagtgagaaaagtgctgtttaaagttcccaacacaaagaattctcaaaactcgacaatagaaaataagccaggccaggtgtggtagtggctcacgcctgtaatcccaacactttgggaggctgaggcaggcagatcacttgaggtcaggagtttgagaccagcttggccaacatggcaaaaccctctctgtactaaaaatacaaaaaaattagctggtgtggtgacacgtgcctgtaatcccagttactgggaaggctgaggcaggagaatcgcttgaagccgggaggcggaggttgcagtgagtggagatcgcaccactgcattccagattgggcaacaaagtgagactctgcctcaaaaaaaagaagaagaagaaggaagaaggaagaaggaagaagaaaataagccacttaataaaaaatgggaaaagatttgaacagagacttcaaagtagatatatggatggctaataagctatgaaaagatactcaatattattaaccattagggaaatgcaaattaaaaccataatgaggtatcaccacatgcctgttagaatggctaaaaataaaaaatggacaatatcaagtcctggacgaggaggaagagccactggaactcttgctgatgggaatgcaagatgataccgccagtctggaaaagtttcacagtttcttacaaagttaaatatatgtcccagcaattcttcctctaggtatttaccctatgaataaatgaaactttatattcacagtagaacctgtatatgaatgtttatagtatctttatttgtgattgccaaaaactggacataacccaaatgtccttcaatgtatgaacggataaacagactatggaaaactactcagcaatataaaggcatgaattttttggatgaacacctgtggggaaaagcaaaaacaaaaggcaaaaacaaaaagcaaaacaaaggcatgaactactaatatacacaacatatgtgaatctcagaggcattatccgagggaaagaaaccagtctcaaaatattacatactatgtgattctatttatatgacattctgagaaaggcaaaactatagggatggagactaggtcagtggttatcaggggttattagtgtaggggaggttttgactacaaggggaaagcatggaggaagtttttgggagtaatggcctaactgttctgtgtccagattgcaagggcagttacatgaatctattaataaatatgtattaaaactcatggaactatgcgccaaaaagttaaatttcatcatatgttaatttttttaaagttcccagcatagtacctgacacgtaattcaagctcagtgaatactcgctactttcccttttctcttttcctctatatatccaggaaatcaactagcatctgacagttgtatttttcttagatagggtctcactatgttgcttaggctggtgttgaactcctgggctcaagaaatcctcctgcctcagcctcccaaagttctggaattacatgtgtgagccaccacgcctagcctgacagttgtttttttttggagatggagtctcactctgtcacccagaatggagtgcagtggtacagtcttggctcactgcaacctctacctcctgggttcaagcgattctcctgcatcagcctccctagtagctggaactacaggcgcgtagtgccacacccagctaatttttgtatttttagtagagatggggtttcgccatgttggtcatgctggtcttgaacttctgacctcaggtgatctgcccgcctccagctccgaaagtgctgggattacaggcatgagccaccacgcctggcccctgacagctgtattttaatgtttgtctgatgtattttgagcccctttagggaaagaactgctcttatctggtttgtctctcttttccccagtgcccaacaaagtctgttatagaatatgtgcttaatcactgtgttgaatgactgaccaatattgctatagcagaatgctatcattctgctatgggagtcttagcaagggtgtgatcacacattttaggggataaggatgagtaggtagcagtatgaatccaggaagctacaagatctacttatgacttctgttagtgtctgtggtgtctggtatagaagtataacacagggttatgagcttatgctctggaatcatacagactccattctgcctcttccagctgtggaaacttagagaagttacataatccctttccacctcagtttcttcattagaaattggagtaataatagtagtaggcttttcatgaagatgttgcaaatattaaatgaataatgcatgtaaagcacttaatacaatgcctggcacatagaagaggctcaattaaagtttttacgttatcatcagaaagaacatatattttgatgcaaacaagcctgtattcaaaacttggctttgccacttactggctatacaactttaggcaaataaccttacctttctgagccttgattttttttttaagctatttgaagagggatgttgtgagacattaatgtatgtaaagcccctagcacaatgcctggtacgtgataggtgctaaagccatgtttttttctccctcaacatgagggtacaatagtgagggctggcttgtatagcaaaattccatatcagctctatcaccatcccatggcaccacagcatttagccatgggagccactcccagcagtgtgcctaacttgactagggccaggacactgtaggaggcagaggtagttctgttttcgcttaagtggttgatattaagagggagggcatgataaagcaggatcacacatttatagggactacaacttttctggcagctcacccagcctcctacatatgcctgtgtactttttttttttttttttgagacggagtttcgctcttgttgcccaggctggagtgcaatggcactatctcggcttaccgcaacctccgcctcccaggttcaagcgattctcctgcctcagcctcctgagtagctgggattacaggcatgcaccaccacgcctggctaattttgtatttttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactaaaaatacacaaattagctggggttggtatcaggtgcctataatcccagctgcttgggaggctgaggcatgagaatcacctgaaccccagggaggcggaggttgcagtgagccgggattgtgccactgtactccagcctgagtgacagagtagaaatgtcatgagacctgtttagagtttagtgggggtagaaatagacttgttttctatgtttttcattgtcccatccagagtaatgctaggtcctgggaggctgtgagagttcgggaagctggcatcaggttcccgatgccaccatttggcttcagcgctcccaccatttggctttagctcatgctactagttcatgttatgctgtatttccttaatctatgctatagccaccccaaacagaatcagagctaagggagctaaactctgaggggagcagtcagcaggttcacttgcaatatctaaagtgccaggaggaacttggactttataggtagtagtatatagggagagagtaggaagcccagtgctgtggttaatatgggccaaattagatgaagattaagtagctgggttatttgcagatgttattaccataattaataataattatattcccttttgtgctctgggcctcactttcttatattcagatagctgtagacaacccttaagtgttctgcctctagtttctcccggaaagcccatgttgtacatgctgccagtgatcttcctaacctacatttgggttctgtgtctcctgcatgatttccttttcctgtttcctttaacttcctgtacctaccactccatctctttaaatccgattttagcctttcttttctttgtttttcattgaaatatatttttaaaagagtcagggtcttgctctgtcctctaggctggagtgcagtggcacaattatggctcactgtagccttgagctcctggactcaaatgatccttctacctcagcctcccaagtaggtaggactacaggtgtgcaccaccacactaggctaactatttttgtagagacagggtcttgctatgttgccaagtctggtattgaactcctggtctcaagcaacccctcacctcagcctcccaagttgccggggattacaggtgagagccactgcaccttggctacctttgttaattctctggacatacctcctaccgcttcggtctggctccaatcttctttgtcttataaacattttatgtttatttccagtcccctttctttgctcaggtagttctccttacctggaattaacctcttgtgcccctccctgcacccctagccctgtctgtatcaatcttagttgtcctctagaatgtgccagcttcattttatatgaaccttccctgactttcccattcctactgatcttcctcatctcaatactaactcccatagtacatagtctctatcgctcgatttagcacttaattagaaattgccttgctttgtgccctaatgattttgattgtattgttttgtctataactttgtgttcctgcactaatactggcattattaaagcacaactcatcagattacttctaccatgtgccaagccaagctgattacatataaagttttgtttaatccttaaccactctgtgaactaggtgttattaactccattttagagatgataaaactataaatgagtggcttacttttgcttgtttaattaatctaaactctgctctgtcattcaatgctcccaccatttggctttagctcatgctgctagttcatgttatactgtatttccttactctatgctatagccaccccagacatgctcttcatatcttatcactgtgcccctgttccagataaatccttatcctggcatttctctgcttcccactttgcctgtaaaaatcaagccaggtttggtggttcatgcctataatctcagctacttggttgagacaggaggatcgcttgaggccaggagttctagaccaggctgggcaacataacaagaccccatctctttaaaaaaaaaaaaaaaaaacccacacatttcagtgcaatgcctggaacaaaacaacaacaacaacaacaacaaaaaaaaacaaatagaaacaaaaggaaaaagaaatttcatttgtccaccaaggcctagatcagggtttcggaacctcagcattattgatattttgggccagatagttctttgttgtggggagctgtcttgtacattgtaggatgtttagtagcattcctagcctctacatactggatgccagtagcaaacctttccccttcccccttccagtttgacaaccaaaaatattgccagttactattgtcagttgtcaattttcaaactgccccttgttgagaactactggcctagattaaatgttgcttcatccaagaaatatatatatattttttggagacggagtcttgttctgtcgcccaggctggagtgcagtggtgtgatctcggctcactgcaacctctgcctcccaggttccgatgattcttctgcctcaggctctctttcatcatgttggccaagctggtcttgaactcctgaccttgtgatccatctgcctcgggctcccaaagcgctgggattataggcgtgagccaccacgcccagccaatccgagaaatcttgtttgttctcctacagtgggaagtaatcctttctcatgttcgagagtacttggcatgaaccttatgtttgtcatgttgctctgttctgtattgtaattgggtccatccttaactgtcctaccagattttgagttcctttaggggtcatgaactaggttttattcattgctgtttctcataacattgtgtttggttcaggacctttctcttaagggtgctgagttgacgttatttttgaattttgaattcgaaaacaaagatactatcttattgttttatgccctttaaatagtttctctagtgcaaaggaggagtacagagtgggctggtcaatggtactggggacagagtgctttggacttgtgagttccctgtcaggataaaagctgaagtcagtgttgggttgtttttctggagttgctatagtctgggctctagatatgttagtatatgacctatacgtctgacctcctctgtgaccttcttccctacccttctgccctatgttatgaatcatgtgcagaatctggatggaggtaagattactgtacttaaaatgataggaaagactttaagaataacacatactataggagcacaagtgaagaaaaaaaggaaaacactgagaatgcccaaaggctatgtagtagagcaaaagtatgtacttataaagcaagaaagatagtttcaggtatacttttgccaattattagttgtttgactttggaaagtttctctctctctctgtctctttcttttctttttgtttcttttttcttttcttttctttcttttttgttttgaaatagagtcttgctctgtcacccagcctggagtgcagtggcatgctcatagcttactgcagcctcaaactcctgggctcaagcaatcttccaactacagcctcctgagtagctgggactacatggtgcacgccactatgcccagttaatttttgtattttttgtagagacggggtttcgccatgttacccaggctggtctcaaaactcctgggctcaagcaatctctgcccacctcagcctcccaaaatcctcggatcgtaaacatgagccaacgcacccagcctggaaaattttcttaaactctgtgaactttcatttccttaccgtcaaattagtcagtaattcctaccttgaaagattatggcaaagatgaaatgaaatcatgtatatcaagtacccagcctatggtctagtttatagtagcagtatttctacttctttaactcgtactaccattgctatgatgtactaggcttgtgctgtgtactcttgcatatgctgtctcatataatccttacaagaaatctctgagacagacagtaatttttttctgtataacccataaggaaagagactgaattagctcattgttaaccatttttgaggttattgtaactcagatgtgcctcaggctgatgataatgttctaaaattagattgtggtgatagttgtatacttctgtgaatatactaaaaactatggggttttatactacaattagtatgtgaattaaatctcaataaatatgttttttaaaaaagtgtcaccgcattggttggagtggtggtcacctttcgcttgcctttctgtagcccagcccataacaatccttagggccctgtagaaaagcactttgaaagtcatgttgatttctatctccatttttaatttttattttttttgagacagggtcttgctctgtcacccaggctggagtgcagtggcgtgatctctgctcactgcagcctccatctcctagggtcaagtgattctcatgcctcagcctcctgagtagctggggctacaggcatgcaccaccacgcctggctaatgtttttgtgtttttagtagagaaggggtttctctgtgttggccaggctggtctccaactcctggtttccagtaatcggcctgccttggcctcccaaagtgttgggattacaagtgtaagccaccatgccctgcctctatctccatttcccctacctccaactttgatagagatgcagtggtgctttgaagtctgaagtaccatggttgctggaagcagatccgtggttagctaactgacagcgaggttgcctcagttcctggggaggtatagatgacttttgagaatgtcagactgaagagtcctggagcattctcttttggagaatttctccctctttccctctttttattccttccttttccttttttgtagttagtactgcttctggggaagttaagatgtcaaagaatctgtgggacaaccctggtggcaattccctcttacccatataccaggggcctgaatcaatttcttgacccctactatgtgacattacatgtgaggagttgtcaaagacagccagccaagtggctctagttttatttttccttgattaaccttgtgctcagggcctctctctgattcccatggctgctatatcactcccagaggccataccggcacctgagaagcagagctctccttttggtccctggacccaattctgaacataacttttctttgcattccctgcacacagctttgacagcctggagctactgctgctgctgctttttctctttctgctcctcctcctcctctttctcctttcttttttttttttagatggagtttcctcttgttgctcaggctggagtacagtggcacagtctcggctcactgcaacctccgcctcctggattcaagcgattctcctgcctcagcctcgcgagtagctgggattacaggcatatgccagcatgcccggctaatttttgtattttgagtagagacggggtttcatatgttggtcaggctgatctcgaactcctgacctcaagtgatccgcccgccttggcctcctaaagtactgggactacaggtgtgagcaaccgtgtccagcctctttctcctttcttaaaaaaatttactatatgcaaatttacttcagcattggtttctggtatatatattttttgctacagtaattcttctttgacttcagtttggaggcactgctctgccttttttctttctagttctctgcctgtatcctggtgcagtcatcatcttgtctcctacttcatggaacattctgaccccctgctcttaattcaggcaaagcatggattgaagtctgctcaggccctttggacagaacagagatagctgacaccatgaatgacataatttttcaagtgaaacctgctccttaggctaaagaaatgtcctgttcccattcttccttgtaagtacttatagggtggctgtagaattcacctaccaggagtggctcatcagtttataggccgcaacttccattgagttcaagttatttggcccagctcatacattcagtcctaacttttgtgagtttattagaatagctttagaataaactatttggactttgactttttaaaagtctaagcatgagctttggagtccaacctgggttcaaatccaaaccttgcaatgtactaaatatatggccaagtgatttggagactcactttcctcatctataaagtaatgatgacaataagatactctttgccatgaacaagccctaggctagtgagagacacaattatgtaaacaggcagtgacaatagcacattttaagggctgtaatggtagtatgcataggtcctgtgggagtttccagaggaatcaggatgcagtgatcttatatgtactggtgtagcagaagccatattgtcagccagcacgcaggcaagggtaccagttcccagacaagctgagctacgtatcagtgagagtaggcatagtttgcaatctgtcccagtaccttagccagatacaagatgaggcagcagctcccccagatggtacccctcatgtttccaggaaaacccgacggtggcttgctttgacagatagggaaattctttctcactaagcaggctgttgttttccttcccccctctttgttattgagtctgctttgtcttttctggatggtaatcctgtcgatgacagggatgagatatatttgtaagacttgtttgtatagatgtctatatatgtgtatatgtctatatgtgcctttgtgtttgtgttttttttgtatgtgtgtatacatcattttgtgcttgtgtgggtatgtgtctttctgcatttagatgtgtctgtgtaagacaagaagtggagggagaagaggaacactgagccaaggaagtaggggctgaaagaaagcccataaatgaggttgaggatcaaggagcaggttagggacaaagggtttggcctgaggtataggacacaggacctggaagtaaaagcagagccagaaatgtaatcagcagcccaaagatgctgtcagtctaggcagaatctgggccccacagagtggtaggcagaatgcaggtatcacctagcagccaggaatggtcaagctagcagagagagaaaagccatgcttcagaaattaaaaacttctgactcttcctgtctaaggaggaattggcagctggctcccaaggccctgcttcccttcagacctaactggtgtttgtgtttgtttgactatatatgtattttttcaagtccttctgtgcatgtctgtgtctgcatatgcctcacattcagtgtacttgtacttcatagcattaagaagaattgtctgattcacttaagttcagtgagtttcctttcatttcctttcattcattcttgtgttcttctcctcacttataaatacctcctttgaaatctttcttactttttgatgtgctccttgccttctttctctcttttttcttcaaacatatttagtgtgtgctatgtgctggatgctggatatgctttgcatattcatttaaagactaataagatgaatttactacctagaaaggtctcacatattactgaggcaaaaaaaaatacatattcaatccccatagatattgtaacaagagatgagccctgcatgctctggaagtacagaaaagagttaatccatctgaggatgataggaaacactatccagaaaaggtattgcctgagatgaatttttggagatgaataggggtttacatggggagggggctgagcatgatacatcatgtggagtaacaagtatgatgtccttgggaatctgtggtcagtggttcttttaacttgagcaaatgtaatagtggggcagggagggagaggttgggaataagattagaaaggcaggctgtagccagatttgtgtgccatactgaggaacttggatttcatcctaaagttgaaaagctagaagtaaacagagctggccctaattctgactgaaggtatgtcaggagcaggttttgcagaggaggtgaagttggaacttggtttttaaagatgagcaggagtttactagatgaagaaaggaagaagagcattccaggaaaggggaacttaacgagtaaaggcaggaggcaaaaaatatggcaactctgggagacatcaagtagggaagtatctagagaatagttatttcatctatgagatagggacaccagtaacatataccttcaatggctgatgtgaggcttgaaaaatatcctttgtaaaccatagagctgtgtgcaaatttctatagttgttgtgttatccagtttcttctaattttttgtcagtacccaacatgcatcaggccttctcaggtatagatccacataggcatacacctcagcagtttggcactggcttgatgagaggcatgccctcttttatctagccacttggtgtcttgaggaggcagaggtaagattagaagtctctgggaagtcactggtaagattagaagttgctgggtcccttgacaagggggctcatattctttattcttgtttatcctcagacactaggtttctcctcagataaaccagtataaatagtatgagcccccttgtcaaggggacctaggttcagaatagtcaaacacatatgaagcatcttctacatacaggcactgtaagggactgtgccttaaattatctccttttctccacattgtaactgtgaggtagtttgcattttacaggctctaggtgacacagtggtaagtggcagaaatgtgattcaagacattatctgtgaaattctttttcctctgtgacacttcataagctttgtgatttctctggatgttgaccaagctgcgtgatcagttaagagtggaaaactttgtgcagtctcaggcagtatggggatggaggagttggagagaaagttgcttggctctgtctttgggattgagtggtaacactttcctctgcatagaacagtggttctttccttcgaggaccaactctcttctatatatctgtctcacctagatgctttcaatatgtctgattaatctgtgtgtccttggatctcagcacaagacctgtcacatagtaactactcagtaaatattggttaggcaaatgaaagaacaaatggtgcttaacaaagccttctggaactcccaatgcctgcactattcttctgccttctcttgtgtagtacaatactcttaataggatattttgtccttaaggacacacacacacacacacacacacacacacacacacacagtgtgtatatatattttgtattgctcattgatgcataagcctaaatcccccctcttagagttgattagatgccaggagcttcttgggagaggcatgagtttgttttactctcttatattctttgtccctaagcctcttcccataccactgcccaaaggtgagtgtcatttataaggaacacgtgatgagctctaattctttttgccaagtctattgaagtgggtgttctattttggaaatggagtcctagaggttttcctgctgttgagtgtttggctgggtttgtgatcctctcagggtgtttgaaagccatgtatagggatggtagcatgagggaaaactgagcagtgaatcgaagttgccgtttgttcatggggattgtcagggagagagatttcctcagcacctgaagccagagcagagggtggatttattatatctagtccagggatcagcaaactgtttttttcgtgtagcctgcaaactaaaaatgatttttacatttttttctttcataattgagattttattggttgaggatcagtacaaacatttcaatttgtacacaattcttaacatacgtaccgaaaatctaaaaagccatgtattgtaattctttttttttaaagttattccagtgactttccagcttaaaatttggaagcaaattgtccttaagaggctatcaagtaccggtatgttcacatgttgataagctgttacatatgtcccaccaattcacaactgaatagcatgtatactacatattcaaatttttaatctttcacagcacagtaaccaagtgattaggaaaacaggactaccacaaccaaagatgttacagagtacacacaattctgacagggagagccatgatcaaggactggttttctttaggaaacaattctactaaaaaataacatgggaatagaagtaatttaaaatgttcaagacattaaatgcagggctgctgactccatattgtcatttaatatgcattgtattataggatataaaaactaacccccatctatggagtgttaagctgacagcaaagacagtcaaaacctcccataattcaataacccacactgttttctggttgtaccaaaaaataaacaaccagcgaatgatttcacctcttaaataaagcatttacacttaaaagatgggatgaggtgggattccctccttcttaaaaatgtttctagagctactaaaaaacttgcatttacaaaatagttgataaaaatattcctctggattgtacaagaagggagacagggaccactgataatgtatgatgtgtggtattattcagacttggcttccttctctcctgcctcatcagaggctggactctcctcagttttcttttccctgtttactgcaggtaaatgttctttagtttcttggttagccacttcggcctgttttccctttgctccccttttcccttttgtttgcacttgtttgtctgaagatttatcctttgctgctgcctttttcggcttcgcttccacttttgcaggagcaggtttagcagacaaccgcgccgatctcctcttgggctcttccttggcggccccttccgcggagctgaccttgctcttaggcatcctggcggcgtggagggtgcgtgcgggatgtctgtgagccgcggcgcaccgagagccttcgcgaagctgggctgcctggtcgctgccgctcctcccgccgcccgagctgctgagatccccagaaggggcggtgggagaaccctgatttttacattttaaaatagtttagggggaaagctaaagaagaatttcaagatgtgaaatttatatgaaattgaaatttcagtgtctgtaaagttttattggcatacagccactctcgttcatttacatattgtctattgctgcttttacacaagaacagcagagttgtgtagttgcgacagagaccatatggaccaccaggcctaaaatatttactgtctgactctttacagaaaaagtttatctggcctctagtctaacctatcaattttaaaaaaacagctttttggagaaagaattcacatactgtgcaattcacccatttatatacaattcaatgggttttagtatattcacagatatgtgcaaccatcacctcagtcaattaaaaacatttttgtcacctcaaaaagaaaccacatacgcattagctattgttctctctccacatttcccccagccctaagcaaccacgaatctactttctctttctgtagttttgcctattacggacatttcatgtaaattcaatcatataatatgtggtctgttgtaactagcttttttcacttagcatgttttcaaggtgcattcatgttgtatcagtactgcctgtacatgttcatgtatatatatctgtactttatttcttttcatgggcaaataatattctattgcatggacataccagttttgtttagcattcatcaatttatagacatctggtttgtttcactttttggctataatgaaaactgctgctatagacatgtataagtttttgtgtggacgtgtgttttatgttttgtttggatgtatacttttatttctcttgggtacatacatatgaatagaattgctgggtcatatggtaactgtgtttacctgttttaggaactgccagagtattttccatataaaaatggttcaagtggctaaaccatttttacattcctgccagcagtgtatgagggatctgttctctccacatgctcatcaacacttgttattgtctgactttttgattacagtcatcctagttggtataaagcaatatctcattatgattttgatttacatttctctgatgactaatggtattgaacatcttttcatgtgcttaatggttatttgtatatcttctttagagaaatattttctcagatcctttgctcatttattttattttttattatttaaaaaaatttccatcttcattttatattcacggggtacatgtgcaggtttgttacaagagtatattgcgtgatgctgaggtttgggattctattgattttcttatgcagatagtgaccgtagcatccaatgggaattttttcagtccttctccctatccccactccttttggagatcccagtatctattgttcacatctttgtgtttgtgtgtacccaagatttagctcccacttacaagtgagaacatgcaatatctggttttctgtgtctgcattaattcacttaggataatggcatccagctgcattcatgttgctgcaaaatattttcatggtcaatatgtaccacattttctttcctttcttttttttttttttttttggagtcagggtctttctctgtcacccagactggagtgcagtggcatgattccagctcactgcagcctcaatctcctgggctcaagcattcctcccacctcagcttctgagtagctggaactacaggcatgcaccactgcctggctaatttctttgtattgttttgtagatacggggttttgccatgttgcccgggctggtcttgaactcctgggctcaagctctcctcccgccttggcctcccaaagtgctggtattacaggcgtgaatcaccgagcctggcctgtatcacattaattaatggcatctaggttgatttcatgcctttgctattgtgaatagtgctgcagtgaacatatgagtgcacatgtctttttagtagaataatttattttcctttgggtatgtatacagtaatggaattgctggatcgaatggtagttctatttttagtactcttagaaatctccaaactgctgtggccgggcgcggtggctcacgcctgtaataccagcactttgggaggctgaggcgggtggatcacctgaggtcggggttcaagaccagcctgaccaacatggagaaaccccatctctactaaaaatacaaaaaaattagccggtcatggtggcgcatgcctgtaatcccagctacttggaaggctgaggcaggagaatcgtgtgaacctgggaggcggaggttgcggtgagccgagatcgtgccattgcactccagcctgggcaacaagagtgaaactccatctcaaaaaaaaaaaaaaaaaaaaaagaaaaaaaaaaaaattctccaaactgctttccacagtggctggactaatttgcattcccatcaactgtgtataagtgttttcttttctctgcagccttgccaacatctgttttttggttttttttttttttttttttttagtttttaataataactttgcgtcctggtatggtggctcatgcctgtaatcccagcgctttgggtggcgggtggattgcctgaagccaggagttcgagaccagccagggcaatgtggcagaacttggtctctacaaaaaaaaaaatacaaaaattagctaggcatggtgatgtgtgcctataattccagctactcagaaggctgagacatgagaatggcttgaacccagtaggcagaggttgtagtgagccgagattgggccactgcactttagcctgggtgacagagtgagactctgtctcaaaaaaaaatttaaataaaataaaaaacctttacttatttttaaattgggttgtctttttggtattgagttgttaaagttctttatatattttaggtacaaatcccttatgagatacgtgatttgaaaatattttctcccattctgtgggttgctttttcactttcttggttgtatcctttgaagcacagaagttttaaattttgatgaagtccagtttatttatttttttgctgttgtttctgctcatacttttgaggtcatgtctgagaaaccattgtcaaatccaaggtcgtgatgacttacccctgtgttttcttctaagagttttaaaggcatctgaagcttaatgtgcactagatggattctaaatatcatctcatccaaaacctgctatatatactaccttcctcatctcagttgaaggcaagtccattgtttcaattgcctgggcaaaaaatattctaaataattcataatttttcctcaactccacatctattggtaaatcctgtgggttctccttttaaaacatatccaaaatagaatcatttctcactatcattccactgcaggcaccaagtctcaatagtctcctagcagataatcatgtctacatttattctcaatgtagcagctagagagcttttttgaaaaaaaaaaaaaaatgtaaaccagatcatttcactctcctcaaaacttcatttttttgtttggtgtgaaagccacagtctccacaaaagttagcaaggccctctgtgatctggtccccacttattctgatctcctctctgacttatattccccttgtcactcactgtagccacactctttggtgttccttcatactcttttatattcctgctttagggccttggttctagcttttgccgctgcctggactattgtttccttaggtatttagtttatgccctcatatttccatataaaatatactttgtggctgggcgtgatggctcaagcctgtaatcccagaactttgggaggccaaggtgggcagatcacttgaggtcaggagtttgagaccagcctggccaacatagtaaaaccctgtctctactaaaaatacaaaattagccgggcgtggtggcatatgcctgtaatctcagctactcgagaggctcaggcaggagaaatgcttgaacccaggaggtggaggttgtggtgagcagagattgtgccactgcactccagcctgggcgacagagggagactctgtctcaaaaaagcgaaaaaacgaaacaaaaaccccaaaaatattctttgtcatttgtcatacttcatgttatcaaagagacctttcccagaccaccctatttaataatgaaatctgcacctctactccattcctggcacccagatcttcattatgaatcactttttaaaataatttttaagaacttatcatcatctggattttattatttaatcacttattgttttattatttattgcctagaatataaagttcataagggaaagggatctgttttgttcactgctatgtctccagtacctagaacagtacctggctcactgttggtacttttttgtatggattcaaagtactatctgggggggtcacttaaagagcttcctttagtatttttttgtaaggtgtgtcagttagcaatgaattttctcagtgtttgtttatctggaaatgtctttattttcacaagagttttgccggatgtacaattcttggttgacatcctctcacttcagtgagccctttgatcatgttatcccattgtcttctggcatccattatttttggtgagaagttaactgttaatcttactgggttcacatgtgtgtgatgagtcatttttctcttgctgctttcaaactttctcattgcctttgacttttagcgttttacttaatgtgtctatttgtggatctctttgcatttatcctatttggagtttattagattttctttatgggtagattaatgtttttcaaaacttgggaggtttttcagccattatttctttgaatatttttccttctcctttttctttctttttttttttttttgagacatagtctcactctgtcacccaggctggagtacagtggcacaatctcagctcactccaatctgactcctgggttcaagcgattctcatgtctcagcctccccaagtagctgggatcgcaggcgtacaccaccacacccggctaatttttgtatttttagtagagatgtggtttcgccatgttgtccaggctggtctttaactcctggccccaagcaatccacccactttggcctctcacaggtgtgagtctttctgctcctttttctttatcttccccttctggtattcatatattggtgtgattaatggtgttctacatttctctgaggctctgttcatttttcttcattcctttttctctatgtttttaggattgtataatctctatcagtctctcttgaagtttgctaattcttcctgctgccagttcagatctactatttagcccctgtcctaattttccacttcagttattgtacttttcaactccagaacatccatttggttctttttttaaaacaataatttgtctctttattgacattctttatttgatgcatcattgacatcatgcattcctttacctctttaaaaatcatgatttttttttttttaatctttggacatatttataatggctaatttgtagtctttttctgttaaatctgacatctggtccctcttactgagagtttctgttgcctactttttttctggtatatgggtcacactttcgtgtttctttgttttttgtttgtttgtttgtttgaagctgaacatttttgataatatattgtagcaactttgggtacttgtctgattcctctggggcttattattatttgcttgtttatttatttaatgactggctagattgtttaagtggttgatccccctcctcccacagtgtgaatcctctgatgttgctcctcagaggactttggtatgcccacagtcatatttggatgataatggtttgggcagaactttgactgtctctttccctggccacacccagctttttaggttcactaattgccatctggttgctctgctcttttcagcaatgccctgaggcataaattgcttcccagactaatccaactatattagggttcctttgaagggatagttcctgaggtcagtgtttgagatttgttcttttttggtttgtttttggagatagagtcccactgtttcacccaggctagagtgcagtggcgtgatcatggcccactgcagcctcaacctcctggactccagtgatcctcctacctcagcctcctgagtaattgggaccacaggtgtgtgctactacacctggcttcttttttttttttttttttaagttctgggatatatgtgcaggatgtgcaggtggcctggctaatttttaaattttttgtgaagatggggtctccctatgttgcccaggctggtgaaatttgttcttaccctgagagactcctcccagctgtctctttccctagttatctccagcaaattctctagtctacagtttagcctatatctccaatgaatctgctaatcttttcctttcaccacaacttctactcttttgagagtaccctacccttagtcttgaaattctctacactctgtcacagatgaggtcatttcccctgggaagagattcagatctctttgttttatagcctgcttcctcggccaggcaaaatctttgagtcacggttctggagctagggtgggggacaatgacatgcttctgagtgacaccaccactttaggagctgaggacttggtggaggggtggcagtagcctcaggtctttttggttttcttctcccagagtgtaatcaccatcttatgagccagggcaatgccagttgtggctccagtattcttagtggcactgcatccaaggtaaagctctcgtcctatgagtggggtttaaacgggacaaaagaggcccaccttttagctgcactcacttagaacttagcctcagtaacaggtagctgggggaaggatcagaaatgctaatatcctgctcaggacattccaggcagctaaccctttaacagggagcttgagagagaaggtctgtgtttagctgcatcagtgtgcagtggagtttctgtgtcattgagttgggagaggcaaggtggagaacaggtcttggtttaaatattgtggactctcgctgttcttagattttcttgagcatatgtttcttcattggctgtgtgcctttaagaccatttccagaaactttaaatggttgcttttgaaaaataagtttcactagttttactggagagtgggtctgtggagcttctcatgctgtcaaactagaagtcccttctaacccatcaattttgtaactgttctttctcatagtgcattttctccagtgctatgcattcagcctatataaatgtggcagtatttaccccaattaagaagataatctctttcctctggggaaatattttctaattagtgatctatttctgtcctcctttcataaaacaaaggttccccagacagtattctttggctagcttggatactttggttctgacagtttgtaagactggagatgttagagtttctctgtctttgccattctggccaggtacctggcaagctgaaacttttaatgctgcctctaggatttgacctgtgtcatgtgcccagtgttttggtggggcatcaacaatgattccatgacaagcactgagcgttctcattgacctcagagggattctctgtatctatgtatgtgctaggtgctggaaaaaaaggagtaaaaggaaaggcaatgttgctgcctttgaagaagttcccctagtggtggagatagccataaaacagataaggacactataatttattaagtggatactgtgaggcacaatggcgtgcacctgtagtaccagctacttgggaggctgaggtgggagaattgcttgagcccagagttcaagaccagccttagcaatatatcgaaaccctgtctctaaaaaaaaaataaaattttaagagtgaacactgtgatagagttgcagaagaggacgccctaagtcagcctttcccatgttatagtcactgacacataatccggatctcaacagatgactaggagtgataaggagaatgttttaagtgagggaatagcatgtacaaagatattgtacaggtgaaaagcctggtactgtcagagagttttaagtaattcattatcattgggaattgggaattcattatcattgggaatgagaggaagtggcaactgatgcactgaggaaggccagcccatagaggagggagggtcttgcataaagttgtaaagttttgattttaaatggagttaaagctttaaaagctttcaaagaatcatagagtagaacaaaaaggaccttagaggttagtagactacaatgtcttgtcttaactatctccattcctaacctcttgacacatggactttatatagcaagcacttagaaaatatccgttttctacctcctctataggtcttccttacatatgagggatcagcatcactgtaatagtgggccctaggattgtacgttcttttagtatctttaatccttcttaaaacatattacacacacacacagacaggagagcttattttgtgccaggcactattctaaggtatttagttgaatttactcatttatgcttccctcaacatgagggttgttaggttttgtgctactatcttcattttacaaatgatgcaagttatacactgaaactaagtggtggaacgaggattcaaacccaggcagccaggtctagaatcaaactctaaagtatcatgttacattgaatccaagctagtgtaactctctggctcctggctaaatatctttcttttagataggctgacaatttggggacctttttctttcttctattcaatagacaattatgtcttgactagctattgtaagctaagctctctgctacatgttataggacaaactcgagagacactccttcagttatttaataaccacacactctgctctgtgccaggccctcggcttggagatggatttatggagctaaattaattattcatttatgtattccagaaaatttacaagatgctggtgaagaataaatgataaataaaatatagtctctatttttgagttgcttagggagagtaagagggggataatgtataccctgagaactaagggaacaaataggatagggcaatgaactcacctgggagagatctagaaaacttcacagaaggcagtgactttttatttaatagacaaagagtgggagaaagcattttaaatggagcaccttgtgcaaaatcttgggggtataaaagatcatggtttggtcaaggagcatgaaatggcttgatgtgtctagagcaggcaactttttctgtaaaggattagatagtaattattttagactttgatagccatagagtctctgttacaaatactcaactctgtctttgtagcatgaaagcagccacagaaaatatacatcaatgcatgagcctggctatgtttcagtaaaactttatgaaaactggctgggcatggtggcttatgcctgcaatcccatcactttgggaagccaaggcaggaggattgcttgagtctatgagtttgagactagcctggacaatatggtaagaccctgtctctacaaaaaatgaagaaaaaattagcccctgtgcctgtagtccaagctactcgggaggctgaggcaggaggactgcttaagcccaggaggctgcagtgagccatcttcacgccactgcatttcagcatgggcaatagagggagactcagtctcaaaaccaacaaacagcaaactggatttggcttatggccatagttttctgacccaatatctggtgtgtaaggtgtctggtagggagggagagtggccaggaaggtacttaggaagttaatgtgtcatattgtaaaagaccttgaatgccaggccaagaagctagggctttatcttgtaggtaatggggagccatgagatgttaagtaagggagttggaatagatatttactttaagatcattctagagtgattgtggtggggggaggagccaagatggccgaataggaagagctctggtctacagctcccagcgtgagcgacgcagtagacgggtgatttctgcatttccatttgaggtaccgggttcatctcactagggagtgccagacagtgggcacaggacagtgggtgcagcacaccgtgtgccagccaaagcagggcaaggcattgcctcactcgggaagtgcaagggatcagggagttagttccctttcctggtcaaggaaaggggtgacagacggcacctggaaaatcgggccactcccacccgaatactgcacttttccgacgggcttaggaaatggcgcaccaggagattatatcctgcacctggctcggagggtcctacgcccatggagtcttgctgattgctagcacagcagtctgagatcaaactgcaaggcggcagcgaggctgggggaggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatacacccaaaggactataaatcatgctgctataaagacacatgcacgcgtatgtttattgtggcagtattcacaatagcaaagacttggaaccaacccaaatgtccaacaatgatagactggattaagaaaatgtggcacatatacaccatggcatactatgcagccataaaagatgagttcatctcctttgtagggacatggatgaaattggaaatcatcattctcagtaaactatcgcaaggacaaaaaaccaaacaccgcatgttctcactcataggtgggaattgaacaatgagaacacatgacacaggaaggggaacatcacactctggggactgttgtggggtggggggaggggggagcgatagctttaggagatatacctaatgctaaatgacgagttaatgggtgcagcacaccagcatggcacatgtatacatatataactaaccggcacattgtgcacatgtaccctaaaacttaaagtataataataataataaaaaagattattctagtgtctaatatggtagatagactgacagaaaagagactagacgtacaaagataagtgagaaatgactgctgtatccctgccttgagcaacagcttctgatctcagtggaaacagatatttcactcatgaaacgtacatgtcctagaactctgtaaatgacatttagagctattgtacctgaaatatggtatgcttccttgctagatgttcaagaggtaaataagagttggtaaacttttcagatctggaacatgtgacttatgggtttgatatggcttggttctgtgtccccaccaaatctcgtgttgaattgtaatccccagtgctggaggtggggctgttaggagtgattggattatcggggtgatgttctcatgaattgtttaacaccatcccctctcagtattgaatagtgagtgagttctcatgagatctggtcatttagaagtgtggtagcacctccccctttgctctttcttcctcctgctctggctgtgtatggtgtgtctgtttccctttcaccttctgccttgattgtaagtttcccaaggcctccccagaagcagaagctgctatgcttcctgtacagcctgcggaatggtgagccaattaaacctcttttcttataaattacccagtctcaggtatttctttttttctttctttttaaaattttctttggcggagtctcatgctgttgcccaggctggagtgcagtggcacaatctcggctccctgcaacttctgtttcctgggttcaagcgattctccttcctcaccctcccaggtagctgggattacaggcacaagccatgatggcagctattttttatatttttagtagagacgggatttgaccatgttggccaggctggtcttgaattcctgacctcaagtgatctgcccacctctggttcccaaagtgctgggattacaggtgtgagccactgtgcccagccacaggtatttctttatagcaatgtaataatggactaatgtagggttctaaatattgtgggctggatgggggttggagagcagcagagaaagtgggaatggaggtgggacaatttggtttgggaaatatggaaggtaagtagtagggaacaaggttggaaaggggagggaagtgttattgattctaaggaagaacccaggaaagccatccagattgctgtacccaaaggtgtgctgctcttcttctggctttatgtcagtgaattctcttctctggtggatcaagctggctgggcctattttgtagaaattatagagagatgtctcccctcttctctgctcccactctcactacttcactactgcttgacacttgggatgggtttatgccatgtgccacctcctgggagatcatttttctgggcgcatggaactaaatatacttactgacagctggtagcttggctctttgtagaactattgagctgtatagttctagccaatgttgcattccccatggtaaggcaggactcttggggagcctccttaggtattcctgagagaagagctgcttgttctaagtctgaaatagtaaatccctttggtgggatccaaaagctgcctgtttagctttgttatcacctttcgttacttttaaactttgtcttaaatcagactttagctattagctggatgtgggacagtgttcaaagtaagatgtggtaatgcctacttcaagtatattgaacatcaaagttacagctcaatataatattcttgggtgctagtacccagcttgtggctgggtaactgggaacttccgttgagggtatatggtttggcaggggagatagacatctaataagactgataaaggtattcataggcactatgggagcacagaagaagtcacctttgatcaagaatctttttctgttactttcctgtccttatctcactctccttccaataataatctcaattaatatctgaattgtgctttcaaactcagtactttagtgtacaacaggaattacaaactgtgcccctgaagggtcagagggcattgtaagtgagtaatgtgggctgtataaatgcatgtgcataagtctgtgagtggtgagagctgtgggaaaatggagagcccacacctcttcagaaggagcagctctggcagactgttgccatgtagtcatgtactccaagagcagttctaagagataggggattgagacctccatagctcctttagcaccaactccccaacctttaagataccccaaattgtataacatatatatattcatactcatatataatatgaattatacatattttatatatagtcataggccacataaggacattcagtcaacagtgggccacatatgcaatgtggttccataagattataatatattttactatatcttttttatgtttggatatgtttaggtacacaaatacttactactgtgttacaactccctacaatattgagtacagtaacatgttgtacaagtttgtagcctaggagcaataggctatttcatataacctaggtgtgtagtaggctatacacatctagcatactctatgatgttgacacatgatgcatttcttagaatgtatccccatcatatgtcataagtgaatgacatataatgaaaccaattttaacagaggctaatttgttataaacaagggttaagttcctatggcatatttctggtcacaaaaacatcaccaaacttacaaataaagaccaaaacacttacaatatgaaacactgaaataaatgtgagctgtatatacatttaagaaagattaataaaaacaagtaagataattatttataattatttacctacttatttcagtttagggttgagagtgtccagagtttatgctagcagctcagggtgcaaggtgggcaccaactctggataggacgccatttcattgcatggcacactcacacacccacactcactcaggctaggaccatggagacatgccagttcacctaaaatgtacatctttgggatgtgggaggaaatcagagaatgcacagaaaacccatgcacacatggggagagcatggaaacttcacacagacagtagccccagccaggaattgatttttttttcattgacgttataaagaaatgacattgaaagaaatggtgttatttgaggagctgctgtatatatttattctttgatatggagaattgattttttccttaagtttaagtaaaaggttaataaaaacatcttcataaaaagttgcattttggctgggtgcggtggctcacgcctgtaatcccagcactttgggaggccgaggcgggcagatcacgaggtcaggagatcgagaccattctggctaacacagtgaaaccgcgtctctactaaaaattaaaaaaaaaaattagccgggtgtggtggcaggcccctgtagtcccagctacttggaaggctgaggcaggagaatggcgtgaactcaggaggcggagcttgcagtgagctgcgatcgcgccactgcactccagcctgtgcaacagggaaagagtgtctcaaaaaaaaaaaaaaagttgcattttaaaattaatttgtggccgggtgtggtggctcacgcctgtaatcccagcactttgggaggccgaggcaggcagatcacttgagatcaggagttcgagactagcctggccaacatgctgaaaccctgcctccactaaaaacacaaaaattagcatgatggtgggcgcctgtaatcccagctactcaggaggctgaggcaggagaattgcttgaacccggcgggcagaggttgcagtgagctgagatcatgccactgcactccagcttgggcagacagagtgagactccatctcaaaataataataataataataataataaataaagtaaaataaaattaatttgtaatgaataatcttcataaaaatagtgtgcttgctatgcaaatgcaacctcatgacaagtcccttagctctcactctccttttccaattaaattgttagtccttaagccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcattgtggttttgatttccatttccctgcagattagtgatattgagcatatttttcacatatcttttggacttttttttttcttttttctctgagacaaggtctcgctctgtcacccaggctggagtacagtggcatgatcacaactcactacaaccttgatctcccaggctcaagtgatcctctgacctcaggctctagcttcagcctatagctgggaccacaggcataaaccaccacacctggctaattttttttttttaattttttgcacaggcggagtctccctatgctgcccaggctggtctcaaaatcctgatctcaagtgatcctcccactttcgcttcccaaagtgccgtgattacaggcatgaaccactgtgctcagtcttgtttgtcttcttttgagaaatgtctagttagatctttcacccattttttaatctgattttttttctattgagttgttcgagttccttatatattctagatgttaaccgcttgtcagatgtataatttgcagatgttttctcccattctgtaggttgtctcttcacttttcattgtttccattttattttgatttaatcccatttatctatttttgtattttgttgcctatggtggtggtggtggtggtggttgttgttgttgttttttggcagtgcagtgacgtgatattagctcactgcagcctccacttcctgggttcaagtgattctcctgcttcagcctcccgagtaactgggattacaggcatgtgccaccatgcccagctaatttttgtatttttagtagagatggggtttcgccatgctggccaggctggtctccaactcccagcttcaggcgatccacctgccttggcctcccaaagtgctgggattacaggcatgagccaccgtgcccggcccccagtacagtttattgaagagattgtcctttcctcagtgtttgttcatgcatttgtccaaaatcaattggctatacatatgtggattttattcctgtgttctgtattcttttccatgtctgtttttatgccagcaccatgctgtatcagttactattgttttggagaatattttaaagtcagatggtgtgattgctctagctttgttctttttgctcaagatggctttggctattcaggtttctttttggttccatatgaattttaggatttttttttctatttctgtcaagaatgtcactgaaatttagatagggattacattgaatccgtagattgctttgggtagtatgaatattttaacaatattaattcttccaacccatgtacatagggtatctttccatttatttgtgtcttcttcaatttagttcatcagtattttacagttttcattgtagagatcttttacctccttggttaaatttattcttaggtattttattattttttgtagctattgtaaatgggattttttttaatttctttttcagatttgtttactagctctaacagttttttggtggtgtctgtaggtttttctagatttaatatcatgttattggctgggcatggtggctcacacttgtaattccagcactttgggaagcagaggtgggtggatcccttgagatcaggagtttgagaccagcctgggtaacgtggtaaaatcccgtctctaccaaaaatacaaaaaattagccaggtggggtggcgtgcacacctatagtcccagctacttgggaggcagagatggaaggatctcttgaggcccaggaggtggaggttgcagtcagctgagatcatgccactgcactgcagcctgggtgacagaataagaacctgtctcaaaaaaaaaaaaaaaaaaaagagagaagatcatgttgtctgcatgcaggggcagtttgacttccttctttccaattttgatgcctttcttctttccttccttcccttccttcccttcctttcctttctttcctcttgcctaattgctctggctaggactttcattactgtgttgaataatagcggtgaacgaaggcatccttgtctcgttccagattttagaagaaaagctttcaacttttccctgttcaatatattagatgtgggtttgtcatatatggcctttattgtgttgaggtatattccttctatacctaatttgattgcagagctgggggctggaatcaactgaagtctcagtcactcacatacctgactcctgaacttgaagactcaaacagctggggctactcacacatttctatctctacatagactttccacatgatatctccagcagggtggcttcagcgtagccaggcttcttacattttgactcagggcccctcagggcccaaaagagagagagctaggtgaaatttatattgctttttctaacctagacttgggtgtcgtgcaacatcactgttgccacattctatttgttagaagatgagtcactaatgtcagcctatattaaaggggagggaaatccacctttaacgggaggattatcaaacaatttgtggacatgttttaaaaccattacagtcggccgggtatggtggctcacacctgtaatcctagcactttcggagaccgagatgggtggattgcctgagctcaagagtttgagaccagcctgggcaatggtgaaaccctatctttactgaaatacaaagagttagctgggtcgggtggcacacacctgtaatcccagctactcaggaggctgagacaagagaattgcttgaacttcggaggtggaggttgcagtgagctgaaattgcgccactgcactccagcctgggtgacgagcgagactctgtctcaagacaaacaaacaaacaaacaaacaaacaaacaaccatcacagtaaattaacctgtctaaacctaatgtaatttggggcaaatggcattatcttcaagagtatcactgttctcatttataaaataagtgtgataattcattggttgtgaagatttgatgagaaaatattgtggaaattcttagaatattgcctaatttataagcaagtactcaaacattttaaattcttccttttttctttcctcttttagcttattgattttcagttaactgtcatgtattgtcttttcatagttaaaaaatatgaggaaaggatttctaatttatatatatttttcaagtgagacatgtaacaaagaggaagtgatagtttagttggcaactaagacatgtgcataaggaaggatacatgagtgatgtgatacacttgtatgttgggtagatggaatgtgttatggctagctagaggcaggtgacctgtgtggagatcttgacgggctgactcctaggtatctcttgtgacttgtgtacttttcccttgcagttcctgagggaagacctcaattaccatgacccaacagtgaaacacagcaccttccatggtgaggataagctcatcagcgtggaggacctgtggaaggcatggaagtcatcagaaggtaataggcagcctggtcatcaatcctagttgtgggaaggtttagagaagagagaagcagcaacttggccttagaagaacatgtatataaaatgcttagtaaagggcaaattattgaagttattctacatatagtcactaaaaaagactgaatatagtcactctgctgggcatgggggaaggttctccagagttggcgtttttcttcattaggatactttttgaattctatcctattcctacccctttcgtcacccacctaaccctggcataggaatcttccaggttctgctgctttatctccagagatagggagcttgctggtctcttgaggcagcccctttcttctctagcttcccacttagtcccagctctgctgagtcctagacaattcaaagattgggtgagggtacagacagactctctcctcttctataccatcttgattgaaagcttttctataccattttggttgaaagctcctgagtcttcttttttccaggttaagtagccctacttcttgaagaaaacattttctcagcctccttcttgtcttgatttcctgcctataagcacttttgttaatgtgtttcttagatcctatagttggctgcagacctccaagtgtgattttatcatcacggagttgagcaggactgtcaccttcttgtttctgaatcctgtgcatctgttagtgcagtctgattagattctggtgcctcactagtcataccactctactgacccatgttgagcttaatgaaaacttcagatttctgtaaaactgctaaaccatgattaccattttttttttctggagcatttccttcagagttcttagtgaaagagcatgtctaattgtgcgagacttgacagggaaggggaaaacagggctttagcttcctctccatttatatctgtggctagggcacagataacaataagactagaagaaatctctcttcccagggtctcttagggcaggttctgatgtaacaggggttaaatgtaagtaaccatcaggatccctggtttttatttgaggaaccttaggcctagatgtataaagttacttgtcattatcatgcatttagtagagccagaacttcagctgtaggccaatgcttttcaataccctcttggttgaaagcattagtctaaggtagagaagactagttttggtaggaatgaggcagtttctatttttatttacattttaatttaggcttatagaatttgagatctgaaagggataatctatattgtagatggggagcattaaatgtgaagcaggaagacctggattctaatcctgattatgggatggacaggctgatgcttcctgttaactctatgttttatcaatgtagaagaaaaattaggcagctgtaggagagagcttcctggatatctttggaagctgagttccttctgggggcttttctttaatagctctcgagcaactcaggctatgtactgatgaagattaagcagtgacatgagctttggaactataccagcggtgccaggaaaaaatcttccattagcatcatttagttttggctttcttatttttctctaataacatgaggacagggtggctggtttttaagagtgggtttcaaaagtaggaacttagaattaaagatggcagggagagcattctggccttttctgaaagctcgcatagaagtatctaggaaaggaaagtgagagggcagaaacagagggactaaatcataatgctagaaaacagctccaggcagttttctggcaaggactttatttttggacttagcaactatttggaacacttccagtgtattctaaattacaggaaaatgaaagacaatggagtgaggttttttgggggagagtcctcattaaccatgagtggagaaaagcatttcaatgcagtgatgtagttcacagctgagaaatgatatatatgtaccctattagaatttgctcactgtgtgttatacctggtgatttgacagactaaaagtgagaatttttatatgtcctcttcctcccaataatttgcttcattattcagaaaaaggcccctaatctctccggagtgatgatttccagagctacaaaaagcatttaatattctggcaccggctcaaactagctgttctgagtttagctagatgatgtagatgtcagcagtggtcacttgtgttcagaacattagctggctagtgtcagtaccatctgtgtgattagcattgttaacatttttctgactaatgttgggagccagtcttttctctgtgttatatagatcttagcagaaaagttttctaatctctatcttagccaactctgggctttaggaataaaaacagcagcagcaacgacaaaaactgaaaaactactttaacatttatatagtatttaatatgtgctaggcactgtttctaagtgttttacatatattaacttatttctcacagaaaccatatgaagtatagatattatgattatacagagttagcacagacttcacaagttaagttcacagcccccgataagattactctcacttcagacatcagccataatttcaagctgttcccaggtcacctgcacttctgaccagctgactacaattcatgcattaccatggccttctcaggtttgataattaactaggactactcagagaattcaagaaagccctatacttatgattacaattttattataaaagttacaaatcaggaccagccaaaagaagaaatttatagggcaagatattggagggtcctgaatatggcacttttgtgtcctctccttgtggaatcaggacacatctccatttccagcacatcagagtgtttgccagccaggaaactcaactgaactttggtgttcagtgtttttcttagggtttcattacataggcaagtttgattgaattcttaggcacatgattgaacttaatatccagctccctttttctccataaaggttggattggtatcaccaggctcagagccccaatgttctagtcacgtggttgatttttatagtgaccaccccccatcctgagtcatcttatcagcctgaactcatgtgtgatccaagggacccaccaggaataataaagacattcctatcactgggaatattccaaaagttcagtgggtacctcccagtaacccaggacaaagatctgccaaattctttattatacaacattgaataattaagtatggaagaactggtaaagcagggttgaagaaggaccaagaatgagggccactccaggaaatccagcagcagagactaggggattcgccttttcttttttttcttttttcttttttttgagacagagtctcactctgtcacctgggctggagtgcagtggcgcaatctcagctcactgccacctccgcctcccaggttcaagcgattctcctgcctcagcctcccgagtagctgggactacaggtgtgtgccagtgcgcccagctaatttttgtatttttagtagagacggggtttcaccgtgttggttggccaggatggtctcaatctcttgacctcattatctgcccacctcggcctcccaaagtgctgggattataggtgtgaaccaccgtgcctggggaattggccttttctaattagctactttcatatgacccagctttattcattttttatttctaagtgtctttgctcaagagtcagatatgacaagagaagaatcagattggcgtagtgtggattacagatttaaatagggtgttgatggtgggagtgtgtgtgtagggtttggagagagctgcaatttccagcccctacaggatcatatgaggttagaggagtggcagttctttaaaggaagggtggctgggtagttttgtagaatccttgagaaatagaattactgcttgcatatttgagccattggaaacaataacagtgtcatttttggagaagaatgatgggaggcactgacctaagggaattctcctctaaccatggctttcattttttctaagcaaagtgcatcgttactgtttctcttctcctttcctggacactagattttaaatgatgctatctgccaaacaaagtatatttcttcttttgagacagagtctcactctgtagcccaggctggagttcagtggcatgatcttttgctcactgcagcctctgcctcctggattcaaggcttcttttgcctcagcctcccgagtagctgggattacaagtgtgcaccatcacgtccagctaatttttgtatttttaacggagatggggttttacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgagccaccacacttggccagtatttcttaagtggtaatttctttcctcgtttttatgaatcaagaactttgtacctatcaatctttgattctatgaaatatgattgcagctgaaagcaaaagaacctggtagtctagtgtgcctgtggactttgccatagtagttgtttccaaaagtttttgtttccaaaagcctggtagaaaataaacattacagactgggcgtggtggctcacgcctgtaatcccagcactttgggaggctgaggcaggcagatcatgaggtcaggagttcaagaccagcctggccaacatggtgaaaccccatctctactaaaaatacaaaaaaattagccaggtgtggtggtgggcacctgtaatcccagctgctcgggagattgaggcaggagaattgcttgaaactggaaagcagaggttgcagtgagccgagatcacgccatggcactccagcctgggcaacaaagagcgaaactccgtctcaaaaaataaataaataaataaataaaataaagtaaacattacagtaagtaagttcacagatctccttttctgtctgtgctactctttggacgatagaatttctctgcaggaagcagtggagtagtacagcaggttcctgaataacgtcacttcattcaaccttgtttgattataatgctgttgaaaattaaaaaattgcttccttactgggaccattgtctctttgtggagtttgcacattttctccatgtctgcacgggctttctccaggtatatcagtttcctcccacatcccgaagatgtgcactttaggtgaattggtgtgtctaaatggtcccaatctgagtgagggagagggagagagaggagggacggaaggagggtgggcggggtgggggtgggagagagagacagagagagacagagtgtgcgtgtgtatgtggtgtgtgcgtatgtgtgccctgcaatggaatggcatctgattcagggttggttaccacctggcaccctgagctgccgaggataggctccagccactctcaaccttgaactgaagtaagcaggtaaataattatcttacttgctttaatcttccttaaatgtatgtacaggtcacgtttatttcattgtgtaatattaggagtgttttggtctttatttgtaagtttggtgatgtttttgtgaccagaaatatgccataataacttcacccttgtttatatcaattagcctctggtaaaattggttttgttatacatgcttttgcttaaagttgcagtttccaacaaaccattgatgacattaattgaggacttactgtactggagagctaggaagcctttagaaagaacatccaggccgggtgcggtggctcacgcctgtaatcctagcacttttgagaggctgaggcgggtggatcacttaaggtcaggagttcaagacctgcctggccaacatggtgaaaccctgtctctattaaaaatacaaaaattagccaggtgtggtggtgggcatctataatcccagctactcgggaggctgaggctggagaattgtttgaacccagggtatggaggttgcagtaagctgagatcgcaacttcactccagcctgggtgaaagagtgaaactccatctcaaaaaaaaaaaaaaagaaagaaagaaagaaagcacccagcagagctgctgacctctctgttgacacaacacagggaggccaggtggcatcagacttctgtctaaaccatttcaaaagtcagatccgtatgaaagagctggcagcccatttttgcttttacataaacctaatgagagatatgtttagtattttcttttagtcattaaaaaaattatttttctaagttaaccatcaagtcatttagttaaaaacctcagacattagttgtttgctgctgtattttttggaagaatcatacagttggctttttctttcccttacattctttcagataatttttgtatactgataataaaaacaactagcatccatgtagtgatttaacttttatcacagtcattttatatttattttaaatagacacttgaggataaaaagttttacttgtattcccatttaataaataagaaaactgagtatctctcacccgagggttctacctgtttaatatatcttatgtgcatctccgatgatactaccttagctcaacttcattacctttttaaaaagatatttattgagttgcaattgacatacaaaaaggtgtaaatctctaaagtttactatttttaagattttggtacatgtatacaattgtgaaaccatcactgcattaaagatggtgaatatattaatcacccctgaaagttttctcatagtcctttgtagtctctgctcccctagcaaccactggtctgctttctgccatagattagtttgcatttgctacagttttatgtaaatggagttatataatatgtacttttaaaaaataatctggccactttcactcagtgtaactattttgaggttcacttatgttttgcatgtgtaaatagttaacttgtttttattgcttagtagtagtccattgtagagacataccacaatttatttacctatttagctactgggagacattgagctgcttttagtttttggctattacaaataaagctgctatgaacattcacatgtaagtctgtatggacatatattttcttttctcttaggtaaatacctaggagtggaatgactagatgatatggtaggtatatgtttttaagaaactgtcaaactgttttctaaaatagttgtattttttatattcccaccagcagtatatgacattttcagttcttccatatctttacaaacacttggtatggttggtctacttaattttagccattctgatagtataatgatcgtggttttattttgtatttgcctaatgactaacaatgttgagcatccttttatgtacatgtttccattcatatctcttttttggtagagtatctgttaaatcttttgtctgctttttattgggttgtttttctaaattgagttttgagaattctttatatattctccatttaagtcttttatcaaatatatactttgctaagattttctccagatctgtggcttgtcctatcagtcttttaacagtgtcttttgaagagcagaaagttgtaattttgacgaagtccagtttatcaatttgttttttaacagatcatggttttggtattgtatctaataaatctttgcctaacccaggatcacacaaagatttctttctgtttctttctagaagttttgtagttttatgttttacatttaggtctataattcattttgtattaatttttatatgtggtgtgaaatatggaacttacttctttattgtgcttacacgtggtcccaattgttctagaaccgtttttagaaatgctgttcttttcttcattgcattgccacacctctcatcttttgtcaaaaatcagttgtttaagctgagtgcagtagcatacactgtagtcccagctattcaggtggctgaggtggggtgggtgggtgaaaactgcttgagcccaggagttggagtccagccagggcagcatagcaagaacctgtttctaaaaaacaagcaaacaaaaatgcctcaagttgtttgtataagtgtgagtttatttttggactctattatgatacgctgatctatctgtctgtctttatgccagtaccatgctattttgattaccatagaattataataattctttcaatcaggtagtgttagccctccaactttgttctttttcaagttattttggctgtttcaggtccttgaataaacctgtcaatttctacaaaaaagcctggtgggattttgaataggattgcattgaatctatagatgagtttgagagaactgacatcttcaaaatactgatgttctttcaacccataaacagagtacatctctccatttatttaagagatacactttctctgggtactattttttggtctttcacatttagaactttcacatcttttgtcagatttatcactaagtagttcatagttttttatgctgttgtatatggtattttttaaaatcatggtaaaatacatataacaaaatttactatgtaaatggtattttaaaataatttctgattgttgcttatatacagaaatgtaattgatttttatatattgattttatattctagacatgaagtccttgcccatgcctatgtcctgaatggtaatgcctagattttcttctagggtttttatggttttaggtctaacgtttaagtctttaatccatcttgaattgatttttgtataaggtgtaaggaagggatccagtttcggctttctacatatggctagccagttttcccagcaccatttattaaatagggaatcctttccccattgcttgtttttctcaggtttgtcaaagatcagatagttgtagatatgtggcgttatttctgagggctctgttctgttccattgatctatatctctgttttggtaccagtaccatgctattttggttactgtagccttgtagtatagtttgaagtcaggtagcgtgatgcctccggctttgttcttttggcttaggattgacttggcgatgcgggctcttttttggttccatatgaactttaaagtagtttaaactaaaaatgtatattctatgaagtgctaaactcatttagtagatttcatcacatttttttccatagacagtcatgtttatctgccaataaagacagttttacttcatttccaatctgatgctttttttttctttttcttgcctgattgccttggatagtatttctagtacagtgttgaagagaaatgaggtgagcagatatccatgtttcatttctaatctttttttttttttgagtcggagtctcgccctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacactgtctcggaaaaataaataaataaaataaaataccaaaattatatatatatataatgttggctgtgggttttttgtagtgcctctctactcctagtttgctgagagcctttatcaggcatagatactggattttatcaaatgagttttctgtgtctattgagatgattgcatggtttttctgtttgtttgttaatttgataaattacagtgactgagttttgagtgtaaagctaaccctgcattcttgggataaatccccttggtcataatgtattatcctttcactgtattgttggattagatttgctaaaattttgttttaaatttttatgtctttgttcatgaaggatactggtttgtagttttcttaaaatgtctttgtttttggtatcaggataatgtttgtctcataggatgaattatgaagtattcctcaagtttttttgaagagttcatgtagaattggtattattttttcttaaatatttgatagaattcagcagtgaagctaactgagcttagagttttctttgtgggaaggtttttaattatagtgtcaatttctttaataggtataaggctgttcaggttatctatttcttgagtgagcttaggtactttgtgtctttcaagaaatttgtctatttcacctgtgttgtcaaatttactggtatatgttaataaaattgccttattttaatgtctgtaaaatcagtaataatgtctcattactgatcttaataatttgtgtcttcttttctttactgattggtcttattagatctttgttaattttacagaaccagtgtttggttttattgatttttctctggtttctatttcattgatttccactttgatctgtattattttctttcatctgctactttggatatcatttgctcttttattttttagtttggtaaggtgaaaactaaggtcaccagtatgagacctttcttcttttctaatacagaatttagtgctgtaaatctcccttaactactgctttagaggcatgtcccaaattctggtgtattgtgtttttttttttttttcctcttttccaactgatttattagtagcgcagacgaataaaaatacctagagtgaagacacaattaatggcaaatgttctcctattactttttttcctgatataatcttcaataacttagtatcccttaataatatgttctaatttgagagattctttttgccctggaaatgcatacctttaaaatctgttttagaccttagatccatccattattggtttatcattatattggatgaaatgttgtgcttttttttttgacttagctcaaaatattttatatttcctttttgacatctttagttcacaagttatttagaagcaagttatttagtttccaaacatttggagattttttttagacttttttagttattgatctctaatttaattccattgtgatctgagatcatactttatgtgacttgaagcctttaaaaaattttaagatttttttctttcatgtcctaggacatggtctatcttgttaaatatcccatgtgcacttgtatgtgttctgttgggtggagagttctataaatgtcaatcaggtctgtttttgttgttttgcttttttttttttttttcaacttttaagttccagggtacatgtgcaggatgtgcaggtttgttatataggtaaatgtgtgccatggtggttttctgcacagataacccgtcacctaggtgtttagccctgcagccattagctgttcttcctgatgctttcgctcctcccactcccctgacaatgtatgttgttccccctgatgtgtctgtgtgttctcatcgttgagctctcacttgcaagtgagaacatgcactgtttggttttccattcttgcgtgaatttgctgaggataacagcttccaactctattcatgtccctgcaaaggacatgatctcgttccttttcatgggtgcatagtattccatggtatatatataccacattttctttatgcagtctttcattgatgggcatttgggttgattccatgtctttgctattgtgaatagtgctgcagtgaacatacatgtgcatttatctttataatagaatggtttatattcctttgggtgtatacccagtaatgagattgctgggtcaaatggtatttctgcttctagatctttgaggaatcaccacagtgtcttccacaatggtgaactaatttgcattcccaccaacagtgtaaaagtgttcctttttctctgcaaccttgccagcatctgttgtttcttgactttttagtaattgccattctgactggtatgagatggtatctcattgtggttttgatttgcatttctctaatgatcagtgacgttgagcttttttcatatgtttgttggtcgcatgaatatcttcttttgagaagtatctgttcatgtcttttgcccactttttaatggggttgtttattttttctttgtatatttgtttaagttccttgaggactctggatattagacctttgtcagatggatagattgcaaacattttctcccattctgtaccattcaggacataggcacaggcaaaagtttcatgatgaaaatgccaaaagcaaatgcaacacaagcaaaaactgacaaatgggatctaattaaagagcctctgtatagcaaaagtaactatcatcggagtgaacaggcaacctacagagtgggagaaaatcaggtcatgttggttgatggtattgttcaagtctacatatctttatcaattttccacctacttgttctatctttttcctttcttttctttctttctttcttttttttttttgagatggagtctcgctctgttgcccaggctagagtgcagtagcatgatctcggctcactgcaacctccgcctcctgggttcaggcaattctcctgcctcagcctcctgagtagctggaattacaggtgtgtcccaccatccctggctagtttttggatttttagtagagacagggtttcaccatgttgactggtctcgaactcctgacctcaagtgatctgccttcctcaacctcacaaagtactggaattacaggcgtgagccactgcatccagcctgcatacttgttctatcaattgttagagaggagtatttaagtttccagttataactgtggatttgcctatttttccttgtagtttttggttcacgtattttgaagctctgttactaggtgcataaagatttaggatgattatttcttagtgattaactgaccccttcaacattatgaaatgaactgctttatccttcgtggtaatctttgctctgaaatctactttgataaaaatatagctgtcttttgactgttgttagtttggaatgtctttttccatccctctacatttaatctatttgtatttttatatttaaagtacatttcctgtaggtgcatatagttgggtcctatatatatatatgtatattttgcaatgtgacaatatctgttaattgcattatttagaccatttacgtttggtgtgattattaatatgattaatcaaatatgattgatatgattattaatataagataatttaggttagtccattttcttgctatttgttttccgtttgtcccatctgttctttaattccttttcctaccttttctgctttcttttgggttaattcagtattttttataattcaattgtattttctttgttggcttattagatataactggtattttagtggttgctttaggagataaaagatatgtatctttaactcatcacagtcttttttttttttttgagacagagtcttgctttgtaacccaggctggagtgcagtggtgtgatcttggcttactgcaacctctgtctcttgggttcaagagattctcgtgccccagcctcctgagtagctggaataacaggtgcatgccactacgcccagctaatttttgtatttttaatagagatggggttttgccatgttggtcaggctggtctcgaactcctgacttcaggtgatccgcctacctcggcttcccaaagtactggtgttacagatctgagccactgcactgggcctactttcaagatatattataacatgtcacatgtagtataagaagcttccagtagcacatataccctaaaacttaaagtataataataaaaaaaaaaagaagcttccagtagtgtattttcatttccctctctcaagcttagattttaatccttgcactgtggcttggaaattcaaggccataagctggggcaattgtataacttccctcatttgtttcctatctctcaagagtcattgtcctttgtaggctgatgtccagtgtcctgaaaaccattatttcatatatgttgtcttttttgggaggggtaattttaattcaggagggagggtaaattccatctctggtacttcagcttaccctgaaacagaagtgtcagctgaatcttcttttgcttgggccgttgttcttcatataccattattcttggcccagcctagctctactgctatgtatctttcacttggttccagatctgacgaggtctttgcttacatttttcagagttttcccatttttctctcatacatgaaacaaacaagttagggcatcaaatttctgggtgtaagaaatattctcaaatggaagttggagaaataaagatactgttaaaaatgttacaagtaaatacctgtatagcaataaatagtaatcatgttattttgaaagaataaatactggctttcctattggtcggataacccttcagcttgtgtaggagtagcgataagcttagatcacaactgctgtctcatttgagactcaacagaataagatatccaaagcttagtaatttttgatgaaaaaaaattatagaaaatgttggctctgtgtggtgactcatgcctgcaattccagccctgtgagaggatcacttgagccccagaggttgaggctacagtgagctatggtcatgccactgtacttcagcctgggtgacagaatgaaaccctatctctgaaaaaaagaaagaagctgggcgtggtggctcatgtctgtaatcccatcactttgggaggctgaggcaggtggatcacagggtcaggagttcaagatcagcttggccaacatggtgcaaccccgtctctactaaaaatacaaaaattagctgggcatggtggcgggcacctgtaatcacggctactcgggaggctgaggcagataattgcttgaacccaggaggcagaggttgcagtgagctgagatcatgccactgcactccagcctgggcaacagagtaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctctgttgcccaggactggagtacagtggcgtgatcttggctcactgcaacctctgcctcccaggttcaagtgattctcctgcctcagcctcccaagtagctgggtttgcaggtgcccacgatgacgcccagctaattttttgtatttttagtagagatggggtttcatcatgttggccaggctggtcttgaactcctgacctcatgtgatctgcctgcctcggccttccaaagtgctgggattacaggtgtaagccaccgtgctcagccctgatggtattttatatcttgagagtttatttatattttaatgctgtagttctgtgttattccttatctacctctgtggtattggccctagaaggtagtgtttttctcctataatttatgtaaacatttctgtgttaaaaatttactgagtaccttctatatactaggcattgtgctagatgagtttagcatacaaggtccatgcttatttctctgatctacttgttttccatcattccacaccacatctcctctggaagtgcactgctttattggcagttcctaggaaatgttgttctttttcatcccatggtgctttcatatatgctgtttcctctattcatctttctcatttgttgatctgtttaaaactcaattaatcatttctttaagtcttcttccctgaaaaccacaggctaagttaggtgtcttcttctgtgttcccacagcccctatctcttcacagcccttagcacactaaatgcaaagatctgttccactgccggttttcccatcagactactggagtgcagcattttatatgattttatctcttaatacttagcacagggcctggcccagagtaggaatgcagcacacaaaaatgtgtccttgactgtttgattgtgtgatcttagataagttgtttggcctacccaacatttcatagcacctaggttctcttactactctgcagccatgctgccagacttctctaatctgtctctactaaccttgtggtttctctattggtggtctttaatagcatgtcctgttgggccctgggagacctggtttttgcctggtagcctagtgagcctatcacatgaggcctaggccagattatttttgcaatgatggttcagggtttgataatgacatcagattagaaaatgaagacctttacctcactgtagtcccagatgagaagctgctagtgggaaccagaaggaagctacttaaagagacaattcacagttccaggtcacacactatctttaggaagggccactttggaaggatttgatagctgccttggagtgctgttattcagagcagaccaataagaagctgggttttgtgatgccttttctgattctgtcagtcactcctttctctgtgctcccacatcaccttatatatccctgtgacctagcatttatcacactatattatattcatttgtttccttgtatattcccctctctagaagagagcccttgaggctggagttcatgcatattcacctctgtgctggttaactcaccctttacctgctagagtagaagccaataaaagcttagtgaatgaatgaataaatgaatggcgataataattatagatgattttttttacacttatagtatgctaggagcttccctttactacatttttatgatgtgaaaactctgattttcatcattttggtggtgaaaaaaatgaggcacaaaatattaagtaatttgcccatggtcttacatctagtaagtggcagattgcaaattcaaatcaagacacctggtttcaaagttcacattcttctttttttttttgagatgggatctttgctatcactcagggtggagtggtgcaatcttggctcactctagcctcaactccaggtgatcctcccacctcagcctcccaagtagctgggactacaggtgcgcgccatcacacacagctaattttattttttgtagagacgaggtctcactttgttgcccaggctggtcttgaactcctggcctcaagtgatcctcctgccttggcatcccaaagtattaggattataggtgtgagccaccgtgcttggccaaagctcacattcttaaccactgtgctatatctgactagctgactaaaggctaagtgaccaactaactaacagctgtgtgaaggaggggcaaagaaagtactggcaaccttcctgccagacctcattctcttgagatgtggatttgaaaccacaaaagtagatgagggcttcgtctggaggcaccacaggtccattatgggaaagagatactgattcgggaatccatttactattattccttccctgccaagagaaaagattggccaaggccaagtgtttgccctggcacatccctggatgtattgctatagctcaagtgctagggagtatactgttccttctgcctggtatgcccttcccccaaatgtccacatgcctcataccttttatttcattttctgctcaaatatcacttcatcagagaggccttccctaatctgacctaatacaatataggactattttttatccccttaaccccttatggcttaattgttctttattatacttatcaccatctgacatataattatttgtttatagtgttttattttgtctccctccaccaaaatataagcaccatgggatctgtgactgttttgtgtattgttgtatctttactcctagagtggtgcctggcaagtagtagctgctcaataaatgttttttccccctaatgaatatattattttggagtttgagaccacttgttttcaaggacctttgtcatttggtgtcagcaatacctcattctccttgaccctatatataactcttggactccagacaaactagagtcagtgttctctgagcatgcttcacatcttatagctctttgtctttgttcacgattctttcttctggcagatctgcatctctgtccatccagattctgaccagtccttaatatctacccctttttgaatgaaggtacatatgaagaaaaagttactactgagtttgtattaaatcctaggcatctcaaacacattaactcatttaattcaacaactctgggagacagatattgctaaattgtaagctacatgggagtagggatctctctcttgatcaccgctctattcctagtgcctggtctcagaatagaacgaaataaatgcttgttgaatagcaaaatgaatattttacagaaggggaaattgaggttcataatggttaagtgatttacgcaagctagttcatggcagataggataggcaaggtcttccagcttcaaattcagtgtttttttgtaatatatcctaaaataaaaaatcagtgttctaaaatgccaggggtttggcagtctttaataactttagtttttgtagctacctcagaataaaacaggaggttttattgatttttacatgaaaattgttcttaatcataaaaggtctgttcctttctataaaacatagtatggagaccagggtatatctttactacccaagatgctaactggacaccagtttctgggattctttgtggatatgtgtcattagtactttttaatttttttatacctcccccctttacctccgtaagtagtctgtgggggtaagtgatacttttttgtgagaaaacataatataaatactgatgggatggacaacaagtgatccaggacccacagattgccatcatttgttcattcgaagaagatactagaggtggtatttatgttgtacttatttttatctcattgtttaatttttatgtgtgttttacaatctatctaatgttagtaaatgaatctaatttataaacacatatacgtatattggcaatgtgtgtacaaagctttttttttacaggtagattatgtcattaaaaagattggagatggctgggcgtggtggctcatgcttgtaatcccagcactttgggaggccaaagtgggcggatcacgaggtcaggagattgagaccatcctggccaacatggtgaaaccctgtctctactaaaaatacaaaaattagctgggcgtggtggcacgtgcctgtaatcccagctactcgggaggctgaggcaggagaatcgcttgaacctgggaggcggaggttgcagtgagctgagattgtaccattgcactccagcctagcgacatagtagactccgcctcaaaaaaaaagaaaaaaaagataggagttaagtcaccctgtgtgtctctcttgtgaaggatggtttgttgtgtagaactccaggggttagccttctctgattcggtgtagcattgtttgtcattttgcccagaggtgtagtctttgatctggctaggggccacatggacaggctcaggggatgggagacttatgacattaggacattgactcttgcttgcatgtcctcctgggatttggacatatgagtcatttggagtctgtatctgtactaagctctccttgccaaattctgcagcctgtcactgatagccacagctctctgtacttgctgttgccttcttcctcactctggcccagggattcttcctatcttctctttggaatgagaaaacagaacaagacttttaacttttaggtgcttgaaccttggggacagggagccctgatatatcagctggtctgttgaatgagatcttcatgctggaactcagggttgctatctgagatacagatgttatagaggatacagctcatcctggcttgttttgttcagactatagtgactccaggtggacaccatgctgccaaaccctacctagatagggcatctgcctaggtaacagaatgatatatgcagataaaaacaacaacaacaaacaaaccaaaacaatcttgaggtttggtctgacatgctgaagctattctccttttcccctacagcttagctatgtaggagcgattattctagagtccatcttcagtggagtgtattggcccccttggcaaccccgtgcctcacttaatgcagtgtttagagcagtggttctcagctgggggcagtttttcccttccatgggatgttgaacaatatctggagacattttttaattgtcatgattggcagcatgttactggcatctatgttgttaaacatcctgcaatgcacaggacagcctccacaacgaaggattatctcatctaaaatgtcattggggcagaggctcagaaactctggtctagagtgacttctgcctgtcaccactgtggtgtagggtgctgatagaggagtttctgcatgccaagattctatgcccagacttgtatcaaggcatcctcccagtagacaaaaggcccttgatgtactgctggcctcaggccttctagcaataaaaaagtagccttctttccactacactccaagcagaaaggcccctttgtgctggatgaggtcgacttcccttggcagcagtggcaggagtgtgttgttctctgtactttacaggctagcacttgtctgtctgccttatatctgtgtgtcactctcttatgccttcattacctgacactccagaccatagtaaatgataacatctgcaatgcgttaggatatatattcattttcaggaataatacgttctagtccatttaacttccatcagcattttttttttttttgagtcagggtcttgctctgtcacccaggctggagtacagtgttgcaatctcagctcactgcaacctctgccttccaggcttacgtgatcctcccacctcagcctcctgagtagctaggactataggcatgtactaccacacctggctaattttttaatatttttttgtagagatgggttttgtcatatttcccaggttggccttgaatttctgggctcaggcgatccacctgtctcagcctccctatgtgctgggattatagtcatgagccaccaagtccatccctcaacacttctttttttttttttttttttttgagacgaagttttgctctgttgcccaggctggagtgcagtggtgagatctcagctcactgcagccctccgcctcccaggttcaagtgatccttccacctcagcctcccgagtagctgggattacaggcacgtgacaccatgcccagctaatttttgtatttttagtagagacagggtttcaccatgttggccagggtggtctcgaactctcctgacctcaaagtgatccacccacctcggcctcccaaagtgctgggattacaggcgtgagctacctttttttttttttttttttttttttgagacagcctcagtctgtcgcccaggctggagtgcagtggtgcgatctcagctcactgcaacctctgcctcctgggttccagtgattctcatgccttagcctcccaagtagctgggatcacaggcacgcaccacccctcaacactaatttaaccccagctctgtcatccttcttttctcaacggtatctcttggaaattaatttatctttttcttccaacatattctagtctgggaattagaaatataaccaagcactgactaagcacccttcacttaagcttctagtatcttgtctcctaggatgcattcctggacacactgtgtctgcctcatttccttcccctgccacctttcccttctcacctcccatgcctctgcaaatagtctaatcttcccccaaaggcactcagcttcagagctttccttctgaactccagcatcttcttgaggacattaagagattggagcattcttgccttcaactttattttattcaggatgtctccctgattatctgctttgcatcacatcctgggctgagaggaatgcctgattttgtttgttttgttttctttgtttttgagacagggtctcgttctgctgcccaggctggagtgcaatggtgcagttatggctcactgcaaccttgaactcctgggctcaagttatcctcccacttcatcctcctaagtagctgggactacaggcatgtgccattaggcctggctaatttttttatttttcttttgtagagttggagtctgctgtgttgcttaggttcgtctcaaactcctggcctcaagtgatcctcctgcctcagcctcccaaagtgctgggattataggcatgagccaccatgtctggccaaatgcctgttttttgacaagcatttcagaagttacttatccacgtgagctgtatgtttttctaaggaggttttgttgttgttgttttgaggcccacatcaaatcatttctggaacccctcatttagagtagttcttattgatgccactgtatatgaagctcttagttcagaaacagtggatgagcaaaaatgaacaggacacattccgtgccttcaatgttttctgcctattaaagggaaattagaccaggtctgatggctcatgcctataatcttatcactttgggaggctgaggctggaggactgccagaggccaggagttctagaccagcctgggcagcattgggagaccccatctctacaacaagtaaaagaatttgaccaggcacagtagctcacgtctgtaatcccagcactttgtgaggccaaggtgggaggatcacttgaggccaggagtctgagaccaacctggacaacatggtgaaaccccatctgtactgaaaatacagaaattaactgggtgtggcggcatgtgtctgtaatcccagctactccagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctagcatggtagtagtacatgcctgtagtcttagctactcaggaagctgaggcaggaggatctcttgagcccaggagttcaaggctgcagtgagctgtgaccatgccactgcactcaagcctcggtggcagagcaagacctgtctctcttttttttttttttttgagatggagtctcactctgtcacccaggctggagtgccatggcgtgatctcagctcactgcaacctccgcctcccaggttcgagtgattcttctgcctcagcctcccaagtagctggaactgaaggtgcgtgccaccacgccccgctaatttttttgtatttttagtagagacagggtttcagcatgttggccaggatgatctcgatcccctgacctcatgatctgcccacctcagcctcccaaagtgttgggattacaggtgttgagccaccgtgcctggccaagacctgtgtcttcaaagaaaaaagatatggatcttatgagaggacagtgatgaatctcaccgtatcattcaacttcaaaacttttttggcttcttgctgcttacagcagtggttttcaaacttgaagaatgtacaaattccttttaaggtaaataatacatcttggacctgcagtgctgacttaaattatttttattataatgttatttaagtatatacaaacatagaacaaagtttaagtcactgtgtaaaatttgtatataagtgtaaacaaaaacagatttatactttaagtaaaaataaacttcagatccaataaaatgatgcttttttgctgaaaatcagttgcttccaggctctttttaagttcagcatatctgtattgctgggtaccatgtgatgactcattcctcccaccatttttctttatttaagctaccatgaaactttgattcatgatctcatttgaccttcactgggctggaactattccttgtgtattgtgtattaagtctacttctattccttcataattgacttttaacaaagtatagagataaatttgctttctgtgtgtttaaacacaatacagatataaaaattattattattattattaattttttttttgagacagagtctcgctctgtcgcccaggctggagtgcagtggcacgatctcagctcgctgcaacctccacctcccgagttcaagcaattctcctaccttagcctcctgagtagctgagattataggtgcccgccaccacgcccagttaatttttgttcttttagtagagatggggtttcaccatgttggccaggctggtcttgaactcctgacctcaggtgatctgcccgcctcggcctcccaaagtgctgggattacaggcgtaagccactgcacctggcctataaattattttaaaagggtactttttatgactattcattaaaaacatcacattataatattgaggaatcactagctctagtgctccacgtatggtgatgatgcaatttgccatgttgcaaatgaccattcagttgtttcagttagagttggttcctgttatgacagaaaatcctttcaatctgatataagcaaaagggagaatgtacttcttgcacaaaactgaaatatctatgaataggactttctacaggcattatctgactcagggcttaaattatatcagctggattttttttttttttttttgagacaggctctcactctgttgcccaagctggagtgcaatggcatgatcgcggcttattgcaacctcgacctccgaggctcaagccatcctcccacctcagcctcctgagtagctgggaccacaggttcacatcaccacacctggctaatttttttttttattttttgtagatatgtggtctccctatgttgccctgactgatctcaaacccctgagttcaagtgatcctcctgcctcagtctcccaaagtgctgggattataggcgtgagtcactgtgcctggcctgtcatctggatcttgactcagcttttcctctgtatgaaggcttccagcagcatcagggaggttgtatacacaacccccctgcccaaacacacacacacacacacacacacacacacacacacacacacacacacatgcttagaacgtgaatgatggagccagactgcctgagaccaaatcttggctttcccagttcctagctgggtaactttgggaaagttatataagcttgctgtgctttagtttcttcatccttaaaatggggataaaatgggatatctacttcatatgaaaatgatgaagattagtgagttaatatatgtgaggtacttagaacaatactctcatagactaagcgctatgtaagagatggcttctattactattattattattgttgttgttattaacattatagttcaggttcattttatcccagacaccagtatagtggaaaagcaagcatatcccctatgggccaaacaaaaattttagaattcagtttcttcagccttgatttgggttatgtactcatccctgaactaagcactatgggcagaaagatggaatgtattgattggtttagcttgggttacatactctacttttaaaggctgatttagctttacctgaagcatattagctgagagcaagggaggagtggttctgttcatacaaattcagaatactgttgccaccaaaaagggaagtggatgcttggtggcaaaagtgaaccatgttcattatagtgctatcagatagatcgtaataggtgatcctgttatactacattagtctctctggggatgcaccaattgggacagttcttgtctgaattaaactaaaagacagtttatatcttttagtgggtaatatttgtctttttgaattgcaattatgaatgtatattttgtgtaaaaacatcagtttgacctctgggttcttttgtattaaaatatttaaatttgagatatattattgttatgaagtacattatgtcctaaaattccaggaaaatacagttgagccttaacaacacaggggttaggggtgctgactgtcccttttcccccatgtagtcagaaatccacttgcaacttttgactccctcaaaattgaactattaatagcttgttgaccagaagacttaccaataacataaacagcctattaacacatattttatatgttatatgtattatatactgtattcttacaataaagtaagagaagaggaaatgttattaagataatcataaggaagagaaaatatatttactgtttattaagtggaagtggatcatcataaaggttttcatcctcatcttcacattgagtgggctgaggaggaggaggaagaagagagattagtcttgctgtctcaggggtggcagaggcagaaaagatagagaaggtaggaagggaggtgggagaagcaggcacactcagtataccttttattgaaaaaaaaatccatgtataaaattcatgtataaatggacccaggaagttaaaacctgcattgtttaaaggtgaacggtgtcactgtaactattttgcatcaacacacttataaacacaaatgcaacatgagcactgaagttgagagcctgtattcttatatatctagatgatacagaataaacttttgctttttacttttagcttatttccaaaatataaatatagaatcaaaacactttaatggtaaattgtcttttttttttttttgagatggagtattgctctgtcactcaggctggagtgcagtgacgcaatctcggctcactgcaacctctgcttcccgagttcaagcgattttcctgcctcagcctcccgagtagctgggactacaggcatgcaccaccacgcctggctaatttctgtgtttttaatagagacgaggtttcaccatgttggccaggatggtcttgaactcttgaggtcagatgatccacctgccttcgcctcccaaagtgctgggattacagtcatgaaccactgcctggccgtaaattatctttttttatctgttttgcaacagtctcactccgtcactcaggctagagtgcagtggcgtgatcatggctctctgcaggctcaatctcccaggctcaagtgatcctcccacctcagcctcctgaggagctgggactctaggtgtgcaccaccacacctggctaattgtccctgtttgcagatgacatgattgtatgtttagaaaaccccatcgtctcagcccaaaatctccttaagctgataagcaacttcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttctactaatcctttatgttgcaatacatcatcttctctgaggctgtccctgaagccctaggcagttatttcctttcttctctgtgccgtatgtatttttctcatcagaatctgtgcttcactcatgctgtttagcttttgatctcttccactggattgggaactaacttcctccaggcttggcactaagtagtccccttatgaatgctcagttgaatagctggacgaatggatggatggataattgattctcaaccctggtcacaacagtttaaaaatattccaaaatcaaatttattgagttataatttacataaaagaagatacacctattttaaatgtacagtttgatgcattttgacagatgttatcatttgtgtaaccaccaccacattcaagatatagaatatatccatcaccttataatgttgcatttgtgattttttcccagtcagtccccagctcccttcctggctccagctaaccattgatctgctttctatcactatagatttgtcttttctaggatttcatataaatagactcacagtgtatactcctttcatacttagtattttatgggacagatagatattaaacacacaaatgtggtaaatattaaggtcagcatgacaacaaatgaaagcagtgcttggcattctagagtcatggctttgcttgtctcttttcacagtatacaattggaccgtggatgaggtggtacagtggctgatcacatatgtggagctgcctcagtatgaggagaccttccggaagctgcagctcagtggccatgccatgccaaggtcaggaggggactgggtttttctctgttgagggtacggggaatgggctggagtgggcctgccttcagattgctctggccagttaagtgaggttctgcctttttcagggcagcgtctatagatcttgcctcttctcacatctgttgtgcacttgctataaagtatgatgggcgctttgtatccactctcttctttaatattcctgtcagtcctgggaatagtactgatagctgccatttactgagtgcttagtacatgccaggcattctactcaacactgtatacagtatctcatttaattcttacatcagtcctgtaaggtgggtattattgtatatagatgatgaaactggttaagtaacttatccaaggtcacaaacatgactagttaggggcaaaactgagatttgaatcttggtgtacatcaaaccctgttggtgtttcttttttctttttttcctgtgccctgagcagctgcctcttttatcacccgggagcctcagggctcttttagcctcccctgggttatccatatacagcttatttataataaaaatggtacagaggagaggctgattgccattggccccagcctcatctctgggatggctccaacagctgttgtttcataactctttgcctactttacacgctgaatatgctagggcttgggctgggagtgggaaggggatggagtactgcttggacttcttgtcatgtcaaactagtgccatatgccattcagtcattaatccatttacttattcatccaacaaatatttactgggtacctgctctgtgccaagcacttgtgctgggtgctagggataaagatgacaacaagctgtccttgccctcaaagggcttactatctggtaagtgctgattatgtataatctgtcatcttattatgtaggtgcatctggttttgagcttcagcaaaggggaaaggggaaggtgaagctgttggaatgcccacactttgcagtctccagccacagagctactgagcactgctgtccaggcctagctgagctggctgttccctcctctgctgcctgcagcctcttcttcacagcttctctctgctctggagagagtaataatcttaatgtttgtacctccctttatagagtgctttcctacatattatttcagttgattctcacaactctgggaggaagagtatcccaacctttgggtgaacaaactgaatctcaaatattttataatttatccaagctggtaagtggcagagctgggatttgaacccaggtctgtcttgttctaaatgccctgctttttttcactgcatcttcctcttgtgccatgtggttaaagataggcttcctttcaatattcagtttagttctattttacaaaacttcactaagcacctaccatgtgccatactctctggtgggcccagaggacaaagagatgtattagacctgacccctgacttgaggaactccatgtttaatggaaaagtagatgactgaccactaagatccaggatttaggtttctttcttgctacccatagaaatagcaatattgccttgtggatccctggaccattttcctcatgggaaggatatctttggcttggattaaaactgcaaagcataggataagaagtcagttctcaggtcactggttcacttagcttttttgtggctagaattacagccaagaccaggtccagccaggctgggcacaggtgtaggggatgtcaagctgtggcaccttagtgacagcaggaagcatggggccttcagtgcttggggtgaagtgagggtggttctaggcccatcactagctcacatggtataatgagaataatctagcagatttgagttcattctctggctttgccacttacttgtgtgtgactttgggcaagttactcaactctaagtctccattttcttatctagaaagtcgcactaggccgggtgcagtggctcacacctgtaatcccagcactttgggaggccaaggtgggtggatcacgaggtcaggagatcgagactatcctggctaacatggtgaaaccccgtctctactaaaaatacaaaaaattagccaggcgtggtggcaggtgcctgtagtcccagctactcgggaggctgaggcaggagaatggcgtgaacccgggaggtggagcttgcagtgagctgagatcgcgccactgcactccagcctaagcgacagagcgagactccgtctcaaaaaaaaaaaaaaaaagaaagtgacactaataatggaactgagttcttaaggttgttgtgaggactgaatgaggtattgtatgtaaagtatcagaacagtagcagacacacagtagttgcttagtcagtgttagctcctttctcatttctttcattgcttacaagtagatagcattccagttcataggtttctttgagaaatagactgtagaaaagatgacaatgtttattctcattagtcagacgaactgcagcacaagtgtttcaaagaggaaccccaagaactcccaggcttgtaggaagcatctgattttacataagtttgcacagtaggaaactgaggtcctcggggaggaacaaagcaacttatgatcagacaaatgagtcactagtagagctgaaatgagaagccagatctcctaaccactcccacaccccatcacagtgcctcactgcgtctcttactggtgggcttgattgctttccaaggccagagaaggaagtagctgttcctgtatgctcagacaggagtataaatcacactgtgatgtcagaagcttcttttctagctggagaaataaagctatgcatcagaaaagagcaccaatcttatagagtagtatagaattaagtgcttacttgtgggacctagaccagtggttttcaacctttcatatcttttacccccctcctcttatatccactgtgttccagcagaagagaaacaaagttccatttttcctaggtcattttcttgttcacaggctttctcttattaaagttatcactgacagtatgggtggaggtcataaaaaattacagtaattttattggaggtaacttgtattgcagtgactcaaatacaagctaacaggactaattccatttttgtcatcagtggttaattaaaattttttttccttttctatatttcatttcaatagcacattagcaggtttatatataatgacagtgagtttagattaggataattcataagtcccagaatcactgggtcatatgacatgacagtttgacctgggctgcacaggaaatgcatttataaatggtaggaggtggggaaaatatgtagaggataaaccctggaaggagaagcacaacagaaaatttagttgggtgtgggaatggtcacagacaggtaatccttagaggatagggtgcttagaagttggtggatatggggagagggctgaacaaattcttggtaaatgttatgtgtctctccatataccctgttgagacccaactggtatagactctgtgttctagagtgcagaggggagcaatcaccaagagctagaagtgttcctgggggaggcgggtaatcctaccaggatccttcctggctttactgggagggaactgatctgctactctttgcctcaacaggctggctgtcaccaacaccaccatgacagggactgtgctgaagatgacagaccggagtcatcggcagaagctgcagctgaaggctctggatacagtgctctttgggcctcctctctgtgagtcttgtgttgagaagggctactgctgtgccatggaaaccaaagctgttgtagtggataggctaaggctaaggctctgggtctcctaggcacacctgcaagatagcacctatactatttccactggtattaaggtatgaaagagtcttacattttagtccagacacgtagcaacatgcattcattaaatactttaaggaaatatctgcattgtgccaatgctgtgctggaccctgtaggaagacctggaatgaatcatgttctgccctgaagggacaacatgagtgttctgtagaggtacacagtacttctgaggcccagatgagggctagtgaaggtatcctatagacaaggtgacatgttacctctgcctttaagggtggatagagctttattctatggaggtggcagaataggacattctaggcagagtaaacaacctgagcaagagtacaaaagctaaaatatgaaaagtatgctcagggatagaagtaaccccctatgggctgaaagctttttacctgttacctacttctatatttcatttcaatagcatatcagcaggtttatatatatataatgacagtgggttattgtagacatgtagagtgcatgaactgattaatgaacatctttgtattattgaatgaccaaggaggactaagtgggttttcactgaagcagtagacacactcaggcctaagaaagggtggtctcttcagccagggtctagttgagagaattaggttgttcagtctctacagatctatgtggtaggaacggccagcctgtaatcctttttctaattctaagttaaccaagggggagcaaaaagtagtgagatttcttggaaaactattttcaaccaaacaggctcttagggcccacttcctgccctttgggaatggctggcctcgatttagggtgccagcagaagaatgctattgaaccaggaaacagtccagagaagcagctggcaggcaaggtcagaggccatataacatttccctgtctgtgaatatggcttggctaatgtgcaagttgatgtctcaatacaagtggatccatactttttgaaagtatgaaacagagcaacctgggagaagactaatgtttccacttcctttgccaccttttttttgggggagtggagggttctaggacacattttactcaccttcattggtaggttttgaataacgacacagtgaatggttctactctttatgtaaggcgtagtctctgtattgagcaatggccttccagtcattcactaacctttactgagcacattctatgtaccagcataatcggcagggtccctgctctccagtacttctatctaaatggagatagctatgtcaacaaatatagtaaagtgtcaacaaatatagtaagtgttatagctattatgtaagtctttccagagttcaactgggggcacaaactagggaggagtttcctattggagtccagggaaactttatggagaaagtaattcttgagctgagtcttaaaagatgagaagtggccttattaaactctccctatgttaacagcttacacatctctttgtatacaccaacaaggacacttatacccaactataaaagctaggctacttttgcagaggttctcctctgtcaccaccatgcaaggggaagctttcagcagcctgaaagtcttccttagccttgtaatatatattatcaagctttatctgtatcaaaatcagatttatcatgtctgaaaggatacagtagaaactgcaggttaaagcagtcaaggattttatctgaaaaaatcagctagcatgggaaccagaatgctggggacatggtactgggtccaggatatcagaaccaacaagaggggccctggtggagcaggttggactgataccaggacaggggtattcttctcttaggcttattgcatgtagcccatgtgctgcatgtgatctaacttaaggaaggccagagatcagcaggaaaactatcttcctgagataggcagaacacaggtactgaagctaagaatatacttcacactgactgggatacttataataataatagtttttaaaaatggaaaacttgtgttggcgagggtatagagaaattgaaaccctgtatattgctggtgagaaggtaaaacggttcagctactgtgtaaaatagtctggtggtttctcagaaattagacacagagttaccctagaacctagcaattccacacttaggtatatatgcaaagaattgaagacaagtactcaaacaagtacatgtacatgcattttcatagcagcacatgtcacaagagccaaaaaataaaacaacccaactgtctattaatagatgaatagataaatacattgtggtgcaatggaatattattcacctataaatggaatgaagttctgatacatgctacaatgtggatgaacctggaaaacattatgctaaatgaaagaagccagacacaaaagatcacatattatatgattctgttaatatgaaatgattagaatagataaatccacagagacagaatgtagactaatggttggcaggggttggtgggaggagggaatggggagaaaccgcttactggtaaaaaattttactgtagagtgatggaaatattttggaactagatagaggtagtggttgcataacatcatgaatgtgctatatgccactgaattgcttactttaaaatggttacttttatattatgtgaattttacctcaaattattttttaaaaagcatatacaacaaaagaaagaatagataaattggacttcaccaaaataaaaaagttttatacttcaaagaatgtaccaagaaagtgaaaagacaacccacaaagtggagaaagtattggcaaacatttttctgacaaggctctactatccagaatacataaaaaattcttgctaggtacggtggctcatgccagtaatcccagcactttgggaggctgaggtgggcagatcacctgaggacaggagtttgagaacagcctggccaacatggcaaaaccctgtctctactaaaaaaatacaaaaattagccgggtgtggtggcacatgactgtaatcctagctactcaggaggttgaggcataagaattgctgaaacctgggaggcagaggttgcagtgagccaagatcgtgccactgcactccagcctgggtgacagggtgagaccctctctcaaaacaaacaaacaaacaaaaaatggacaaaggatttgaacatattatttgtatagtccacagttcaatggccaatatacacctgaaacaatgctcaacatcattatcagggcaatgcaaatcaaaactacaatgaggtaacactttttacccactaggatataataaaaaagacagtaacaagtgttggtgaggatgtgttgaaattagaataatagccaaaaagtggaaacaactcaagtgtctgtcagttgatgaatggaaaaaaaaatggtatatacatacaatagaatattaatcagtcactaaaaggaatgaagtactgatatatgctacaatgtggatgaaccttgaaaacatgccaagtaaaagaagccagtcacaacaggccacatattatataattttgtgagttcacttatataaaatgcccagaacacacaaatccatagagacagaaaatagattagtggtttctggggctgggggtgggggcagtgggaaataggaagtgactgctaatagatatggcatttctttttggggtaatgataatattctaacattaattttgccagtggttgcacaaccttgtgaatatagtacaatcattgaattgcccattttaagagagagacttagaattttagggtctgtgaattatatcttaataataaatatatacatgcataccttgttttattgtgctttgccttattgcacttggcagataattgcattttttacaagttgaaggtttgtggcaatcctgtgttgatcaagctgttggtaccatatttccaaaagcatgtgctcacttttgagtctctgtgtcggaatttttaagcaataagttatttttaaattaaggcacgcacactgtatttttagacataatgctattatacacttaatagactacagtatagtgtaaacataacttttatcactgggaaactaaaaaatttttgtgactcactttattgctatattagctttattgcagtggcctcaaactgaacttgcagtgtatccgaggtatgcctgaacagctttttttgtagctcctggatttttattcagacaacttgtttgaagtttggggaagaaccctgtattggcaggtgaccttggtcccttttcaaaattgccactcactgtgtgaccttgggtagtcacttttctcaggtgtgttttatgatttgtatcaggagattcctccctacagttcctttcagctgtgacattttatgatttttgggaggaacttcttcctcaataagggttctgtgtaaaagacaggaggtctgttccttcctggtgtctgcatcctgtatttttaggacttctgtgcttggtccttgccttattaagtgagctttggcaattcagttctgcctagatttgggtttccttatctgtaaaatgggtttgttcattaaaggttcttactggttctctcattcaggggattctgatagagctgggtatactcttggaagctaaggttttagaaatcagcagctgtcctgatggcaaatattgtttttatatttttctactgatgcttgtcaaaggaaatatttgaaaatcgccggctggaatctgaggaaaatactaaggagctctttgccaggagacttctgaaaggggtagggacatgcctgctgggtgtttacaaaaagtcccttgatctgtgcccctctagactttatttcccctctgagcatggactaaaaatccctatttcagttctattctttaatacccatttaggaggcctgtactggctctgacctgtattctgaacttaggatgagttcttaaggctgagtgagcagacacttagacctcatcatcagtcatttagcacacaaacaccccagagaacctagacttgttacagctgtgagctatggccaccttactgagctataataaaaattctgttattggtctgaggcttgacatatcttcaattaaaggtttgtcatgcagtagccaagagggtctgctgagggaacaggtgccatctgtccacagcagcctcagaacttgggaagagggaagagggaagagggatcagactggctcagcagagggccacctcaaggtccattttctgacagtagatggcatgcttaatcctccccatgtgaccacagagtagcacactgccctttaggatctttttcactctacagagttggctctgggtttacaggcccatctagggctcgccaaacagtaccagtttgcagatgttaggtgtgtttggagatgttaggagatgttatccatcttctacttccattagaggaaacaagatataataaagagttccagctttgaaatcaagctgaccagctctatcactcagtagctttgtgaccttggacacatttctaaggttctctgtgccccaatttgctctaaataaatggtagctactatttttaatttttaatgtgtgcctacagtgtgcttagtcctgggctaggggctagcatgccctttgtgctttcagcaggaatattgagaaaagtgcagggaggcctacagaataattgttgcgggtcaggggcagttggagataggaaaagaaaagactatgcctcatcttccttcttcattggctcagaaaataggggaaagtccccagtgagcaggagtggttgcttttctggcaaagctcactctgatctctgtacctgcatccttaccctctctctcttttctgttatggtccaatttgcccttcaagctttctccaggatgtttttccatccttttacaggcatgctcaactctttcctcttattctcctgtaggaacccacagccctttgtactttttttttttttttgataacaatatgtctctctgccttttatcctttaaactgggaactccttgatgaaagaattttgttcatctgtcatcagcacccagcttaagatctagccagaattaagtgctgggagatgtgtgctagaagttatatggaaggaggctgggcctctccagactacagaagtgaggggatttgggagaagaatctggcccagcttggttttggggagaaatgctatctatggagtacctgaatagctgaggcatttaaagcatttgttgggctataactagaagggaggggggcccatgagtagctcttacacgttaaacagacatcccagcacagaaggctgtgtaaatgacaaaagaaattcctactacatattttggcagtgagggatgaatatctatatctgccagggtattgtgtgaagtggacagggtggagagaatagattgggagaagggattccagaaggtgataatgattggatgctcactttctcagtgctaacttgtaccctgaaaattcttattattacccctgactttgttaacatctcagtatctcatttttttacaaccacttcccttgtctcaggcctgatggtgttaatagttgacctcattttgctaaaatctaattgcagcacacagactgggaattctgccatcctctggttcccccagtcccagccagcttccctgggttagctctgttcacctagccagccacatctgttctcctgaaacctccatggttactctgccctggctatggttactgagtgcaaggtagattctgagagctgagtttgtgtaggggttgtgcgatgcagctggccatgctctttttgtctccaggagctggcatttgccctctatatgcactttgtattgtagctccctttccacctaaaacctccctgcattctccccttttctcccttttctgcctttgctaaatacctgttctggtcagaccctgtgctaagagtatggggctacagagatataaataaaccttgtgccctggccctgaggaactcacagactaccagatggtgactgacatggaagttgaaaaataggctgggcgcagtgactctctcctgtaattccactttgggaggctgaggtaggaggatctcttgaggctaggaactcaagactagcctgggcaacatagcaagacctccatctctaaaaaagaaaaaaaaagttgaaaaacacacaagacagtccctgagaaataaagagataacctatgtttacctgtccaaagaatgggttgatcgtagctcacaggagatggaatggaaggctttgtgggcaatggtagggagaagacagtaggaattgaagaatgggaatgggattataatgggaagaagcagattattagtaaggcatagattagactcttgatttgcctattctctcctctttttctacacaatgattcatagactcacttagtggtgtggggtacagcctagggctctgcgggagggacccgacaattcttacatctactgcttcagctacttcttctttctcaaactccacatctatattcttaattatctcctggcatgtccatctgagtatctccaagacacctcaaagtgctgtcatttacacctacacgttcgatctcgttagtaaccacacattctatctctgtagtaactctaatgcattttacagctgaggaagctgaggtctagataggggaagtgaattatataacaaattggggcagaggcaaacatagaaccaggcttcccaacacatagtgtgggatgcctcccttggtagcacaagaatttctctacacggacccttgtgtttaatcttaaggcctggttatttggccttggggtattcactgccctgatggcaatgccactatcagcttccaggatattgtgtgggggaaaactcaggccttggaactcttagagtcaagagttccaagagtctagcttgagctagatcagggccatattagacatctccattgtaagagatgtttgcctgtaacaaaacagaaacaatatttgctgcgtgaatatgaaagctgtagtgagaaagtgtggtgtagcagaaagacaatgtagttgggcaaatctggatttaaacccagctctagcaagttagtgtcccttacagagcctcagtttcttggtctacagaatgggaataccaataacctatcttatgtagtagttgtgaggataagagacgatgaatataaatgcctgatatgttttatattttctctatttcccttcctttcttatacggattaagggaagggagatattatcatacttgaagcttatcagtaaagaatcaatccttccaagatttattgagtgacttctgtatgctggttgatgttatgctgtgcactggcatatataggcaagtgatgatcactaggaaccttaaagagtaaatcaaccgtgttagaatcatcttcttttatcaagcttggtagctcatggatgtggcaggtagtatttccggactttatctatacatttgacaaggcagagggttggataggatggatatttgtatatttaagtggagtcaaaactagttgaaggaatccagtggtactgataggtggaacagtattaccttagagggagggagtgactgttagatcttatccttggccttggttattcagtattcttattcatgacttggatgagaatatgaagctgggcaaaataatagatctggttccaaattgaactggataaggtagaataagaaaccaaatgaaataactaggctcaatctgcatacccaccttaagtatttgaggtactggaagtgctcgttgcatggagtcttgtttgaacaaggatacctttgacttttggtaagaatataaaggggatattgaagttgagaaaccctaggaaaccaagattaaaagtcattaacaaacaggggagacaaagaataccccaggctctggtagtggctctggaggaggcaggtgtgttccaggaagtaaggcaactcactgtgctgcagaaatagctccccttggaacctgaaagacaggagagtgatggcttacgtatggctagacttgtagcctgcctggaggctaggggatggccgctagaggaccctcaattttctttcagagagcctggaataaacatatgaaggacatggccaccaccctgacctagtgacccccctcccttgggtggaaataggatgtgttaatctgtctttgatcccatctcatccccatgttctgctgctcagcctttctgtgaggagctatgatggtaactcttcttgtcaaactataggcatcagtatcatatggtttctttttctggtgtcttgaccttcccttaacttggtggctctacctgggtccttttggatttccaccagccccatgtccttactatgtccaaggatcatgccagtcctacctccttctctgctgtttaagggcaacttgctgtgcacagagggtcattagccctggcataactcccttttttccctctttctctgactcccacatccagggctcctctgagcccacagcaaaacctagacagaggatgcaggagtagctgtctccttcttatagtgcccctttcaagtcttttgtgctgtggcacagagcccagatctggtataccaggaacaatgttagttccagaaatgcctctctcctgattggctaagtttttaggatgtggcttttgctttttatcttgtggtgtcatttcttgtttaacatttaaattttgctctggacaatgggcattctttgaaccccagctggtggctggggccctcgtggttcactgaattgctaccaggtgttctctgaaaatagctctgcccctcaatttctggtaggtataatgtctcatccatatgaatgtattcatgctatcctgttctagagtctctggatttcacagtagcctagaaatgttctccatagattgagacttctggacctttccctgatctgtgccaagaatggcctggtagtccaggatacctagttcctacagtgacttcagtcctacagccagaactgaggcttctggtgacattgctttatatcctttataccagtcatctccatttacctactgtggaactttagaattgcttaccctgtatgacagaagccactacatcttggcatatgggctcatccagcccagagatggctggggcatattgagaaggcactagttctctcctcttcactgcatcttaagaaagtgtgatttaataagcatcctgtattgctgtaaggcctctcatttcaaaacaaagccttggctagcagagagatagacatagagcttactgtaatagtgtatggcaagtgtgtatctaagaagagaaactaattccttctcagtgggagagtgtgtctgttatggaaggcttcatagaggagggatgcagtggagtctgcaaggctaagtgtgcagtgggcaccctaactcatcatgccctcccctctctggcagtgactcgccataatcacctcaaggacttcatgctggtggtgtctatcgttattggtgtgggcggctgctggtttgcctatatccagaaccgttactccaaggagcacatgaagaagatgatgaaggacttggaggggttacaccgagctgagcagagtctgcatgaccttcaggaaaggtaaggcctgccccttcaggaaaggtgaggccctgccagttcttgggaacctcctatttccacctgggtgtgagccacttggcccctgagaccttgtcagcatggcagcccaggctgcatcatccttccaaaactgcattgcaagtttaggttgctgatattccaattgctattgggcagttattcctcctggggagaaacttgtttctatcttttttgcctcttagcttcagagggagaaatgtgtagctgccagaggtcttgagcttcccattgcttgttatggggtcattcttccttctgcctgtctctggactgcttctcctagcatataaatagatgtaatgaactgttctttactgttccccaaagaaacctcaaaaccttccttcttactgtccttagttctttcttataaggagtctaaatctcataaacactaacttgctatataactttggataaatttctttccctcccaggatttatttcctcattggtaatatgaagggattgaccttggagaatgctaaactctcctaggagaacacttccaactcagatggtctgggattctgttaaaataaaatgtgacttcaaaactatggcagaagatttaactgtgaaaagagagtgcccgtcagtcagtcagtcagtcctgacgtctaggaaccagttctgtgatggcagttatgagaaattcactggtcctgagaaaaaaaacttacacacccacaagaagcagcagtgagagcacacttaatgcagacttagttccagactcagcttataggataagaatgctaatgtctagaaagacaaagaggtggatgagtggatgtgggactctgaggaggtagcctttaaagatgggtagcgaggtcctaggtgttaaggttgagtgtatagggtggggtcagatccctggaaccttaagatgcatgtggggaagttagtaggatgcagaaggcaatagagagtcaaatcaggtttttttggttgttttgttttcgagaagaggagaggtctattcaagactgtcttttagaaaatgattctggaagcctagggactctagttgggaagtctttgcaggaattcatgtaaaaggaaatgaagtcttgtcttttcatttatttctatttattattattattattattttgactctgggtcttgctctgttgcccaggctgaagttcaatagcatgaacatggctcactgcagcctccaccccctgggctcaagagatcctcctgcttcagcctcctgtgtagctgggtgcatgccaccatgcctggctaatttttttattttttgtagagacaggggtcttgctgtgttgcccaggcttttcctgaactcctggactcaagaggtctacctcagcctcccaaagtgctgggattacaggcctgagccactgtgcccagccattgtgttatttttaaatggtaaacactatttaatttggaggggtagggacaagacttcttgtgagccaggtattgttaaatacttaaatgcattattacttttaatcactatggccctttgaagtaggtactattagagttggggaaatgaaggctcagagagggtaagtgctttgttcagggtcatatatcagtaagtagtgaactaggaattttgacactccagggtgctgcctctactgaggtagcagacttattggatttatttccatgggctgggcttctagggagcaagaggggtctgatctctaagctgattcctggctactttgctgggccccttgttcttgggccctttgccaattaggagctaactgctgctgtctgagcagtccccatacctcatttgtttgaaaaacatgtactgtttccattccaaaggcaaaagaatctaggcaggagacattccaagtttggggataaaactaagctcccagcactccctgctccctaaagcttccagagctaaatgaccactgtggcacttagaaagagacaaagacacccctccccttttccccctagagataggcttgcacacatgcacacatatatcctcctctgagtgtccagagcccacatgccacctggttcctccttgtattaacagacctgcaatgccagctttcacagagctttattacagagttcctgataatttatgtgaataaatataattctacatatacagtccagttaggatttcattgagtttcaagataattatttgaggcaggcaggaattttgattcccaaaacaggcaaaacttgctcatagtcacacaactgcttagagccaggactaattgcaatgctaattgttgttgccttggagtggggcagtgcttaattgtatacttatttgctcatttctacacccaacaatgattattgttctccatctctaacagaccttattggaactatgaaagggtgtcagtcttgattctactttaaaggagctcgctattattataaaggacagacatatcatagtattggcttttctcaagaggctgctttcataaaaggacagtatttcagtgaagaagtgaatccttaatggtgtaactttatatagttgggtcatggaagagtacagtaaaggaggatattcagcaagggaaggagatggcaggaaatggcgcctctgatttgtctttgcctatgcatatatcgccatctggtgttcattttcagggggttcaactccctttctcttcagggacaaattaggcagatcacaatttgcgggaagcttgcagcctaacatttcctcttcttacctccttgcttgttccatgatgtcttttgaagtctccgccactgatagctctggacttagaggtttttttttttttttttttttttttacagattgagttctgtttgtttcatctacttaattatctcagtggtcagtgttctctaggggtccttcttgttctgtagtctatcctttcttttctatacctcaagtctaagctatatatcttatctcttcttcaccatcctttctccttcctaatctggtcccctggtaacctggtggtttttacttagaaaggaagaccagacagtaaagtccgttttctcttccaaagggattagcaaactctcagtctttgttctgggtgtagcccaagtctctctttctttccctgactcctttcaggcagagctgatgactccatcttttgggaagacccaagaccttatatatctatatctatctctttctattatagaatttgtcacactgaatacagttatctgtctacttgtctttgttggagtaaatcatgagctcctcagtggcagggagagctttctgatttatcgccacgtatttagggcttagcacagggcttggcacttagtaggcacttgaaagaactcggtgaatgaatagatgaatgaatgagtgtattaacatagatagccgtgtggaggaaagaagtgaagaagcgggaaggcttgtttagctggatggaaggttttgtcggtgaactgagggaatgtgtgtgacggtgcaagggtagacttacattataactcatgcccttgagatcttatccactaaggaagatacttaggaaaggaactcagggcctgggggcagcaggggactctcctgagtcctttggcataaatttaatttgttttgtgcttctgggaacagaagctcaggagtccaagaggactcctagctcaatagttccttcctcatcttccctaatccacccctctgctaccaccccagtcatttctcagccattaggttttccctggatctttttgtcaagcttgcagggtattctacattcattgaactttctagataccactacataagaggaataattgtggcatttgaagtcacacagattggaattctagcctcagttcttcctacaagttgcaagactctgtatctgcctgtcccaggctgataatgataccaatatatcattatctgctgggaggacaaatgggaaataccttgtaaactggtacttgttatgattttagtatgagatagtttcgaggagggattcagatgcctgagagcctggcttcatagccttgattactggcagcaaaatgatggtcagtgtgtgaattaggtaatgactgtggtttctatgggccttgagctagctcagagccagacacacagcagagcagggagaatatatgctgagagttggagctgtcattttcctctttgatgccatgactcatggcatgttggctggcacccccttgcctggcctcctccagctccctgcattgcccccccaggctgcacaaggcccaggaggagcaccgcacagtggaggtggagaaggtccatctggaaaagaagctgcgcgatgagatcaaccttgctaagcaggaagcccagcggctgaaggagctgcgggagggtactgagaatgagcggagccgccaaaaatatgctgaggaggagttggagcaggtaggagagtccacaaattcctggacaccttgacgggtgggtaaagggcaggggcccagggtctggctagaaagttacatgtgtgaggaatttgaaatatgatccaaagactatgttctagagtcactggactcttaccaacaataagagttcaagttgtaaaaaatagtcactatgggccaggcacagtggttcatgcctgtaattctagcactttgggaggccaaggcaggtggatcacctgaggttaggagatcaagatcagcctggccaacatggtgaaagcccatctctattaaaaatacaaaaaaattagccgggtgtggcggcgggcacctgtaatcccagctacttgggaggctgaggcaggagaattgcctgaaccccggaggtggaggttgcagtgagtggagattgtgccattgcactccagcctgggtgacaagagtgaatctctgtctcaaaaaaaacaaaaaaagaaagaaagaaaaaaagaaaattataaaaatagtcactatgattttcaaagaacagtggataataggtgataacagttattttgttccttttttgaggtatttacataaagtgtacaagtcataagtatacagctggcaagcttttgcatatgcatgtacctgtgttactaccacccagatcaagatacagaaccttctcagcaccccaggaaactcacttttgctaccccaattaatatttcatccaaaagttaactactgtcacaacttgtaaaccagattagttttgtctaattttgaacttcatataaatggcattatacagtatatactcttttgtgttttgtttctttcactcaacattatgtctatgagagtcatcaaagttgcatgtagtgatagttggtttatttccattgctgagtaataatctattgtatgagtatactttaatttatccactcttctgttgataaacatttgggttgtctgcagttttgttgacttttatgaataatattgctatgaaccttcttgcatatgtctcttggtgggcataagccctcatttctgttggacatataatattcatgtatttagctttattagaaactgtcaaacaattttccaaaatgattgtaccaatctatactgccacaacaatgtaagagaattctagttgatccatgacctcagtatttttaggcattttaattttaaacattctggtaaatatatagtagtatcttgtgattttaattttcatttccctaatattattaaacacctttttataaatttattggccatttgatttgggaatctcttctcattttaaaaattggattgtctgtctttttcttattgatttgtaagcattatttatatattttggatattagtcttttgtcaatataaatacacatatatatagaaaatattttctctcagtcttgacttttttttgctttattgtcttttgataaacagaagcccttgattttaatgaagtgtaatttaatcagttttttaaaatgattgatgcagtcaggcgccgtggctcatgactgtaatcgcagcagtttgggtggctgaggtgggcagattacttgaggtcagaagttcgagaccagcctggtcaacatggcaaaagcccgtctgtactaaaaatacaaaaattaactgggtgtggtggcacatatctgtagtcccagctccttgggaggctgaggcaggaggattgcttgagcttgggaggtggaggttgcagtgagccaagaaagtgccactgcactccagcctgggtgacagagtgagactccatctcaaaaaaaaaaaaaaaaaaaaaaaaaaaaaaattgatgctttttgctttttgtttcttgttcaagaaatccttccctatccccaagatatttccctaaattttcttctgaacctttattgtttgtcttttcacatttagggatattatttcaaattaacttttgtatgtgatatgaggtaggctgtcaaggatctttgttttttttcccccaagtaaggtgatcattcaggaatctcttttttttttttttatttttcaggtcaaaaagttttctaatttttattgtggttccttttttgggacatggttatctagtatattgcttgattttcaaacatgtgaggactttttaagttatttttcttttgctgatttctagtttaatttcactaagatcagagaacatatgctgtgtgggtgtagtcctttgaaacttgttgagacttggtttgtataaaaaaacaactaagcaattcagttaaaaggcaaagattgtcagattggattaatgccaaaactcaattatatgctgttcgtaagagacacattttaaatataagaacacaaaaaaaggttaaaggaaaaggatatgagaaaagatatatgttacaaaataaagcagcaaaattaagcaggagtagctatatattgatataatatttatattaatataaaataggatttaggtcatgaagtattgacctaaagcagttgctaagtgaaataaagcaagggtagctatatattaatataaatgtaatatttacattaatataaagtaaactttaggtcaagaagtattactggactccaaaaatagatatttcataattataagtggatgaattcaatttaatatataacagcccttaatttggatacatctaatgatgtagtctaaaatatgtaaagcaaatattgactgaactaaaatgatactagacaaattttataatcaaagttagagattttaatatgcttctctcaataagccaccaacagcatccataaggatataaaaaatttaaaaacatggttaataaatttgaattccttgacacatatagaacactttgcctaactctagaatatacattctttttagcacttatatatctcttaaaatatacttctgctccattctctcctctccttctgagaatctaatatttatgttagatcttttaactgtattccacatgtctcttatgctcagttctgttcttttttctctctgtgctttggtttggttattttctattgatctatcttttaagttctttaattctgcattctactgtaagcattctggtgtttaacccatccagtgggttcctactctcagacaatgtatttttcaattctagaatatccactttactcttttataggttctagttccctgtccagaatttctatcttttatctattgtatccatcttttcctgtatttctcttaacatagcaatcataattattttgaagtccttgtcttataattcttacatctggatcatttatgggactgcttatttttcctcttgattattagtcatattttttgccatttatgtctaataatttatttttattacatgctggacagtgtgtataaaaaaacaatagaggctccagatgattttctcttccatcaggtagttttccccctttcttttgtgaagtatattaaggaactgatcacctcaagccaatcagagatcaagctgcatttgaactaggttgtagttttagtaaaacttggtgtagctttcatttgtcccagtttctcaggtatgtccctccctgacttttaaatggaaagctgttaaatttctttctcttcagccctgaaagactgtgagagatgcagttctgccacttcgtaggctgttttctttgtgccccagtggagatcttctacatgggtccagcccaattttcggctgtcacctaaaatcatcaatgtctcccaggaagaaaatgactggcaattgacaaatcatcttagaaaggctttttttctctctgacttttggtttatctagtctagtggttttcacactttttgttcttaggactctactttttttttttttttaagatggagtctcgctcttgtcgcccaggctggagtgcaatggcacaatctcggctcactgcaacctccgcctcccaggttcaagcaattctcctcctgcctcagcctcccgaaaagctgggattacaggtgcctgccaccacacctggctaatttttgtatttttagtagagaaggggtttcaccatgttggtcaggctggtctcgaactcctgacctcaggtgagccacccacctcagcctcccaaagtgctgggattacaggcgtgagccaccacacttagcgaggaccctttactcttaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggcatgatatgtctctttctgtctgtctgtcttccatcttccctattccttattttgtagttatttctctctttaaccaaacagtttttttttttttttttgagacagtgtctcactctattgcccaggctggagtgtggtagcacgatcttggctcactgcagtcttgacctcctggactcaagcgatcctcccacctcagcctcctgagtagctgggaccacaggtgcacaccatcccaccaggctagttttacaattttttgtaagatgaggtctcgctgtgttgctcaggctgctctcgaactcctgggctcaagtgatcctcctgctttggccttccaaactactgggattacaggcgtgagccactgtgcctagctcccaacagtttttgagccttgtaggcctgcccctttgtatgcctccctgactatcatgcttctatttgctctctttttttctcttcttcatccattcttcccttcttagcttatcccattccttaaactgcttttaatatagaacttgatcataaattttcagacttggtatattagtctctaaggtatctagtcttcatttagagctataaaaccaggaatgggctatttttaggttttttttttcagggaacagaaaccaagtgaagattggcactctcattgcctcttaaaggaataaaggtgttctgtccctagctgaggccctcctggcctatcttagctgtggagaggacctcaggcttgctatgggatgtttacctcattggctgaagctggggataataagactgctttcaatgcatcttctctgggattctgttcaggtaggagaattggagatcacttatgctggtagcttggatgagacagcaagaaactcagtgtacataatgtctgtatgtactttcaagtcttttacactttagtgctttgtgactgcctcattgtgtgctccctgcagagaagtcggttatttctacttatacattggtcctctcatgtcttggcttctgttggcaatgcctgtgttaggtgtgggcatgctcattatcttcccaccttttacagagttcttttcaaagcccacttgctctactccctgagagaatcatagacgcagtctctgggctagagaagactttggagagcattcaggacaatgcccttctgaagtaccaatcatttttcagttctctctgacatgagctcttcacataactcccatgacagggaactcattctctcctgagatcaccccttcactgatagtttggatttgcatgggagaaagtccttcctcacactgaattaagagccggtttaggaagcacagggtcacacaaccagttaagcgacagaccagggaccagaactagattttcagattcctgaccagtgctttttctgtcacactgtgatgtcttgaagtctaagcacagaccctgactcttggtaagatgattcactagctgacctgttcctgaagagatcagggaagactgctggaacttgctgcatgaccaggaaagtaagctgatgtgatagaaaagaatgcctttgtctgggaacagaaacatctcaatttgggttctggttgacactgttgaccttgagtaggttaattttcttcgctgagcttgctttcttctatataaaatacggaaaataatccttaccttttctccttcctgggagagttgtaaagcagataagaagtctgagttctgaagcatcatacagagatgttggagagtcttagtagcagtaaatgaactcacatccttttggctgcctaggttcgggaggccttgaggaaagcagagaaggagctagaatctcacagctcatggtatgctccagaggcccttcagaagtggctgcagctgacacatgaggtggaggtgcaatattacaacatcaagaagcaaaatgctgagaagcagctgctggtggccaaggagggggtgagaacagcccttctattgtcctcttttctcctttttgcccttctcctttttacctgcatatcttcctcttctctccctctccctgttcctcccattgggtgaagagatatcctggtggtgggttctgtttctttcctaatgttcagctcctgacagtgtcctcaggcttctggaggagggaatgagggtgtaggggcattcctgcctgtcttctgggaaagatgaaacaagtggaggcaggcagagggaaagctctgccagccccaggctgccatggggacagaggtcctcctggggcaaaagggctatcaaggacccctttgcttctcccctcgctttctctattttgtccccctcctttttcttctaccttgcctgcctttctctttttcctctttctcttccctttccttgtacagcctcagttgtgctaggaggagtgggccccagccataggggaaggcctttctcatttattccattctcgaatccctgctcttttcgagctgggggcctcatctttgcaggctgagaagataaaaaagaagagaaacacactctttggcaccttccacgtggcccacagctcttccctggatgatgtagatcataaaattctaacagctaagtaagtaacaccagttatctactctggcaatgtccatatcatcctcagaatttgagggcatacagggcctccaacaccaattccatttcctcattggtggagggacagctctggtctcctgcctcagcctttatttatctcctgccttgctcttaagtttgagtttattgtgtgttttattcacacatattctcaaaacttgttcctctgagaagaggcttcattcctattggggctcacaccaagtccatgcctgcagttctctttcctctgtcttcaggcaagcactgagcgaggtgacagcagcattgcgggagcgcctgcaccgctggcaacagatcgagatcctctgtggcttccagattgtcaacaaccctggcatccactcactggtggctgccctcaacatagaccccagctggatgggcagtacacgccccaaccctgctcacttcatcatgactgacgacgtggatgacatggatgaggagattgtgtctcccttgtccatgcagtgtaggtgacctctttgcggggatgaaggaaggagcctttgatgtacaggttgagaagtctgtggcctctgttgtgcttaaacagcagatggggcagatacccaggaagatagttcaactcatgaccttggtcaataaagcacaatttactcaggttatttctttatagttgtccttttggtgttctttccttgttgtatgctctgtgtgcccctttgggtctattgtgctaagtgtgtctcccttcattctttttcactttattgtccctaactaccactctatctacctttataaaaaatatgtcctttagtgaatttcaatgtaaaaatggcatttattctatttattgaacttatttattttgatttttgttccttattcttattgctaaagtagatgaatggaatgatgtttctttttgtgtttttgtgagaggccctataaagaaatagtcccttaaagtgatatagtcctaaatcctctaagctggaaaggcattcttgcccaggagggatctcctgcacaagcatgtctggctttccacctggactcttggatcctacccgctcttcctctgtcctggatcttccctctcccttttctcccctgcaagtgatgagagttgagtagagcagagccaaaaggaacaacactggaattcttcagtgaatgaagggagttttcccttactggcccacaattgaatttttctttggatcagaagctattttaagtaagtagaatagcccttatggtaaagctattgtcctaggcccatattctgccagttcagcgggagggcagaaggccggggctgggttaggggcttactttcagattctttaatcaggctggattcccactcgagacagaatttatttgtaattttatcaataatactttgcccctggccaagcctctttgttcttctaatctgataactcgttaggcctttaatcaaaggcttaacaaggacaggatcactgacaggcagagcttgatcctgacttgctgatctgaaggcttctgtgttctccaggctgggagggaccttaattagctctgagctacccaatccctgcccccagcccttcctttattacattgatggcaggccgaagccctccataaatcagattctcttctccttttggcctggctgttgaccctagatgctgcctggctgatggggcgtaggttcagtgaccgctctctctgctctacatccgccggctcggatgatcagtccctctggaaataccccggtttgaggagcccctttggggcattttgtttttctgactttcgggactaaatcaacactcttaccccatgggtcccttctcctgcctgcttcacgcccctgcctgctccctctatcccctcagcactgtccctactaactacagggaggggttcgggggtgagaagaatcagcttgcttggcaagagctggacagagaacacccatggtaatggaaggcttaggcttctccctttagcgcagctgtgcaggtaacttggtagcccttcttccatctgggctgggagggaaagagggaaggacaaatgacccctttcttttctctttttcatgtttctcccttttcttcccagtttcccccttctttctcccccttcccccccctattccagacttcctcatcctcttcagcctctctttcgtaccttgaaagctaccagcatagaagccctacctcctgaactctccatcactatggaattatgctgtctccctggtggtccttccaaggcttcgctcacccttgtaacctggccctttctctcatctttaggtagaatgcagggaagcttatctatcaggctagaggagaaagaataaaggtctgcactctcttttagctgggagtgagcccaaagggggatgcactagcatattcctaagttacttggtgcccatgtatcccttcactgggcatagtggccattatctccaggaccccgatttgcagcctgatccaagagctggttctttgttgtttatgtgcttattggaaagcgaaaaagagtgaacattagcataaaaagcatccatagtcccaccatatttgagcaccttctctatcactcttttctgtgaaattttttatgtggttaagataatgatagccactgccacttattgagtgccatgacctgtttcaggtgccttaaagacattattgtgaagtctcagaagaaccctgcaggattttagaaattaggaattaaaatggggaagtcagctgctcaaggtcacagctagaagtgaaagtcctggtttcaacctctagtgtttggtattccaaagctcaaggctagtacctataattctgtatcctttttcccctctgaacattttaataggcatttttccattttcttcaagtctttttataagcatcatttttaatagctctatagtctcccagaaactggatatgttatcattttcccattgttcattatttatgtttactttcatacaactattaataaaaagtaaacaattatgtttacttctcatttaattattaataatgatgaacatgtttatgtataagtccttgtctatgctgtgaattatttcctgaggttggctttctgaaaaggctggttcttagtgctctcccggaccttatcccaagcccctatcctacccttccttgcttgtgtctacccactaactgccttgccacttccctttatagtgatattgcccataggtctccttctattggaattgccactaaaactgacctgggcacttcatcttcaatttcccatccttttaggacccctggtgggaggtttctgggaggaggtgccccattctccagattggcattagaggcccagggtggtctccagcaagcatttattcatgggcacctccttacctgccagcccaaagtgggctggcccctcctgacactttctttattctccttgcagcccctagcctgcagagcagtgttcggcagcgcctgacggagccacagcatggcctgggatctcagaggttggtagagggcgaggctggccacttcttgacaagccgggtatctctgcggcgaatgcgcagcctttcatctggacagtctttcagttctgaaggctacgggaccagctctccatctgcctctgctgctgcttcttgctcctcttccatcaccaccatcaccactaccaccaccaccaccaccaccttcaccaccgtccatgtccaccctgtttattaccaccacagcacttcctatttcctccagatggagccctaccctgacacacccccttctgacagcaccgctgtgatgcctgggcattcagagagcttggggtatcagctgtctctcttttctttcttcccttccttccctttctgctgcttttaccttggtttctgcctgccagctgctgcttgatcaactctgggggtgtgtgcagtggggaatcttcttatcctgtttgttcccagctctgggattcctttttaaggtcagcctactttctccccttctgtgtttggggtttgctgactctaaaaatgagtaacgactttcttccctcatgaccctatagcacttttgcctaaactatgcactttcacattagttatctcacttgggccctcacttcctttactccttcaacaaacatttactaatgcctactctgtgccaggctctgctgggcataggggttcactggtgataagatacaatcccagccatcaagaactacaatcttgtctgagagagatacataaataattatggaaaaatttattaagtgctatgggggtgttgaggaaggagtgactaacagtgtgtacctgggtggaatgcttcaccaaagagatgaatttgtgctaacatcctgtgtgaagggaaaggagaaagagtattctaggcagaggaaacactgtatgcagagacatggagattccagagaatacaatatatttgtggttagaacactggatatgtgttggtgggaaggagaaacaggtgaggctagaatgacgaaggctccgaaagggaagggttttggcctctacccgttaggagatggagaactacaaaagggtttctaagagaaagtgaatcagtcacatttgcattttagaaataacattttagtggctgtgtgaaggaaggaagtggaagactacaggaatttggaaaacattccagtagaccactaggggaggtaatgaggacttgggataaaaagacatgataaatttggtaactggctacagtggtgaaggaaagggaggatctagtatgacactcaggtttatagcttgagtgactgagtggacataacgtccttcatggaattcgggaaccaagatagcggacataggttttggggttttggacaagaagagtttataggtggggcaggaattaaaatacacattttaagaacagtaagttaaggttctaaaagggtaagtaattccctccaggtctcatagctagttgagagcagagcacagattagaacttggctttccattccagaatactccgttggatatttttgtcttttcacaaggtctcaaaaagtgtactggaaaataattggtgaaaggtttttcttccacagctttgtctggcagctgcagagactattcttgctaatacccaagatggtagactagaatcagagatagtagccttgaccttgcctggaacaagcttaggagaccttcagaaagtccttcccctctggaagtacttctcatctctgaaatggtgaccacagcccagtcctggcctctgggctgcagtctgcttactctgttgcttttttttagttctatctcactctggatacccatttattcagctctgccccttaaacctctggatagttatgcttgagggctgttcctttctcttgcacaaagggattgcccttactaggattattactcagcagagccactcatatccattctcattctcattttcatccaaaagcctaggaagggagactgctccttccagtacagatggagaggatcaaattgggttggggacactaagggatgctgtgaattccatgctccaaggtttaagctgagggcagtggggaggaagggcggagaggtacctgtatccacctggcctgttcactacttaattttcttttgcaccacgcaccagaggatcatctctaaaggcaaacaggctctctagtaaggtcagtagcttgggatgggagtccgaggcagcccagcctttggggagggacctctggcctgattgttctcagtgattcagggagggaaggtgagcctgcctcactgggccttttccctcctatatctccctaggcttcctcccaggttcttatcttgctttggcagtcccaacttttagctgatgagagaggcatagaaggacaggaatcaggctgggtgcagtggctcacacctgtaatcctagcactttgggaggccgagagcggaggactgcttaagcccaggagtttgagaccagcctgggaaacaaagtgagaccctgtctctacaaaaaaaaaatcaaaaatttagttgggcatggtggcacatgcctgtggtcccagctacataggaggatcacttgagcctgggaggtcaaggctgcagtgagccgagatcgcgccattgcactccagcctgggcaacagagcaagaccctgtcaataaataaataaataaaaagatggataggaatcaagatgaaataggggtctggtccaggagaagtgaggctgggagggccctaacctcctgatttctcctccttggtgttagagagggtaggatcccagaatcttcacttcctcagcttagaggaccctttttctcagtgtgattgcttcccagaacttccttggcaccttgctcattggtttataatagtgtttggagaaggcaagatatggagaggatcatcttggggcttagagaaacaaggacaagtttagaagcaaggacagtgtcagatatatgaaaccaaatatgagactgaatatttgtaaatactagaatatgtggctaaaacagtatttgtagaatggaagctgagttggaattgttctctgctgcctgctgagtccaggaaggtactggcccatggggtggctacttagttatttgcttccaactgagaattaaatctacaatagctatgagccaaccccctgcttttgcctgtttcaggggcctggtacccttcctaacttctgaccctcagcctctttctttctaggtcctatggtggtctccttttccattcatgactcttcccctttggctagcagacgtttaaacatttcccttaggtctctcctctgcttttgctgaggttctcaggcctctaggaaggcagaaggaggattcaggattggcagagagagcacctccatatctacctttttgtctgtagagcaggaggagtggcatctggaattgattcatggtcttagcaaccaccagctccttaaagggtctcaagttcctagactagcctgtgtgtgtgcatgtccagtgtgcggtggcatgtctccataactcagccttgcaaagaagcctcttgcgaccggcccgtacataggcctttcagcttggcaggcctcatcatcttcattcccacaataatttctacatttccaagtgctttgccagcatatttgatcctccaaacagtcttgtaagataaattgaattggtattatcttcattaggccaaagttaaggactagcaagtttagatgacttgacttgtccaagatcacacaggagtccagacctcttctgaaccactgctctttaaaggccaacatcctgtctttctatgcctccctacattctccgtcagcagagttctgaaagagaccccacccttcctgccgcaccacagactttggtttgaactctgcaatacctatctatgacctcctttgaatcctatgagatggttagaagaggcagcatcctggccttttggggtgggtgaaggattatttgcaaggctgttctaaccttctcatctccagcctgggtcaggtccactgactgcatgtgccctgttccttggggcctggcccagactggataatatcctaaggtgtgacaggagtaagtggggaaggaaggcatggaaaatggtgactcggagcaggctgtaggttctgtgttagcttgagtcccaggaaatacagccagctatgagaaggcagagattttattgaggatgccgcctgtggaatttaagcctatggctgcaccagttcagagccagagcattcaccactggtggggcccaggtattggaaaaccatttgccagacagatgatggtatgatgacatttgtttttgtttcttatctgtttcttccctccctatcacttttccctttcttgtctttctctcttggcccttctttctacctgcttatccttttgcttttcttcctctacaattctactctccttttcctgtctcttttccaatctatcctcattccctcctcctgcctcctctcttatcctatacttatggctgctcaacttctgtctattcctctttcctctctccttcccacctgcctgttcatcctatttctctctcctgccgctctatccccattttcctaccctgtccttgtcttctcgtgttgtccctctctcctcttcgcctttcccctatcacctcatccaatatatgtccctttcttcctctctgccccatgtcttgcagggatttgacccattccgattcggagtcctccctccacatgagtgaccgccagcgtgtggcccccaaacctcctcagatgagccgtgctgcagacgaggctctcaatgccatgacttccaatggcagccaccggctgatcgagggggtccacccagggtctctggtggagaaactgcctgacagccctgccctggccaagaaggcattactggcgctgaaccatgggctggacaaggcccacagcctgatggagctgagcccctcagccccacctggtggctctccacatttggattcttcccgttctcacagccccagctccccagacccagacacaccatctccagttggggacagccgagccctgcaagccagccgaaacacacgcattccccacctggctggcaagaaggctgtggctgaggaggataatggctctattggcgaggaaacagactccagcccaggccggaagaagtttcccctcaaaatctttaagaagcctcttaagaagtaggcaggatggggtggcagtaaagggacagcttgtccttccctgggtgttctgtctctccttccctcccttccttcaagataactggccccaagagtggggcatgggaagggctggtccaggggtctgggcactgtacatacctgccccctcatccttgggtccttcattattatttattaactgaccaccatggcctgcctgccctgcctccgtcccaaccatgggctgctgctgtcactccctctccacttcagtgcatgtcttagttgctgttccctcagctcccagctccacctctggggttcagcttctgtctctgctgtcccagttttgaggtttggtttcttgtttctgtctcttgctttcgggctcctccctcccaccactccccaacttcccctagcagttgcagggaagataggacgagtagcttctgacatgtgtgcctcagatctgttccaccccactcacagtggttctgtttgctccagactggggctagggcctaatctttgaagtttgttctttggtattgatgtgggtcagaaggagcctcatcctaatctcactcaggcctccagggatccatgggggagtgaaaccaattctcagagaacaacccaccagagacttttaaagagaggccaggcttgggaatgggttgggagaggcatctgttcattggagcatgagtggatgccagaactgtaggttataaggcagtcactttttctctctactcccacccacacctgcctccctcttacccctgctcccccacactgcaggaggatttgtctctaagaggtgctgccccaaagctccccaagcatcaatactcctagggctcaggacaagtggctcccctggccaggagagccacagccatgatacagggctcttatggagccctggagttgttgggcaaggatgctgtcattttttgaaccaaaagacaaacaggttaaaaggaaaaaaagtaatctgaatttcccaagtgcctacgctgcatattccccttgttagatcccattttcatgttactttgtagccttggccagaggctcaaaaaggacacaaccagtttggggaaggggtggctaaggaagatggtataggtgaaggcggctgtgtgaccactttcccccacccttcccaccctctagacaactctctcccttacctgtttttgctatggctgtaaaggtatttttcctctgccccactccctgccatacctttatcctgggatcctattttgggcctggggtgggtatacctggggctggtcttaggagggtgctaggctgcagactgccttgtactccctggacaccctcaaatggggttttctgtgttatttcataaaattctttgaagtccaataaagcatgtaggagattttaaccactgctggctttgactctcattgtgttctctgtgctgtggcatgatgggataaagagacaatctttcctttgcccagggaaaatgaaacttgaatgcacatacccagaagctctgtgggcagggttaccagataaatgcaggatgaccagttaaatgtgaatttcagataaacagtttttaaagtataattttctctcatgcagtatctgggacacatttttatttgctaaattgggaaaccctatgtctgggtaaacttgaccctatctatcctataacttcacttacgacttttaaaaaacatatctatttaatttttctttctttttttttgttttttttgagacggcgtctcactctcttgcctaggctagggtgcaatggcgcgatcttggctcactgcaacctctgcctccagcgttcaagcgattcttctgcctcagcctcctgagtagctgggattacaggcgcgtgctaccatgcctggctactttttgtatttttagcagcgggggggtttcaccacgttggttaggctggtctcgaactcctgacctcgtgatctgcccgccttggcctcccatagtgctgggattacaggagtgaagcaccgcgctggcctaatttttctattttttgtagaaatggggtctcactatgttgcccaggcttatctcaacacctggcctcacatgatgctcccgccttagcctcccaaaatgctgcaattacaggctcacttacgactttccatgatttttgaaattacttcacagggagcctgggcagcttctggagggcagtgagaaaccaacgaaaaggcttcagggaaaagatgccacagatgaaatttcataaagatcgctttgggtgtagcccaaatcagaagcttctacaccagccttacatattacggttctcatctattcttattctccactctaagtcaccaagtccatcctacctccacaaggcaaataccctgtctctgccaccatccactgaagaaccctaaaagcaaatgggtactgaccctgccctgcttaaaattctctcagggctctgatttgcgtcaggataaaatccaaacgccatcggccttgcgcggttttcttccagttccagagtgtcagtcctctggccgatctaaaagccctggggctccaagctgcccacggctgtggagcctgggctggagcccacagcggacggcagtgttaggattattataataaatgtcagagcaagaaaaacgttcccgccggttaggttttgttatttcaaaaataaattaaccgcctttcctccggcggagacgcgcaggtgagagggcggcgcctgacccagcgggctctaggtgctacgccagggccccgagggtcccgaactcggcttgcccacacaaaacatggtagcaggagagcagcatttccgccgggcatgtccatatccaatggggcccatgggagaggcgtagtcttctgggtcttgcccagactcaacatggcggctacacgtcgcctgtcagtctgtgaagcctaccccgggcgtgggccgcagcgtcgagtaacgtcattcgaaccccgtcgcgcccctttgtgcgtcacgggtggcgggcgcgggaaggggatttggattgttgcgcctctgctctgaagaaagtgctgtctggctccaactccagttctttcccctgagcagcgcctggaacctaacccttcccactctgtcaccttctcgatcccgccggcgctttagagccgcagtccagtcttggatccttcagagcctcagccactagctgcgatgcatgtgatcaagcgaggtgagggggggacgaggtgggcgagaaggaaggtgaggggatgcgggctgccgccgccggagctgatgcccagcccgcccgcccgccttcgctgcttcccgcctttcccgcatttcccgccgcggccttccgccctgtcagcccgctcggccttctgtcttcagtcagcctgcccc

SEQ ID NO: 12192 - DNA, 10451 bp, Human
ggattcctggttccctgaaggaggagagggatgatagcttggattccctaggtctttccaggatgcagaaagaaacaggctggggcctggattctgaggcaggaaggaatttgggtctggagttctggctacttgaggaccaaaggcaggaaggatcctgccttgattttacttcagaaaccaaatcagtcttctataatctggggtcggagggagtccctgtgcccaaggtctctctgcaccccaccatccacatgtatttttccttctatcccataatttattaaatcactgttctccccagagacagttgtcccatggatttctgggtctggaaataatattggattgggagtagggatgggttcctggtatctagggatcgaggcgaacgtccaggaggggactagagggacccacacatttgcacatgaaaaaatgtaggtttgggtggttgagtctctcagagaaggcagtgtccagacgtctgtgtccagggtctgggcagtatggacagggctcgctggagctaggtgcttggggacttgccttctgagcttttcttttactcttctctgttgttgttgttgttgttttgttctgtttttgtttttgtttttgagacatggtcttgctctgttgcccagactggagtgcagtggctcactgcagccttgacctcctgggcccaggtgatcttcccacctcagcctctagagtagctgccatcacaagtgcgcaccaccacgctggctcatttttgtagagacgggattttgctatgttgcccaggctggtctccagctcctgggctcaagcattcctcctgcttcggcctcccaaagtgctgaggttacaggtatgagccaccgcactggccgcctcctgggactggtgttaggggaacttagagggcgatgtctgggggctgatagctggggactttgatgctgaaccctgcagagtctgggtctccaatgggggtctggggtctcctaggtcctaggactgagtatcctggcatgccgttctttgggctatacagggtgtgtgtcgtgtgtgttggggcgggaggagtggagtggtctggacggccaacgactggaccagaaggcagaaaatgctaaagcaccaggataaacatctgtgggcgtcatcgaggttcccgggtggaggcgggaggaggggcggggcagggctttccgcctacccgagaccaaatacgggcacacacaatacacaccacacacgcgcgcacacgcacacgggcacacacgcgcgcacgggatcctgctccgctccgcggctcccccgccccggagagctccgcgatcagcacccgggacagcgccaccgcccacgtgcagggggtggggtccgggcggggctggcgcctcggcgtctcccgggagtgtcccgtccagccgccgagcaggtaggagctgctgggacccccgccctcagcccatccgcatccgcatccctagaggaaaggggtgtgcgagtgggggctggggcactggggagacaaccagagggagggcagcagcctgaagcggagagacagggatctggggacgcgagacaggtatggagaagacaaagagccgagggcggggagtggggcgcaggcggaggggagagggagagaccctggagacagaggccaggcgatagggaagagagacaggcgggttggggaggcagacacagggaagacgcctatgtggggtcaagaggcagcgtggagaccgaggcggtcacgagagcagcacggatgcgtggagagaccaacaggccaagaaggatgagggggctcagcacaggcaccgggcagcccccgacccgccctccagcaaaattggggagagggaagagggaacctgcgtctcagctcccaggaccaggtgcggagggagcagtcggctgtgggcgctcggaccacaggctgcccgctccccacctcgcgggacctcaggatcccagtcgggctattggggggttcccaggcaccggtgggccccggagcgagcctgccccgccgggactccgcgtctgtgcgtcagccccgcccgttgtcctggcaacaacccgttgcccgggcaaccagctttgctctcaccccgcttgagaggagcccggctgttgctctgggcaacgcggtctgctggttcccacgtctgccttcgcccgcttccggttcagaccctgcggaggggcgaggacgaggcagaagtcagcgggatgcctgtggggccgtggaggaagagggtatccctttaggatggaactaggtcctggacaccccctctcaagtgcggggaggctgatactacaactcccagcatgactcgcggtggctgtccggtttctgcgcggctgttcgcgcaaaggcctcatgggagttggagttctttgttgtgcgtggggctcaaaggacgtctggggtgggaatgggggactagggtgcttgagtgtctctgcagaaaagactccaggaccccgccaccatgttcccggagcccccaaccccggggcctccatcgcccgacacgcctcccgactccagtcgcatcagccacggcccaggtgagcaagacccgggggtggggggccgagcagagagaaagcctggccaggattccgaggggcgggattcggacgggtgtactcgggcaggcgggctggaaaatccggctgggatcccgggtcgtcatcctggactggaatgcgaacgaaatggggtaaaaggaaggaacagatttgcaaaaaaaaaaaaaaaaaaaaaaaaaaaaaaatcgaaaccggatcaaggggtgttgcatggaatgggatcttagaattggaaggtccacctagctcttcttttacagataaggaaacaggcccgatgaggagcagggcttcttgtaaaagcatcaggagttgagcagaaatggggggcggggtcgggtaaggaaaggcagaactaacaagcaagcaaatccagatggtgtcagcctgggttggggcatcgaatctctctataggccacattaggtggaagaaaaacacaggaagaaatgcaatgaaaatggctggagggaaaaggaggccagcattccagcttccacgtgtaatcaggactgaatcagcctgcgtgctgcccaggcctcaatgtgtgttgtctccacccctctgcagtgcccccctgggccctggccaccatcgtgctggtctcaggcctcctcatcttcagctgctgtttctgtctctaccggaagagctgtcggaggcggacaggcaagaagagccaggcccaagcccaggtccaccttcaggaagtgaaggggctgggccagagttacatagacaaggtgtggcccagcccagcccctccacctggccccttcccgcaccctgctcctctcaatggcccagctggtcccagtccctgctcccttctgtcctataggaacccaccttactggctcatcctccctgtgtgtctagccctcaactggactctggggacccagagatggaacagaactagttgctattcccaagaacttcccagtctggtgggagagtcaggcactgacacagacactcaccacacagggtaatatgtgccatactacagggtctcataggagcacagaaaaggcatcccactgtatagaaacctacagaaacatataaatatttggctctgggccgggtgcggtggctcacgcctgtaatcctagcacttgggaggctgaggtggacagattgcctgaggtcatgaattcaagactagcctgggcaacatgatgaaaccctgtctctactaaaaatacaaaagccagccatggtggtgtggtataatcccagctactcgagaggctgaggcactgaaaccgggaggtggaggctgcagtgagctgtgatcgcgccactgcactccagcctgggtgacagagcgagactctgtctccaataaatagataaataaataaatggctctgaaagctgaaaaccagctttgtgccagaatactttaaaatatgctgatttttttcagaaaatgggacatatttacagtaggaaaaagtttaaaacagagggtcagacagaggaggcttcgtggtggaggtgacttctgcactgagacctgagggacagagttaactgagaccagagagaaggacattctagtccaagttggagcatgtgttgaggccccatatccagattcaggccccatatccagattctgaggcttatttggggaacaaagagtcatttctcacaatagctgcactctggagtgaagtgtctggagaactcagcagtatccatgtcatgaaggtgatgaaggctacaaatatgttttgagcatgagagggacagggtcagatggtgttaggatgactcctctggaaccctgtgtaggacagatctgcggcgagggatccagggacgaggccagtgcagcagcagcctggagaggataaaagacatttgcattggatgaggccgttggaatggaaagtggtcactgcagggtctgaaaattaagtctctcagtgcagagtgcagtggttgcctgggagccagacagccctaggtttccaaccaagaaggaccatttcctggttgtgtgaccttggagaactcactgtccctctctgagcctcaagtctgtggtcactaacttggtatttcccctccttccttctcaataaggagctgttcaattagcatccgtaaaggatgctatttagggtcctggtgtccagccccatccctgtcccttaaaccagtgatgttcaaagaccgtctgcagcagaatcacactgggtacttgttgaaatgcaaattctggcactagcacctgacctatcaagtcagaatccctgaagaggtgacctcagacattttgccacaggattcaggggaattcaggttcacattgaattttaagaattgctggcctaggttaaggagacaccttctgctttttcattcaactttagaatggcaagtacacagtaaatatgccatttctcctccatgttttgctgtgctaagatcacaagtaaacatggcagtttggactagcaccccagtacatccattagcatgtgaaataaaacctgcattattcctgtgggcaatgggacactatcagcacttgttttaatctaagcatgacaagcacatgtctagttcctgcccatagcagacaccactaatcaaaccttcacaaacatactgcatctgtgttaccacgtctatttcctgcctgtggcagacagcactagtcaaatactgaatctgcttagcctgtgagagctcaggtatagcccaagggacctgtgagcctcccttggcttctgagcctgatggatactgctatcaggggaagacttcacccacccttacccctggctccttaaggtgcagccagaagtagaggagctggagccagcaccatccgggccagggcagcaggtggcagacaagcatgagctaggacgactgcagtactccctggattatgacttccagagtggccaggtgggtgtggaggaaggggaagctttggagggaggatcccgggggttccaaccccttctgaaaggagccatggaagggaggctaagactagtgttccccacctcccccactgtgcctgggccctgcagctgctggtgggcattctgcaagcaatgggattggcagccttggatcttggtggctcctcggacccctatgtgcgggtctacctgctgccggacaaacggaggcggtacgagaccaaggtgcatcggcagacgctgaaccctcactttggggagaccttcgccttcaaggtgagctcctgccttcaggccccgtgttccatagcctgtgcccagtccctggaacactagggaccgaccccttccgcttttcctggaggcggccacagctcaggtggcagctaccagctctggggctattccactggaccctgggcactactgactcctgggctgtagcctggtccttgggcggtacgatttgggttccactgacccgtgatttttttccgcatggatccctggactttcccatttgagttcccccaactgttcgcttcgaccctcgctgcctcactccatgccttccttctggttgtgctgtgcctcaccctatctctgacttcctgctctctactgcggattctctgtgcactccaggtcccctacgtggagctggggggcagggtgctggtcatggcggtgtacgacttcgaccgcttctctcgcaatgacgccatcggggaggtgcgggtccctatgagctccgtggacctggggcggccagtgcaggcctggcgggagctgcaggcggctccgcgggaggaggtgagcatgcgcggtcgcgccccgagccacgcccccaggcccagtcccgcccacaacatcctgagccaatcagatcataggctttccagaccctcagggcggcgtggattgtacccctgaggaggcatggatgtggagccggggctctggtgatgggcccctctcctttcagcaggagaagcttggggacatctgcttctccctccgctatgtccccacggccgggaagctcaccgtcatcgtcctggaggctaaaaacctgaagaagatggacgtaggaggactgtcaggtgtgtgggaagcaagggagtggggtgtgtggggatggcgtggggtgggttctcgttctgacagtttctgagcctcgagggtttcttcggggacagggaggacctggctgctgtggaaggcatggattttggcatagagctagggagacccgaagggtgtaggcagtgtttctatgttggtccaacaacccagcagtggggagctataagactcctccttcctctccccagatccatacgtcaaggtccacctgctgcagggcggcaaaaaggtgcggaagaagaaaaccaccatcaagaagaacactctgaacccctattacaacgaagctttcagcttcgaggtgccctgtgaccaagtccaggtgagctcaaacctgcccttctccaagagcccagacctttagtaatcgccattgctaggcggagggagactttttagcatctccctagaaaccaggtgagggggtctgaggttatgctctcagtctgtttcctcctatgaggaccaggaagcctcttccactccaggaagagactccttaaaattgggtgtgggtgtcctatctgctctaagcgggaccgggatgtcccacccctaagcagtaccagatgctccaccctaagcaggatcagtatgccccgccccaccaagcggaaccaggatgctccgcccccaagcaggaccaggatgccccgcccccaagcaggaccaggatgccccgcccccaagcgggaccaggatgccccactcctaagcgggaccagattccccaccctaagcaggaccaggatgccccgccctcctcaggaacgtggttctaagaaaaagagacctcccctcacttctttagggacggcgcctaccctagcccggcccctgttaaagttctgcagctttgcggctcttaggaggctgctcccccaggaggcgccgaacacacccgctccgcaaccgagtcctgagggttcatttccttagaaacctggctgcgcaggaagaaaggcgccagagcctcctcctcgccgcaggctccgtccctctcgtctcccaccccctcccccgtcccgagctccggggccccgagccctcgggtggcagcgagaggtaccctcagccgtgaaaacggacaccgccccttccggggcctcctcccctcacgctcctctctcctcttcctcccgcgcccaccccagaaggtgcaggtggagctgaccgtgctggactacgacaagctgggcaagaacgaggccatcgggagggtggccgtgggggcggccgccggcggggctggcctgcggcactgggcggacatgctggccaacccgcggcggcccattgcccagtggcactcgctgcggcccccggaccgagtgaggctgctgcctgcgccctgactcccaccccaagcccccggccaagcctggactctagcccctgaccccagactcccgagaccggccaaagccaagccagccccacccttaagcttcctctgacggttaccctccccccaccttccaccccaaccatctgaaccattcctgtcttctcacccccaacgatgccaatcacgacaactttccagcacactcccccgaccctcgcggacacacccagatgccccagggaccccgggaagggaaggcagcctggtttctcctgcccccgggtcctgccccctgctttgacaatcagccatcctcgtctgctctcctctctcttccaacacagcccatccctgcactgctcctggggccaaataaatattcagcagctccggtggcctgggcccatgctccttgatgggggtgggcaagggctgggacccaagaggaaacctcgtttccaggaatgggcgctcgcagggcggtgtgagtgctgttcgtcctgaaagcctctgagagactggcctgaccccatggactccctcacactctcacccgttcattcctcactcaccactctgagcctgggtttcctcctctggagaatgttgggataataataattcctgccacacgctggctgtgaggagtccgcgagaactcccttgcttgtccatgaatttatccactcgcttgctcacccatgactcacatcgattttcatacccatttctgcatccctccctccctctcttttttttcttccttccattccatattccctgaggtcttctgttgagtgctggggccccagaatatccaaacacagacctgaccccccaagcgacttactgccatcaaaacaaaggagaggcgcggagccagggaatacaatctccagagcctgcgagagaggttggagttcagcaaggaaagccaatgatttcaacttcacctctttcttttttcttttcttttttcctttttgttttctttctgtctttccttttctttctttttctcttgttttttttttgtttgtttgtttttttgtttttgtttttgtttttttgagatgaagtctcactttgtcgcccaggctggagtgcagtggcacgatttcggctcactgcaagctcctcctcccgggttcacgccattctcctgcctcagcctcccgagcagctgggactacaggcgcccgccaccacacccggctaatttttttgtatttttagtagagacggcatttcaccgtgttagccaggatgatctcgatctcctgacctcgtgatccgcccgcctcggcctcccaatgtgctaggattacaggcgtgagccaccgcgcccggcccttcttcttttcttttcttttctatttcttttcttctcttcttcttttttttaattttgagacggagtttcgctgttgttgcccagaatggagggcaatggtgcaatctcggctcaccgcaacccctgcctcccgggttcaagcgattcttctgcctcagcctcttctttcttctttttttgacagggtttctctgtgtaccctggctggagtgcggtggggcaatcatagctcactgcagcctcaacctcctgggctcaggggatcctcctgcctcagactcctgagtagctgggaccacaggcacatgcaaccatgcctagctaattttttcttttcttttcttttcttttttagagatggggtcttgctatgttgcacaggctggtttcaaactcctgcaatcctcctgtgtgagtagctgggactgtagacatgagccgccgcatctgacctcattgttctttcaacgaatgctgcctcctactctgtttctagcaaagatgatagttccattggcttctaccttatctcatcccatacagaattttgggtggtgaacaaagacctataagatttggccagagaactctctgagcagcagattaagtggagaatgaggcaaaaattacccccacgtaccaaaaaaggaggcagcaaacaaacttacttgctcctaagcttcctggtagccaatcgggaaagtgaaaatagaacagctacacagattataatatccatgagatttttaatttttctccaaaggaattcagtaacttttcatgtgtgtgagtgtgtgtgtgtgtgtgtgtgtgtgtgtgtgtgtgtgtgtggctgtagagcatgtctttatgaagacagccctttatgttactactattactgccaataataatcctcacagcaaactcatgaaataaacatgatcattattcccagttgacaaatgagtccaaactgtgctttagaaaatttggggctgggcgtagtggctcacgcctgtaatcccagcactttgggaggctgaggtgggcggat

SEQ ID NO: 12193 - DNA, 12411 bp, Human
cgaattacagattcagggagatttaagaaacatgcagtagaaggaatgttcgtgtccctccaaaatgcatgtgttgaaatcgtaacccctaaggttatggtattaggaagtggggtctttggaagataattagatcatgatggtgcagctcttatgaatgagatcagtgccccgataaaagggactttgaagagctctctcattctttcctgccatgtgaggatataacaaggagacaatatgacagtctgtaacctggaagagggccttaaacacaaccagaccatgctgacaccacgatctcagacttccaaccttcgaaactgtgagaaataaatttctgttgtttacgtcacccagaccatggtactttcttacagcagcctgaactaacaaaaccaattgtaatgtatggacttcattataattctgatttcaagtagtaaactgtgtgggccggaattaggaagcaatgagaaatatttgaatgctaactggatatttaatgtaaggaattattttatgttgttttaggtgggataatggcgtggatatgtttttattttttttaattcctacctttatacagacatgctgaaatatttacagttgaaatgattaactgtctgggatttttttcaaaataatctcagtgcagaggaaactggaagggttgtagatgaaacttggaagtggatgtttctctctacttttggatatgcttataattttccatataaaagttctgaaaacggaaaataaaatgctcacattgtgaggctaaggccaaaagaaatcagagatgcatgagaatttccaaattcaggattatttaagaacaacatagagaaaaaaatacttctggtttgagttgcaaaaatttatttcttttatgcaatatactaaaaaatcataattaattgaaaaatataatacttcatatgtaaaggggagaaaactactccaccaaagatgtcacatcttttaattcatttggagatcaaagaaatgtgtctgccaggcaaccaagggctcatggaaaggtgtggtttctgtacaaatgctatttgtctaatattttgtgctgttaatgactgtcccattagcatcttcactacacttactttcatagaaaggagaaacatgatttatagagccctttagtgacaagggtgaggatcctacacactatgttgctggtttcctagtcttcagcaagaaagtgtaggagagaagcaaaaaacgtcctgttcaacccctgctcctggatgtggcaaggaagaggagttacccggcttgaaacaaaagaaatcctaagtctgacacacaatgtcatgtttaaattcccctttctccaaaatgtaaaataaatctgcttccatcttctaaaatactatgggactaaacatccttttgttatgctaaggaaaagccagtattcgcgttgatttagaagagggatgttctggttatagaacgatgctgtgtctcagaaacacttaaatactattaagctagaaatagaagggaaaataatgcttccccgcatctcccctcaagtgtagtcctctttttttagcctgatttccgacgaaatgtctgaatgcctacagttatttggccatcctgaaaagtgcaacttatcctgacgtctcgagggacggaaaagttaccgaagtccaaggaatgagtcactttgctcaaatttgatgagtaatatcaggtgtcatgaaacccagtttcgaaggagaggggagggggcgtcagatctgcagacggaagcaggccgctccggattggatggcgagacctcgattttcctaaaattgcgtcatttagaacccaattgggtccagatgttatgggcatcgacgagttaccgtctcggaaactctcaatcacgcaagcgaaaggagaggaggcggctaattaaatattgagcagaaagtcgcgtggggagaatgtcacgtgggtctggaggctcaaggaggctgggataaataccgcaaggcactgagcaggcgaaagagcgcgctcggacctccttcccggcggcagctaccgagagtgcggagcgaccagcgtgcgctcggaggaaccagagaaactcagcaccccgcgggactgtccgtcgcagtaagtgcccgcgcggtgctggccgcggctgcccgggtcaccccgccccgcatctgtccgaggtggccgcgctgggggcgccgctgcggcgagggacagtggggagactggcttcccaaacgccaacgcccctctttgtcttccacctgcagagtttcctggtttgaaggtgtgggttggtgggttagggggctgggggagttgggattcagggagaagagggttggagaatctttgggacgcgattctctcgcctaaccggtacaggtgagacttcagtccttatgtttttgatcttggttcatccgttgtggggcagaaaattctgttgctttaactcttggataaccacccctaatagatacattatttctctctttggtgtcttctcctcctaccccttcccagaaatccaacatgaaaatcctcgtggccttggcagtcttttttcttgtctccactcagctgtttgcagaagaaataggagccaatgatgatctgaattactggtccgactggtacgacagcgaccagatcaaggtgaggccccttcccaggacggcccgcacccttcttcctgggctcgggagctgtcaccttcccacgcaacagcaccctagttaacgtggcacgcaccgccaccacggaaagaggcagcggttgcgtgcgagaggatggaaaggggcactatttcccgggttccccacgggattttgtgcccacgattcaagtttcttcccgagggctgcaccgtccggcccaggaactccctgcagtagggatgccctcccggatgagcccgagatcctcacaaggcgggaaatctcgtaagatttcatcccccaggacctgggatttcgggggctccggtccagctgcactgccctagcgtctgggcacgggcagaggagggcgcctgggtcgcgggcagcagcgggcacacgcgcgagctgcagggggattggagggccggaggctggagggaagttaatttcctgccttcacgtttgttttgcggacctgaggatgtagcttgaagtctccctttagaaactcgtaggctacaggcgctggggagcgcgcctcggaaaaacggtgaaagtcgtctgtaaagcgttgtcacccttccccaccggagccccagccccagatcccacacacctgtgtgcatttagggcggtgaggactctacaaagccggcaccgagacaagacaaagtcaggtggcggcgcagcagatgagggaaggtccccgggctgggaggaaagagcggaaagcgctcgaagcttgaagacgccgagccagctgctaactcgccctggcaggcttgcggggggcgggacgcgagttcggcggggaggggcgcagagaggcagcgcctcgggagggaccccgctcagcccgagcgtggggaaggccgcctccccacgcctcggggccggagtacagcggggggaagggctcgggttgctgggtgcctcgctctggttgccttacacgccctttgtccgtgcttttgtctcccaggaggaactgccggagccctttgagcatcttctgcagagaatcgcccggagacccaagcctcagcagttctttggattaatgggcaaacgggatgctggtgagataggcgaccgtccctaggtgtcttgggcagcccgccctgtctgctcactccttcctggagtaccccagggtctctcgctctgaatagagatttccactccaagaggggtgtaattccccaggcgcgacattggcccacaccgcactaaggcacgcacgggcccgcggggggagggaaagatctggttcgcatgcctcactgtattcgagtgaagcgctcccttgactaaagatccaaactgacaaagggaaggcacgggcctccaggggtagtactgcggatgatccaagtgcatgtggaagaggattttatagcattccctgaggtgagagtacatttgtcttgggatagaaatatcgtttccttgaattcatcgcacggtcagtggaacatgtagttaatgacaattcgtctcttgtcagattcctcaattgaaaaacaagtggccctgttaaaggctctttatggtaaacattcctataaatctttattttactattgtgaaagcacatgtaggaaagtgaaataaaatcttttatgggctgaaatacaagatctgggtcatgcctgtttaataaagagatggatttgcgcactctctctcggtttctctctctctctgtcactctctctgtctctctctctctgtcactctctctcagtctctctctctctctttctctctctctctcagtgggtggccagccttgaaggtgggatgtgttacagtcttatagttaataagaggcctcagaagtctcatagtcctaggtttgaatcccatagaaggcacttaataaaaattccatttgtttgtttaaatatttagtttttatgattaataatttgtttagcatttatggttctgctttattcctcaggataatatatagatagaaaatgttacatattttgagaatcaaattattttataaaagatataatgtagcatctttaaaaacaaatctatatgtgtttgctaattttatctttcttctaggacatggccagatctctcacaaaagtaagttcaaaattattttgacatttatcaaatttaaatgtaaaattatattgaatttcactttatttatcttaccttattttctgtcatgactctagggcttaatatgtttaatgaagacaatataagaatgggggagattcatattacatccagaatatggttgtttagacatattgtacttagcaaagagatgcattatattaaaaaagaaaaaaatgtcttttaagtcccttcaattgttagttttagagaagaatttcaatcctaggattagaaatctaccatacatatttcttcccagccacccaccccctaagcttactttcactgtaaacaaacaaacaaacaaacacgaaacccccacaagcatttataggcatctcctaactcattttagtatgcttggtccaataatgatgtcatttattagggtcatccagcagccaattaaatggaatgagtgagtgaacatgagtagagaatccatactaaaaatgaagacggtagagatgcagttttttaatcccctaattgaatgggaaaactcgatcagtaaaacatttcttagggcagcaaagatggcaaaattgtggtatgtgaaggtcattaaatttgtttctcagttaatggaaccggagttgacaagaagtggaaagggtctatcttcatcgtattgtccactcacctattgtaccctgtcatggatttggttcattgggtggcagagcaggccacattaacgtagcagctctattctcaactattaaaataaaaaccaagagaaattctctcactagcattaaaatagtaacctttccaaagagttcatctttgaaaaataaatagtattcatatttactttctaaggatttgactttgaagagaattatatataaaaattctatgtaataaaaaatgtactctgttcatgtgaaaactaataaacttttctgaaaggagtatcttttaatatccaataaaataaaaacagtgaccttttagaagattataatcatcaaggaaaggaatctggtttaattaaggtctacttgctgagaagtacaacttattaataacacaaggaattatgcttggatatttcactctcacacaaatgtgaaattgacttcctaaaaaatcaaacctagctcaaataacaatattttatataaaatattttagacccttacataacagataaaatatatgaatagagagtgcttgctaatattaaatatagaattaagaaaagtggtttcattgtattgttttagtgtaatttataaaacttttaaggaatctttatttcttcagtctcaccaaaacttgaagtagatagatatttattatacagacatatattcagaagcttgctttgttctggttataatagtttgtttcctcaaagatatacatattaaaatacccctaaatgtatttttccaggacataaaacagattcctttgttggactaatgggcaaaagagctttaaattctggtatgtatgaaattatgactgaaaatagacagtatctcaaatctatttctattttttctaagacatagttttaaaatattaaaaaggagtggtagatataaaaatgagtattatggtggaaaaatttaattgttgtacttgtaaccacaaatggatttatagctggttaagctaatactaccacagtatctgtctatttctctccaatcaccattcttaccagtgtctgccccatttaatcattaccaacctgaatctttgggttagtgctatattctttcctatagatctgttaaataagccgtgtttaaccttactgaactaagggggagtggggagtgcagggaagaatgagggtgattttcacttgttatcaaagtaatttgaaagttttacaagacattacatttggcgatcttccaatacaaaaataaattcacaaaacaaattctttatgcaaattaatcactttttatgaagttgtagaaattcaaaatctaaacatcctgatggatgttggagaggacaaaagtgatacggtttattccagtactttcaaaaaggaacacaattaaatatccttgagtgttataaattggttctggctataaactccttagagagaaaggatgccacaattctcattttaattctgaacaactttttcgtatgatataaaggctgcaggtttccttctcttcaatttccatcttctttgtaaataccacgtacatatatctgaaaaccattattagttaactcattcatcacactgatttcaatgtaaataacccctagatcattttaatagaagctcactttttgttaagaccttatagctcttacctctagggcttcttggaaaagctattcaaattctattttgccttcagtgaaaatagaattaaaatactaaatacgttattaattataaagtaatcagcagctgtcttacccatttagaatatttccagtttctagacaatctataagatgtgctggcttaatccttaattatctggatcctaggaaaaataattatcctagtgttttttaatggagatttttttctttattgtgaaatgtaagacttgggtacattaaataaaaccactttctgtggggcaaaaatcaaaacgcgcaatagaaaaaaaaagttaacacaatctgggctacggcagaagccagagaatatattcatataattgaaaagttctaagtgtttcataattgaccttttgatacaaaatttccaataaatctggaatttgaagttcttggtgaagtccacaggacttcctagtgttcttattgggtccccactttctatttagacactacctttgcatcttctcaccagtcattttgggctgccgaagtgtaaaagtgtaagaaattatcaatgtgccttaatgaaaaacttgtaattgttttattaatatgtattatcttcccacttttggaaatgaaatataaatttaaaccacaatggcttttatttgtaccaatacatactagtcctcacttaattgtagttttcttgataatcatattagtcatcaactttccatttccagaattgatataggtttcagaacatgcttaactttacaaatgtagatattgtacaagttagaacagattaaatacaattaaatgtacttaaaataataacataattttaagtagtgataaaaatcactgtagtgaatcaggatcaatttataactaaatctttgttcctccattttagttaaggaaatataaataggtgaaatgtggaaaaaaatgtgatatgatccacagtcaatcagggatctttttatgtacctcattgaggcaaggttatcatagccttaatctatagccctctgatctttacccactcatggtcagggacccctttgacaatctgataaatctagatagatgccctttcccagagaaaccctcatcagctcatacactcaaaaatttatatcaggcttcagagggttcaaagaccaggtaagaaactctgcttccatgtaagaggacattatgttccagctaaatcactgtctgtctttagttggtttacattagctttcatctaatttctctgaggaatagagtcatgttacctaaagcttgtcagagactgaacttgggccattcatcctgttcctaatataatcaaaccagaatgagaaataaactgtttccttccctcacgcctgtccagtgttggctcagactgttctgcctcacaagtgcatacttaattgatgtaaaatatgcagcttattgttaaccgcacttaaaggatagctgggtgtttaagaccagtattaaaagagggaagtgataatactggtgcctttacctgtcttctctgtcagcaaatcttctcactgaggaaactgtttagagtagcacttattattcctacagatccttcacagatctttctactctttctgtttacattcagtattttatacaggccatactgaatttcaaaaagcatagtagttccactataccatacgtctaagtctataaggtattcgttaaggatgaaaaatatcccaaaatacttttattgcaacagtctgatttttacccctttgtggttacagatccctttgaaattatatataataaatataatataatataatatacaattttggcatttttttgtccagataatcaatgtatttaaattacttgctagctatatgttaaatacctttggaagcaataattaatgcttcacaggccattaaggtgctagtgaaaagttaaacagtatggtatttagatggctcaactgacttacctatggtaaatgggctgtttttagtcttgagggcagtccatcactgggaggtatccacaaggtaggaagagacccctacacaattagatgccccttgaacaaagatcagcaaacttttcctgaaaagaaacagattataaatattttaggctttgtgagccatgtaatctctgttgcaactacccaaatctgttattttaggccaaagcagccatagacaatatgtaaatgaatgagtgtgtctgtattcctataaacctctttacaagaacaaatggtattctagatttggcccatggtctctgctagaataaaagtcccacatttggtttttatcctactagtattcctggttattttaggcattgtcctttctagaattcactatgggtatctgccactgcttgagaaagctgctgagaatcaacactgcaatatattgtggaaatatgctttgggggcaccaagtatatgatgaatgatgaatgaaaccgagttctgtggttagatcatttccaatcagaatagagactgaggcaggattggaagatgtgcagataacattcttagaaatacttctgtagagggaaaatgtcattatgagtttaaaataaattactatatgccctgaactttagttgtgtaactccctcagtgaattcacttaaaaaacactttatctcttctttgttttcagtggcttatgaaaggagtgcaatgcagaattatgaaagaagacgttaataaactacctaacattatttattcagcttcatttgtgtcaatgggcaatgacaggtaaattaagacatgcactatgaggaataattatttatttaataacaattgtttggggttgaaaattcaaaaagtgtttatttttcatattgtgccaatatgtattgtaaacatgtgttttaattccaatatgatgactcccttaaaatagaaataagtggttatttctcaacaaagcacagtgttaaatgaaattgtaaaacctgtcaatgatacagtccctaaagaaaaaaaatcattgctttgaagcagttgtgtcagctactgcggaaaaggaaggaaactcctgacagtcttgtgcttttcctatttgttttcatggtgaaaatgtactgagattttggtattacactgtatttgtatctctgaagcatgtttcatgttttgtgactatatagagatgtttttaaaagtttcaatgtgattctaatgtcttcatttcattgtatgatgtgttgtgatagctaacattttaaataaaagaaaaaatatcttgaagatttttgtcacatgtcttttattaacatttatgtccaattagcaatctttcctttaataggtgaaataggttcaaagcggttttgtctaaaatgcagtttctctgtcatgcactttttttgctaaatcacttgtcatgagatcatttatgaagaacacaattgcattttgcattccaaagagtaaaggctaagttctggttttatatgcttttaattcctttttacaaataggataataatctatttcaaagatatatttcactgattattttcttgttgagtaaaacatcagctcactaccatttcagccctgctcagagcccaggtataaatgcatcagtgcctgagtctcactagcattaagatagcaaatcaaattctcacaaagattgtcggaagatgatacaggaagatgaggtgttgataatagggcaacaccctcacagcaaaaataagaactcctttccagcatttctaagaagtgcctgtgaattgctaatacctataacactctctctgtctgatagaagcacatgcgtcaggaataaataccaagcattgagagggaggcttgtgcattttgattgataagtgtccttggaatcattttctgattgcatagagcatgtgaagtattgaccagtggtgaaacaatgcagacaagcactgttcagtgaagtaaaaaaaatgaatttagcctggactggtgactgttggtgagcaataaaaccatttgtaggagagaagagctaaagcatattttaacatacatattttcaattaaatgtttttttaaaaaactccaactcatattccttagtacacaatacatctaaatatgaaaaattatataatggtaagcaaaatggagaaaaccagagtcatcccctagagccccactccccaacagcaatgtttaacattccattgaataataattataataaataatcattagctaaaattatatatgtacttaatcactcaatgacaaaaataatcgtcattattatcattttacagatggggttatgaagcttaacaaaatgctggggtcagagattataataggagtcaggattggaaataaactgagggggaaatagagcaaatatctaacaatgaaattgattaagcaaacgtactaaaacaacagaatattatacagtcatttaaagcagcatcatggtgtatttaataatgtggaacatatatggtatgttgttagacataaagcagtatttgttatatatatatttacatatgtatttacacatatatatatagtttttctgcatagctgttgtaacaagaggaacaattttagtggataagcacatgggactcaatgtcatactactcaggtttgaatcttggctctatcacattatgaatggccttgtaaagatgggcgagtcccttaacttttctttgccttattttcctcatcagtaaaattagaataacactagtactcactacatggcattcagctgagggttgagtgaaatgatgcctgtaaagctttgaacacactctctcacacacagcgagcattcagtgaatgttacctgttcccattttaagctactgttcaaaatgccagtgtgaaaattagttctatattttagccataaaaaatgtttatagtcactagacacactgaacaagcaacagcatggggtggtatttaaatctttgcttcacaaattaaatccaggctatatcacaaatttgcagtgctttgtgctgttcattgctgcactaaatagtccccgtggctccttcccactctgaaattctataaatctctgtggtatgatcccacagtgctacataaagacatgcattggcggaacttcactcatgcctgctttccctctaggcccagaaacccagtagcaacacaaataggaaaagggacagaaacttcagtttaagtttctgctcaaacaatttattattactttctctttgtgctatatttcctttaaag

SEQ ID NO: 12194 - DNA, 17478 bp, Human
tgtggtgtgcctgcgcggttggggtgtgtagatgtggacccttcgaggcccttctgcgttttcttcgttgcgtacgattgtgctccgttggtgttctcagcagggatctgattctgtgtgtgggggtgtgtggcccctgcgactgtgtttgggtggtgtcgtcgttatgtcgggcgtgtgtgatcccgactgtgctggattgtgtgtccgtgagccgctgcgtttgactgatttcgttgtgtcctgttgggcagtgtgcggggctgaccaagtcggcttctggggcagtgctaggtggtgtttgtttgctgcccttctgtggggctggaccctgtgtggtcctgtccgcactgagttgtatgcctgtgtgcctgtgtcctttagaggtgcgtttgcaaatcgctgggggcgggagtggggggagggcgagcgagagatcgaggcgctggtgggggcggcggcatgggggcggggagcgggatttcacattttattccaaattatgatgtattcgggagccagttgttggcttgggtgggcggacagcgcccggtcggcggctgctctgcccggaggcccgcctgtgcctaggtgtttgaggggttcgttggtgagtgggaggctcctccaggcttgaagctgagcagcgctcgccgaggccggcgccttcgagccggtagctgcgggcttcggttcccgctgcactccggcttcatccatttctggtcagtttcgtgggtgcggccgccgggctccaagggagaggccccgaaaggacaatgggcacattcaccaggcctcgagcctcgggtggggacattcgggatcacctcctgggaagattttcccgccccctcttcgggtgagcgacgttgccgcttgggtctgatacccgtcgcatccgagaccgaggccgaatccgggctctgggagggaccgggttagtggggccctagctcgggttgaaagaattttgttttgtcaattattgtaattgctaatgccatcaccatcacaatcgtcatcattaacatctattttaattaaaataatcatcccagagcgcagcagtttgtcccttttggctcctttggcgggagaacaaagcagcgggtttttttccgctacagccgttttctaagttgctgggtttgaggtaggaagagaaaatggagagaggcacggacacagagacttggtcataaggcaaacattaacccccagcgaacacgcaacattaaccccccgcgaacacgccgggaatggatggattcccctcttctttcctcccctcccctcttttggattagaagaggagaaagaaaatcttccgcattgtattgcaatccagggaagaattattcctatatgtccaccaaagccgcggcaaatagaaggaggccttcgcagttaatccaagacttcgatgtgtgatcataagcctgacgatttaggcaaaacaaattaaacaaaatccactaggaaaaaataaaagcaagctcaatcctgctacatccttgaaagtagtgtcgggtttgtttttacctcctttccttttaccttgtttattgctgtaacaaatcattagaattctcccttactctgtctaaaccccgaaaaatcgaaaatcatttcgtaggggtggtggaggggaaggtgggggacttttcccctttgtttctttctttccccctttgttggtctttatttccttttctttttctgtctctctcttcctctctctttcttctttctcttaatcagtagggagacgagaaaggacctgaacagatcagatatctctctccaagcccccttcccaactccatttctgtaggaaagtacagcccctggaattgggttctggtttcgctttgggctggaggtgggtggatgggggtcagagagagaatgaggtgggggggacttcaaggttctgtcccaccgaccagagtctgaagactattcgcctttcccaacacggacctccgcccatccaggcccgggactatcccttcgcggtgtagcggcagccggagacctggctgaggaggcaaccgcgtagacacctccctgcttagaaaacaaacactgaaccagaccgatcccagttggagggttcgaaaatgttccagacagcctgtcgggaggggttgttgttgctgttggactaaatagctattcctgattggtcatgtatagggttttttaaggcgggtggggggaggagggggtagaggaaaggctccaaacacctgcaggttgggggcggaaagctgtttgcgattccctggactggttggtcggggacaggaggtaattcccagccattgacccccatttctctctctccctccctcttgccctgcctctttctctccacccctatctttcctggaaactcgctttgggcgcggcagatcgcccaggaccacaccgcagcgtaactgcaggcctctcagcgaaaaagggggaaagcaaagacccgggtgtgcatcctcttcctcggcttccgcccctttccggcggagtggagatcctattcagaggggccggtctctctaaatatgccccaggtgagttttcaggggaatggtgccggtggaaacggtgtctaggaaggccttgtgttccggcctggggtgaggaaggctcaggacagaggagagcccattctcagattgggggtggggggaggggaggaccagccagagcttggaatcgggatctgactgctgtagctgcctctgtggcattcagcggctttttcccttttccacccagggtaaaaccagctagttggacttagtcgtccaggcctttcccattggtcccggttctgtggacgtttcccaaggccggtaactttggggcggctgtatccgggtggtacagactgtgcctggagctcccgcaggaggaaggcggcagccttcctggctagtgcagtcccagctcgagtgggccctgatcccaggcctgaggcctagggtggggaggcaggaacacccctcttctccggtagaggcgaggatggtggtgctgttccctggtgggtttggtacttgtgcaggcttggggcttctccagggtgttgtgctggtgtgggcccagaagagagaccagaggctgggtctaagggcctgaggctgttttcatctaagaaattctctgtatgggggattgggtctgcttgagacctgtccccaggaagaatctcctggggtcttctgtcttgttctggcacaggtggaaatattctggctgtctggcaactgcagatgaggatttcctgttgggggctataagcagggtctccgtagtacaaagagagaggagctgtagtcgtcaaatactctagaacgattcagtctaaaatctccctcctccttcattctccccaaataaaaacaaacaaaatctctcgggcgttcctttctgtaatccaaatcaagtgatgcagcttagtcgccaacaaccatcagtgtttgtgagtggcttctttggggcatggacctctggctggtaatcctaaaccggcaggattttcctaaaatgtggggaggagccgggagaggtcctccacagatcctgggatccaatcatatatttcttacaaggaaccttggcgatgggatatttataggtgtctggagaggacatttgtggccagggtcaattcatctggaatatgtactcccattgcctctcaggaatccaccgctagagcaggagcctaagaattaattggagggtaaaaatgtgtcataacagagcttgagctcagtctgcaactgcagtgcacactgtcactcggttagaagctggggcttaagcatggatcactgggctcacaccggtgtgtcaggacggagagcagtgaggtagggaaccaataccttgaagcttgtatgtttcccaggggttggtatatttctggcacatttcgctgctgctgggagcaagaggacctggctgatatacttctggtgcatttccagtggccttggtgtcttggtggttgcattctatggatagagacctattgtctccaccaaaatcataaactcacttccaatgaagtgtcagggacctactgcctttacagcttgtatacaccaggacttagggaattttgtggtttctgtgccagacctggggggctggcattcccaaagaaggtgtacagcagtctgaatcttgactctctgtcatcctgggtgtctagtggcaattgagccaagctccagaggaggctgcagatgatccattctcccttctggggtgggagggatggttcctaggatgactcctgtccagagcattgcagtggcagtatgggagctcaatggctgctatgtatgatttagatggactctgcatgggggtaaattgtttttttgtatttgttttcttcttttaaatacccaattatataattcagagagcagaaagcttattttaaacaacttatgtggtgttgatcatatatgtacaactcacaactcacaaactctggcccttgagtctcctgatttttctgttttggttcttgctggtgcccagctctatctggatgaagccaggtgatggaagagccccagcacacctgtgggaagtagagtggctgtggtcatctcggagtatgcttgtgggggcacaaggtggtttcactgctctgggaatacaggagggttgagcaaagtgagattattgctctggtctggctctctcacagataggctgtgagtgacttgacattcggccaggcagttttctcactggcccattctccttgttaataatgtttacttgaacgtttgcacagcactttcaaatgcataaaggaggtattcctcccatttcccaaagaacaccaaggcaggagatggcggtgaggggggctggaagagttcaagggcctcatgacatcctgtcctgctcttggatgggagtccagaccccactggcctcagggaacccttcaaatgcccagctccattctacctcagccaggcctctctttgagactcgacctcacttcagagtccagctgagcagaacgaggtggactgtgcagggaggttgggccagcaccatcttcttcccttggcgacctctcatctctgtctgagtgggagtaaagatccgctgggcgggcagaggactcacagtggatttgctcagtgtagacagacactccctcactccccagcgggggcgaatgtgtgtgtgtgtgtgtgtggagggagctggttcctcgggattattctctgccagctctggcggagtggatcccagtccccgtagcctccactttctaattccctacttccatccgcaccgggtttctgggtgtgtgcctgtaggtgggctgggaatattgctgagaggccaagggaggttcctaaagcaacgaacccctgcctgacagattccccgctaaaaccaaagagcacgatccggaatttgttccctcctcttccctttaggcctgagaaaggggacagagtaatctctttcttgcctccttgtacatttccttcctcctgatttccccttctgtgtttctgtcgctggctgtattccttttcttccggtgtctctgtcgtcttcctccatctctgtccttttggccctcagtctctgtgtctcccaggcacccctcccttctcccaatccagagaccctctttccctcccaccctagccccaaccggcctcccgccctagccccacgtggcgctaactttgtctgcctcttctcacgtctcggtgcgtgagttcctctctctgcccttctcccctttaccccagcccacgtcggtgggtcaggggcggtcgtcagagcgggcatccgcttgtctgtctgtctgcccacaggatgaccgagcggccgccgagcgaggcggctcgcagtgacccccagctagagggacgggacgcggccgaggccagcatggcccccccgcacctggtcctgctgaacggcgtcgccaaggagacgagccgcgcggccgcagcggagcccccagtcatcgaactgggcgcgcgcggaggcccggggggcggccctgccggtgggggcggcgccgcgagagacttaaagggccgcgacgcggcgacggccgaagcgcgccatcgggtgcccaccaccgagctgtgcagacctcccgggcccgccccggcccccgcgcccgcctcggttacagcggagctgcccggcgacggccgcatggtgcagctgagtcctcccgcgctggctgcccccgccgcccccggccgcgcgctgctctacagcctcagccagccgctggcctctctcggcaggtcaggggccaggggccaggggccaggggctgggcgggtgggcagggcgaccacccccaccggggtttccttctacacatcggcggcggcctgccctgggggccgagcgggtggagcgcagggagaggaggtcgttttaaacccagtggctctagagcctcaagctggagcccccgagtgagtgccagtgagggaggggccttctgtgagagagagtgtgcgtgtggctgcggggtgcatggctgtgtggaagccgagaggaggacgtggacaccttcgcgggtgcaggcatgtggctggtgtgcttggtggtggtgtcgtgggggacggagaggaaggagtcccctgagcgtgggtaccaggaaagagtgtgcctgcatgtgctttgctgtgagcagaggtagatgtttgtggtgtgaaattcattcggaaactcagcgctagctggacaggcaagagataaggatctgagggtggtggcagaggcaccctcccccgaatctctgctggagggcccgcctgaggactgacctgtccctccactcccagcccctctgctcctagccgtggtctctggccccagcctgtactccggttggtgtcagggcatccgtttccctgctggcgctactgtgatgatgagggagagaagccatagggttggaatagaaaccggcagatggggcagggatagagtgtggggcagtcaatgaacctggcgggcacccgagacagagctatggggagcttagggtgggtgagggcagagagctaggcggagcatttcagctgaggggagtcagggtttcctgtctgttgtgtatctacagccccttatgggtggggtgaggtggggagaggggacagtgtgcccctttgtggtgaccaagatgcacaccatcaggtgtgaaggttacatttgcctgagtgggcatgtgtttgggagtggaggtgtgtgtggattatgtgcttgtttctggggcgggagaatggagagtgtttctatctgtgaagtgtgtgtgtgtgtgtgtgtgtgttcatttttgtgtttattccatgtgttattcacctctgcttctgcatatgtgcctgtgtttgtgtggagggatgtgtggttaggtgtcttttcctccctttgcttgttttatgacagacagagtgagggcattccgtgtgtatgtgtgtgtgtgtgtctgtgtgtgcctattcccagctcaagtgtgaagggaccagggttgcccagaggtggggggctcaagacatgtggggaggatccctaaggaagctctttctcccctcccctcaacatgggatcttgtgatctgcccgttccctcccacagcgggttctttggggagccggatgccttccctatgttcaccaccaacaatcgagtgaagaggagaccttccccctatgagatggagattactgatggtgagtctgccccaccccaccgttgtacctgcccctcacgctggttagagccctctggaggagggaacatctgggactactccgtaggtatctcacaaagatgggcgggccactttccaaacccaaactgccgaagcccttcaccctgcagctgagctagggctaagtaaagtcctggatggggctagcaggaccacactcacagtcctgcaaagaggaggcatgggagagagacacataatggcgcttagcccaaacctctggagttagttcccaaacctttggagttagttccagtccccagtccgggctccattcctacactttggcaaggatcccaagtgggcgcagaatcacacagtgtcccccgatcccccattctaggcactgaccctcagggattccctgcacttcctcccaagtcttccttagagtctggagtctgcttcctccctgcaatggagtcatcaagggttttctccgaggtccctacacagtaggctccccttgtctcccgttaacacattctgggcttagacctggagttcccttcctgacatcatggattctaccttgccccctggattccccgagaagggccttggcactgctcctttgaggtacttgaatattccctgaacttgcaggggtggtttggacaaatgggagatttggaagaccctcgccatctttccaaggttgaccttgtatagtagattggtcccagcaccaggggtaggagagcaggcacttcagagctgagggactttgagccagacccagatgcccccagaacttcagcttggctgtggcctggggctcctgtaggaaggctgcccaaggcctcagagcaaggctgggatttatgctccaaactggtgggaggaatatgagtatggagctggagcctctggagtggagccctctgtggtgttctggagaggagcggggctgggatctgcacaacagaaaagacttcaaaagacccaagcagcctggggcacaggtgtgcagggctgagaggcaggggtgccttctgctagattagagaggagttctctagtctaagagaggtgggtgtaccaaacaggaagaagacaggaccagccctgaagttccccagggatgaggcattttctacaataggcagaagaggcagagcataggggcgagggtttgtggggtgtgcaggagtgtagggcagtcattatccataagtgttggcaatatttaccgagcacctactcagtgctggccagagagaggcagaggacaccaggaggggtagacagactcaggaaagaggaaggtgaggagagggggtggttctctggaataaaaccagagaggaataggcagacatgtaggcgaagggtagggtatgagtgtgcaggatgtgtctaggggacactgaaattagagattgaacccaaaaagagtccatagaagtagaactaatgcaagatctagagttaggacttgatgtggattcctgttgctgaattgctactaccatgtattggacacctactatgtgccatggactatgtgtgcttgatttctgtttattccttaccacaagctcatgagggcaatattattgtttacatctcacagataaggaaattgaggctgagagaggttacccagcttgatcaaggtcacacagctaagtcctgggtcacacagctaagtcctggaccaccctcataacactggtcttaagctttggaataagtcctgaccacttccccaccatctccccttctggatgtagtctagctccagctgtgacagcagtcataagtaccccctccccaactaggagctccctcaagatcaccagcattagccatggtggagggactgtcctccctatgtcactgctgagggatgctctctgtctggcctggaggcctgaaagcagcaagtaatttcctcagaggccgcccagggtagaactgccctgcagttgtgctgtgtttttcccaggctgggtctggcctttggcaaacagtcagctgggctagggcctgctatggtttggaaaggcagcttcagaggtaccatgggcaggggatggtgatccttcccattaaaagtgtgtgtgtgtgaacacccacacatgcatgtgcatgcctgtgtgcgtgtaggagagagaaagagatgatcaggcagtaagtgtggcatggatgagctgattcacagactgaccactgaggtgaggtctgcttccatcccagcctcagtctccttagctataaaatgggcagtgggacttaggtgaggtcttagctcttctcctctacctcggttttcacactctgaggtctggttccaggggttactagaagagggaaaataaatatcctaggactggcagttccttcagtgctcagagcttcctggactatgtgaccctggcttgtgcctcgatgttagggagagaagcagtctcctcagcccagaagttcaagagcactagtaggacccttcactgtcttcccctggctttacaaatccccagtgagtcttgaacacagcacagtgctttgcacaccataagtgccctagacatgtgtgctggtatccgccactgctccataagtctttatacatggaatgttagtgactattgggccaagccatagtcagtggattgtagacatgaggagactgaggcagccttcagaagcctgcctagagctataggccatggctgtgcatagctgtgtcttcacttctctcctgggtatgagagcccttctgcatcgatctctgctctcccctccattccccacctgccaccatgatgggtcagttagcagacattttctaagcccctactctgtgctttccatcacccttaggataaagtccccccgccttactgcaaggccctgtggagtctggaccctgcctactctgatcttgtgcacaggactccagccagcctggcttcaggccttgtctagtgcagggcctgtgcattcccttggcttggatactcttcttcctctccccttcttgtgcctggctgtttcttcacagcctcagacaagccttcccagccactggagctaaacatggagcttcttttcattacaattcagccctggtttgtttgttttttaatattcgtttccccattaacatgtaagctccatgagggcaggcactcaatttagttcaccattattcctcagtgcctagcacagtgcctggttgttagcaaaaaactgatacatggataataatagctaacatttattgactgctaagctgaggcaggcattgtcttaagttctttacctgtgttaggtactagacccatgtaacaactcatgacttagtagtattacctccattttgcaggtgatgaagccaaggcacttcacaagtttttatgtcacttgcccagagtcattcatttaggtaggggtagtcaaataggaatggagtctgtctccttagacatagctgtaaggcctcttggcacaagtgaatggatgaatgaataacatacggtccctgtcctcaaatatatcacagcccagggagggagacaagcacagaaacataagtaatgatcaagagtgatggaactccagggattgcggtatcgtggtggttggttacatctgtctggaggggttgaggaagttcccatagatgaggaagcacaggaacttgaatttgaagggtggatgttttctaagtaaaaggaaagtaggcattctaggcttcccaagtttcccaatgtatggagatgcctttggggaaggaatctcaagcccattctcctaactcttgtcctcctaatctccaggtccccacaccaaagttgtgcggcgtatcttcaccaacagccgggagcgatggcggcagcagaatgtgaacggggcctttgccgagctccgcaagctgatccccacacatcccccggacaagaagctcagcaagaatgagatcctccgcctggccatgaagtatatcaacttcttggccaagctgctcaatgaccaggaggaggagggcacccagcgggccaagactggcaaggaccctgtggtgggggctggtgggggtggaggtgggggagggggcggcgcgcccccagatgacctcctgcaagacgtgctttcccccaactccagctgcggcagctccctggatggggcagccagcccggacagctacacggaggagcccgcgcccaagcacacggcccgcagcctccatcctgccatgctgcctgccgccgatggagccggccctcggtgatgggtctgggccaccaggatcagccaggagggcgttcttaggctgctgggatggtgggcttcagggcaggtggggtgagaattgggcggctctgaagcaaggcggtggacttgaactttcctggatgtctgaactttgggaagcctttactgaccctggggctggcttttctgtttcctgtaccagtaggagatcagaaaaatggagcaaagtggtaggtactttttgtgaagacggcacggtcttccctcttccctcagtcccaaatccttcccaagtaagaggctggagttgtcactgcttttggcctggagtttgggatccctgtctttcctaagacctggggttgtcagctctcatctgaggcatccagcagtctctgccttgcctttagcccctcccaagctggctggggtggcctgtgtggccacttctgtccatatttataggtacccaatagctgcccatttcgtgagccccatcttcacccaggcctatgttgatccatccagcttgccagatgctgcagagtcacaagcctcgaggtgccttcttcagggcctggttgaagaagatgatcagtggacagtctgctctagatgagctgggccggagggtcaggaaacccagtcgcccttacttcttgccctggggatcaaagttctgctttctccccaatgagacttgccttcctaagcctgtggctgtggagacaatgtctgcagccctgagaaagccctgtcgggctttgtgtgaaggcagagaaagggacaatgatagtagagtgatatggagcaagagatattttgggcatgtgggcttcaactcctcgacatcactgttcatgctggcgagtgaatgccagtgtgctgatgggcgtacgctggtgctgagtagatgcgcagccccatctgtgcattctcctggatgcttagagggatttctttgctgtaagatgtctgtttgctgatggtctggtctatgttccgaattgagcacaaaacctgtcctatgaatgctttgcatttggaatttttgcttgacttcagttattggtggaatctttagcgctcaataggaccaggatccagcctcacttctagggtatgggaaatccaatcagagaccaggccctggctaagacccaaacatatgcacattcacttagcagaaccttaaacacccctcagttgtgcagcttttggtcatcaagggtgcgtctgggaggttggtttaatgcaatagaagtgctcccctctgaaagttgtacatgaaatttttgtaaatcacatccttatccttcatcttttaaagaaataaccactgcaagtccttttgtaaagtgaagaatccttttgtagaatgaaccactgccccttcattgatttcctgtgtcaatccagatggtgggatgtggttttcttaaggtgaggcctgtctgtgacctgcatctaagcccatgggacaaattgcacagaagtcctgtatgtctgtcattgtacccttaagtcaccctagccctctccctctaggctctgccttcgaggtcagaggagagatagcctgtggccctgtcctgccatgcaagaactcatcactgtggctgtctggaaagcccccccttatagtttgggcttcagcctagtggcttgtcctcaccatgatggggccctaattcagccatgtacagacagagaatatgtctgctcctttccccttccttttaagtaaggtccaattctcgagcttggggcaacattgttcacctttgtagcactcaggctctccattcaatttcaggctccccagatcatgttttggtgaaaattagggttggttcctttccaacgtttggaagatcctgtgaggagccccatctgtctaaagatagagtcattgctgtaggatctaaggctgtttgcttcaccgtggattcgcttgagttaggaatgagaagtagccacagtatggatgggtggatgggttttatgagatggatcacatattttattaagaactcaaacttctggctccctcttctttcagacttgccatgtgactctggcttggcctatctcctagggctatggtgtggactgaatgggatcatgaaagtagacagttttgagaacgtaaagaactttttcttttccctcaatctcaatcctgcagtggggtttcgcagcctgagtccacgacctaggcagtaggccggtgtgcctgactgcccagcatttgggtaatttagattgtaaaccgctttggcctgagttattgagattgtcctcatttctccagattatctatttgtgtgtgtgtgtgtgtgtgtgtgagagacggtgtcttgttctgtcactcaggctggagtacagtggtgccatcattgctgtctgcagccttgaactctgggctcaagcaatcctctcacctcagcctcccgagtagggaggaccacaggtgtgagccaccacacctggctaatttttacttttttttttttttggtagagatggagtcttgctatattgcccaggctggtcttgaagtcctggcttcaggcaattctcctgcctttgcctccagaagcactgggatcacaggtgtcagccattgcacccagcccagattgtcttaatttctatcttgttccaaggccagggacagtaataagaatggaaaagagatatgggaacactggcagactgtgtaaaatgtaatgcaactacccaaaacaagcctggtaggaaagggcaagtctttaggtctttgtaagaactaaagaagatctgtaatttttattttcaccctctgtaccccatgaccttatccttcctctccttccttgttacccatgaaaaactggcaacattccaagaatagcatctgtacaaaggggaaagaacataaaggtaaaacaaaacaaaacaacattttgagaacaaagatgaccataaccactgaagggaatcacatcttttaagacaaattcatattcttttatttgttatggcagatgacaagatggtacaacctttattcttttccaaaataaaacaaagggcacagcatctgtagtcagccgacaactatttcggccttttgggggtgggtctggccgtacttgtgatttcgatggtacgtgaccctctgctgaagacttgccccctgcccgtgtacatagtgcattgtttctgtgggcgggcccagcactttccgtcaacgttgtactgtatgtgatgaattgcgttggtctctgcatttttctgcagaagaggagtaaccgctccaggtaccttgacctttgtacagcccagaggccaacactgtgggtgtgtgactctttagcaaaaaaaacccatgtggtgatgatgtgtatatatatgtgaggatgtatcgggaagatttctaaataaaagttttacaaaggggccttaggactctgtgcttgcattgcacccctaggcctgagacgggatattgaaagaaaagtcatggcaagaacctgtttctcctgacatggggagcctccaagactcagctgtagtcttaggaagtgggattccaccctcaaccctgaaggcaggcctggtggggaggagacagccttcctccccagggtttccattctttctctccacaggcctcatagagggggcctgtccccttggcttcatgcacccatgcttgtatctcaggaagcctcagcagacatcccctctttgtgttggggtgagcttccatggctgggacagttgtatgtatcctaggttcaggacagattaaggccataccataggagggccccaggttccctgatgactcaacggctgcagcggcggctgcagctcttatgcctggctcttaaggattggggactcagagatgaagtctgaaggtaatggaagtcgagagtggaggctctgtggcaggctccatatcatctgggaggacttccctggaggctcaggaatggaaatgtggtttagatgatacaacccttattcttttccaaaaataaaacaaagggcacagcacctgggtctgggggaagccactgcatgtggaccatttgatcctcagggatttcagtaggtcatgcaggcacttctaatgaagtatcatgccttcctttctttctttcatttatttatatattttttcaagatatgggatcttgcttcttctagcctttgcccaggctgatcttgaactgagctcaggagttcaagggccatcaaggtgaaaaagaaacaaaaggtgcaaaaaccagaaggtttttgtctcagtcccttgagtagttaggactacagcatgtggaactggcaccctgtttcatttaacaaatatttattgagcatctagtatgggcctggtattgttctacgtaccggggatcccacactgaataaaacaaagatccctgttcttgttctggtggagcttaacttctagcaggggagacggtaaacacacagacacacacaactgtaataaatatgttgattctgtagtaagttacaaagtgattagtattaagaaaaaagttgtgccaagaggtgagttcaaggacctcacagataactctggcttttttggggtgagccttgttcatcttgctaggctctgacttggctgctcttgtcctcagggtgcttccaaccacagataggagggcagaggcagggtagtccttggggaccatgctctgccctgtagagaagctccttggtttttggaagctcccaggtgtgcctctccctggcacaggacaaggaggtacctgggatgataggatggtgagatttagccgtggggtgagctggctgtggatctcagcagtggtggtgttggcctggtctgtgctcacaggtgagaggagcagtatgaggaagggacctgtggttaagggcttgagggagagaaatgagaaagagcaatcagagaggaaggagaaaaacagagagtgtgctgttttagagactgtggcgtttcagaggaaaagggtgagggaagtggttaggcaagtccagcgcagctgagtggtcaggcaagaaaggcctgcaagtgttgattggatttagcaatatggaggtcactgatgacttggatgacagtgacaccaggggagggatagaggcagaagcctcactgtcctggactaaagaatgggaagagaggagcaccatttccagaaggatttttcccaggagagggcaaggcattccacgctgaggtctggaagggcccgtgaactctgcggccagcaaggcagaaacgatgaggtgatagaatgtccaggttggcctgaccctggggggccatgtgggctagtgtacatgtctccagaagaggagacagggccagagaggaaaagagtctttccagggccacacatcccatagtgatcggcaggggaggaccagacttc

SEQ ID NO: 12195 - DNA, 31074 bp, Human
ctgcctgtgagtgtagcagtacgtgaagccccacatagggtgtactcttaggccaactgatcagaaccattactgtgcatatatatatatataatatatgtatatacatatacgtatgtgtatatgtgtgtgtgtgtgtatatatatatatatatacacatatatagtaaacttgcttagctctaaatacacacatagtgaaagaacaagttgaaccggtaagttctaccaagaaccacatgaaactaccagcagacactattgtaagcgccaaggggacctttctccttggccctctgaggtttggctgaaaatcactaacatgaggaacattaatagaaaaaacatacaaatttacttaacgtgtatacacaggaagaatcacagcgtgattacccacccctcagagggcttcagaagcttgtggatacaatcccagcgacacaggttatgatagggagaagaggaattctgttgagggattacaaaggagaatgaatgtatcaggaacacattaatttgtacaacatcttgtgaaagggtctgctcaggtgtgattactacattcttggtcttacagggaggcaacaaaaacaattatgttccttgtgatgtgtctaaactttatcctttgctttggcagagatggcgtggggatttaggggagtgggaccttgaggcttcttcagttcagatgtcaaaacgccattatttgggggtatgtttctgcgcctccaacactgtttaacagggaggcttgtttcatccagtaagggagtcaagaaatggttccccgaagaaaacgattcttgaaatctgacaataaatgaggtgtcaaacaggcaaaaagtgtgtcggaatgagcacggatgagggtagggtggaaaaatcttggtacttagtctgtgggaagacctgaggaaaaaaagccactacagtttatagttcagtgtatggtgggcgaacgagatgaagccgaaaacttggacaatcagggattgtccaagagcaagggaaagccaccaaagatttttcagcagattgccgtgatcatatttgtatttgaagactacaacgatgctgtatgaaaaatggatgcacaaagccgaattgggaagctattgttcctggaaagtataaccctgaaggcggagagttgtagagaacagaactgatgtttaaaaagaaaaatccacaaaacgtggtggtggagcacgtacctgaagttatgcctattgcgcttctgatttcaaataagtaattgttttaaattgcctactaacataaaaaagcccagtcgattccaaacactggcacccaggcgtgagaatccatggttatttccttgggtgagctttattgtatttttgcgggcgctatggaaatgctcctccaggcagtacagatcagcagcggctcgtagtgaagaacgttcaaggaagagtttgtcccggatcaacaggacatggggcttgggaagcctggactgccatgaggaaggtcgattcaccactacagacagggagcctgaggcctgggtggtgccgacaagtcggcagtcacgccaggtcaggaagcgccgaagccgcgggaaaccctggactccatcccgggatttgtccccgtgtcgaagatggtatccaggtcgccgaaaacttcccggaagtttagaccaagacctacttattatctacggtgtccgggaaggtccatgattgttccacataaagtcagaagggaggaaaggcgcacgcgcattggggacttgactctggaaagcgtccagaccaaggtcagcggagagtaggcatgtagcttctgcagttgctcctcctcaccctccgcgacctgatttcctagaagggctctgtcacccgaaaagattttccactggcttagaggagggagggcccgccttcccccgttatccattggctgctcgttccgccgcaagttgggggcggggttagggcgcctttcgattgcatcagctggtccagccgaggccaagtcccgggcgctagcccacctcccacccgcctcttggctcctctcctctaggccgtcgctttcgggttctctcatcgcttcgtcgttcgccaatgtttgaggagaaggccagcagtccttcagggaagatgggaggcgaggagaagccggtgagcaaacttggtgggacccagagaccagcctgggactctagtgggtgcagacgctacgctcgcggcgggagcggggggcaggaagcaggaagcggccgggaccgcgtgggtcggagaagtgggggatggtgggactcctggaaagtcggaaccccctttgggaaccatccattcataaattagggtggggccttgcagttcatctgtgggtccattctctttacagatgaggaaacagaccttgagtgagcgacttgttcagagcctcacatctacagtagttagacgcggagacagaatcagaatcttaggcttgaggcttccaaacttgcgtttatggcttactgtaagcgggaaacacattgcagagccttatttaatcaatctcctaagatcctgcgggggtaaagagctccattttaaggaaaggaaaaccgagtgcccgagatctgacccagcttgtccaagtttgggtggttaagtatacattttgcccggcactgatctgggcggtgcatgtgggaagatgaatagggcccagttccccgactttgagggcctcacaggctgatgtgtaagagacaggaaaacagccctagtgctttgtgatcaaccttgtggtattacagaagaggaagtttaggaaggcactttagaatttagtttggaagaatgatttcaccaggtaaacaggcaggacggggcttcccacgtaaaggtagggaaggcagtgaaaaggggcacgcaggtgaattgtctttcgggttgtttgcaagagatatgccagaagggttaaaggaacagtaatcagaaggatcttaggcaacaaggatgtttgaaacttgtattctatacatgaaggatcttaagcaggaagattgtatttgtaaaagtcacgctggcattgggatagaaggttaggccacatgcagaaggctgttgtaatagtccaagtgagaagtggtgacgtcttcagctaagggatcctctatcccaagtctgtgacaggacagttcacttaaaagccaaatttttttcttgattgtccactcgagattgaatggagaaactgcatacgggcacattctaactatgtaaatttaattctagatgataaatggtgactatacgtagatttttttcacataaaatgatatttttactgttttgtaacttttttttttttttttttttttgcttaatagaatgtggtcaacaactttccatgtccataaatattctcctgtgctattcttaattggacgtgatatgtatggttaacacatatgtaatttttccttcctgtaataattatacaatagttaatatttattttgagtactaaatacgagtttggcactgtattaatgcattccatgaattaactcattcagtcttcttttttttgagacggagtctcgctctgtcactcaggctggagtgccgtggtgcgatctcggctcactgcaagctccacctcccgggttcatgccattctcctgcctcagccaccaggcctggctaattttttgtatttttagtagagacggggtttcaccgtgttagccaggatggtctcgatctcctgacctcgtgatccgcccgtctcggcctcccaaagttcttggattacaggcgtgatccaccgcgcccggcctcattcagtcttcttaataacgctgtgaagtgggttctgttattatctccattatacagatgagaaagcaggcgtaggaacagtaacttgctcaaacccagtatccccgtttttttccttcctcaaacccagtatcctatagccaatactaataacccctgtgctgttctgagtgagtcagggacagatcattcctgagaaaggtaattctgtagcttctcttcacaatccggttctgtttcccaacttttgggttgagattttagattacttgtatgtagatgtacataccatatatactcagggaaatagagaacagttgcctactctcttcccagtgttgtagaaaaggggtcataggcctcagggttccagagagacctgttgtaatttcccagctctattacttaatgatacaaatgggcaagttacttctttgagccagtgttcttgtttgtaaaatggagccgtatttagaaccagaaaacctttgtggtgattccctctctctctctccctctctctctctctctctctctctctctctctctctctctcactacccctgttcatttggcaaatggtcaaaaccaaaataatcttatcagaaatataaaacttattttatcatctttccattttaaacctgcacagacctgcaatttttctttctttttttttttttttttgttgtcgttgttgttgttgaaatggagtcttgctctgtctcccaggctggagtgcagtggcgcgatctctgctcactgcaagctccgcctcccgggttccagccattctcctgcctcagcctcccgagtagctgggactacaggcacccgccaccacgcccggctaattttttttgtattttttagtagagacggggtttcaccgtgttagccaggatggtctcgatctcctgacctcgtgatctgcccgcctcggcctcccaaagtgctgggattacaggcatgagccaccgcgcccagccgcaatttttctttttacccagtatacttgatcagttacatcacttctgcagtataacaaaggctctattgaatctaaatgaacctttaaagtttattaaatccagacttctggagtaggggggattttagctcagcatgaaattaggagtcatattttaaaattagttttttttttaattatacaagtaacgcattttataggatttaaaagacaatggccaaaatgtccatcaactgataaatggataagtaagcaatggaatattatttgataataaaaaggtacaatgacaagtattgatgcatgttacaacctgatgatcttgaaattattatgctaactaaaagaagcctgtcacaaaagaccacataatgtgtgattctatttatatgaaattcccagaataggcaaatctatagaaacagaaactaggttaatggttgccagggtctggagatgaaggcaacagggagtaaactgctaatgggtacaaggtttctttttgagggtgatgaaaatactctaaaattgatggtagtgatagttgcaaaacagtgaatacctaaaaaccattgaattgtgtactttacatgggtaacttgtatggtatatgaattgtatcttaaaacttaagaaaactaaaggtcacaaacatgcaaactaattaaaatccctgtttacattcctggcacaggatttattactttaaaactttctatgacttcacttgcttctaattgaagtctgtattccttatggtaacttttagttcttgcttctgtgagccttagtctgtcttaccttgtattactttctaaaacaatccttcattaatcagcctggtttagtcattttttctctctttaaattttaacatttctgacaacaagcttatgtgtacacataggacacatttcctgtattctcagaatccacctgttgaaatgcattccatcctttaaaacgctagtcctagcttatttgacatctaatcgtagcgttactactgtgttttctcctccgggagtttctcacacatgtatgccttactttccctggagagactaggtttacacatggtagggattgggccttatgtttgcttcttccatggcttttgttagcactggtggaattcatgggcacactttgcattcagtttttttttttttcccctggaaatatgcttactgaatcaactgcgtgcttccttgtggccatatgtttggtatgtggtccaagtaaacctgaagcgagagtcacaagaatagttaaaataaaataaatgaaatttgaggagttaaacatcgttagtaactccttcctactttttaaagacttgcctttattgtaagttgttaacctgtctttgccagtgatgaaattgttcagtctttcaatatcagatttccattttttttaaattaaataacaaatactaaaataacattctcaacacttcctggggcatcacaggatggaggtgtcacattagattaaaatataaaacgttttttgcttatttagattggtgctggtgaagagaagcaaaaggaaggaggcaaaaagaagaacaaagaaggatctggagatggaggtcgagctgaggtaaaagttatcatcacagagggctctgttatcagaggttggcaaatcgcagggaactttctgagactttcctaatgtgtaagggttctaatggtttacatggtagtgtaagatggtactggttggaaaaatcaggaagaagaattaggaaagggtaatctgagaggggaaaaaagactttcagttgttactgtaaaaggaagcaactggcgtatgattgtataagatgatctgattgtagggttgaatataaaaatcagagaacaaaagttgaagaggagactggtaattattcagttgccagatgtgatgccagctctgacatttcattaaatgagatgttagggaatagagacttggtgtttgggcttacactgaatacaatgaaaaccaaagaaagccagttttttgaccccctccttgccctttccatctggacctgccctagggttggcttctaagccaggacagatccccttaaggcctctcaagtctgcagaaaatgctttcacttctccaggctcacactgaaaggaactggcatatcaaaagccagccctaaatcaacctggttcctgagtattttgcttttacaggcagttaagcttgcctttctactttatttttactgctgtgaactgtgcttcactttttgctttagtcattacagctgttttattggagactctttagaaagctaccagaaggaagaagcacaaaggaacagcctttttagaagtagcacagtaagctggcttttaagagccacttttacaaatgctgcaattgctaaatttatagtgccgtcatttactttagggtaagtttatagatgatcaagtgtagtgttgcttagaaccctacctaaccatttatcttacggctgatcagttgatcagtctcccgaccattatacccccactgtaattgtgaagaaaattgttgattgtgaattttaaaatttgcaagccaatggaaaaatgcatatgttccctaatttcttttttatactttcaatacaaacatacgtgctgttccatcacagcttgagaaatgacctggaaataagacaaagagtataattagaagactcttctgaacagagaattttaagtgggacatgtgattatttatgtttaacgattggtctggaaaaaagagtgtacagtgaactgtccaagaccttggtcttcccctccaagggcaacttgcaggttttattcatctctgcaatcacagagactgacacagagggtatctgctgaatgaatgttgaagagattttgacacgaaattctaattgggacattgcaagtggctatgatgataaactgcagttaagatacagagggtggtgcaggtgggtaggattataatgatgctttagagtggatggaactgggtactgtgcattagtctgaggggttcagattatggttgtagaatgacaggctctgtctgagcttttagttaattcatgggttcttcaccattgaaggttatggaccgttgtgataatttgatgaaaagctctcaacaactgaacgactaaagaaagggagggactgctgtgggtgggaattacaaagatattagggcctgatacggtggtaggaaccaatcacttgagactgagtgggagaatcactggagcccaggagtttggggccaaaatgcgctgtgactgtgcctgtgaatagtcactgcgctccagccagcctaggcaacatagtgaaaccctgtcgttaaagaatggaaagaaggagggagggaaggaattactgggcagacaattaatctttttcatttgatattattttctattatctccagtcaattttgttttgttttgttttgtttgagacaaggtctcactctgttgcccaggttggagtgcagtggcccaatcttggctcactgcaacctccacctcccaggttcaagcaattcttatgcctcagccccacaagtagctgggactacaggtgtgcgccaccacacctggctaatttttgtatttttagtagagataggattttgccatgttggccagggtggtatcgaactcctggcctcaagtgatccatctgccttggcctccctaagtgctgggattacaggaatgaaccaccatgccctgccccagtcagtttcttaaggattagatattcccttgtactcctttcaaattgtggtatgttgatatatatggagacatatgtatggagacgttggtagcattatcaacattgaataaatgttaaaatctgtattgcagtaagtcattttatatctgatagattgaaattcatttgaagatagaaagtcatggcaaaattaagcaatctcctcttcacttttgtatgaagtgttaatgttcatgtaatttgaagatgatgaatgctgtagatgttagtttgactgttttgttaccacagattcactgcctttttgaaatgttccatagattatagagtgacagtagaagaagtcagctctctgattgctgtctctttttctttctttgccaaacctctagaaacctaagtgggtgttttatatagaatatttttgttaattttatctgctatagaaagtagtagtgtgttgttttatatagttgctaattacatactccaagctgatcatggcatctttgaattcagtaaatactttccttgaaggggagaccttaagtcaaagaaatttgtgattggttgtgagtggacatataggctgacccgctgcacagaccatcacctggacatgaatgaaacaaaatagaaaagccagtttattgtttttatttccagtattgtttatagctctatttgtaaaataatttagttagaaaagatcctaagaagacatcttaaaagagaaaagaccacttgctgtaaatagtagcaaaatggtaattgtcgattcagcataagaatagggcatttaattccttcttttaccttcatttagaaccaaattgaggtaatgccgggtgattttggcagtgtttatttaccacattgaatcaatagtcctgggtttctgtattgtttttattatttctttcccatttctaaataggaaagcaatatttactgatcatttatttcctgatttgtttgttgtcttgcagttgaatccttggcctgaatatatttacacacgtcttgagatgtataatatactaaaagcagaacatgattccattctggcagaaaaggcagaaaaagatagcaagccaattaaagtcactttgcctgatggtaaacaggttgatgcggaatcttggaaaactacaccatatcaaattgcctgtggaattaggtataagctacacccatcatgaccttccatagtttgtggtctaactaaacttccttttattatcttgccatgttttattcttataatatttttatgttaccattcagtgtttttaatctgtttaattttgcctacttgagattttttaaaaatcaaaatgatacagagctttgtagtcaaaattcaaagttaatttctgaaagagtttactttggtcttatcttttggggcattgtatatttttagtcttactatgattataaatgttacaaaaccgactagacagtgtttacctatttcgacttaaatgtcttggttttgaagttaaaaatgaagctacataatctcacatggaaaggttaagaaacttcatataacacatgaaaaaaatgtactatttttataaattcaatgaaagactattcctagtcttaaaacttttattggggtgggaagaagttatttcaattaactgagaattagatgcatattttgtaataggggagaggctttcttaatctgatatgattgggatcaataattggtcagtttatcaaaataagagttggtaaaacatatatatgtgtatatatatacgcgtatatatacacgtgtatatatatatatcttaaactgggtattgggaaactctagtcataatctgtttgtgtatgtcctgaaagcgaaaaataaaaatgattctttttttctttctttttttttttttttgagacagagtcttgctctgttgcccaggaggctagagtgcagtggcgcgatcttggctcactgcaagctccacctcccaggttcacgccattctcctgcctcagcctcccgagtagctgggactacaggtgcccgccaccacgcccggctaattttttgtatttttagtagagacggggtttcaccgtgctagccaggatggtctcgatctcctgaccttgtgatccgtccgcctcggcctcccaaagtgctgggattacaggcgtgacccaccgcgcccagccaaaaatgattcttaaatttttaaatagttggaaaaaataaaacaactaagaatatacaacagagaccatgtttggcctgcaaagtgtaaaatatttgtgtggccttttacagaaaaagcttgccaatcttggtcttaaacacttcaacttaaaatatgtgaatatgtatgtattcactaactttatatacatacataaaacagtgaatatatatatgtatggcaaggtttgggggatagcgagtgctaattagagttcttacattatcttaacacatacgagaagtagtctgagcacagaatccttgcagattttcatgtagttgtagagttacacctaacttgacagtgtttttgtgtgtgtgacttggatttatcaagccttctcaaacattcaacttggttttcatagaatccataattcccttattgtgttattttataattatatatttttgaagtttatttataagtgttatgtattgaattgaaccatttggaatcaccatatgaattgtcatgtggttgattatcatcaattttgtattgttgaaccaaacacgtaaaagaacaagcacaaaaacagtttggggaaccaacgtggctgattcttggtaagcgtattatacaactagtagaagcagaaccagttaggcctatgagccatgagcatctactgtaccacagacattagttagtactttttacaaagtgaatggagtgtttccattcatttgacaagtgcttctacctacaagttcttctaccttactccaaaggaagtaaaaagttgtaataccatgcaagtttctatgtgagagcatagagaactggatagacctttacgtatcagttcaacctttcattttagagataattttgaaggtcaggttgattaatagattcctctgttgtcacacaatgagattgtagccgtgtcattaaaatttaggcttctgttagtttgggaactttttcctctaccttctacaatgttgatctagattacattgtaatttatcaagtcttcagttgaaaaatattcttcaagaactataaaattctaagttgaattacatagctgggcgtgttggctcacagctgtaatcccagcactttgagaggccaaggcaggcagatcacctgaggtcaggagttcaagaccagcctggccaacatggcgaaaccctgtctctactaaaaatacaaaaattagccagtcatggtggcgcacacctgtagtcccaactacttggaggctgaggtgggaggatagcttgaactcgggaggtggaggttgcagtgagccaagattgagccactgcactccagccttggtgacagagcgagagtccgtctccagggaaaaaaataaaaggttgaattacataaaacattgatgggctttagctctggagttaagtcactgatctgcactgagaatactttatgaaatttttacaaaagtccagaataactttttgttctgtgaaaaattataacattgataacaggctatttaaagattcacataattagtggtgaatatgaaagggaaggacaaaaaagacatgttccatttgcgtcaaaaggtttttctttgaagttttgttataaatcttttttttttttttttgagacggaggagtctcgctctgtcgcccaggctggagtgcattggcgccatcttggctcactgcaagctccgcttcctgggttgacgccattctcctgcctcggcctcctgagtagctgggattacaggcgcccgccaccacgcctgcctaatttttgtatttttagtagagacggggtttcactgtgttagccaggatggtcttgatctcctgacctcgtgatccacccgcctcggcctcccaaagtgctgggattacaggcgtgagccactgcgcctggccgttttgttacaaatcttaaagattattttacccttctttgaaaaattgaaatgatccagtatggcccatgtgtaatctacattttcagagtaactctattcttagaatcttggggctccatattggatcataagataaaagtcatgttcttcccaaagaatatagagaatatgattatcctttttatcagttctttaatctcctgaaaactgttttacaccaatatgatgaaatacatttctctctgccaaattcatgttatgttttgtgaaatgcatgtatttattttattgactccatctgatctcaggaggaaagaaaacattgtttataacctatggtaaagttagtaggagcattgaaaatagaaaggagtttgttgtttactttctgtttggttcttttctcttgatcctcagataggagttgtatacattttgttgtaaacccttagacatagagagccaccaacacagcaagcctggctagcttaaagccttctagtggtaggtttctttgagatttacagtgtaaagggtgtatactttttcttcacagtgtagaatgttgcctaccttcgttgagatgtccaggctgttatagactattatttctctagctgtgcatttagatgtataatctggctcacctactcaactctgctctagtcacacagcttcctgcaaaaacctctcttcacttgcatctctgcttgcatctgtggccattccctcatctggaatgccatggcctcctcttttcttcctgtgagtgctttatcctcaaagcctttccagatgactctgacctgtactgctttccctcctcagaactcctgtagcttttacactctgtgtgctctgatatttcatcacttgatgatactttatgttcgatgttgtatattgggtgtgtaatgtttttactcacattatatggaaagttttattaaatagtctttcattttacctctatatttgttataaatattatcataggcatttgcagaatttattctgaggttagcattgtctgtcaaagaaaggatctggtgtacattttaagcaggaagaggaacagagaagttatttagtaggccttttttttttcctttggagtctacatagcttagctttgtagaaagagaaaggtgggtgtattaagagaaaactcggtgtggtgacttgtgccagttgtcccagctactctagaggctgatgttggaggattgcttcaggccaggaggccagcctgcgcaacatagcaagaccctgtcgctaaaaaattaaaaaaaaaaaaacttatttgttggagaaattaagattattcaaaccattggaaattgatagtgcttatttatcagagttgccatatctgcttaaacaggaggcattcaatgtcaaatgataatgttctgcattttcaggatcttccagttaggttcttaggtacatttttggaatttgttgtttttatcattatatttcagaaaaatagagatacatcaatataaaaaaacaatatataataaaaatagtgtttattttcctgttttcaaattagattcgtgtgtacttatatatgtgtggacttttttttttttttttttttttaagtcaaggcctggccgacaacaccgttattgctaaagtaaataatgttgtgtgggacctggaccgccctctggaagaagattgtaccttggagcttctcaagtttgaggatgaggaagctcaggcagtaagttgctgattagtattcattgaattttaggatgcagattcacatttgaagtcttttccagctcagtcctgctgcgattgggtggctaacatttattgttgtctcactgtcatatttgaaatcttcattttgtccttcatttagggaacataataaaagtgcttgccttagaaaataaaggggtgaagctgaataagtcttttcattactagacacttcaatagggaaaatgttttgggaattgtattaaacattgattaagcaagtaaaaattgttttctaaactgtgaacactattttattttaattttttttttttttaatgatggagtcttgctttgtcactcagactgtagtgcagtggtgcgctcttgcctcagtacaacctccacctcccaggttcaagctattctcctgcctcagcctcccaagtagctgggattataggagcgcactaccacacttggctaatttttgtatttttagtagagatggggtttcaccatgttggccaggctggtcttgaactcctgacctcaagtgatctgcccacctcggccccccaaagtgctgggattataggtgtgagccactgtgcctggcctctaagctatgaacactctagcaagatatgtacatttgacaaataaatttgaaccttacttcaaagcactgcctttattggataatttctgtatttttttctcatcttaagatgcaaatctgctggataacactataaaagtcaacctgcatgtgatgacaagattttctttttaattctccatggctgtgtatcatataaggggagacaaagtattttgttttagtgatgattgttcacttatgtatgtggattagtggttttcaaatgtattttggagccctcaagtttcttacgagaattttttaatgtcactttggtaccttaatactaaatcttgaaaacattgctttgggtgtattctgactcatcccagtgattactttaaaaccaagtactgccatttgatttcagtgtacagatgtttgtcctcgtgttttgtcattgtgttgtggggtcgggttgtaccacctttgttttgggccagtaacaacatgtaatttctaagtgatgttccatagccagctaaaggccagatcacagtgtctgagacatggtgctgtgggcacattgactcaaaagaacctgggccattgcaatcaatgagttagtcacattgtgagtagcagttgttttcagagaacaaagtctatgtcatttaattagtgatgccaagtttagtttaatttgtttgaaaacagctaaaccagatgatttccaaaataaaaatacactagtaattggaagccttttgaattactttggctatggatagaaacagtagtttatagatttagaaatttaggattttatatattgggtttacttgtagtaaatattatcatctgtctctttcagacaaccacattaattggcaacttgtatgccaagactcagaccatgccatttttctttaaattttcaggtgtattggcactctagtgctcacataatgggtgaagccatggaaagagtctatggtggatgtttatgctacggtccgccaatagaaaatggattctattatgacatgtacctcgaagaagggtaagccatcaactagataaagaaaactgaagtcaatgactatggatccataagttattcttaagagttctcagtaagggaggaatgatatagatctcactgcttcttcatcaggtatgcccattatcagtacttgaagtgttgcaatttacctgaagtaatagaggatttgatgagacctctgttctagattgatggaggtagagtcctaaggtattttgggaaattcagggagactggtcctcccctctcctttaaaacctggtgatagagttgcgggaaggggtcactagtgagaaaggtctccatggatgaccaaggtagaagctactgaaaatataaaatgtaaaaattacttatgaaaaatgttttgtttagaattctaagatacgatgcaatagtctaattttttaatattaaaacccttgaagtattccaaatactatttccaaatgaacatttttcgaagccatggtgtgattcgaatggaatgaaaagattatactttcttctccttcaggggtgtgtctagcaatgatttctcttctctggaggctttgtgtaagaaaatcattaaagaaaaacaagcttttgaaagactggaagttaagaaagaaactttactggcaatgtttaaggtaaattgaaccatagtgcgtggcccccactgttaatatcatttattcatgttagttgaagtgacaccactggcgttccgtgtactaagctgaagtctaattggttctttagcaaaaattaagtgtttttattatttttttaatttcatttttttcctagcaaaccattccttcaacatgtttttaaaacatgaagtatcaacatttatattcatacagtgctacgttttagctatagtacttagaagtaaaaattaaaggacagttttttaaaataataatttttcctgttttcagtacaacaagttcaaatgccggatattgaatgaaaaggtgaatactccaactaccacagtctataggtaagaatattagatgtcattaaatgtatctggtatgtatgtcattttgtctttgttaaaattcctttcattttatctttagatgtggccctttgatagatctctgccggggtcctcatgttagacacacgggcaaaattaaggctttaaaaatacacaaagtaagtaatgtaactttaaagactgtgaatgtatctgtctagaatagatatatgtttaaactttcactgatttctctttaccattttctgttgcacatgaaaggatggtattttctcatgctctctattaactgggagctgtatgccatcaggattttataattgaaatccctcaaggggtgactgacttgctgtcattgccagagcaatcacaggggatggagattttacaaaatcatacagcatgggccatcctggctctataaaagctttgagactcactgggagtatgtgcttttgccctttatatgtctaaattaataatttcccaagttgttgtttttaacagaacccagttttatactagttcataaacattttatggaggtttttaaaatgcactttaaatcaagagaataattgagtcatttcaagattttttttttattggctcatttctatttttgctcattttgtgagaaatgcctttgcaggcaaagtaatgtttgtggaattgtggttgagtattgaggggtgggcagttttgggggtattggggtgtagaatgggtctcactctgttgccccaaaaagacagagtggaggaccacttgagcctgggaaatgaggttgcagtgaatggagatcgtgccactgcactccaggctcaagcagtcctcctgccttagcctcctgagtagctgcgaccataagcgcacaccaccatgcctgggtaattttcttttttttaaataaagaatggggtctccctgtgtttcccaggctggtctcgaactcccaggctcaagcaatcctcttgcctcggcttcacagagtgctgggattacaggcatgagccactgcacccacctgcagattgagggaggggcatttttgaggatagaaaacagccaactttgtgctgcagaatgagtaactactctaacaaggcctcaaagcaattgggagttaaaataagtgagatgtttacaaatttgaatgttgtttcatggttaatccttgttttcagaattcctccacgtactgggaaggcaaagcagatatggagactctccagagaatttatggcatttcattcccagatcctaaaatgttgaaagagtgggagaagttccaagaggaagctaaaaaccgagatcataggaaaattggcagggtatgttcaagaacaatgatgtgtcttgactgagttttcttcaacttcatttgaagtttgaaattcagctgcatgaagtactaggaattttgttttgaagagatgttgtggctttttagtaactggtgctatgtcctgtacaaactataaacacttactgattgtccacattatctgcctggagtatgctcagtaccgcacaaaaatgcatttgaactacttttattgagagcaaacactgatgatctacggttttctgtaaaagaagtataacagcttctcatagagctgggagaactatggaaaccctctagtttcactgactcatttaaaatgtggaaacagagtcccacaaagattaacctacttgttgcccaaggtttagcagcatgtcgcacatggatcctgtgctatcatttcctctacccattatctctgttactgctgaatgtcctctaaactggaagttaggctagataaaacattcccccttaaaataggcactctgtgccaggggtccttggctattaggttatgaagcttgagctggaggtagcagccactgccttgcacccctgactacctgacattccagctatgaggcagccagcaatgattgatgggcccttccctgagggcttttgggcacttggggaggcggatgttggcaaggaggtaggagggtgtgtttctttcaccatgacccaaagtcagccaactttaccatcatctatttcattatcagtgtctttttcccagtctccttcctgatactcttactaagaaaataaatacatacataaataaaatgaaaaaagatccagatcttggagctttaaggaatttaagaaccatgagaggtactgcagtggatagttaaagaactgaagggacccttattccctgccactgttggggaaacttgactggattgaggaatataacaggcagggcatgtgttacacgtctgccaaattgtaaatcagctgcaattctataacatcagaaacactgacatggtttctttgattcaggagtggcactgattgaaatatgggacatcatgaccatattctgagctcaagaacactgaaatttatgtatatatacacacacgtatacgtgacgtacataaacattcttttgcttttcttttacccaggaccaagaactatatttctttcatgaactcagccctggaagttgcttttttctgccaaaaggagcctacatttataatgcacttattgaattcattagggtaagtcatatttattgctttcttctttagatttaggatatgtgatcattttattaaataaggtctactaaaaggaaagataatctgtatttgagaagaaatatataagacgataagtaaaagtagaagtctgtggcctcataaatcatccctaatagttgattttgcccatatacacatagaaactggtgagcttgaagggggacctgtggtccttgacataggagctctgtgccctctttgactttgatcatttatttgtattttctttgaaaaaacggtttttacattgcttttttcctttgtaaattatgaaatgtttcaagtataagtttatagagaatagtatatccaatatcttgtacttaactacccacatttaacaaatattcacattgggctatatttgcttgagattttttcattcatgatattaaaaaaaaaattagttgtttaaaaagcctctctttaggacccagttttgatccatatacctccatatactggtatatatatccatatactggtatatcatataccagttttctagaagaaactactgttttgaagttggcatggattctttttgtccatgttacttatatctagcccatgtatttgtacccttaaattatttatgtatttgtgtgttacatataggaagcctcattgtgtatcagactgccttgtgatttatttttagagacatgcaaatcaagtttattttcacttgctacatattattttgttatataactaccacaatgcactcatccctgtattgatggacactgatgtataattgtcccttattatcagccatgctgcagtagcatcacttttataagcctccttaggtacatgtgccaagagttttctctctggtatatacttagaagtgggatttctgaatcatggcatgtgtccatctttttcatgagagagtataaaatcactctttaagtttttactcccacttgaagtatgagcatttatttgcctacacatgtttctgtttattttctatcagagcgaatataggaaaagaggattccaggaggtagtcaccccaaacatcttcaacagccgactctggatgacctcgggccactggcagcactacagcgagaacatgttctcctttgaggtggagaaggagctgtttgccctgaaacccatgaactgcccaggacactggtattcggcagctttgaatttctactgaagattttcacatgctacaattcatcctgggttcttccctcctttaacaacattttcattaaaaacaaattatgtgatcagaagagcatttaaacgcaacatctttgtattatatcttctgcacctgattagatccccactttttttttttttttttttaaagaggtcttccaactggagtgcaggtatgcgattatagctcactgcagctgggactgcaggtatatgccaccatgcccagctaatttttaaaattttatttctgtagagatgaggtcttgccacgttgctcagcctggtctcaaactcctggcctcaagcggtccttcaaccttggcttcccaaagcgctgggattacaggcatgagccactgtgcccagccagatctccagatctgtgggcattcagtaatggtactgggatcatagcaatgaccaaggcagactataaaacaggaagatgaaatatgggggtgtaacaaattacctagtgtgttgttgttttaaagaaacctgttctgtcaaaacctgctaatgactcagcattcttggaaaatgttccttgtcatgaggccgctctgctttctatctttgaaagttgggtgaagaacagcttaagggaagacacaggagagctgtggatacaggtagcttagtgtctgcagctcctactagccaggcctggagggcagaggaggtgagagaagaatctttgtgaagaagctgtattataggctaggggaccaaccaagttcattcttaattttcccagattcttcagttgttggaatacgttttttaattcttcactgtggttcattgagttataacttatttgctgttttattcatgcaagtgcttttactgctgtatgtagcccagaatttgagaaatgttgcttggatggacagctagaatcagtggctttttgacaacctttcgtgtaattaaatatagcattacagaagcagttttattcttaagtgtccgtggacttttctttttctcttcagccttatgtttgatcatcggccaaggtcctggcgagaactgcctctgcggctagctgattttggggtacttcataggaacgagctgtctggagcactcacaggactcacccgggtacgaagattccaacaggatgatgctcacatattctgtgccatggagcaggtatgagaccctgggaataaaatacttagaaagaagagtcaagaaagtcaaggaaaataactactgtttctttttttgttttttaatttgaagattgaagatgaaataaaaggttgtttggattttctacgtacggtatatagcgtatttggattttcttttaaactaaacctttctactcgcccggaaaaattccttggagatatcgaagtatgggatcaagctgagaaagtaagtggtgtttttcagcgtgcttttgaatactgtttgaaattggcttgttctgagatgtaagaaagccaagcctctttaaatggataaaagcaaaatgaaattggaaatggttcctaggtttgtgtaagctagtttttttctttatgattgtgtatttttgaaatggttgaatgttttcatgacttttttcagttatcaagctataagctttaaaaaggggttggtatgagcatatgttcaggtggacaaaattctaaagcagagaatattgatctatgaaagtaattactgtatttttagtctcaaattaggctaaaagaagggaaattgcgatgaaaaaaataaaaatcattttgctttatcctcagcaacttgaaaacagtctgaatgaatttggtgaaaagtgggagttaaactctggagatggagctttctatggcccaaaggtgagcactaaagtacatttgggtaatatgattttcacttgtggatgaagaagatacgacttcgaaaaaagttggaaaaaagaaaatcagccctaatccaactattgagctccactttagtatcactggcattttataataacccagtctttgcttcttagattgacatacagattaaagatgcgattgggcggtaccaccagtgtgcaaccatccagctggatttccagttgcccatcagatttaatcttacttatgtaaggtgagtttctggtgtctgctctgaatattctccagggatatataagagaaaatatatataataagacaaaacaattttttttttctttatagccatgatggtgatgataagaaaaggccagtgattgttcatcgagccatcttgggatcagtggaaagaatgattgctatcctcacagaaaactatgggggcaaatggtaatttttgtcactgtcttttttttctgattagtataaattggctacaagaaatgtctacttttcgatttaattatcagatggaaagggagaatgattccaatcggttgcttctaactaacgacaagtgttcattaaaaaataaggaatcacaatctaaacacaaactttttagcattaagaacaattgctaatagtaattactttaattccagaacttgatttgtttggatgttgtgtaatactttctaattaggaattagtattctgtaagaagtatacttactgttttggatgcttttctagtaactttgttttgggatttagatggctttgctggttttacatagataaatgaggaggcttatggctttcttcgttcagccttgctaatcataacaagcaggtatttggacatgttttaaaagccaagcattttttaaaacagatgccaaaccgatcaacatttgtgattcatttctgtgaggttaagtaagtttttgtttccaagatacatggccacataactttcatcttaattcttaagcagttttttctggacccacagtgcatttgaaagcagcacagggttataaaagcacccgtgtgtagagccttccatattaatcatattgatttaaaacttttgtaaaatgacgtacattggtttaatcttacacattactgtcatttcagttttatttgaacttggttacttcagaaattaggacagtttctcattctgatcaatgatacaagataatctctagatttctcaaagtcagataaaatgtgagacacattctctgcaaggtatttcaagaattaagggagtcctcagctaattgctctgctaaacctgttttaggtggggaaaagtccatgattagggtagaatttagtgcctactttagccttttgcctgatacaacagaacaactgaaaatagaggaatgatggagaaaaacattagcctgatgtttgcagcatcagaagcatttgacacttgtattgcttcaaagggagaattggatgggcttattttttaataagtagtgaaaactctgatttttaccaagtgccataaccagttattatcaattacaatttgctgaatgatacaaaatggatgttgagtaaactgagggcactgtgtccccgtgaagaataagtaataaaatgaacaattaatcactacatgcagttattaaatcatttgttacctcctctcacagccaatacacagtgttttgtgatgtattaaagtgtgaggcctagtcctatcctcaatttgctttgctatctacttagcaagacaaattgtagttacaggctttccttacgtagggttagttttcttctcctgcatctcctcgccttaatctttattggataggtcttttcattttggggttttttaaagccaagttttaaaagtagtcgttacatgttccaggaaaagatactgaagagtagagtaagaaatatgctgtccctgtttagtgaatatgcccacatctacactgaatatttttattctcttccaaaggcccttttggctgtcccctcgccaggtaatggtagttccagtgggaccaacctgtgatgaatatgcccaaaaggtaagccttagatatgaattttctttcaatttaacatctgttgttcagcttttcaaatcacataagccctgtattcttggtgaatcgagctgttgtgataaagagaaatgttactatttttaatctttgttaagcctgaatagattatattacttctttaatgcttttctccatgattccataatcagaagacatatttggatagtgttttatgtacacttgtatattttattgtatttgttttaagagatgggatctttctcttgccccaactggagtgcagtagtacagtcatggctcactgtaacctcaaactcctgggctcacgcagtcctcccaccttggcctcccgagtagcagtgactacaggcaggagccaccatacccagttacacttgtatattttagtatttagtattttaaaaaaccagattagcagatatcaggtacttcagtatggtaggtaaattcccgttcaaaatacagtttaggctgctctttgactcagtgagtaattttgcttcattttaatgtaaatttcttcaggtagttgaaattttttcaggttaatagtatagcagaccaatgtcttgcctctctaccaaaaaaactaacttaccaacaaatgtatagccattcataacttcactttaaagcattgttctgccatagtgaaaattccatactaaggaatttcaaattattaaaagttgatgagtgaacaatactgtaacatcaaaaccatcatgtcttcagaccatcagaataaaccacactcagttcttaattacccttaagaaataaatgaacttgagcatggagatgcatacctgtagtcccagctacttaggagcttgaggcaggaggatctttgagggttcagggtgtgatgattgtgcttgtgagtagccactgcattccagcctgagcaacatagtgagaccccatctcttaaaaaaaaactgaagtgggccaggcgtggtggctcacgcctgtaatcccagcactttgggaggccgaggcgggtggatcacgaggtcaggagatcaagaccatggtgaaaccccgtctctactaaaaaatacaaaaaattagctgggcgcagtggcgggcacctgtagtcccagctactcaggaggctgaggcaggagaatggaatgaacccaggaggcggagcttgcagtgagccaagatcatgccactgcactccagcctgggtgacagagcaagactccatctcaaaaaaataaataaataaaaacaaataaataaataaaaaaaatgaagtgaacactaaaccatctaatagataaaccattcagactattcctgttactgcactcagtagttttagttacaaatgatgacaatcaaagttatgttccatggttgagtgcactttgtcttatttgtatgtgaaaactcacacagtaggaagaagttctgtattggttaactgagttctcaactggagacagcactgacttccccatttccctttgcgggtaggtggcattccagattatgtggtggtaagcttttcttttgcggggagagaagacagggcagtactcctgatacctaataactatagagcagacatgttaaacaccctgtaattatcaggccacttccccaactgcagaattgcccatctcacgtgcacacacaggacccatgttgagaaaaatgaagaaactgatgccttattctttaaagtagttataagttgaagatgtagacctatcttggcattctaaaattctgtaacaacccttctgaaatgggtgtaataaaatgtcaacaggttaattggttcgtgatcactgtggcttaaaaatctagttaaaatgctaagacttgtgcacagtataggcaaagtcacttagattgtttcaaaaagtatgccttatagaaataaacatttgacatacataaataacccttggtttacacataactcgcatttgagaaatgaatgtgttgtagatcatttagaatctttttcaatcaaaaattgaaagaaatatttcgtcacccaggtcaaccagagattgctggttttactcatgatacttaagtagagtatgatagttactatttcaccttcagctgtacttaagatgttttcctggaaaaattcattctgctttctgaccaggatttccagaaactctgacccttctaagaggtctgggtggaattgtgatggtgattctgctagtagacagtgtaacttctgcgtctacaaaaagaggataggccgtcactgctcacatggctttgcgtgaaagcccaatggtactgtctctatggcagagatgaggaaggaacaccagcgtcctccaactttcctgttcttcctttgggttaatggccactgtaaggaaacagttttctgccacgtgtggggtgatttgaatgtaaaatgcccaactctcatagcaggctgaacagaaacattttttatactcattgttaatttgttctaatctaaattacttttagactattaaatattattctattttaaagttaagggactaatgcctctgataacctgattaaaaaaaaaaactttctgatactcagaagttaagatttattcagttgaagatcatttctttcaggtgttgatcgtgtgatatttttcacatctgtaatctgaggttcatatgaaatgatagtgaaataaaattgttcatttaggtctttttgtcatgttaatatgttatcaggttaatgggaagtttaatctagttaatgtaaaattaataaattgtaatctagtttattgcttttttggaaaagaatactgaaaacattgtttacttaatacacatgacctgaggtaataaagaggagctggcctttttgaggggggaataatggcagtgaataatattatctaagacagttttgccagctttaaattcctggaagttcatccaagaagtcctgatccctgtgttcagtaaaatcatgtgagatcaaaatataattctgattttagatctgacaaattctgtatctctgttacaataggtacgacaacaattccacgatgccaaattcatggcagacattgatctggatccaggctgtacattgaataaaaagattcgaaatgcacagttagcacagtataacttcattttaggtaagaatggaaacttaccaaagaaaatttgccacacctcaggaaaatctactgaaaccttgagacaggtttaagtgaattgtaatcaagaatttatttagttccttccagtcctgattttttttctattatatattttaatatataataactataaaaataggctcatgcatacatactgggtttttttttttttcacttaaatcatggatgtctgtgagaaaatattttgctattataacaagaatgaagacgcattgcttttaaacacatctattggattactttctcaagataatgccttatgtgggattacttgaaaaaagatattcatgatgtttggggttttattatttggttgttacgttgtctagattgactccataagcacagtagttttagatattgcaaagagtttcttttaaatatcaacacatggtcacttgtaccttttaatgtatcagaagctatggggtaggttttgggtcctaggatcatttcttttcagatgttcagtgtgaattcttccatatctttagattaagtctgacaaagctttgtgtgtttgttttagttgttggtgaaaaagagaaaatcagtggcactgttaatatccgcacaagagacaataaggtccacggggaacgcaccatttctgaaactatcgagcggctacagcagctcaaagagttccgcagcaaacaggcagaagaagaattttaatgaaaaaattacccagattggctccatggaaaaggaggaacagcgtttccgtaaaattgactttgtactctgaaaacgtcaatttatattgaacttggaggagtttggcaaagtctgaataggtcaacctgcaggcgtaactatttttgacctagtcagtttttaaacaatgtgcatttgaaggagttaattaaaagagagccaataaaatgattttactcattcagtatctgagtactggaagtgaaacatgaggaatgctttagtgtaatgtgggagaacttttttgtaaatttaatgcaattgaaaaagttttcaaattcaattaagataactagaattggattatggtgtaaaaataaaaaaaaaatttattcacataagtttcaagactgctctgtccctcacatgtacacatacatgcctgagacagataatgtggttcagtatttatctttacagttttacagcaaatataatgcagggtggatggagacggggtaggtctgcagcatcataatgctattcataaactgggtgtgagctgggtgctggcttctcagaggataaacacttttgggagtgtcatttttacttaatgttggatggacaccttttcaaacaaaaactaccatggatctattacagagtagatttgcacaaatgtttaagataaaacgtgaatcttcagagaaatatctgtttatggcagactgttctggaccatagaatcacttggtttacaaattccctattttctcataagggatcattttcaaaatcttctaccaataaatggtgattgaaaggacagcacaaagtaaataatttcttatgtggataaatactaattcctccttgttagaatgatattttaaaagtaacatcttttttttaattttttttgagacaagatcctttgtcccccaggctggagtgtggtgccatgatctcggctcactgcaacctcagcctcccaagtaggtgggactaaagacatgtgccaccatgcctggctgatgtttgtattttctatagagatggtttcatcatgttgcccaggctggtatcaaactcctggataaaagagacccacctgcctcagtctcccaaagtgctgggattacaggtgtgagccaccacgcccagcctaaaaagcaacatcttgtcagtgctataatctcaaatagcttgtttgcaaggtgtgatggttaatactaagtgtcaacttgattggattaaaggatgcctttattgtttctgggtgtgtctgtgagggtgttgccagagagattgacatttgagtcagtggcctgggagaggcagacacaccctctgtgtgcgtgggcaccatccagtcggctgccagtgcagctagaacaaagcgggtggaagaaagtgggattaagttggcttgctgagtcttctggctttcatctttctcctgtgctggatgattcctgcccttggacatcagactccaggttcttcagcttttggactcttggacttatacccgtggtttgccaggggccttctggcctttggccattgactggagatggcactgtcggcttccctgcttttgaggcttggactcggactgaaccactactggcttccttgctccttagcttgcagacagcctatcgtgggacttcaccgtgtgcttgtgtgagtcaattcttactaaatttcctttcatatatacatatatcctattctgtctctctggagaaccctgactaatacacaagggtcacttcaaagagaagctaatttgcatagattaattttcactttaataaaggagctaagatctttaatcatagagggcttttcttttgaaactttataattaagccttgcttctgaacagctttaaaattaacttttgtgatagagttgtaatttttatgtgtctgaaagaaacttaattttatacttaaaccagactcaacatttagagaagctttataaatctttcaaaacttgggataaaaaagtgtaataaagacatagtttagtgggactggaaatcaaaggtttctcttgatctaactaacacctacttagcttagtcctcacttctagtggaatcattagagggccactgtcttgatgggagggttcttgtgtggggttttttttttttttttttttgagacagggtcttgctctgtcaccaaagctggagagcagtggcacagtcagggcgcactgctgctttaaactcccggattcaagtggtcctcccacggcagcctcccgtgtagctgggactacaggtgcatgccaccacacttggctaattttttttttgttttattttttgtagagatgaggttcctactatgttg

SEQ ID NO: 12196 - DNA, 137949 bp, Human
  misc_feature (1)...(137949): n = A,T,C or G
gcctcctgtcagatcagccttggccttagattctctcaggagtgcaaaccctagtgtgaactgtgcatgcgagggatctaggtggtgtacgcgttacgagaatctaatgcctgatgatctgaggtggaacagtttcatcctcaaaccatctcttcctgacacctgtccatggaaaaattatcttccataaaaccagtccctggtgccaaaaaggttggggaccactgtattaaatggaatcttgttagacttctcagggttattacagtgatcaaaggagaaatgatataggaaggcactacttttaagtcccaagcaagcatgaggtgtgataagtatcaaagcacttgccattcccttagcttcagccttgggttggccgtctgtcctatcattcaggtctcagctccactgttaccccagagaagcctccagtaacatcatatctaaagtagcctccctctccctttcactctcaattccatcaccctgctttattttagtcaagacacctcacttacgaagtggtttaattttttgcttgcctgttgatcatgtgagacaagtaacaaacgttaagaagccatgcttgctcatttctgcttgtcagcataatttcacacagcccctgactctgtgaccacctgcagctggcggaaagacgctttgaagacaaaacgagatagaacacaggatcccccacgtctcttgcctgagcccttgccttttactgcacctaagataaagtctgatgaggttagtgattatgcttctgtaatctataaacagatgtactcttaagcccaaactgtgatgtgcttttacacatactgaatcttcaccaactgtttctaaattgagaagggaagttctgtgttggagggatctgcttgaatctctctaaaagactcctccagggctgtaggcctccatctctagtcctcagtaagacttctgaataaaactaactttcattctttaacagcttgatttttaaattttagtcgacaatcacttattgtctttctcctacagtagaataaaagtttcctaatggcagagcccttgcctcatcttccccaggcatgggaacagttcctggtataggatgcacacagattttgctgattcaggatagccgtgaataacagtggagactccagaggaggaagacctggatttgaagcccagcttctcaacccagcttctcaatttactagttgggtgacattaggcaagttatttagcttctctctgcctcacttgcaccgtatgtgaaaagggggattctgataatatacgcttcagagaacttttagtacatgtgaagtacctagaacagtgcctggcacacagttaagtcttacatgtgttttctactcttcagtgagtttaatgttaacacattaatagtgcacgtgaccctctaagtgtatcagatatgcactgccccctcgggtttcacaggaaaaccacttactcttttggtaaaacaggctgcatggctccactgccccgcgtcacccgcctggcctcccaccgcttagcggaaggggaggtgcggttcctaattccgacaggcacgtagtcttccacaagtggcactactcggggctctcctggctaggggcgttcgagccactaggggcgggtctcctgggatgggaagactggggctagggaggttcaacgccgcccccggaaacctaagggacgctccctgaaactcaccgggacgcgcttccgacccattccggtcacttgccttgaaatcgccgcagggctgcgcaaacctgccacccagggcccaagcgaccggggcggggcgatcgaggactgggcgggcctgcaggatcagaggcggggtagggcgtccacggggccagcaatcggggcggggcggggtgattgggggcgggacggggagatcagagggcggggcggggcgctttgctctggactctggggcgctaggctccggactccgcggcgcagactgcacctcgcagtctccccaggtccgcccagcagccgcgcttcagccaggtaagggcgccgcgggcgggctggggcggccccgggagtgcgatactccgggcgaggacgggtggggacggggatgagcgcggcaagaggcggcttccacacgcccctcgaggaacggggaaggattttctcccctccgtgccgcagtgagcgcgggtgcgccgtctctgggtcccctcttcggtccgggaaggagggacaggtgcgcgcagtggcgcagcctcgccttcctgccggcagtagattctccacttctccaactcccgcactgacctctcctaaggaacacccgcccctttttcttgaagttccaggcctgaggccgccctgcggcaagttcagcgttggggtcacgtcccagcggcgagcagggctgatgcctcctttcgggttgggcggcggcgcgatcttgattgaaatttggcagtgtcgagatagatatacctaatgtaaatgacaagttaatgggtgcagcacaccaacatggcacatgtatacatatgtaacaaacctgcacgttgtgcacatgtatcctagaacttaaagtattaaaaaaaaaatttggcagtatcggccaagatgttccgcagttgcacgtgactcacccagtgaagttcacgttctcttccccacccccccaataccccgcccacctcgccccgggaagttgtgtttgaatattgaaaacaggtgcccggccaatgtatgtacttcttggaaaaactagggccttgacctgggagtgtacactttcctaattttctttaatcctaaatttcttgtggattttattttattttatttttcccgtggacgtgtaacatggtggtgtgtaccaggtttggaaacaatctcatccattgctattctttggaaactggaatatttgattcgaaagattgatcttaatgttaacttggaacaacaggatggctggtggctaagtgggtttgaagattatccaaaatagttataagttttgcgcgtattccttgtatttttccagtgaatgctcattttcctcttgggaaattctgagaatttactcacttctagattattctctgctaaagagctgggaagaaacaaaccagcggatctcccaaataaagtttgggatttaacagtttaggtcgtgacactggtagctgcttactctgcaataatcacctggagtaagggatattaagatttatttctaaggggaaaatagaagtatgggtaactttcacattatgtatttgaaagtattttttagtttagttacattttcaatgtttacggaagacttacactttccccatactccagttaatctgatccatatattacactcttgccaacgcagatgcttactgtggtgtgtttatgttaatgatcttgactcttctcacaagggtgtgtacattctggtctgtggaactgtataggccaagtgtaaactcatgcagtcagtgctttactctagttggcaatacctttgccccacataggtccaactagaattttcacatcttcccaactaggaaaggatatagaatattaatgtatgctctagcattttcaacctactttattctttatcaagataatcatgttttctcagcagctagttactcaagggcagcagctatgttttaccaaaccgtggaaaataaagctgagataatggtaacctttgcttccttaagttgacccttgatagggaggttggaagggttgtgagcagtgtctggcctacttttacgcttggggaagaattactggcctctctgcctttctccgggtatccagagtgctgggagacagggccttgggcctccagccacacctctgcctacaggttcctccaggttgaccaggttggtgcctctcctccctgccccagctgttccagctcctcagcttccaccccacccctcccagattcttacccctagacaaatcaccatgttgttcagggcaggggtacttggtctgcagagtcagcatgagtgttgatcttcagcatggtgctggttccccgtggatgctccttggatgtctgctgcttcagagcctttattatgctcccttcttgtccagtctacagcaggcaaagtggagttactgaagtcaaacccagatcaacagttttgggggccagctgccttggttggactaattacgatcataaattgggcattcaagtctgttggaaaaaagtgaaattggctcatggtcactggcaattgtaaaattatcctgtacgatgtggttatgctattataaaaggtttgtggaaaaataagaaacaacccagaaggaaggggcctagtagttgcctccacctccaaacacgcctgtgcttgggcttgccttattgtcactaccccagctcaaccaattcttctgggattggattgtaacaattaatttccccaccatgtttgactgctcagagctcagatgaccgcagctactgtagtatagatgtagagaattacatactcttttgtttagagaaacaaggatgggctttttcaaaacagattgttattagggaaacaaagaaaaagcaaacaaatgtaaaaatgtgtgggcacagaagccaaagtttgttttgttatggtttatagttttaaacttttatccaagttacatttctccctttccagaaacaaccacttgtaattctttgccatttgtggcttatagttgatacttcttgatttttcaattttaagcattatctgttgacttcccactgtggaagatgatgagttggctctctttttccctccaacccccaacgcaagtacagcttccctattttcccattcttgcagtcgttaaaacagaatattgaataatggttagatcaaaattcacagctaagccaagcataacttttttttcgttttttttttttttgagacagagttttgctcttgttgcccaggctggaatgcaatggcacgatcttggctcaccacaacctctgcctcccgggttcaagcgattctcctgcctcggcttcctgagtagttgggattacaggcatgtgccaccacgcctagctaatttttgtatttctagtagagatggggtttctccatgttaatcaggctggtctcaaactcgtgacctcaggtgatctacttgccttgggctaccaaagtgctgggattacaggcgtgaccaaacataacctttgtatctttccttgcaagttaataaatggatatgtctataaaacacagattgggaaacatctgaggcttacataatgtaagtcatttttactatcatgaaatacgtaagttatcttactttttattcatcaggcagtaaaacggctaagtaacttgattcatacctagtatgtagctgtcgtctcctggcatcctagcagcagctgtcctgtctcattcctctgcccttctccctgcttccacataactactctgtcctgaaaatccttccacctcttcttctattatctcttctctctaaagcccgtagtcttattatgagctttctttaactgttttaattactccttctcaccttttacaatcannnnnnnnnnnnnnnnnnnntgggctcccaagtgctgggattacaggcgtgaccaaacataactttttattttccttggagttaataatggatttgtttgttcattttatttattttgtgctcttcattgattaaacccacagctcttggccagttttccaaattctccctcaattgaccaggtattttgtcaatttcgttttcctcaagaagctgttcctgagcctactggcttgctataatccagactgggtgcctttggtacattggcacacttgtcaccccaagggttccctttgtcatcattctggagattctcatcatttgtctcttgtgttggatctcctggtacttgtagcacatgtcttcctcagtcttggttgactcccttcttttggtagagcccatcctaaaggagcttcctggaataggatgcctagaggtctacttttctgagactgtagatgcctgaaaatatgttttcaactgacaattgatagtttgactgagtgtagatttctaagatggcaattttgaaggcattgttctattgacttccacattgtggtattgctgttgagaaatttagaactctactgattcctcagctttttcttgtaatctgtgtagaggttacaatttgctgggtcctccctgaagtttatagaattttctcttggcctccacagtcctaaaatttcacgacactgtgcctaggtttgggtctgttttcatgcattgtgttgggctctttgaatctggaaactttcattcttcagtttgggaaattttcttaaattatgtcattggtggccgggcgcagtggctcatgcctataatcccagcactttgggaggccaaggcaggcagatcacctgaggtcaggagttcgagaccagtctggacaacatggtgaaaccccatctctgctaaaaatacaaaaattagctgggcgtggtggctcacccctgtaatcccagctagtcaggaggctgaggcaggagaattgcttgaacccaggaagcggaggttgcagtgtgctgagattgagtcactgtactccaacctgggaaacagattgagactttgtctcaaaaaaaaaaaaaatatatatatatatatacacacacatatatacacacacgtatatatgtgtgtatatatatgtatatatgtatatatatacgtatatatgcgtgtgtgtatatatatgtgtgtgtatatatatacatatacacacacatatatatatatatctatctcattggtaatttttccccctctattttctgtgtctgtgagaagctcatattgttcagatattggctatttttgactgggccaaaaataagtttttcatgactgtaatcatgaatatttaaaatcaaaatctctatttttttggttgcctgaatatatacatatatatttgtatgtgtgtggtttgtgtgtctatttctttctggtttttgttttatagtgtcagtgtcttttcctttctccctaagaagcttaatgattttttggagcaactttttttccttcctgcacagattgaatttcccaagcggcttttgtcttttcatttgtttaggtttcttctctttcatgttagaagttttccttgtgtaactaatgcccttggttatctactcacacttcagagggggattaaaaagcagaaggtctggggttcaggcagggtggctcacgcctgtaatcctagcactttgggaggccaaggtgggcggaacacttgaggtcaggagttcaagaccagcctggccaacatggtgaaaccctcgtctctactaaaaataaaaaaaattagccaggcgtggtggcatgtgcctgtaatcccagctactcagcaggctgaggcaggagaattgcttgaacctgagaggctgaggttgtagtgagccgatatgatgccactgcactccagcctggcaacacagggagactctgtctcaaaaaaaaaaaaaaatgctgaagatgtggatgagcttgtcgactggggaattcatggtagggggaatctggctgggctttttatttggggaacctctgtggtcgttacctcttgggctggtgagagtcctcagagaagccttttccattcttttccccagagattgacagagagcctggttgtcagtaagtggaaaagaagactggaagtctcagcatccagtatgtagatgtgcatataacccctccatgctgtttgtgtacagaccccctgaagggtgaaggagtagggaggaaactccaggttttttgctggggtagagaaggggcagtcacctaactggttggagtggccagagggatctgtgggatccagctttttaaaaagactttaaaaagtcactaattttttagcccacccctctttttatagagggttcaattgcctttaattatttaaccttttggagattccatggtgtaaatcagattatttcttggcttctgcttattccaccaaaatgtttttgctattgtctcttcactcattctctccatccttgctgatttatacatgaaataaaaaaatttctttattgtcattgtcttaggctttcagaagggagagaaagtagaggtttttgtccagtctgctaatagtggctagagtataatttctttaccaatctctatccagagactggcaccattcagtcatagcagtgtgttgctgttttccccttcctctacccacaggaaacattttcggatcaggctgggccgctgagccgagtttggacctcagatgccttcatatacaactctaagtgtacactaccaattgatcatagttgtcatagggggcaaaacctatatcttaggttgggtggtacgtagattactggcatagagcccttgttcctgtttctttctttctttcttttcttttttttggcgggggtggagacagtctcgctctgtcacccagactggagtgcagtggcatgatctcagctcctgggttcaagtgattctcctgcgtcagcctcccgagtagctgggattacaggtgcacgccaccacacccagctaatttttgtatttttagtagagacagggtttcaccatgttggccaggctggcctcgaactcctggcctcaggtgatctgcctgccttggcctcccaaagtgctgagattacaggtgtgagccaccgcctggcctattgttcctgtttcttgaattcactttgtgtaggatgactctttctgccatcttgacctctgaatgttttacctttcagtgaagtgcagcttctattaagtccaatattattttaatctgaaagatgggattggtgtcattgatggccatgtggcctcaatggaagttatcattatttccttctggaggccagtttatcacacaactgccttaccagcagcagcacccttacttccctttccacttgtgccctccttggaatgtgcaccaagttcctgtttctggctgggctgatgtaccctgccgtttgtggatgatcacgacttttccaacgtcatttcatcagttgagtcattcctcaggctcccttaatgggctgtgaacttccagcatgctctcccagttgctttgtaacatcaacattctttatggttacacacatgatgacaagagtcagtttccacaaaagtaggaggataattgttcctaagccatcttatctgtgcagaaaaagcaaagctcgatcttcccatgatggcagctatgcattggcaatacagaaaacaggagtgctggcgattgtgacaatggagtgggtgcaacaattactttatctttggaggatgacagatggttaaaaaggctttttcagcaggtaccactaggcaccattgtgaacaaaagcttggctagtagggatactgcagagctcattcctcccactgtgcttccacaagcatccttcccttttctaaacgaagtctttgaagtcattggaacctcccttttccaggcagtatagtttttctgtaatgtactgggtcttcacagaagttctttcctagggaaagcatagtaccaagcaagtacttaatatactgaatgaattttccagacaattttggacactttatagttaagaaaaaatgatatttgggccaagagtggtggctcatggctgtaatcctagcactttggaaggctgaggcaggtggatcacttgaagtcaggagttcaagaccagcctggccaatatggtgaaaccccatctttactaaaaatacaaaaattaggtgggcctggtggcacgtgcctgtaattccagctactcaggaggctgaggcaggagaatctcttgaactcaggtagcagaggttgcagttagctgagatcgcaccactgcactccagcctgggcaacagagcaagactccgtctcaaaaaaaaaaaaaaaaaaaaaaaaaagagacatttggtcacaattacccaagttgtactcaacaatctaaattctctaaattcttgattagactttcacatcacttgtctatatatggattgaaatatagagcattcaatttaagttttctcaagtgtattgtttcttgtattatttagaaatattcttcactgaaaacattcttgaaaggacaacatacattattatcattattttccatctgtatattttttcttagcatagtgttatgattatcttagtttttatggctacaaagaatggattttggaggagggagggaagtaagtattcattatgttatctcatcagttttatgtttctaaaggaggaacacttttgtttggatttctacaatatatacttttgccttttgtaactatatgtcatttgtttttcaaggttaaagcttttaaccttgaaatgcttacaatagagtatcaaagcgacagactttaacttgtcatgtactatatgagatacttacaaggtgaaactccctgtcaagtatcctactccttttatttttaattttggtgacattataatgtgatttagtaggaaaaacctttgatttttcttctcttatccttcatggaattccaatgatatcttttgttactatttccttagaaactcttaatgtcctcacatactcctcaatattatgtttcaaccacgacttgtgggatttccacatgactgccccaaaaatgaaactggctttttttcttacaagagtgatttaaagtttcatttttctgccaatatgatttaagcatgcaacaaagttagtttttactattagggttatttttgatttgtagaaggcagttgatttcttcattttcctgcttgggtgataaaaatgcttgatccttcaaccatgcagggaaacagaaatacaatttaactgggtttgaatgctgtcagacatgtaaatttaggtatacatgcttttgaatttttttaaggattgtcagtgtctttgtcacatacttaaaccagttatagaagcattgcatgaaataattcttgttcataagttctggagtcctagccagaagacattttttaggctcagagctgttgacacaccatcttgcttcccccaggcaaaagtttgatctttgggtgccaccgaggttctcagacacctggtgtgctccttggactctccttgccatcagtaaaaaaaaattgtcattttgtagagttttatatattccttgttagaagatgtaaacaatactgaagcttacaaagaagaaattaaaaataaccctaaaaccattccagagagaatctttgtgaatccccttccagtcatctctattaccagctgacttttaataaatctttagcaatgttctagaaaataattaaggagcattatgttacaactgtttatgtaactccaaattctacaatctttatttatacacaggtagttactttatgacgttgtaattagtccatgcataattttctttgggtaattctgtcatgttagcatacggtggtattttgagccactccccagttgttggacacttagatttttttttttctttttttttgttttagagacagagtcttgctctgttgcttaggctggagcacagtggtgccatcaccatagcttactgcagccttgaactcctgggcttaaatagaaggtttgagcttcagcctctggcttcagcctcctgagtagctaggattgcagatgcatacgactgcatccagctcattgaaacgaaaattaagcagcgatgaggccttgctatgttggccaggttggtcttgaactcctggcctcaagtgattctcccacctcggcctcccaaagttctaggattacaggtgtgagccaccacacctgactgatttctagcttttattcatcagttttagaaggtcataaaataactcactagcaatgtgaagtttccattttttctcttttttgaccttttagaattacagtgtctctgttatgtgaggacaagaagagccagaatgcttgaggccatgttatgtacccagttataggtcagataaaactagaagaacctgacaggtcatttgcagagactgtgttcttgttggtaatgtgtagagcctcatttcatcttattggatgtctataggaaaactttccaaggatcagtaacaaaacatggaagagttgttatgtaactgtgcaatgacatttgacctcagtacctggtctagagtttatgaaactttgtgtgacccgggaaggcatcttatgtcctcaggaaactccagccttcctatccattgtgccatttctctactgcttgagtaatcatggcccagtaaggtgtgcaaggcaaccagcaatgttagagaattttgcattaatgtagtttcttgataaagaactacagcagagtgagctcctgttcagatttttcttttgacatctttctttttttttttttttgagacaaagtctcactttgtcaccctggctggagtacagtggcatgatctcgactcactgcaatcttcacctcctgggtttaggagattctcatgcctcagcctcctgaataactgggactataggcatgtgccaccacgcccggctattttttgtatttttagtagaggtgagcttttgccacgttggccaggctggtctcgaactcctgacctcaagtgatctgccagcttcagcctcccaaagtgctgggattacaggcatgagccactgcgcccagcccctttgtcatctttctagatatcatggtctaatgtttaaagccttgggtggatttcttttttcttttattttaggtttgggggtacatgtgaaggtttgttacgtaggcaaacatgagtcacaggggtttttatacatattgtttcattaccttgcatggatttctaagttaactattaactggaattattttcctgtgcttcaggttttgcatctattcaacaaactataatgacacataattaacagttcacttgagaaagattcatggcctaatacttgtaaaggactttgagcttctctgagagtgttttatacacagtcatgaacaaggagatggcttgttctatttggcaaagggcaagtatattatgcccattttatagatgagaaaagagagcctcatagaagataatggcttgcttagactcacggtaaatttaatgtagtgtctgtggaattttccttggactttgtggaatgaatgaaatctaaaataaattctacatgagtgtatgtgtagggaagtagggaaagtggatttatactgttttaagcaaatataacatttcggaggagagtctttccctttgaaagagggtaaccatgtcagacaaattcgctagagttcttaaagagaattaaataaataatcagggaagacagggataaacagattttccaagtgttgaaaagacgccacacaaagtctggtaagtaaattcagtcagcaataagttgggaaaaatatttttgaaaatcaggactcaggagagggctacacgatgaacaaaggttaggcatagctggacatttctcagaatgtgtatcagaatacagatatggttgaactactctagttattatttttaaaataaattacatacaagagggagtatacagtctacatgaaccctttgggacatgaaaaagctaaacagttgatctcaagtctatgcaaaatggcagagaaataaagaatgcatttagggctgggcttagtggctctcttgttatcccagcactttgagaggccaaggtgggcggatcacttgaggttgaggagtttgagaccagcctggccaacatggtgaaaccttgtctctactaaaaatacaaaaattagccaggtgtggtggcgcatgcctgtaatgccagctactcgggaggctgaggcaggagaattgcttgaacctgggaggcagaggttgcagtgagccgagattgtgccactgcactccagcttgggtgacagagtgagattccttctcaaaaaaaaaaaaaaccaaaaaaacaatgcattcagataaaatgaatcgatctgtacatgtagatgtacattccaatgcttgtttcaagaaagagattcagatattataaagtcttaactgaaaacattcactatatgacttggaacaaaaatttctagtgttagctgttggcacaaataattcattaaatgccagttttacccattttcatgttgcttcagcatctaagataattttttcactgctcattaatgtgtcttaaagacctaatggatttaaagaaagcaaatatatttatcaatggtatagaagattgaggaaaatacttccatccaaattttcagtctagaaaggtaaatgaggaggcatgtggacagggtgcaccctcttgtactgtggcaaactgacctaaataacacaaaggaaatcattcatttgtaccttctttattcccaagtaataaacatcccaaatatctattgggcatatatgatgtgccaggctccatgctaagctctttacctagagtatcaggtttaatcctccaggcagccctttgaggtgggtaagattactttcagcgttttacagatgaagagattgaagttcagggaggttctgtaacacttggtaagtggtaagtggtggagctggagtccagaagtctgctgagctctactcactgaggtatgctcctctcctctctttgtcatattttccctccttgtaaacagagctggacaacctagaaagaaatgtgaaggtctacttcaaacaaaaccaagcagttagtttctctggatatcaccccaagccccttaactatatagaccttaagatgtcttcaaagcagcactgttgaacagaaatattctgtaagccacatatgtaatttaaaattttctagtagtcaccttaaaaaaggaaagtgcaacaggtgaaattaattttaataatatatttcatgtaagccatatataaaaatattataatttcatgtaatcatataaaattattgagatactagaaataactcaggagaaatacagtacaggacatcttttgtaatgcagcagatagagtgaaatgtagttctaccaaacaacaaagttgtgattaatggaaaaaaaattatttactgcttaagttttacattttaaattcatatttattaaaataaaaaatgtggttcgccattcgcactggcttcatttcaagtgctcattagctattggtggcaagtggctgtcatattgaacagcgcagctctatagcaaaaggtattctttgtctcctaaggacccgggactcctagacactctatccccatccctgactcctgactcctctcagcatccatcttattttccctgcctatgcccagaactgctatatataatgtgcaggttatacactacaaaattctgagatgtcatttatattgtagacccagtggatttgcttatttactgcaacaggttttaggaagatagaagtaaagtttttaaaagaagagacactttttcctaatttatgcaaaaagacttttttttttttttttttttttttgagacaaggtgtcactctgttgcccaggctggagtgcagtggcacaatatcagctcactgcagcctctcgaccttccagggtcaagcgatcctccctcctcagcctctctagtggctgggactacaggcaggcaccatcactcctggctaatttttttttttttttaattttttgtagagacagggttttgtcatgttgcccaaactggtctcgaactcctaggctcaagcgatccaactgcctcagcctcccaaagtgctgggataacagatgtgagccaccgtgcccggccacagaggcattatttttagcagggtgggcggtggattgtagcccttctgtctcttcctcgcattctggtagttggtcccatggcattgttctgttgtatgctcagcactactccagtgccctgcctgtggctgaaagtgtagaagcagcctcagtcaacctctcctcccccagaaatactgtcacagagccatagtcattcttcatggtagtttaccttggagtcatatgtgtgttattcataattgtatttccagtgcttagtgcacaataggtgctcagcatgtttattgatttgaattgttatcttagctttgactctgtatttgggcctctgcattgtgtcctcagttgtccttaatgatacatgacccagggctgatttatccaaatgctgaccttgccctctctttcatggagtcacagatcacccttcatatggtacctttgttctgataatactaattgtcattattgttattttgataataatagctgccattgattgatcacttactttgtgtcaagcattgtgcttagcaatttatgtaaattatttcatttaatcctcccacaatatctataggaggtaggtactattttacaatgaggaacctgagttactgagaagttacattacttacctgaggtcatacagctagtaaatgtcaaagctgacctttaaaaccagttctgtctgacttcaaagctctctcaagtgcccttttggttatctggggccttcctgacaagtgactgtgctgtagtggactgattatttgtctgcccagactttcttcctttgggcagctactctgtccaattcatgtggtttgggtggagttgacactacccagggatgatcatgtgattcagccttggccaatccgagcagtccctccacttgaccaagggattggctcaggggttagcatgtgatccagtctggctcaatgggactcttctgctggcatttaggaaagggggagctcttcctctgggatttaacctggagcgatgtaacctggagctactggtggtcatttttccctgctccatggaggaagccgcaatacaagagaatgggaccgtgcagtgagaagcagcactgcacggtggtgagagcacactcagcattgtttgaagtgcaggagtcagctgtgccaggacttctcgattatgtgagccaatgtgttccttttgttgttgtttgcttaaatctaattatgtgcatttgaaagaaccctgcttataccgggttttcagaagatgagtatttttgtcttggattccctatgctattgtctgtctgcccttggtcatccactacttttttggccttcgtgcctacttggtgccttgcaggcctctcatccctgtagactctgcaccatgttcagcttgctgtgtcccttttaggtcagtaagccctgccctagtgaaaggaggtgccacacccaacacctcctcaccaacagcccccgcccctccatcctgccctatggcatagcccacaaatggatctgggtgggaaaaggattttgccatgagtggaacattagagaaatctgttcttcatagacatcggaaaaattactcgtcaacctactctttggatgctgatcaaagactattgaatgctaacctcatttggtctctgacaccatctgggatctcagccagtgtaggcggaggccttgcctcttatccccagtttttttggccaccagcctttctaatcaactgtctttctatgtactctcaagcctcctatgattttgaacttccattcttctgctggctgccttcccaaatctttccagtggccctttgagagcattgttccactgtgaatcaactctcccacaccacagcctcctcacagagtaacagcattgccttccctgtagctctctctgctgtagcctactcctagcttccctttgccacttctagggcatcacttttctgccttcctgcaaaacccctttgtcctttagggttcaagccattcatgcaggtaccctcctggtctctccttttgccaccaacctctttgtcattctccctgattgactcacctggttcatggtcatctctcccagctctgctatctctgcattcatagatacaaccaactttttatgtttgcgttagttgtgcagttgtcttggggttaatgggagtcgttaattatggcaggagtggaaaataagggagacttcataaaagagattacgtatgatcaggaccttgaaaaatgaataggatttcaataggtggataaagagggaggagccttccagagagaacaactcgagcagatacatggggatatgaaaagacctggtacatttgcttgcttgagtcctggaaaacaagtggtaggaaaggaaaagggaactcagattaaattggacatgattaggccaggctcggtggctcacgcctataataccagcgctttgggggggcctaggcaggtggatcacctgaggtcaggagttcaagatcagcctggtcaacatggtgaaatcctgtctctactaaaactacaaaagttagctgggcatggtggtgcatgcctgtggtcccagctactcgggatgctggggcaggagaattgtttgaacctgggaggtggaggaggttgcagtaagctgagattgtgtcactgcactccagcctgggcaacagagcgagactctgtctcaaaaaaaaaaaaaaaaaagaattggacatgattacatttatttaggattgaggaatgaccctaaggagtatgcaggtggaagaatgcaagagaaagaacaaaaagaagaggggcaggatgatcttgtaaatgacaggatgaaaactttattggagtgattgtaaaaggtgagaaggagtaattaaaacagttaaagaaagctcataataagactacgggctttagagagaagagataatagaagaagaggtggaaggattttcaggacagagtagttatgtggaagcagggagaagggcagaggaatgagacaggacagctgctgctaggatgccaggagacgacagctacatactaggtatgaatcaagttacttagccgttttactgccttatgaataaaaagtaagataacttacgtatttcatgatagtaaaaatgacttacattatgtaagcctcagatgtttcccaatctgtgttttatagactacaactctgggagatgttaacgaggttcaggggaaatagagtaagttctatgatcaaatgaggttgggaagcgctgcattctatatgattcacctattaaagcccctgagaaatgcatacaaggaaccaatttgatgttgtttaacccagcttttcccaaatatacttgtccattcattcatttgttcattcattcaacaagcatgcagtaaatgtgtgctatggtagtatgttttgagtactctgctggccactggtcctagagtagaataaagtcacccagtgttcctacatttatgagattatggtctaatataagcacatgttatcatcccacagctcctagtgttctgaggaacatgatttgggaagccttcagttaaggtatttaatattgctttttgtgctctggaatggaatgacatggagtgattgtctgcctatatctctgcctttatgtctctatcttacatcagtacctctgcctcttcacagaatgtttcttagacctgctgccttgggcagggatagagctgatgacaaggaaactttcaggtctgggaagttggtgactcacccaagatcacccagctagttagttgcagaaccagggacagaacccagctcttctggctctaggttctggttctgtgctcatttctttcttggtaagaagggacaacttgaaatgcttgaaaattaaaaaaaaaattaagcagactcaacagactcagtgagatactatggcctttgccaatttaatcaacaatagcaggattgacttaaggatcagcagcaccaccaccactaccactatcatcatcatcactaatgctgagtaattactataatccatgtgccatactaagcactttatgtatatttgcttatttaattcttacaactctgtgaagtcataattattaccctattttataaatcaggaagcaagctcagagaggtaattgtcggtgtttatacaactaataaggagcagagcaaagcttccattttaggctgttttcagagtccaggctgtgaactgcgttctgttatctagtgaaatgttttttctgctttagtattttcctctcagaatcagttggtcttttctctcttccattttagcttgccttgcttcttcgtctttgtaaaaaccagatcttaggatctgatttgtttattctatgtcaggtagcattcatccaatatttgcttctactatttcttctctgtaaaacccatagtcttattatgagctttctgaaaccattttaattactcctcctccccttttgcagtcaccccaataaagttttgatcttgtcatttacaatatcatcccacccctcttctttttataataaaggctgttatttctcttacattcttccacttgcatactccttagagtcctccctcaatcctaagtaaatacaatcatgtccaattcaatctgagtatttaatgaataatatgtgaaggaactgctttaggagctgaggacccagtggtgaatgcacagaacaggttcctttcctgtgaaacttacaaccagtggggagagtgcacaagaaaaacaacacataatcaagaaaagtgtcacacagagataagtaccatggaaagaattaaaacaggataacatagtgagaataactggctgtctactttagactgggtagtcaaaggaaggtctttttttgtggaagtgaatttaaactaaaatttgagttataagaagaaaactgcaagagagaaatgggtggggaggagggagaaagaaaatggagcactcttccaggtagagagaacattatgtgccaagaccccagccatgagtttgcagtgtttgaagaataggaagaaggctggtgtggttgaatcatagtgggccattggggagtggtactagatgcggttagagaagtaggtcatatactaggttaaggagtatgggttttagtttaagtgcattgggtaggcgttggaggattttagcagggctgatgacatagactgatttatgttttttaatgaatgtatttactgatgcatggaaaaatgattataaggagataagaaggaagtactgagacccattaggaggatattccagtagtcctgatgcgggataatgatggctctattagttattgccacagtaatcctgtgtaacaaacagtcccataaattcagcagcatacaacaattaggatttatttttgctcatgagtataggatgtctgggtaattctgctgatcttggctgggcttggttgatcttaactgggcttgcccatgtgtctgtggtccactgtgggttaggtaggcagctctgcaatattgcctgggttctctgatatgtttgaggggccagctggctgtcaactagtatagggatggtctcagctgagatgtctggatcaactctgctctcctccatatgtacattacatccctctagtaggctagtttgggcttaccctcaggctggacagttggattctcacggtgatcgcaaagaagcaagagaggaagtagaaacaaacgcacacgttttaaggactcagcttgtgtcaagtttgctactgtcccattggtcaaagtaagttacataggtatatccatagtcagtgtgggagggcattgccaaagaacaggaattcagacaggtgtgaaaagatacaaggagatatgaaaaattggggccattattccaatcaatctattgcactcatgggagagtagtgaagaatgagaatcttgaataggttcaggaaatatttaggggtacagtccaaagaacatgctgatgaattagatttgagtatgagagaaaagaatgaatcagagctaatgcctagatacttggctgagcagctggggagatgatgaggccatttacttggatactggatgaagagcaaaatttaggggactatctagagctctgtgttaagtggtgttgtgtttgagatacctgctagatatttaaataaagatgttagggttgcagttggatacagcaatctgaggttctggagaatgtcaaagctaaagatgtagattttggagttatcagcctatagatggctcagctggaattccaggatgcatgccttggctgggatctactgaaatccatcagccagtcaccctgaagtcttctagtctatgcgtaactgataagactcacatcgtgctttgaatgtgcttttctatttcactagtttaaaatattagtgtctacttgtataatttgtgctgtgaactgaaaactacagttttcccactctgccatgtacagccttctgatttggcagaaataatactgaaaggacacctgccagggtcttagtaattcttagttatagtaatctgagacatttcagctcagggttagcagaaagatcatgaagtcaagaagcagggcttaaatcagatgaagttggaatctccaaaggtaattacttcctttgtgaagccataggtctttgggactgtttcctgttaccttgggccattcagccaagtacaccataaaatacttggcctatcaggaaggcacatactagcatttaaaaaattttacaaacgtgctgtttaaattatattacacaatattaccatgaacataagatttacatttctgtcacatactggagagtgtatcttaaactgaatttcactcaagttttgccaaaagtggtcttgagataatatttaacagatacagaccaaggatcatattcctgatttacctatttctgtactttattcctatttcttgaattaaccagatagcaacctatttagctcagcccaggtaggaatgcctttactaaggctttatttactaagccattatgaaatgttaatataagaagtagcctgttgaggagcacttttgtgatttctgcccaaactgctgttgaagacattttgtaatatctttcattatcttttatgatcccataaactggtttctctttggagtttagtgacagggaaaatttttcttttgataagctggtgtgtaatttatcataaacattattattctatgaagcattcaaaaaattctttaatctctgatattttgagaagctccaaacttgacacacgattacacaaaatgtttcagatttctggttttcagtgtgtagtagaattgaagcatatatgaattaggggaattcaactctgtgggccagccaaaaaaaaaaaaaaagaaagaggagacaaagagagagaaacaacaatgtaaagagtgcagatgaacctattcatctttccacctgatgagtatacaccccagaaggggtgtgtactggaggcgtgtgaacctagtgctctctttgtctgcctgagtctgcagaggatatccatgagcatctcacagtgctcaatgtgatttgtggttaaagatacataccttgttatacaaactgacccctaggcccatgccagatactttagtcccaaaccagaaaacctaaaattgattattctgtgggctggattgtttgcaaaaaggcctgcatcattcccctcccagtgtctgctcaccttgagtagtcacctcccgtactgacgctgggcttgtgacttgcttttgccagtgaaacaagagcaaataaatgtaaagcattcagagacatgcaatgtgctgtgtactgggtgcgtgctctctcttactgcacttaggaccctgaggactgtaggagcaagcccaagttgtcctgttcaagaagccacgtgtgccctggctgatagcttataattgccagaagcgtgaatgaggccaccctagatatccaggccaggaaagcccaactgacctgcagaatcatgagaaacaatatgtttttattatttgtacaccactaattatggagtgggttttgtttttgttctaatcaaaagctaactgatagaacttccagtgcttctggacatttctgctgatactgtgttggacatatccagagagagtgtatcagtctgcagtgtgacctgtgtctcctgtggaagactcaaggctaattgactgtgttcagtttttaccctatgtgctgactgagaaccaacccctgcataagtctgagttccactctgttttccactttctgccttttggtttctgactcctccttttagttttaattcttgtctgtatatttacatgttgtacatgtattgtttcttaaattacttttattgagaataaattcaattaacataaaatttgccatttaaatcgttttacagagtagtctagtgatttttactatatttatgatgctatgcgtcatcgccactatctaattccagaagattaccattatctcagaaagaaaccccacacctccatatcagtaacccactttcagcctgtgtggatttacctactctagacatttaatgtaaaagtaatcagtacaacttgttgccgtttctatctggcttcttttatccaacataatgttttcaaggttcattcaagttgtaccatgtatcagtatttcattcctttttagggtagaataatatcatatttcattgtatgaatatataaattttgtttattcattcatcagttggcagacattgggttgttttcactttttggctgttgtgagtagtactgccatgagcattcacatacaagtttttgtgtgaatgtgtttttaattctgttgggtatatacctaggagtggaaatgctgagtcatacgaaaattctatgtttaacttttgaggaactgccaaactatttttcacagtgcctgtaccattttacatttccagcagcaatgtgtgagggttctgatttctccacattcttgctaatacttgttcagtttctattttttggattatattcctcctagtgtgtatgaagtggtatctcgtcgtttcaatttgcatttccatagtgactaatggtgttgaaatttttttatatgtttgctgaccattcatatatgtttttggagaaatgtctattcaaatccttcacccattttaacactgggttgtctttttcttgtttaacggtaagtgttctttatatattctggatactagaccattatcagatatatcatttgcaaatatgtttttcattctgtgggaacttcttgtaaccttcttcaataatgtcacgcaaaaatttttaagttgatgaagtcctacttacctatttttcttttcttgcttatgcttttgatgtcatatttaagaaaccattgcttaatctaaggtcatgaaaatttgtacctatgttttcttctaagagttctacaattttagttctttaattaaatctttgatccattttgagttaatttttgtatatggtgtgaggtagaggtccaaatttatttgtatccagttatccctataccattgttgaaaatatttttctttccgcattggatggtcttgacatcttggtcaaaaataattgaccacagttgtgtgattttatttctggacccttaattctgtattgttgatctatatatctatccttatggagtactacacagttttgattgctatgccattagagtaaattttaaaattgggagtgtgagtcctccaattttgttcttttttttttttcaagatagttttgtctattaattttactatatgggttttagaatcaccttgtccagttctgcagaaaaggttgttgggattttaatagagaattcattgaatctgtagatccatttgggaagcattgccattttaacaatatcatgtctttcatccacgaatgtgggatgtctttccatttatttaggtctttttaaatttatttctacaatgttttgtagtttgccgtgcaaaaatctcattcttccttggttaaattttgttcctgcatttttttttattgaaacatgtctcaatttctctctgtaggtagacaagataaaaatgataaatccgtaaaaataatttttcttgttttgagatggagtatcactcttgttacgcaggctggagtgcagtggcgtgatctcggctcactgcactctctacctcccgtgttcaagtgattcttgtgccacagcctcccgagtagctgggattacaggtgtgtgccaccatgccgggataattttgtatttttaatagagatgggtttcaccatgctggtcaggccggtctcaaactcctgacctcaagtgatctaccctcctctgcctcccaaagtgctgggattacaggcatgagccacggtgcttggcccaaagtaaatgtttttaatgtagctcttcagctattttaatgtagccagacttttttcctagaagtcggggaatgaggatactagatttctagtctcaaaggtgttattattatgtttataattttggctatatcatcttagcttttatttattcatttataaaattgtacctgtcaaagtgccatctactctgtccattttaatgttttagcgattaatagtaatagtaatgctatgaagattaagttaaaacagtaatactgatagcaagcacttaaatggcatctatgtgccaggtaactattctaagtgttttctgtgtataaacttacttaatgaaattaaatactgggtggggtgaagctttaaaggactgtgtgatttttttgtgtatgtgtgtttgtgtgtgtatgtgtatgtgtgtatacacgtgtacgtgaagtctttttggatgacatttggaaaactcataattttaatctagagttctcaaacaatagttatagtcaatgtttaattttttttttttttttcctggagaaggactctcgttgtgttgccaggctgcagtgccgtggcgcgatctcggctcactgcaacctccgactccctggttaaagcgattctcctgcctcagcctcctgagtagctgggattacagacacgcaccaccacacccagcaaatttttgtatttttagtagagatggggtttcaccatgttggccaggatggtctgaatatcctcacctcgtgatactcccgcctcggcctccggaagtgctggggttacaggcgtgagccactgtgctcggcctaatttttaaagattaagatattaataactgtattaatgaacaaagggagggaggtgatatctctcaactctgcctgtttgggctttaattatttcacctctcaattgagaagtttgaatccaatgatctctaatcttagagtgcctagctctcatagtcagctgtctaatggcttagatatgatatctctctgtcctgtgtgtggtatttgagaagaaggatgttgcaggggaaggctctttgaggaattagatcaaaactccacagaagtgtgagcttggggaaggcagagcttgtgttttccatgtggaatgttatatccctgtcacagtacctgatatacagtagagtttaaataaaatgttttgttgaaaaatgagtgaagaaataaacataagactggaaagaagtcattttgggtttgatatgatttggctgtgttgccacccaaatttcatcttgaattcccacgtgttgtgggagggacccagtgggaagtaattgaatcatggggcaggtctttccgatgctgttcttgtgatagtgaataagtctacaagatctgatgattataaaaggggagtttccctgcacaagtgctcctctctttgcctgccgccatccacgttaagatgtgacttgctcctccttgccttccaccatgattgtgaggcttccccagccacgtggaactgtaagtccaattaaacctctttcctttgtaaattgcccagtctcgagtatgtctttatcagcagtgtgaaaatggagtaatacagggttttagtttcttttaaatagtagaaacgtgtatatgtggattgagtgtggggagaggaaggagtattaaaatggatatatttaaattaatataagctgtttcttactttttgtatttcttcatactcatcttgtatttcacaacactgagcccttggcctgggatgtgcctttgccttgccatctaccaacttactcagctttttagcccagcccaggcatcacctttgctggttatctctctacctcttttttttttttttttaattatactttaagttctagggtacatgtgcacaacatgcaggtttgttacataggtatacatgtgtcatgttggtttgctgcacccatcaacttgtcatttacattaggtgtttctcctaattctattcccccaccagatccccaacccccaacaggccccagtgtgcgttgttccccgccctgtgtccaactgttctcattgttcaattcccacctaagagtgatctctccacctcttatctccaggcagagttgaagcttgtaaccatctgtggtctagcactgatcacatggtaatgaaattgttagcttctgttgtgtctgtcccttttactagggtatgagtatcttaatggccatgttttatgttttattttgataacatatctggcatttagcaggtgttcagttagcagttgttgagtgtgtaaatgtgaaccaatacagaataaagatgaggcaatgaccaactgaccaattgctttcctgagtgtttgctgcgtgtaaggaattttatgtgcatttctcttacttctcatgacaatcctttagagttggtatcatcatcatcctcattttacagataagaaagcagtctctaaggaattaagtaacttgtgtaaagttatgcagcaaataaatggcaaagctaagatttacagccaggttaagcagacttacctgtttaagttccttccactaaaatcagggtttttggccagaatttccagtaaaaataatgagtgaaataagatactggacatcaggtgacatcaggaaaaaaaagatcttcgggatgatgtttaaagaaccattgcttatgtcttctccagcagtctcaggaaatagattaaaaattgggtcttttaatatatcaaaaggtacaggcctgccctctcagtggttgaattttctgtttaacacagtagtaaaatgaggaacaagtgggtttctagatcaagctacgtagaataattacatttgggggctaaagacaacattagagctcatcagcctcagccccattaatcttacagatatcacaagacccacagagtttgtaagtttggtcctcagttgctttgtcagttaagggcagagagtgttcctttacatcatgaggctcactttatatattaatagaaaatttagaataatggtagataaaaacttgtcatattaaagagacaagagcatgagagcttggttgaaataccatcacttcacacattggagatagtatctctgagcttctggtccccctcagaaaaaaagaacttcctgcataggacagaattcatcatcaggggcatctctgagaaaaaaggatcctgtaagttgtttgttaacttatgattccaagactttgctaatttaagatgcaaatgaatatacaatggtccctccttatctgtgtggcttttgaaataagagttttctttcagatttgcccactgatagtaggaggaactacacatggtgaaagatctgaagtagacgcttctgttacctttgagatttggcttctgaagtaaataccagcaagctagataaagtgaaatcattgtcatccgataaatacttaccgaatacccaatatatttcaggcagtgttctgggtgctagatcaggccaaatattatattttattttgtgtggcttgtgtaagacagaatactcagagggaaaagaagacttggaaatatgcttttgagaaattgatatgtaatggaattgagatttatgtatacgtgtaacatgtacacaaacattaatttattttgttgtgggtccatattgcttatataagtaaatttgattttcagaatttcacacagcactggaagaaattggacattgacttattttaccaatgtagcaagacactgcacattaccacttttaaagtccttaatagattgtaatgtcatgcgttgtttttaaggtactcttttcccattcttctctagaacaaagatcatttcttgttcatctttgttaaccaccttagtgcctcatgcatggttcctaatacatcatgactgtgcaataaatgtcagaataaataatcatgaatgtctcaaattatttctgtggacaaattagctcatgaactgaaaatggtaaaaagatggttgagtgaagaagaggaaacatttgagggaaggaagaaaattgacgaggataagagatgaatgaaacaagaatgaggtggtcaagaatgctatcatatattatatgtcctggtaaacttctgctgtgttagaaaccatccaagacttaaagggatacaaccattttatcaccctcatgaattctggaggttaagaattagtgcacagtggggatgtcaaggctcttatcttggaaaactttaatggctgggggtgacttgaaccacaaagggctggaatcatttgaaggtctctcactcatgtgtctggcttctaggctgagatgatttgaaggctgggctcagcagtaattctgcaatagaactgtatgtgatttctctccttgcagtgagcttttctcagtatggtggctgggttccaagagggagaatattcaaagagctagacgtccaaaaaaatcaagcagggctacttgggcttttatgtcctagtctcaagacatttctactatactgtattagtcaaaggagtcataagcctactccaattcaaggggaggtgacatagacccatgagaagagtgtcagtgaatttacaggtatttaaaaaaaaaaacagaaacagcagcactacatattataagtggaccagataatgacaatgatgaatagagcaaagaacaggaaagttcattatcaatttacttcctcagagatgggacatatgacaatgtcattagacactttccaaacagtagttagattatgacatacatccatgatactttttgagtatagttgataatttttatttgttacaaatcatctatgagaatgttttctatcaaattagtgtttttaacagttttttttttcctgttagggatcaggtatgtaatggctggcatttcagtttttgaaattcttcattaactgagctccataagctttagaaataagggcagatacttgtctggtcaaatgtgcctttatgatctagtgtgttctgcagttccagttatgatgccgacctttggtaatctttctaatgattcttttataaaaagtctgccatttgaatatactcactttgcctgactgcccactgtgctttgggactttgttggtctgtagagaatctttttatcatgatgtagacttgaaaaagaacttcagctttcatgaacttgaacagggaaatggaaaggacatagagggaagagaggagttataatgagttcaactgttgcattagactgtggttttatttttgggagctagaaatcacatattcctttatgtctgagaagaggtagcgcagattacattagcacaaggctctgctggctcacaggaatcaccgggaccattggaaggtatttgtgatgaggtaggtagggcagtaataatggtccttggggaaggtgagcccatccacctttttcttgtgttgtttgtctgttttggtgcttttttccccctccctcctttctcttcctgcttttacccttttctcttttttcttatcaactctgaagtgtttgatgactgggacatggaaaactatgttattcctgtaaatatgttttaaacactttttattgtggaaaatttcaaacataagtaaaaataggatgatataaggaacccctagtatttatcactaaacttcaatagttatcaactcatgaacaattttattttgtctatactcttccatacccttcagattaggaagcaaatcacagacattattttatctgtgaatttttcagtatatatctttaaaagataagaactctgaaaaatataatcaccataccatcacacacacacacacacacacacactcacagagcaaatcataaacaactgaacactatcttaatatcatcaaatcctcatatcatcaaacaaatattaccgatgaaccttaatatcaacaatattgagttagtattcaagttgccataattgtctcatacatttcagttgagaggtctcttaagactaaatatatgtcagaccctcctgaatctctctcttttatttttgttcttaaatttttttttgttaaggaaagtttctcatttgtaaaaaaaaattgaatgtactaatgacttggactcttcattcctattttaaaaacattgagaaaagaatatatagacacggatgaatgtttcatattaaaaataacagaatactgtggccaaggaacaaacattggcatttgattatcttatatataatttccaaacattctttactctgatgctttctcctagtaaaaggccctgaaaatcactgtacccactgagaaatttgttttatcttattttcacttgtattgtttccctctgcagtagcaagaaatagacaaatattggttttatacaagaaattcccttatcagaggagaattggtgtcagaatttgccacttaaagtgaatccagttacatttcacagtaaacagtaaaagagaaaaaacctggaatgattcagactttatcctgaaaactaaagtgaaaatatgtttacctcatatttagaaccatttagattataactaattcataggaaaaagagtgaatctagtattttcttgatatcattttctgacaaaattttaatcaaaattttgacttcttttacgtgtgagtttgtcagcacaatttgaaagagagctttttttttcaaaagcattagaaagttttaccagtttttgcaagggttttcctgttccatagaataaatgttaaccgactataacaaagataccatgatatataatttctaaaataagatagaaatatacttgtctctcacaaagtaagtgaactagtctagcctctgctccattaagtcattccaggatcaggctccatcttgtttcttccccaccttcagagtaatgctgggatgcataagggaagttgagtctgccagtcggaggctggaaaatgccctaaatccagggaagtagcttgtctttaagttgaaaatggcctggaaggagtacatataacttctaccacacatctttttggtcttaacttagtcagatggccacactttactgcaaagaaggctgggaaatataaatatataaatacatataaatatataaatttatatacatatatataaatttacataaatttatatatgtaatgcatatatctgcatatggacaataagaaacaactattcctagggcagcactctcagtctgtttctaggttcacatgtcccctaatccagtgctataatcacctaccctatggtagtggactggggtaggggatatagtatcaggagagatgagaaatcagccggcctttcaacttttgccttttgtcctaagaggacttctcttatcctctctttagatgctattgatagtgaaagataagggttttatgcagatctcttggtgctgttcaaggtgtctaccttcaacaggttagcagatgaatactcaaaacgttatagcctgctgcatatcaactggctgaaaggagaaatatataagactttaagaaaatacaggttatcacatggtgcttttgtttaatagctcaggaagacagaggtgtacagtgttacttccttctgagcacgaaaacattgcctaatcctggaatagctccaattcatgacgttaaatggggagcctagaatgtactctattttgattgaactcatcctagtatttttttcctttgttgtatttctgctatttaatccccttttacaaaagaaatttggggctttaagctgagagtatatattgcagaagaatatgtggtaagatttattcttatataatagctacgcattttggtacttttgaattgaaatataacctgatactgttgacaggcaccacagcatttgatttctcagattaaggtcggtttgatgtttatttgcacaaatttcctaaaattgcaaacaaatagtaactttgtcacaaacttgtgatgagattgcaaatggtaactttgtcataaacctgtgatgagatgtgaaataaggtcacctgttctgatgtagaagtttgtgaactgagggctttaactaagttttaataatatgaggacatcaccaagtattaaattgaattatataatattgctaattctgtaggtaaaatactgctggatattggcaaaatgtggcacatagtaaatgacttaacctaataagatgagaatttcaacaacctctaatcactctttgcttgctcttataaatagtccatcctttccccactctgttatcagggccctttttttcttatttactatagtccattccataatatcatttggtaactcacagtcacttttgttttcttttgtctctgattttctttcccatttagcacctctgttctcttgacttaaaatagtatgaaaagtcatattgactaggataggctgttctagtcaccagctatttttttaaaaattattattttctctctctctctttttttttttttgagacagagtcttactccaacacccaggctgaagtgcagtcgcacgatcttggctcactgcaacctctgcctcccgggttcaagctatttgcatgccttagcctcccaagtagctgggactataggtgcatgccaacacgactgtattttcagtagagatagggttttgccatgttggccaggctggtctcgaactcctggcctaaagtgatctgcccacctcagcctcccaagtggtgggattacaggcgtaagtcaccgcacctggcctattttcttattttaattttattttttaattgacaaataataattgtacatatttgtggggcatatagtgatgttttgatatgtacaatgcatagtgatcagatgcagggccattggcatatccgataaaaaattatttgtttttaggcagaatttttcatgatgaaaaaggttttaagaactgttggctaaaattgctggactgtgaaactgagtattagtcagatattcagatttgcaacgctggatagacagtataactttggtggtttgtgtttctcaccggtgatacagtgacagtttctgttgtctacctcagaatattagtgttcaaagacaatgtgttaaaatgttcagaattttagcagttagccgccaaggcaaagggaatagtactcttgtgttcaactccaatgagatagaaaaggggtttatgttgcagtcgagttttatttaaaaaagatgtttgtggcccggcgcggtggctcacgcctgtaatcccagcactttgggaggccgcgacgggtggatcacgaggtcaggagatcgagaccatcctggctaacacggtgaaaccctgtctctactaaaaatacaaaaaaattaaccgggcgtagtggcgggcgcctgtagtcccagctactcgggaggctgaggcaggagaatggcgtgaacccgggaggtggagcttgccatgagccgagattgcgccactgcactccagtctgggcgacagagcgagactccgtctcaaaaaaaaacaaaaaaaaaagctgtttgtaatccttagtaacggctaggagagaaagctggaatcctgaagttttgtttcatcttcattttaaaatttagaacatcaaacctattattttctttctcagaggggacatctcccttcaattttcgtattaagagtttgttgtggctcttaatgatgccctgaaagtcataggctatctctgttgaaatctggagattgaatccaattgcacttagcagtctcctaaactaggagactggaagtgacacctcattaaactttttccttccattccaccttcctttccactagagaagttgtatagtgtagtgaagagtgtaggccctgcaattgtattgcctaaattaaagcctggctcttattcttaccttgtgatgtgtaaagtgtagacagtactagtacatacttcagaaggttgttgagagaatgaagtgattcaatacattgaaagtgcttagtgattgggacagtgccaagtagtaaaagcttaataatgataatgataatgattttttattatttttctgtgtgaatagtaattccatagggatactcctggattcccctatggtctgcttattcctccggatttcactgatcttatcaaaaggttattagattgacctctcaggacaatgatgtttacttttaggaaaatctaccctcagcctcctcccccattttggtccagatttcacagcatttagcaggtatttcatagtttgtagtttgggattgaaggctgtctttttatttctttgaagatgggattctcttcctctggtttttatgttttattatttagggtagaagagtagaacatatacctttccactgctattctccaatgatattctgattttcagagggaatcattttcattttttcaaactttttcatctcattgtatcttattaaacaaaaattatgggaggccattgttttggactgagctcctgtactaggccccaacaaaccagaccaaacagaaatggagtcacccatgctaaatgctgcataatcaaactgaagctttaagggagcaggtagatccccaaatagaccattttcccccctgaaaacagaagattacagtctacgtgaatcagtttaataaggaagtcccctctgttttaatctttaccaaaaaaagtaacctgaagtaacttgatgttactaatcagctttttttttttcctattattctgtttccttgttcccaccttataaaatccatggttctgccctggcccagtgggagctctcattctattttacagagtagaggctaccctgactcatgaattgtgagtaaaagtcacttttactaaatttgttgtcattttgtctcttgacagtctctaaacatgctttacattgctacttcttgctttttcaattgtagatattatttattggtttcctcctccttctcctctgctaccttttcctccttctcctcctactaccatggaggaaatagctctctttcataaagtactcccccacccacacgggagcatacttcctgctctcacacccaatgtatttatattggtagtaagattatcactattgtttacctgattatgacggtgtagttgttatttgtagcagaactctgtagcatacctgtgattatttttccttttctaaacaattttttgttttcctttggaattattttgttttttaaaattggctaaattttactaacttattataaatcttctccccatacattcagttttgtttcctagaagaattctttggaagaacctccttacttgatccaatccggactggttgtactcttggccagctgctcagtgtcattcattttgggatttcccttcatcatctattgggggagggggtccctttacctctttcttatgttggaatgtttgtttcctaaattcttgtggtttttgcttttttggtttcctgctttgttttggtattttggctacatccccaagtagctttttgagaaaggtggataagagaaaattgttaaagccttgcgcatatttgaaaaacgtctttattctcctgtcacttcattggcactttggctgagtatagaatttttgattagaaatcactttctttctgagtttttcttcattgtcttctactctctggcattacccttgatgattaccattctgaattttgatgctttcaatgaaacttacatttaagcttgcttaatatttggcttatccccatagttgtgaaattttacaagagttgccttaatttggtagtatttcaatctgaaaataaccttcagtttgaagaaattttcctaaaaattttctttgattgttttctcattctgttttctttgctttctctttctggaacttctggtttttagatgctgaactttctgagtgagttctgtaattccattatgttttctgcgtcttaattttttttttttttgggagagtttctcaattttatgttctaacttttccattgagtttttaagttctgtcattttatttttgatttctagtagctcctgtttttttggctctatttcttattttggctgtgtcttgaccttgtttcatgcatgtatttcccttaattctttgattttgttgagtttttttttaacattttctttttttctgtacaacttttgtttcttccaacttgccctttttttgcatttgttctttgaccttagattcatattataatttttcctcaattgtctggggtgatccttggctttctctcatttatcagagtgggactttaaaaagtcagttgagctgggcgtggtcatgtgcacctgtagtttcagctacttggggaggctgaggcaggaagttcacttatgcccaggaatttgagtccggcctgggcaacatagccagaccttgtctttaaaaaaaaaaaaaaaaaaaagtgtcaattggaagcttcatgcatggtagtgggccttgctgactgtgggcttaactatagggtagtctggctgtgccatttttttggggacacttctatgtctgtgtcttcaagacttttcccttagtccagtcctgatgtcctggagccagatgggagaagagagctgactagcctcatcattgatatggacacttgtacagtttcacttaagctcctccttttcagtgtggtattcccagctgcagctgcacttagtctctcccaggatagagaccctgtgttttatagtcttccgaaataaacctctagttttcttccagggttgaggagggttagtcacctagatctatggcatggaagtggagaggatcggggactctctttattaaactgatttgccaacaattcttctgctttaattccttctccatcacaacttctagagataccatattcttctgattcttgagctatttggatgttttgcagaagaaattgggttgtttccagccttccccttggtgggacctggcacatatttatttgttttccagtttccaaaattctattgttgtttccttttttgttttctatttccttgagagtcagttccttaacaacaacaatgtaactgtttttaatggaatttcaggaaggagccaatgcgaagtgtgcattcaacactctatctttggctggaagtctacatgaggagacttttccttcatttgtatctctctgaactttagtagatttcttggccaggacttcccattggccaatgaattataacaacagtggtgaactttagttgtatgggatagaaggatagggaaagcccgtaagtaggaactaggagacttttttctagtcttggcttgtgtgaccttgagtaagccatttaacttttctgaacttcagtttcttgagggagatagatggtgactaagattcctttcaacttaaatggtgtgattctgtataagagtagtaatcacacatatgtcagataaggtgttttttttttgttttgttttttttgtttttttgagacagagtcttgccctgtcactcagactgtagcacaatggcgtgatctttgctcactgcagcttctgcctccccggttcaaacgattctcctgcctcagcctcccaagtagctgggactacaggcacccgccacctcacccagctagtttttgtatttttaatagagatggagtttcaccatttccaccaggctggtcttgaacccctgacctcaagtgatcctcctgccttggtctcccaaagtgctaggattacaggcatgagccaccgcacatggacagataaggtgattttttttccccaggacattcaacatgaatgttttttctgcccctgatgttgagaccttttgcttctagaactgcatataagtcctgccccatttatcctttgggccttccaaaagtctgccttccatttgtttacaatggtattgctcactgtgttgggaactacatgtctacacatggcccgtttatgagagcatcgcttgctcttccctggtatccattctttgttgtttttttttcagacggagtcttgctctgtcgcccaggctggagtgcagtggtgcgatcttggctcactgcaagctctgcctcctgggttcatgccattctcctgcctcagcttcccgagtagctgggactacaggcccccgccaccacgcctggctaattttttgtattttttagtagagacggggtttcaccgtgttagccaggacgatcttgatctcctgacctcgtgatccgcctgcgtcggcctcccaaagtgctgggattacaggcgtgagccaccgtgcccggcctctgttcttataagtagtcattttcacccttgaaaatgtgttgcacaaagatgaaaatataatttccagagaaatggtatttgcattctgacagtttcttaggaaagaaggatggagtgccaaaattttaatatggaataaggaagaccaacttagatgcaaaaagggcaagagctttcctgtgactccttagcttaagttggctgttgggttaattagttctgtggtttagctgctactgagaggctactgtagacactgggagtgggataaagaggtacaagagttcagtgtcttcctttaagatagtggctctcaattctatcagtacatgaaatcatgatgctcagggctcctccccagaccaactgaataaaaaaacctggaagtggagcctagacatctgtattaaaatgaaattccctagattctaatacacacttaaggttgagaaccattccttaacagctaagtgagaattaaaaatacgtacattaattgctgtagacatagcagaatatgattagctctatgatgagtgatagaaattatggcccaggagttggaaggcttttaattaataggagccattaggagagactacatcaaggaggggaattttgagctggtatatcttcacaggtggaaagcagagagtccactaggccagggaatgaatgctgtgaggggaatctccggagatttggaagactattttgattggagtgtggtggaagtaaagatggactggtaggctgcagccagaatgtggacagtctctcgtgtcagactaaggaattttagctttactctgcaggtcgtggggaggcattcaggatttctgatgagtgaaatggcaatgctgaatctttgaagattgatccaatgggagtgatggataggtagtttgaataaaagcaggcaagaacttgaggaaatgaagaccaattgggaagctactctcatggtccagatgtggggtcataatgttctgagcgaggcaaatagccgtggaattaaaaatgataaacatttgcgtagtattttcatagtcagttcttgcccatatctcatttaaacctcacactgaccttgtggtctttccttccatactttacaaatgaaggaactgatgttcagagagaagctgttgtaaaggaaccttatagaaaatggaggggcctgattggatgatgaccaatcagtaataggaaattaaagggtgcattggaggtgttggattgggtgtgaagatggtagaattcctcagtggctaaccatgtccagtcaccggccgtgctgtctgagagccacttcatgctgttcatgtgactcttcttgcctctgtcctttaatatgcagttatttatttattattattattattattattattattgagacggagtttcgctctcgttgcccaggctggagtgcaatggtgcgatctcggctcactgaaacttccacctcccaggttcaagcgattctcctgcctcagcctcccgagtagctgggattacaggcacctgccaccatgtccagctaattttttgtatttttagtagagacggggtttcaccatgttggccaggctcgtctcaaactcgtgacctcaggtgatccacctgcctcggcctcccaaagtgctgggattacaggcgtgagccaccacgctcagcctatttattattatttttgagacgaagtcttgctctgtcacccaggctggagtgcagtggtgctgtctggctcactccacgctccacctcccaggttcaagtgattctcttgcctcagcctcctgagtagctgggattacaggcatgcgccaccatgcccagctaatttttgttattttagtaaagatgaggttttgctatgttggccaggctgctcttgaactcctcacctaaagtgatctgcccaaagtgctgggataacaggcgtgagccactgtgcccagccacagttacttctttaaaggcatagtggaggcaagagaaggagaggctgttgttaattcaacttgtctcaaatatgaatcttcaagccttttttgaatgtctttgggttttcagatagttaaattgtgttgaattttaaaaggctcagtctaggtatgaatagtctggagttaaagggctgagactttcttatccaggtggactctgccctgagcaggttaactatgactggtaggtttccatttctcttgtggtggagacaggagccatagggaagagaactctggagcatggtagtgtagacaccagagaacatccctgtggcactggtaactaggatgcttcattgagattacatccttatcagagctggagtatgaatcatatccaccaccatgctaattcattttgttcatgagttggctgtgtctgtaaggtcatctgttttgtgaaccaagatcctgaagcaattcaaatgccagtgtaaatcagccacacaggtgacgaaatgtgcttttccatatgagatacttgttccctgcaatcaaatagtaggagtgcaccagaaagctaagggtactaggaggtaaaaaggaatgaatcatcatcatgaagaaccttgattagatttttctcatgaaatgatgagatgtggaggagcaggatggaaactggaaaaggagaggagattgaatttttgtgccccaggcattctcagtttgggcacagagatcaatactcatctgctccagcaggggtgagggtgaagctgattttggtaattggaaatggcaacatccatagaaaattaaactgtcacattttaactgtttcttttttcactgtagaatactgggatcttcagtggcaggaggagtaatcagaagacggagatgaattttaacactattttggaggagattcttattaaaaggtcacagcagaaaaagaagacatcgcccttaaactacaaagagagactttttgtacttacaaagtccatgctaacctactatgagggtcgagcagaggtaagagacaatcacgatttacttttctgctttctatgtagataacgattttataatattgcctgcctctccaatcttattgaaaatgctttgggttaatgaagtaatgatttattatcatttggacttgaaagatgaatttcagagtatggatagaaattaacaaatctgttaattataggtttattataattaacctatgaattaatctattagattacattacttttagatcctcatggaatttgtaaggtgcattgtacatatggctctctcctgtaaaccgcctattatgtatcaaagtcttctttagcaaatataaattgtatccaagtccattactttatatgaatatttcttctttattaagtagaagttacttaaaactggttggtgatttggtggactcaacacgttatcgaagttgacctaaagcagagtttttaaacattcatttttttaatgataaacagctactacaaagtttcttcgatggcagcagggagaaagcagctcactaaaaaacctggccggtgagcacgtggcacagacaaatgtgtggttagcacactcctggcttgtgggtggctttagcttctccttccactgctagatgaggccttgaatgtgcaatcacctctggttcttttgcttctgacatgttgggtgtggcatttgctagtactgccacatactgccttctctgctagaaatatccttggtttccaggaaatgaccaggggctgggttgcccatggctaaccatatgctgttatgcaattggtttcagtggactgttggtgatcctggtttagtttttttttttttttttttttgagacagtgtcttgctctgttgccaggctggagtgcagtgatgcgatctcggctcacagtaacctccatctcccggttcaagcaattcttctgccgcagcttcccgagtagctgggatttacaggtgcatgccaccgcactcggctaatttttggatttttagtagagatggggtttcaccatattggccaggctggtcttgaacccctgacctcaagtgatccacccacctgggcctcccaaactgctagaattacaggcatgagccactgcacccggccctggtttagttttcattctgttttttttctagaatatcttcctcagacgttgatttagttgtattttttttctcccactgatttctctgtgatttggtttcccccaatttagatagaatggcattgtgtttcatgatggtcctcaactcttaatttctgctgtggctcgtcattgtgacctgtggtattctgcaggttcatgtaatttaggagcatactcctttatccttaagtccccaaaatgctgaaaaccaaaacctcaaaactcttagttacaaaacctgtgtgtgtgtatgtgtgtgtatctgtacatgtctatgtgtgcagaaatattaatgtatttaattatgtggagctgccctagtccctgctgggactattatgtaacatatgatatatgtgctatatttgctttgttaaatctaaaaaatttaaaaatccagaagtgttttagacaagaactgttaccagaaatgtgaattattttgaaacctaaaacagattttaaaggaaacatttacacatttttgctgtatggtaataatttgttataatttgattttaatatatagttgactcttgtcaatgtagggttagggacaccaacccttgtgcagtcaaaaatctgcatatagcttttgactccccccgcaaacttaactactaatagcctactgttgactggaagtcttactgaggacatgaacagtaggttaccacatatttggtatgttatatatatataacatactgtattcttacaataaagtaagctagacaaaagaaaatattaagacaatcataaaaaagagaaaatagatttactatttattaacgggaagtggatcatcatacaggtcttcttccttgccatcttcacgttgagtaggctgaggaggaggaagaggaggggttggtcttgctgtctcaggggtgacagagggggaagatgtggaggaggttgaaggggaagcaggagagtgaggcacactcagtgtaacttttactgagagaaaaatccctctatcaatggacccatgcagttcaagcccatattgtttaagggtcaactgcagtaagtctaagaaaagaagtgaaagtggtaaaatgcaatttttttactaatgaaaaaagtctcagaaaccgacattgtttggttcgcagtatgggcagttactattgaaatatattgcaattgctaactcactttgaagaagataaacatattgagtttaaagtaccccttttggtttagcttaaggggaataaggacaacagtggcatccctcttccttcagaacctcgctcaccatcttgccttggagcagcctcagccaccctgagaaccagaaaggacagaatgaggaggtagtcacaacacagaaaaacccagcctctaacacttcctggcagaatccacctcctttctggctgctgctgcctgggctagagagcctagtcctgttacttaattcctgccttcacccccactcctctgatgagctgggcgttttgatcccttctggtttcttctctcatggaccaacattcactggcatacttgtgacctatgccttgaaatgtggtcacagattcgtttgcctctcatagtaaaataattgtcagtagtaaaaaaaaaagaaaaaaaaagaaaaaaaaagaaactttgtaagaatctggcttcttaaaataacaaaagttctgacagtgctgggctgaattccccaacagctctccctggcttctaggcatggccagcaacaccttgttgctatgtttcttccatgtttgtgctaatgtgctcagttcactgtttgccgtggatcaatcttctgatttccatctccctatccctggaagctgtgattcggaaaagaatgtgagggccggtcgtggtggctcatgcctgtaatcctagcactttcggaagctgaggtgggtggatcacttgaggtgaggagtttgagatcagcctggccaacatggtgaaaccccgtctctactaaacatacaaaaaaattagctgggtgtggtggcaggtgcctgtaatcccagctactcaggaggctgaggcaagagaattgcttggagccaggaggcagaggttgcagtgagctgaggttgtaccacgcactccagcctgggtaacagagcgagactccatctaaaaaaggaaaagaaaaaaagaaagagaaaaaaaggatgtgacatgagtaatctgtgcaaatcaacaggtttttaaaaataatattttgttaaaaaaatgtgactctagaagtaaattagaaccacaggggccattcagaaataaaatagccctagagatatttatttttattgttcatagttctcctgttttcaatagaaaaacaatgaggaggctgtcgattgatctaataactatgatttatggtttctttgtggctaccaagtgccactaatactcgttaaaactctcagttcataatgttagacagaagacgtccatcttctccttattctctggacagcttcttcaacatgatgacagcaagcttttcttgaaattcttcctattatgtaataaacctttctgtgcttgttgaaatatgctgaaaaatcctattctagataacgagaaattcactcaaaccatttcctcagtctaattttgcaaaacttgcatttcagtttccgctgtgggtccttctttagtttgtcctcctttctttatggtagttagttaattcatgtgtatttccacatattccaaatgaactgaaaaaagatcttcctggaagtttatattatttgatcctattcaggataacacagagcaaaggacactggaggtttcataagtgatgttgctttctagtcacggggctaaatgacacaggggacagaccacccaatgtttcagtggaggctccatgggataatgaggtgggaaccaaggaagagcagcactggagtttgatcaggaaaaagatctacaaataatagtgagagagaaaatgaggaattgatttctataggttgagatgttgaatttaaaaaattgaagtagtatgtaaatttgcaactatcattagctaagaaatcaggaatttttagaattggactttggatctcttaatttggttggctttttgtctgttgtactgccccagcatggaagctggcaaataacttacaaagttgaaggaatggggaaactcgttgtgccagggttcccaactccacctgtacattcagtgattcactatgacagctcacaggactcagcattgagtcatactcacaactagatttattacagcgaaacgatacaaaacaaaatcagtaaagggaaaagacacatggggccaggcataagcttccaagaatcttatcctagtagagtcccagaggatgtgcataattcctccagcatccaattgtgacaattgtgaaatgtgctattagagacttggtgcccaaggtttttgttggaggctgatcacacaggtgtcctatgcctagtgtaccaaggttccagactccagaaggaaagcaggtcttcagcatgaactgcattgtacagtttaggtacagtgagccacctcatcagtgttggtaatagtgggaccctcccaaagtccaagttcccagatgccaggcaaggatcagccttgtaaacaggcctttcttgggacagcagcctcaagcctgctgtgttaactcttttctgcacattagtagtaaaaatgatacaacctattgagcactaactacaaattaaccactgtgctaagtactttacatgcattatttctcttatttctcaaaacaattctgtattaagtcttgttagacttaatttcaaaatgcagaactaaggcttagaaaaattaaaaacctgcacaacatacagcttacaagagattgcgcacaccttccagaaattgcaggtatatttcttcaaagcctatctttgaaataatcttgatattccaatgaaaatttgaaaaaaaaatctaaacatcttaaagttagcaccccataatacagataacattttaaaagtttcatggatatttttgtttgttactttcagttataacttctttaaaaaaattttctttgtgatggaagagaattaacacttgagagggtttttgtcctggatctaccactctctcattggactttataaaataattttctccaatctatagtttaaacatttttttgtgtatatattgtctttatactttcttcaaattaatttttaaatttataattgacacataatatcttttcaaactgttagctcctccgtttcatcagcatttcaaccccaacacacatctgatctgttaccagttcctgttgtattggtcagggttcttcagagaaactgaacctaaaggatatacatggcatatatacatatgatataatgtatgnnnnnnnnnnnnnnnnnnnnnnnnnnnnnnagaccccaggaaagctggtgatgtagttcagtctgagtctgaaggcctgcgaaccatgacagccagtgatgtgaatcccagtttgaggacaggagatgatgagatgggatgtttcagcccaagtagtgaggcaaggaaaaaggggtaaattcctctttccttaccttttgttctattcagggttggatgatgcctgctcacattggggaggtcagtttgcttcctgagtccacagattcaaatgctgatctcaccgagaaacactctcacagacacactcagaagcaatgtttaatctgggtaccccatggcccattcaagttgacacataaaattaagcatcatatcggtgaattttctctactgcaggcttattgcagctcccaaccccagttttaggtggattactgccctacttgattcaattcctggatcttcatctttcatctgcaaaatgcatagcttctctaggatcaagttaaaattccttagtttgggatacgaagtacttgatgcaattttttcttcttctcctcttcctcctcttctggctgtgtctcctacttacagttgccctttcacatcgtgcctttgctaatactcttcaatctatttggagtgacacactcctctgcctgcctgccaggatccatctatccagccaccatctattttatctttcaaaaatttgttgagtgcctggggaacacttactcatcttttctgacatagttcaatccccatcttctcagaagccttttctgtctccctcctggcaaaagtagaatggatcctcctcccctttgtgctctgtacacattattatggtatcttgactacctgactatttacatatctgtgttacctactggattttaagctcctgtgatagtgtagtataataagaaatatacattttggcaagcccctttcagccgtagctatgtttatgttaatgaggtgacttttggaaagtaataggttgactttaggatgggggatctggttgtcaggggagccaaccatgtgattagagggttggaactttcagccctaccctccaacctctagggagggcagaagcaccagaggttgagctaataatcatttatagccaaagatttaatctatcatgcctacgtagtgaagcctccatgaaaaccctaacagaaggggttcatagcgcttccagattagtgaacaagaatgtgtgcatgtgctagaggatggttggattagttggttctcacactgctaataaagacgtacccaagactgggtaatttacaaagaaaagaggtttaattgactcacagttcagcatagctggggaggcctcaggaaacttacaatcctggcggaaggggaagcaaacacatacctcttcgcatggtggcagcaaggagaagtgctgagcaaagcgggaaaagccccttataaaaccatcagatcttgtgagaactcacccactatcaggagaacagcagcatgggggtaaccgcccccaggattcaattatgtctcactgggtccctcccacaacacgttggggattatgggaactacaattcaagatgatatttgggtgcagacacagccaaaccatataaatggtataacccaaactccatggagacagaagcttctgtgcttgggacccttctggacctcaccctgtgtatctctttatcctgttgttcatttgtatcctttaaaatatccttgtaataagttgataatagtaagtacactttccctgggttctgtgagctgttccagcaaattcttgaacccaaggagggggttgtgggaacctccatatgtagccaagtcagacaggagttgtggtaacctggggatccactacttgtgattgacatctgaagcagagggcagtgttctgggagtgatcctttggtctgtggggtctgtcttaattctgagcagttagtgtcagaattgagttaaattgtaggacactcaattggtgtgtgccaagaattggagagttggctgttgtggaaaccccactccctgccacatatttggtgtcagaagtgctgagagagtataggagaggtatttttcttttcttttctttttagctgtgtattagtccattcgtattgctataaagaaatacttgaggctgggtaatttataaataaaagaggtttatttagctcactgttctgcagcctgtacaaatagcatggtgccagcatctgcttctgatggggccttaggaaacttacaatcatggtggaaggcaaaggggacctggtgtattccatgatgagagcaagcaagagagatgccatactcttttaaaacaaccagatctcacatgaactcagagtgagaactcattcattaccatctaggagggcaccaggccattcatgagggatctgccccccatgacccaaaccacctcccaccaggtccacttccaacagtggggattatatttcagcattagatttggaggggacaaatatccaaaccatatcaaactctttgagggcagggttcatatccatttttgtatttctgtgggcctagggcagagggagtactcagaacatgttgcatggctggatgcactggatatcctagagatgaggagatggggagaactcaatcctaaatgtatttaggaatttaagattgagttctccccatctccccatctctaggataaatttaggatttatgtatgttgtgaaccatgacataaatgtatgttgtgaaccaagacaatcagaaaggttgtcacactgctaataggtagaagaattagaattcgaaccttgatattgtgactcttaagttcagtgctcttcccaaaatgccacagatgccttgcagcgtccagccctatggggcttagcgagtgttctccccgtgtgtggagacaagagattgtaataaataaaggcacaagacaaagagataaagaaaaagcagctgggcctgggggaccactaccatcaagacacggagaccagtagtggccccgaatggctgggcttgctgatatttattgcatataagacaagggggcagggtaaggaaggtgaatcttctaagtgattgacaaggtgaagcaaatcacgtgattacagtatagggggcccttcccttttaggtagctgaagcagagagagagagagaaggcagcatacgtcagcgttttcttctctgcacacgtcagcattttcttctctgcacttataagaaagatcaaagactttaagactttcactatttcttctactgctatctactacgaacttcaaagaggaaccaggagtacaggaggagcatgaaagtggacaaggagcgtgaccattgaagcacagcaccacagggaggggtttaggcctccggatgactgcaggcaggcctggataatatccagcctcccacaagaagctggtggagcagaatgttccctgactcctccaaggaaaggagactcccttttgcagtctgctaagtaatgggtgccttcccagacactggcgttaccgcttgaccaaggagccctcaagcggtccttatgcgggcatgacagaaggttcacctcttgccttctaggtcacttctcacaatgtcccttcagcacctgaccctatacccgctggttattcctaggttatattagtaatgcaacaaagagtaatattaaaagctaatgattaataatgtttataataatgactgataattcttcatggtcctctctatatctaatttgtattatgactattcttattctaactactttctttattatactgaaatactttgtgccttcagtctcttgccttggcacctaggtaatcctccacccacagtgcctctcttatttaatctggttgtaccaaaattgagcattctcttgttacgagatgcttgaaactttaatattttacctaggttaacaaacatgatggtgggggcaggcaatcagttacaagtacgatgacatgagtctcaaacaccctgggaaatctctcatttgtataggctctcctgggtcatattggtttttttcttgaccaatcctgggaacctggagacttagtgatacagggataagagcctgttgaggttctgagatgatctgatgtttctcccttagttatattcgtatattaggtggttccccaagtggaaactgtaggtttattgggtccttctaatctttacctgaaggtttgtatctttcagcacttcctagggttctggggagttggtgtggaatgggaaaagaataatttcttgtactaccgggcaattggaagtatctgcatcaaatgttagagattaccaggcagtccaccagcttgtaaaaagtgctatgactctggcaggtgtggtggctcaggcctgtggtcctgacacataaggaggtagagagtttgagaccagcctgggcaacatagcaagccatcttctgtataacaacaacaacaacaaaagtgacatgactctaaatactccatgtaatcattagtgtgtgatgggattattctggctctggaaattctcaactatattatgccttgaaaactcatattcttagacaattgaatttctttgtttctgaaattaggtggtatcaactttcttctttgtgtctcaatttcctttcttgtatctcttctcccatttctgattcatatctgtgtttttattctactctcctagatctgacctttcttgtcattaatcacttcaagaggccatgatgccaggtccgaagtccaagggtcttacttactcctttaatttgccaaattgtttacctttctttaatgatattcactgtctttttttttttttctctaggaagctgaaatctatttaagacagaatagggggatactaacattccctccatccatacccctagacattcttttttataattacagtacagtgatcaaaattaagacatttaacattgatatactattattgaatctggagatccagagcacatttcatttattattccactgatgcctttatagctattcctcaccctccctgcccctccagccccaagtccaggatctaatccataatcacacattgcattcagttggtcaagacataaagttttaaaatatctatggtgagaggaagagataatacggaagaaatgctgtcctttgttacatactataaaatgccagctatctcatgactactcaatgatttcatgtaagagtccatacaatgacttcacgtaagagtccacaaacttaaaaatcagtgtagtctattctcctactttcattgtcatggttatcattaggagctgaaggtgtccctccccaccaaagaaattattgtagcatggttcactaggatgagtaaaaatcacttattactggctgggcgcggtatctcacgcctgtaatcccagcactttgggaggccgagttgggcggatcatgaggtcaggagttcgagaccagcctagccaacatggtgaaaccccgtctctactagaaatacaaaaattagctgggcatggtggcgggcacctgtaatcccaactactcgggaggctgagtcaagagaatcgtttgaacctgggaggcagaggtttcagagagctgagatcacgccattccgctcccacctgggtgacagggcaagactccatctcaagaaaaaaaaaaaatcacttgttactgtttaccatctctctcgtttcctccccttctagcttaattttttattattttgtattaaaacagttgtcaggcatgcagagctttttatggggtaattactactaaatgaagagaggagtttaatcaaaggtttggtcctcctgcaacttaagagtagaaacaatagacatattctagatcttgaaaaacactctttgatctggctgtgatagttgtgttttattcatttgattatttgtattatgatgagagaaaggctatatgaaaaatcagcattgttgttcagaaatggtattacttaatttaatttagtcataaaacttgtccgtcagcaatttttagtgatatcagaaagttgagttttaagcaaagttttatttagctatttttccactgaacatattcaagactgtgacataggaactgaaggcaattacaaaaagaatgattcctagaatatttggaaaatggcattgtagttgaaataaacatagtgtttctacccacccctcttctcctacctgtctaccttgaaaaaaaattgtcttaatttgaaatgtatgtaacttcttgcattttttttaaaaaagaactacatttgacatcacaatttgtgtaacttgagttgtatttctccttttatgctatgaactactgggctgaggaattcttagaaatctttgaaattacttccttgtaattaatagtttctagaaagtgtttattttgaagatagggatgatagcatttacactggaagacagtttaaaaagagaccaaattatgagtggaggaatccttggtggcaagagtatagacctgtatacagttttttgtttttttttttttcctggggcgtagagattggggaaggccacttggccaagggtgagaatgtgagcaatgatgggcagagagagtccattcaatgcagagggaacagcaggtgcaaaggccctggggtgaaaggggacttagtgtgtttgtggaactgttctgttctgaggcctataaagatttataaagcaaataattacaagaggataaatacaaggagatagttgatttgttagtaataaggaggaatcatgcaattttagagcttaaagagactttaaagaatcacctccagatttttcacttgtgaaaactgaagataaggagatggtttgctccaggtcacctagtgagctggttgttaagcctggacccaagctcatatcgaatatttctggatcatgctctctgagtgcactgccttagttctggaaaggatgtgtctgggttgcccagtggataaggactctaattctatacagtgtcaataatatggttgttataatggataccatctagtgactattcagactcctttgcttgcaaataccgatgctctttgtcttacgacagggttacctcttgataaacccattgtaagctgaaaatgtatttgggacacctaacctactgaacattgtaggttagcctagcctaccttaaatgtgctcagaacacttacattagcctgcagttaggccaaatcatctagcacaagcctattttatttatttaattaattatttttttgagacagggtctcactctattgcccagactggagtacagtggcgcaatcccagctcactgcagtctccacctcccaggctcaagtgattttcctgcctcagcctcccaggtagctgggattatagatgcgtgccaccacgcctggctaatttttatatttttagtagagatggggtttcgccatgttggccaggctggtcttgaactcctgacatcaaatgatccacccacctcagcctcccaaagggctgagattacaggcgtgagccactgcgcccggcacaggcctttttataaaaaagtgttgagtatctcatgtaatttaaaaaattattttaattagttttattttttgagatggagtcttgcttcgtagcccaggctggagtgcaatggcatgatcttggcttactgcaacctccgcctcccgggttcaagcgattctcctgcctcagcctcccacgtagctgagattacaggtatgatccacctcgcctggctaatttttgtatttttagtagagacagggttttgccatgttagtcaggctggtcttgaattcctcacttcttgtcacctgcccacctcagactcccaaggtgctgggattacaggagtgagccactgtgcccggcctaattatttttatttttgagacagggtcttgctctgtcatccgggttggagtgcagtggtgtgatctcagctcactgcaacctccacctcctgggctcaagcaatcctcccatgtcagctttcctagaagctgagaccacaggcacataccaccacgcctggctattttttttgtatttttagtagagatggggttttgccatgttgcctaggctggtctcaaaatcctgagctcaagtgatccacccgccttggcctcccaaagtgctgggattacaggtgtcagccaccacacccagtcctcatgtaatttattaaatactgtactaaaagtgaaaaacagaatggtagtatgggtacatgaagtatggtttctactgaatatgtattgcttttgcatcatcataaatttgaaaaatcgttaggtcaaaccataacttgggactgtctgtgcttgtcactttcctacctttgaagctttggtcctgctgtgcctagcagttctccttctcctgtctatttactcaagtctcatcccaaatccttttaagtgggaggctttgtacacccctctggttatacatgccttgccctttctgaattcctgtttaaatgtaatttcctgttaaatgtatatgtgttatgattattgcctttttttctcaccggctacataataatttccttgagggaagaagttgttttgtaatttaaacatatcacacacaatacctcgcacccattagccttttaaaaaagtttttgttggtagtaattacaatggtgatgatcagtaaatatttaaagtaagcaaaaagatctttaatataaagatctcacattgtgagagttactccccacataattttgttccattttattttttgaagtggtgcattatttaaatttagaaacagctgggcatagtggctagcacttataatcccagttactcaggaggctgaggtcagaggatcacacccagaaattttttttcagggacagagtcttgctatgttgtccaagagtttacgtctagcctgggcaacatagcaagactatctcttaaaaaaaatctaaaacaagggtatgttttaattcagtatttattagtattaatctctcccccaaactagatgtggacattattataaacaaagttatcaactgtcaaaagaaatcacatgacaatttaagaaagtgatactacattttgagttgtttctaaaactatttcagacacaccaactgttagccataggttgatgctggtcaggtacgtgtagaaaattatatgcagaaaggagcttagaaacacttgtgttactcagcaattaattctattattacttttttaggaggacttctgatgttattaccttttagttttgtgaatatactgtacttctgagataaataaatattaatgttcactgattactacttcagataaaaataccattttggtcttcttaccaaagctcttcatttaccttttttacttttcatattagaaaactttctcaaagtttcgcatgattctacattggtaagcccctgaaaagaaaatactacaaaatatgtgcaatattgtttgttaaataaaattaaacgagtaagcaagagactgaggtgaaattgcaaaatgatttttaatagattattggaaaggaatttttccccattacctagttagatgacatgtttcttattctatctttattccaagcaatcacataggcattgctgttaattttatttgcgactacgaaagtcacatggataggtgtaattccttactcataagattgtaaaatataaattttgtgcctttgagaggaatatgtttataatttcctggtagaagtatcttttatttgtaatatgggactcagctcatttgttttactttcttcatcacttgtacaacaaagatttagtgagtgtgtacccagtgctagggatggagtaattaaaagatgaatggttctggcctcattaagcttacaatctgattaagctatagttctacctctgtgggttcataatgacatactttgttatgctacctctgctgtgctatgaagggggtctcttgagacctggcgttcttaccttgtgtgccaccgttgtttgcacttgcccacgggactctcaacttcactggacattgggtttccaagtgtaatatggggcagttgtgcctagaggatttcaaggtttcctcctgttcttacattttacatagcacagatcccacagaaatatcagtgttttgtatacatacttgcattgttctgttgtcttcagtgccccataaagtataactgtaaacaacccacagatttgcccacggactattttacaagtgaagaaactaggggacagtgttctctgaagtgacatcccatctgaggaggcgaaccaagatgtcttatctttcgggcgagtgtactgttaaaccacactgttctacttcccacaaagggggacttccttaaacagtaacttcactgaccacctctattcatatgtttccttcctccttcccttctttggctgtatagataacaaaccttgcaacgggtgttcttttaccagtggttcatttatgtttgtttttttccgcactgtacccctgtgaggtgttaggaaccctgtgcatttaagtaaattagaattgtgcagaaaagagagaccagcagaaaaaaaatatttctgtgaatgcttttatatacatatatatatatatatatttttttttttttttgagacagagtctcactctgtcacccaagctagagtgcagtggcatgatctctgcttgctgtagcctccgcctccggggttcaagtgattctcatgactcaacctcctgagtagatgggactacaggtgcgtgccaccacgcctggctaagtttttgtatttttagtagagatggggttttaccgtgttgcccaggctggtctcaaactcctgagctcagacaatccacctacctcggcctcccaaagtgctgggattacaggcatgagccactgtgcccagcctgtgaatgcttatattaaagaagctgaaaagggttatgcttaggtggtaaggctcaagaactttaaagtgagttttgttaaatggtacatttcatatatactttaagtgattcttcttaaagaaaactcacaagtgactcaaagatgaatttattcacgttcattgtctatctcaacagcagagaaactgtcacagttgaagactcctggacatttactgcaatatatttgtaatttagtttaacactttagaaaatagtaaagtaagctcatttttgggttaacttatcctgactaggactgattgtagtacaatataaggataaatagtaaaactttgaattttcttggaaaatgatgagcagcttgatgctaatgatcagatataattaaaaaaattttttttgaacctcagagtgatttttttattttcagacttcacaatcactttctaatgataggtgttctgatgaaaatatctgcaggaaacaagaccaaaattcactggatgagataatatatttcttgaagttctagaatcagcttatcagctgtattctgttccttcttagttgtaggaaactttagctgtggtctaggtccatctctgagtttacagaatttctgtgaagttagggagtgagagactaagaggatggactcttgtgccagattatctgggttcaaattctaaatctgttacttattaattgcatgacctaggacaaattacttaatctctctgtgtctcacctttaaactggggagaataataatacttccctcataggtgtttttgaggggtaaatggatcagtatagataaagtggctaggataggtcctggtaggtaagtgcatgtaagcagctgttattattatatacataaggtaggttgcattgttgcccattgtgtctttacatgtttcagtctttgctcttgcctctgttttttcccagatatcaatgcatttgcaatgagtgtaattgtgtcattgtgttattaggtcactaatcacaggtgattcactctttaaattgatctgtggtgctggtagtctggttatgttttggagttctggtaactggtggaaatgcatacctcgggtaggttcatgtgtttgacatctctgaaccatgttcatggaactctgttgggggtcgtctgctgtggatgtttttctctggatgtttgccagtggtacacatatcgatagggtgccagttgtggtaactgtggtgttgctttctcagttttagtttttctttcctccctcttcctcctcctcctcctcatcatcctcctcctcctcctcctccattttttttataaagaggcagtctcattctgtcactcagactggagtgcagtggtgtggtcatagctcactgcagcctcaaactcctgggctcaagggatcctcccaccttggcctcctaaggaccaggatgacaggcacgtgccactattcctgctaattttttgtttttagttttgtagagatggagtcttgctatgttgcctaggctggtcttaaacttctggcctcaagggatcctcctgcctcagcctcccaaagtgccaagattacaggcataagctaccgagtctgaccaactttacatttttatgacaacagaggtgggtctgctatggagttaaagaaaagtaagctttaggctctttcaattccatagcccttcctaaggcctctggaagggccccagagcttttgcatttatgattttgcattttagttttatttttaatttttaattgacaaagatttctcctccaaagtgtttaagcttcagatccctcaaaatctggatctgcctctgtagagcacataacatttcatttgttctaatatctgacaatttctgcaaactctgacagtgaaatactctcaaacatttccactgtaaaacagctaataaacaagcatgtttacaattggtttatgttctctaagttcttcctttgaaaaacaaagtggtgtgtctctactttaatctgttaattttatttccctgaatagagttaaacagttgttgtttttgaagtcctatacttttcttgttaaatgtattcctattttatagttttagctactcttgtgaataggtttttttccccatgatatgttgtaattattgttaatatatcatcaagcttgattttttataaatctattttttttgagacaaagtctcactctgttacccaggctggagtgtattggtgtgttcacaactcactgcagcctcaaaatcctgggctcaggccatcctcccacctcagcctcccgaatagctgggatacaggcgtttgctaccatgcccaactaattatttgttatttttaatttttttttgtagagatgagctctctctatgttgccaggctggtctcaaactcctgggctcaagtagtcctcccacctcagcctcccaaagtgaggtactgtgcctgcctacaaatttattttgtaaccaaccattatactctgctacgtctgactgttacatagagacatagttttctatcatcaacttcattatggaagggttattttctactgaatttaatccaaattacgagaagaaaaaaattaaaaaaaattaaaaggtattttaagtgctaaacaagaacattcaaaagcatgggattaaaactttctgtgctgagaaagttataagctgtgtgttctggagggaggcattgatggggagtggtggaggaatatatctacccagtaaccttaaattttctgaattgaccgaaatacaaatttagaaatagagaaatctagatttataattcatagtgactaccacggtgggataattgaattcaaacccagcctatctaacttggaaggcacccacagacatctctacttgaatttcttagccaccacccccaattcttttttacttgaatctgttcatttgacaaaaatattttaagcacctactttgtgccaagtactgttgtaggctctgtggacacaatagtatagaaggtaaatgccctgctgtcctggaatttaccttctaaaggggagatgcagacaacgtacagataccagtaaatatccccctgccatgagaaaagtaaagccgcatgagagagatggggccttgcctgctgtttctgtaggtagggaatagagaacttaggaagagcagggcaggccacggagaagccaagagtacaaaggaccccagggaggtgggaaatgctttattgctcaaagaacagcagagagggaaaggaactgaggtggaatggggtgggcatgggaggggaggaggccagagagctgggcaaattcatttttttgtttgttttgtttttgttttttaagtaacaggcagattttggagggttttgagatgggagagacaagatgttgctaattcatgtatgttgccacgccagggcacagtgaaacatgaactggcagttagaagcttggagttagttctggctctgctagccagtgtgatcttggagaggtcagtccctcagtttccaccctaaattgaggaaattagactgtgatcaccagaatccctttcatggccaaatattatgattctcagatggagaaattgttattaagcattcatatgtgctggccacagttgttggctaagtgggatagaggagacctgccactcccaccctctgctcagactttggctctttgcctcacccctgcctctgggaagccaagttctgagcctgcctggaccacagatgggtgtatcactctgttctcactggggtcctcatcggtaggtgtgggcatgttgacttactctgtttgccttggtcttctttcttccaaatggtgttgttctctttcattcaatttcctcttcttttcttctattaggatttatacattttaaaaaatccttttcctatcattttagtggagtgcaataagggaaaggagttaagagcttgtgatcaatccattatgcttaaattctggatttttgtttttttattttgagacgaggtctcactctgtcgcccaggctggagtgcagtggtacaatcatggcttactgtagcctcaacctttcgggctcaggtgatcctcccacctcagcctcctaagtagctaggactacaggcatgtgccaccacgcacggctaattttttttttttttttttttgtagagacatggtcttgctttgttggccaggctggtctcgaactcctggactcaagtgactctcctgcctcagcttcccaaagtgctggaattacaggcatgagccaccatgcctggcctggaaattctttaacatgtttattttataatgttgaaaacatattttccttgaggacgtcttgaagaatgcctttcctcagaggaatacaaggagcctaaaaggacatttgggaatgagacacacagggtttgtagttacaagcagtatcccagcaactcaagacctgaagggttaaagcacctgatgcctgccagataaattccagaatcactagtctgtcaggctgtcttctggggcctcagtctaccttttcagcttcattccatattttttcctcatggttctctgctgctgcaatcaaactgtctgattcctgttgaactctattttcatgttcctaccacctggtccattcttctgacctggaatgcccatccttttttgcctacctaaaccctacacattctttaaggcatagttcaaattctacctttcttggattcctgtcaacggtgcagaagatctctgtctccttcctttgaacccttgcccctcgttctttatttgtggggtttttttgtttgtttgtttttgtttttgagacttagttccactctgttacccaggttggagagcagtggtgtgattatggctcatttcagccttgacctcccgggttcaaccaatccttctgcctcaccctctctggtagctaggactacaggtgcatatcaccgtgcccaactaattgttttcatttttttttttttttttttttttgtagcaacgaggtctccttatattgcccaggctggtcttgaactactgggctcaagcaatctacctgttaagccttccaaagtgctgagattacaagtgtgagccatcacgcctggccaacttttcatattttacacttttaaatattgctttctctggtgtgtgtgtagtggtatttcactatatttttaacttgcatttctcttatcacgaatgaaaatgagcaagtctacatgtgttcactgtccattgacatttagtctctatcgaaatacctatttctacattttgtttcttaggttttctgttcttttcttatttgtttttaaaaggtataaaaaatatatatattctgaatgaagctcatctgtgtgtgctttgtactttgtggcttgtctaactctcttaatatctcttttttcttattgtggaaaaatacacataacataaaatttactcttgtaaccattttagagtgtacaattcagtaacattaagtacatttataatgtcgtttaaaaatcaccactatctagttccataactttttcatcaacccaaacagaaactgtcccccttaagaagtcagtccccatttccttttcctcccagcccctggcaaccctaatctacttcttgtctatatggatttgactattctggatactttgtataagtagaatcatacaatatgttacttttgtgtctggttttttccactaagcataacgttttcaaggttcattcaagttgtagcatatattagtactttgttccttttcatggctccattgcatgggtagaccacattttgtttattcattcatctgttggtggatatttgggttgtttccaccttttggctactggaaatagaaccgatatgaatattcatgtacaagtttttgtgtagacatatgttttcatttctctgggatataggagctgaattgctttggctttgagtatgtttaaccttttgaggaactgttagactgtttcccaaagcagctgtgacttcttacattcccattagcagtgtgcaagcgttccaatttctccaaatccttctttacacttgttattttctcttttgttgattgtagctgtcctagtgagtgtgaagtggtatctcattgtggttttgcctttccctatggctaataccattgagcaactttatatgtagcttattttaaaaaatgcatataggctggaaaacctcctgtctggtgggaacctcctctttatttgatttttaaaatgcaggggacagtgatgtgctaataatagtatatatttagcaactgggagtagaggaagaagccctgattttcagcatttgccaattttcatggtgttaagtactcccactatggcagatctccggcccctgcatgatgtcatggagcacagagctgggaacggcatgcacagtgggctctcatgagctgtcatgagctgactccagcacaccagtgagtggaagggagaatcaggtgaagtgagcctcactgaggctgcctgctattatgcaggccaggcactgcataaccctagagggtgccattcacatgttagtctaaagagaaagggatataacatttattgagtgtctacaacttatttaatcttgaccacagtcttctgaggcaagttgtattatcttagttttcagagaaatccaagggttagggagcttaattaactaagtcaatgatttgcaactaataagtgtcaaagttggcatttaaaccaggtctttcttacagtgaagctcattctagttcaccaactgtgtcaggggtggggatctccaagaccaccgccaggtttgatgatttgctagcaggacttacagcaggggtccccagcccctgcaccacggactggtaccggtttcggtgcgtggcctgttaggaactgggctgcacaggagaaggtgagcagccagtgagcaagcaagcattacccactgagctctgcctcctttcagatcagtgttggcattagatcctgataggagcacgaaccctcttgtgaactgcacatgtgagggatctgggttttgtgctccttatgaaaacctaatgcttgatgatgtgaagtggaatagtttcatcctgaaatgatcccgctcaccccaggtccatggaaaaattgtcttccacaaaaccattccctggtgccaaaaagcgttgcagattgctgacttatgggacttagataatagctgtactcatgactgtcatttattacagtgaagagatagatgcaaagcaaaatcagcgaaaggaaaaggcacgtgaagtctggaggaaaccaggtgcaagcttccagagcttacaggagtcctctcccagtggagtcacatagggtgggcttaaaacctccatcagtgagctgtgacaacaggtgggatgttgcctaccagaaaactcatcactcagtgtccacggtttttaactgggagctggtcacttaggcccctctgcctagcatgtgcccaaattccagactcccagaaggcaagcaggtgttcagcatgaaccattttgtttgtataaaccgttaagaccccttgtggcactcatcactgctagaaatcatgggaccctccccagattcaagtttccagatgccagtcaagggccaatctagaaaggcaagtaagcctggctaagaatagcagtgtcaggcctgctatgttaactgttttctgcacattgaccaaatgcaaatataggaaagcaaattgagaaggagatcctgtctgcttatcattgtatcctccttcccccagtgcctgcacaggacttgatatgtggtggtttctaataatggctccttgcgttgtacagattcccatggatactcagctcctccctgtgtctgtgctgcctgtaaagcgagtgcctctgtgcttgcaagtttctctgagttagcccaaagtggctgttctttcaaattctgatgaattatgactgcttattttagacatctcagtgtagcttcatgaacccctactatgaattctcagtaacttttctctgctaaaaagccttcatttgaaatgctgaggcctgctctttgtgtctccggtggaaatattggttctttatttccagagccccagacaccctgtctcagactcacttatacatcagtgagctttgactaaaagtggaacagtttcctgcacctgaccccagtgtctgggtcacatggggaccatcatgttggggttacaccttcctttgctctcatgggcagggctgactgaatggtctgcgcagtatgcatttgtgagaagcacattgcagggggctctgtgtagaggaacagttctgagaatgagcaaactggtgctaccatgagctgtctaaaccccaagtttttgtttttgtttttttgagacagagtcttgctctgtcacccaggctggagtgcagtggtgcaatctcggctcactgcaacctccacctcccaggctaaagcgattctcatgcctcagcctccccagtagctgggattacaggtgcacaccactgtacccagctaattttttctatttttagtaaagacagggtttcactgtgttggccaggctggtctcaaactcctggcctcaagtgatccccctgcctcagcctcccaaagtgttgagattacaggtgtgagccactgtgcctggccataaaatccaagttctttttattcttagttactgtgacagaccgagttaaagaaaacaaaaggaactcacctcgcctttgtctggctggttccctcagttctcaagtgaagtgaaaattattttcctgcctgcagctttgcatagttattttcccattgcttactttaatgtaatggccagcaatgttcttttctatagttaggaaaagcagattttctgaaaccagaagcactagttctgatgtcagacagtcagtgttcaaatcctgggttctgtcactccctagcttatatgatgctgggcaagtgagcatagccactttcttcctcagtttcctcatctgtaaaacagagacaataaatagttactacctcaaagggttgttatggggatcaattgaaatgatacaactacaacatgcactaaataaatttaaagcaaaactggcatatggtaagccttgaagaaaagttagtaatattgccattgttgttaagtttcaggatataaaaatccattttttttttccttctgccacccaggctggagtgcagtggggcgattttggctcactacaacctctgcctcctggattcaagcaattctcctgcctcagactcccaagtagctaggattacaggcatgcatcaccacgcccagctaatttttgtatttttagtagagacagggttttggcttgttggctaggctggtctcaaactcctgacctcaagtgatctgctcacctcagcctcccaaagtgctgggattacaggcatgggccactgcactgggcctaaaaatctattctttttggtggttcacactgatttgagtaaataaaatttcttactctctaccccatatgcctttacacgtttatttatttaaaaatgaaaaactgaagataattgtttgaaagaagttccagtgtggtaggtggaaacctgtccaccttaaaataagccacagtacgggcgcctgtagtcccagctactcgggaggctgaggcaggagaatggcgtgaacccgggaggcagagcttgcagtgagccgagatcccgccactgcactccagcctgggcgacagagcgagactctgtctcaaaaaaaaaaaaaaaaaaaaaataagccacagtactttggaatctggcagcctggggcttcccctgtgactctccctgcctttgtgagctgaggaaccactgactgggctgttggttctctggggagaaagggaatgatttctcctcccctcctctggcatggagatccctccacagtctttccccagcttgtctctccaggtggaggctggaacatgcctcctacctcaccagactcataacattctgcttcccgtccccttccttagcctccttctggctgtctgtcatgctcctctgagagcccgtgtccttgctcttagaactccagtgagcagctctctctccctactgcttcggtagcccacggcccttcttgcttgtgcaataaataattagtgtgtatctcttcttgtgaaatccatggttttcctgtatcctttctggccactgcttgtctccttccagggctgccctttctctgcccgcctctcacatgtgcgtgttcctcagggttctttcgtggggtctcttttctcactctgtgcttgccttagaagacatcatccgttccagtggcttcagttaacttctgtgtgcagatgactttcccagtctttgtttcccagcctgatatctattctgaggtctgagttctcacaggtatctcaaattcaaatgtctgaaaagaatctcaagatgtcccccacccctgtaatctctagttcagtaattggtaccatggtctacccagttgcttgtgccaggaacctgagagtctgtctcaacttatccctctcttcaccctctcttgtctggactctcaacaggttctattggttccaccttctaaatatatctcagtcctgctctttctcctcccatctgtgccaccaccatgatccaaaccaccattacctcttcttgggtgaatacagcagcctctgtatcagttaggattgggttatgctatgtaccacacacaatccctaagtaatagtttaaacaagataaagtttcttctttttctcagtgtggaaaaaccaaaccaaaaactggaagtgggctgtctagaactgctatggtggatacaatccagggatcctggatcctgtctttcctctccatagtcctagcttatcttttgtttttgccaaagatggctccagccatcttgtctgaattgcaagctggaggaaggaagaaagacagaaaagcaagaagggacatctcccaccagagtcagatccctttagcagctttgccttatgttccatacaagacttctgccaatatctcattgaccagaacttagccacatggctatacctagtagcaaagggaggctgagaagtgcagtcttttattctgagtaccaaggtaccacctaaaaatcagggttccattattagtgggaaatggatgtcataagcagacagctagcaatttctgccgcatcctaatgggctcctctttccactcttgctcctctccagtctgttgtacccaatggctgagtgatcttttaaaaacacaaatacgatcatgtatctctcctgcctaaaaccctacaagaaattattatcccaattttaatctcaaaagtcctcaacatggcctatgggacactgtgtggtccagcagcctgccagcctgtccacattgatctgcaattctttctcctcactccccaccccccagcccacctgtttttcagttcctcgaaggtaccacctccttcccatgttgaagcatgtacattacctatgtcctttctctagaacccgtgtatcccctcccttgaatggctaacttctccccctctttcaggtttcagcttaactattacttccttggtatatttgctgtgatcttccagattagattagatttccctgtataatgtcattctgcacttttactttgtaccacctatctctattttattttaatacattattaatacaattagtttttcagtctctttctctcattctcatttataagcttcacaaagcaggtgaaggcatcacttaacccagtactcatcctccttcagagggttgttatggggatcagttgaaatgatacatctacaacatgcactaaataaatttaaagcaaaactggcatatggtaaaccttgaagaaaagttagtaatattgccattgttgttaagtttcaaaatataaaaatccattctttttggccaggcatggtggctcatgcctgtaatcccagcactttgggaggccgaggcgggtggatcacgaggtcaggagttcgagaccaccctggccagtgtggtgaaacctcatttctactaataaaatacaaaaattagacaggtgtggtggtgcgtgcctgtagtcccagctactcgggacgctgaggcaggagaattgcttgaatctgggaggcggaggttgtagtgagctgagatcgtgcctctgcactccagcctgggtaacagagtgagactttgtctcaaaaaaaaaaaaaaaaaaaaaaaaaaagaaagaaaatcctttctgtagcccagactggagtgcagtggttgttgagtgattgaatggaatccaggttcaaggaaaatatgatagatttgttttgtgtcatgtgaaagagatgtaaatgaaagagataaggagagatgtttgcctgggtagtttagagatacagatttaagacgcaagtgagaagttggggttagagaagtaaatttggaatcattggatctggttcatttaatgctgtttatcctaaaaggaggtggcttcctgagaggacatgctgtgggctttgaagccaggcagatctgctctgaatctggatctgtcattaccagctatgaaattgggcagttgatgaaactttctaagtctcagtttcttcacctgtaaaaggagaaaatacctgccctgccaggccatttgtatttaagcctctggccgatagaatattagaaacctttctgtccattggcttcaaagatgctttaagaatgaaaacatttctaccttaaaaacagagacaatggaaaacattactttctttatcatctccttggtacctttgaatatacattttgcacagtgaaaatcaagactggcttctgggattagaaacagaagggctctgtggccttttttagtttagttttttcttttttcttaaatttaaatatacttctattgtgtgaaggagagaaaaaaatatattttttccccttgcctatcttagtttttccagctggggccttttaaattagaccaccaaaagagagattaacaggagaaaagcatagaatttttatttagtaatttttacatgtacgtgggagccttcaccaggaaaataaagacccagggaagttgtaagggttgaaagcttatatattatgttggacaaagagtagtaaattggtaaattgtaaagatatgacagggaaaaggagttggggctattttgagagcttctagctaatgggattccagtaccaggttggctagcaaccctgtcctgatgggaaatgcagggtagctggacatgaatgtctacagtgtccctttcctggggtacttctttagcctggaggatggttttatgcctagttagcccacctggaacctggggactccctcacatggggaacttgtttatcttatttatctggcagccactgttgtggctcttgtctgacccatgtccagcttacacctgcctgaccatcgccctggcgccgggagcctgacttgatattccccccaggatccctgggaaagcatggcctgaggcagctgcagccactggttcttcagatgaaaagtggaaactcaatacatcaccaggtaggaaatgagttcagagatttttacttacagatcttggacaggaagggcggaatgggctgggagggcagtcctccatctccgggttgcatgaggcaggaatggagtcaggcagagagagaaaatgcatgtgggaattggcagtatatataaggggtagggtgtggggtcactttgagttcctgggcaaaggcctaaatggtgcttttaagggaagcttcgataaagtggggaaccctgtctgctagataggagagatgcctttaaattcttatctctggctgctggcctgagccatttgggtgtggtgtggaactagaactatcaagggtgactgagccctgctttgggtatgaaaaagttgaatctattcaaaatggatgctgaggcaacatgaaagtataagaattcacttcaggactaggacagttaattgtggaaaagtagcaagataaggactagtataacaaggtttgtacagctttccctcagcctcagctccccatctctggtgataagaatgaatgtctttcgtcctcctggtataaggagggcacctttttcatgggagttaatctcatgctttcaagaagaacaaggaaggtcacagtgcccttcttgcatgtgctgttttttttaagtgcctttaactcaatccatatgccgaagtagcatatttttgggtgcttaccatgtgccaaacatggtcttatatgctttttaagtattaactttaatcctgtgaactgtttgaggcagatacagttactattcccattttacagatgatgaaactaaagaacagagaggttgagtactttgcccaaggttgcagagtgagcatgtggcagagctgggaccccagcccatgcagcctgattcccagagctctgaaccattgtactgcactgcctctggatagctttgtgatattttttgggctaccaaattgtgtgtttatagaaggatcaaacatatattaatctttatattcaccggaatatgacttagccgtcaagacagcctgacaaaccggcaaaatatgtctttgtaacattactcttgtgctttgaagaggaatttttgaccaaagatgctccctgctatcgtgtgttaaatgctgtgagttaccagagatcaattgttcctaacgtaaaaaggaagtgctaatctagtcactggctggctcagtattggtttcatactgtaagatagaactaaaataacagcctcgaagggtaaaaatagtggagtcacatgaagcatcaaccgtcattttaaaaacagaattgtaagacccatgaggaaaggttaatttctttttctgtttgaaaagagtggatgttggtagacactggtcgtttctattacggcctcctgtaattttagaaaaccgatatttgtcatgacctgaggaaacatctcattcatggcttttataagacatagtcaaattcagcatcaactctcagaagatctttcttggagtctagaaggtaggtgtgaggatcgtttcttaatcaaaactagtggctctcgcttttaggtttcctaagggctagtatgcttttcaaaaataatattagtagctaaattgatcaagcacttaaactgtttgtcagcgttcttccaaaagctttacatgaattgactcttcgaattcttactgcaatcatatgaagttctggtgctattattcatcccatttaatagctaatgaagtgtaggcacagagaggttaagtaacttgttcaaggagatacagtgagtaagtagcagagctgagattcaaactcagacagttgggcttcagactttttgcttttaagcagtaagctctattatagaggcctgctggttcttagcccagggagatctaagacgtgtaaaccagaatgcctgcccacactgagtagggatcttccccactcagtctactaacttgcatgccagtctcctctggaaacaccatcacagacacaatcagaaggaaagctttaccagctctctaggcagtccttcttccagtcaagttgatacctaaagttaaccatcacaccttccaagactggttgctgcataggtgctataatgtggtatctctgtaccaccagaagggaggtgaggcgggggtaaggaagagaaaagcagacagataaagcttctgttgcaggtgctggtgggcactcagtgagtggcgtggctattggacagtggggattctgtattttgcactgtgggggcatctctcagaatggccagatattctgcaacagggatgaatgagagttagtttcactagagcaattgagagttagttgcattagcaagagcaaactaagagggaacaaatagtttaattatggctcctagctgtgatagccagcaaagagtacaacattgcagcctagatttctgtatcttactcatttgcccttgatcaatttgtttaactcagtgccccatttacccaacagtaaattgcagatgctaaatgactcattactttggcagagtcactggttctgtaattaattatggagcactttaagattgatgaatgcaaggagctgtgcacacacgacctgtacgagcagttgtataaacatcgggattgttgttgtttctaaggcttgcttcctgttctgagcccagtgtgcactttaccacaaaggacagcaaaagctttattagtagcaattaagaaatgtgccatctctgcttttactggtttatgatgggctctttttctattctcaaaaaaaaagtttgtaagtagattcagttacaactttgatcaggctttaaaaaatatttgagaagtgttttttaaccttttatcatagaatatttacaacttactgaacagtagacagaatagtacagtgaaccccgtgtacccattacccaaccaagtaaccctagtcacacttcctcccacctcattatctataacaaatcccttctactcccattgtcttgcagaaaccacatcatttcttctacagatggttcagtattcatctgcagaagtcagggagcccccagcttaagcagaatcttagtgccatcaccacactcttaaatatcaacagaacttccttaatatcatcaagcactcagtcagtggaagaaattgttttaaaaataattttatctacagaatgttcacagttgatgggttgtattacaaaagtttgctgtaagttggttatttgcaacaccagttgaatgaatattcctgtagaaactgtagtaaaagcagtgattggcccgcattaaacccacaaaaacccatggaatacataatgaagcaattctgtgtatttctctttgagtattttactgaggggagagttgatgggcaattcaccgtctgctactagagacctggctccaaaatacattttctctttcttgtgggtgttattatggtgattccttctccctgtgcccacttcctcactccccccaactctcatcatctactcatcaaacttcccattagagaagcgagaggaagaaactttacctggtatggctgactgtattcattgaaaacaaggagggaatgtttctcttttagggggtagcaaagggtataggaaagctgccattatatgcagtttagtattttaaagacgtctagaaaacaaactgcaatgtgatctctttaacattgaagagaactagagagatatatagggctaagtagcagctgatttaaagaccaggttaatgttctgctttcgcagttccctagcaaagctcagttcagttttaagtaatttatatttccagtccataattgtgtgcatgcctctgtgccctccactaacatcagataagcagggagtggggctcttctttgtagaagaactggctagatataggcagggtagaggcaaagtttccaagaggctgtgagcctttcgatgcacctttccagaaatccagctccaggggaaggctttaggagaattgccacagggtttcccaccctcagggctgtcattgctctgggttatcacttcatcaatccattggtcatggttgggataccaggaggtggggtgggaatggtgttcccccttgggctgcagtggtaggttttgttccacagatttggccattgcgtatttggattacttgctgcccctgccacccaccatctatcccagaaattgcattttctgtcttgccctatttgccatctgtaactctcacccaccagaaacttacaaagcttatctctcccaagttcctcttgataagaaatcatgtttatgtgattctagttatttccactttcataaagatataaagtatcattaaaaaaaaaaccctaacacatgaagtgcttactggacagcctcagaacacacacgcagtcctactagagaaacaaagtgctactagtcagtattaaccatagaaacctaagaactgaaacctaggctaaagggccttccttcttttttgttgctaagaaaaataaaacaaaacaaaaacaaacaaaaaaacaggccaaaagatgctcactaacatatccaatgataaccatctctcccttgacagtagttacgtttatctctgaagattgtaatgggacagttactctgtcacttgggtattactatgtgcagcagtacactttgatggaatagagaggagaggaagcagagtctgggattatttccaggaagcaggtcctggagattcctggcttgcctgtgcccacctggtgtggtataggtctgagagaactgcagcagaagaaagaaaaaagatagaagataaaaaatatgagcaaaaactcttctcgaaaacggcgtagttaagaaaaagtggtggtgctggttatgctcttcaggaggctgaggtgggaggatcgcttgatcccaggagttcagtctgggcaatgtagcaagaaccctatctcttaaaaaaaaaaaaaatcagaaaaaaaggaaaagaaaaagtggtggctacaactggatattgtgaaattagacctgagaaaagtctaactgctcagcaattccacttagttgagtcctctcctatttatttattcattcattcattgacttattcaacaaagttattgggcacctgctaggtgccaggttgccaggtgccaggctctgctgcaggtgctggagagggagtagctgtgcctttgctgagcttccagttggtgacctttattagacctgccttgaagaaggggtgataaagagaaggctaggaccaagcagcagccttggtaggaggtgttgaatttattttatttattactcattttcatttaagactgagtgaatcaaatggatgggtgagttctttctaagttggaataaatactagggcagagccttcatttaaatgagagctgatcaattacctacttctggcccattataaaccagagttattttgcttaatctttctactcatttttttttcttttaccattgttgttattgcagttttaagcttatgatttagaacattaaattattaccaaagaattttatagtttccaagtatccccagacttcagggtttccgagagcaggggccatatttttttcagcattatacaggtatgctccaatgactgcacgtatttaaattgcattatttgatgagttttcacattaggtatacatccatgaaaccgtcactacaacaactgaaacactgagtatgcccataacccctaaaagttttctcatgccactttatcttcatacctccctcttcatgcccaccatccctaggtaatcgctgatctaatttttgacatgatagattagtttgcatgttctagaattctagaataaacaaacttatatagcaggtactcttttttagactagcttctatcacccagcatattattttgacatatattaatttggttataacaatattgcatttctattactgtgaagtactccattgtatggctataccacaatttgtttcccctgttgatggatgtttgggttgtttccagttttgggctattataaataaagccactatgaaagtttttgtgttagtctttgtgtggacatatgcttccatgccttttgtgcttagtgcattatctagcatgtagtatatactgagcaaatattgtcctgagtggttgttagacttcacctgcatatcttttatggtcttagtctgtcacccaggctggagtgcagtagtgccatcatagctcactgcagccttgaactgagttcaagcaatcctcctgcctcaacctcccgagtagctgggactgcaggtgcacaccagccacacctggggtaatttttaaattttttttgtagaaacagagtcttgctatgttgcccaaggtggtcaacatagcaagtgttatgttgctgggattacaggcatgagccactgtgccctgcattgcctacatttccatggtaattgataaataagaccaaattacttttaaaaatagttatttaaaatattattctgttttaagagaaagaatggttctgctattatcctatttccctagtttgttctgtgatattttatgcattatagtcaaacttaactgtctactcctatatttattgagttcctggaatatttactgaattcatccttaaggagaaagtgaaaaactattggtatgttacctaatgaaacaatgtaaatgccagtgaaatatttaaaagatctgtattaaatatttttttattgaactgtataagaaaattagagagtatataatattaaaagttaaggctgtttatatgggaaaaaagtttaaaggctgaaaaattgtataaatcttatatttaaaggcaaaaacaaaccaaataactgacagtaagtgattgtgagggtccagataaattatgctatgtgcctgtgagcatctcacaattaatcctgaaaataatctaggagataggttatgttaatctaataattttaagatccccatttacagataaggaaatagagactagaagaggttatttaatttgcatggggccacagagctggcatttaagcacagcttgctggtcactgaagcctgggtgctcaatcattatgtcatattgactctgctgtgttaaaacattgagacaatactgaaaatattgtggcatgttcaataaattttttaaaaagtcccctagcagcatagtcaattgctgtgtatattattcacatacatgtctctgaaagtcagtcaactttacaagttcttcatcagttttaaactttcctaataacttctgattttatatttagggtaacatttttgtagttttcccatcatttacatttgccagcctgtttctagtcacttcttattagtctcaggagacagcaatatccagtcttttttcctttaacaatcaaatcaccattgtctcttgcacttgaggctctttggcactctggatccagttgtgatccacagataatgctctatgattatctttctatttcttgcctcaaattttaaataactttgggaactttgattcgtcttgctagggcgtcaaaatgctgtccatgacttatttcctacctcgattataaatgctttgtaggtaggaaatctatcccatatttctttggttcttgctaaagaggtttctgacatcacattggtctgaaatcctggagtcagagaaatttgcctctcagtaaaattccaagtgaacctgggaagatcattttagcagacacatggagagtaagagggttttgctaatgtgtaatgataaattgaaatttgttgtagagagtgcctctgtgggcttctgtttctttagaaattggctccatgaaggcttaaactttaggtgtggcagttagtagagttaatttaggtttttaaatgggaaaattcatagttataatctgataaatactcacctggcatttcagacagtattgaacaagtctccagtcagcatacatactcactagaattgcaggaaaagtacttaagacaaatgaagtatttacatgttattgctttcaaatctaaatattaatgtttgtggtggtagttagcaccctacttcccatgatgcttagctccgagtgctaaacagatggtagatatttcatatactagatatggccagggactgttgtccctcacagatctgcaaagtgggagtcctttctgttgctgtcacctagtgtcagtttcccacaggtgtttttgctcttgctatttttggagaggtaacatggtatagtggtcattggaaggcttaaacaagttgatatgcgtaaaccataggacagcaccaggcacacagtgctattataaatcttacctattattctttattatttgaatatgggttaaatcagatactatgatttagtatatttccattcaccacatggaatctgatcattttgcatctttgctgccagattcagatcccaaatgccaacactgagtttcacgtaaattcttatttcctagtgagacatttccccatgcaccattctaggctgaaaatgtgtccaggtgggagatctatctccagaagccaaatgttgccataaaaatccattgtctatttctgcattttctgtatcttttcagtaaaatgtattgaaacctcgggggtgggaataagtaggcattttggatttgtctggaaatgcttacgtctcaggagaggtggctgagagttagtgtgtgtaacctttatggggttttacctgaacatatccctgtagattgaatcttgttatgtgtaagtcagtgttctcagggtgctcttcacacatgtgttgggagcgtgttaggcaggcctggtggtcaaggaatacaggtacaaaataacaaatgtcaaggaatgttagaattcaaaataaagagataatttcagccagtgttgcccaaacttcagccgttacatatactacttagatgaatttgccatatatgtgccatctgtaaagcactatttatctaatgttttcctttaaataatttaatgtttttttccttagacacaattatttgaaaaggaaactgtatcagtcagtaaatgaaaaaccatgaataaaaggtaatcataaaactatatacagtaattacaaatgtttatccaagttccacctaaaaccacctcagcttgagatatttaactgatctttttcctggcaattcatgcgtgtgtgcgcgcatatgcatgggcgcgcacacacacacacacatgcacacacacaccttgttatattgctgtgtactttccatcaagcatcatcataagaaaacattttctttaaagttttagtactattaaaaagaattccttttagtcctgcatgtattgacctgagatgtctatggtatataaaagtgaaaaaaatgcaacacactcccaaatataaatgaaagtacttgtataagtatgtgaatgcacacatacgcgtgcatgtttatgtctgtgtatatgtatgtatagcatacatacatacatatgcttgtatgagtattctaaatactcatacagtgtagagagaacacttgaattgttaaattacttttgagaggtattggaatgactgggaagaaggtttgcttcttcttgttggcagtgagcatggaaaaaattaaataatgaagattataaaggaaaaaaccctcagaaaccaccagagcactctttgggaaacactgatttagttcagcatgtctctttatcaataaaaaatctgaggcattgagtagctgaggtgtggagtactcttaatctagaatatattctttaagatagctaactgctatagcttacaataccctgaaactcctgccttaccacaatagaaagtttctttcttccttacattatatataactgccttctacatggtgtttcagggacccagacctcttccatttaatggcttcattgtttttcagtccccacaatctttcagtggatcttttgagtccagtagggcgacaaggaaggggatggaacaggaaggatagtgtgaaaggttttagaggatgggaagtaatgttatgtcacttctttccatgccccccttggctagaactcagtcttatggcctcacttaagtgcatggcagataaggaagtgcaatctagctgagccaactccccagaaaggggaggaaaaatgtggcaatcagagatcgctagcatagtccttgctccaagggaatttgtaatctttggattgaatttattaattttggcattccttgaattcagaagtctattacatgaaacttaggcagtaagagatctgtatacatttatttttacacaatgtattgtaattcctactaatgttaagaattaaaccatttaaatcacttttagacttaattcaaaacacataggttagtaagttttgctttcaaccgtaataaaacacatctggtgataggttttagctctggggccacaaaggagagttgtgaagagggttgccaggaggtatggaaaagtcttaagtggtcataagatcacttagggggagaaaacaacacttgaattttaaatacagtgaaaatatgtcttcagaaactataattgcctacatcaacacgatcttatatgaagattctgtgattttggaaatgaaatttttgccttcatatttctttttttttttttttttagtatttattgatcattcttgggtgtttctcagagagggggatttggcagggtaataggacaatagtggagggaaggtcagcagataaacatgtgaacaagggtctctggttttcctagacagaggaccctgcggccttccgcaatgtttgtgtccctgggtacttgagattagggagtggtgatgactcttaacgagcatgctgccttcaagcatctgtttaacaaagcacatcttgcaccgcccttaatccatttaaccctgagtggacacagcacatgtttcagagagcaccgggttgggggtaaggttatagattaacagcatcccaaggcagaagaatttttcttagtacagaacaaaatggagtctcccaggtctacttctttctacacagacacagtaacaatctgatctctctttcttttccccacatttccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgttccctcttagtttgctcttgctaatgcaactaactctcaattgctctagtgaaactaactctcattcatccctgttgcagaatatctggccattctgagagatgcccccacagtgcaaaatacagaatccccactgtccaatagccacgccactcactgagtgcccaccagcacctgcaacagaagctttatctgtctgcttttctcttccttacccccgcctcacctcccttctggtggtacagagataccacattatagcacctatgcagcaaccagtcttggagggggagggagagggagagccttcatatttcttatagagattttcctcttcctgtttatattctggatattactttaaaaactataatctttaaaattatgccatgcttatgtatatattatgccatgcttatatatatattactggtttcttaatatgtttctttttctccttagtgtaaaaacactttataaaatataaatcacccatataagttactattataagctagtttaaagggaggaaaaaataatgagataccaagtaatggaatgccaagtttttgttagaattttgtccttggtaaagaggcagcagtttctcatagaatcatcaaattggaagtgcctctaaattctattcatttgacttctcttagaaagctctatgtaaaaaattattcccagtattcacaagaaaaatgtcaaatccatcctttttttcgtttctcttaattaatgtgttctgctgtacttaagacccattcttctaaatctgttctgagtggaaagggaaaagactacatgtatgaatagaataggccttttagggtcatttggtgtttttagtagaatatgtcattcattttcttttctgttaaacagttgactggaactctttagtctttcactattgactcacccgaactttcattgtaaatatgatcatttgtctctgtaaccctagaagatgttgggtttttgtacattccataagggcaacggattgtgtgtgtgtgtgttttcaagtctctattatggtactttgatatctgtgctttgcagatggtaaaaggacacagcagtcaatatttaatgaacatggctgaaggactaaaccaagttcacaaactaaatacaaattgtcgtgagggaatgcaatgaatgttagccacaggtttagtgctatgcatgtgttgaagaccgcaagttctaaattttgtcttcttaatttgatgaaatattttatccctcaataatatttaatgtgtgtgtgtgtgtgtgtgtgtgtgtgtgtgtgtgtattttttttgtctgcctggtcctttgttgctaaacatgccatttcagcagtctgctttgggtttgtgtttgagatctgttttaattgttgtggcctgttgagaaagaacacagacagactgaacacaaaacaattcagtggtgcaaaatgaggcctaatgataggatagcaatatatgtacaaacagaggttctttataattgaattgagaaaagaggtgggagagggtgtcatgtggcacacagtaatataagcatgtggatggcaagagaactacttacggagagattcaattccagccaacaccccatctgtcacatccaagtaatgttaatttcactttatttgctgtatagttttgtttgtatttaatttgtgaactttctttgattttatagttgtatacaagctataagtttaagaaatttctactgaatttatgtttgcacatagttaaatgataccaagttacttaggtataggtggcacttacaaattcaggattggaattaaagttcaaatcctggattattgtgtgactttgggcaagttaattatactctctatgtattgatttctccatctgcaaaatgggggtgacagtaattctcatgttataatgctgtgaggattcactgagattatccacattaagaggctaatgtattgctggtttatagtaagtgttctataattgttagctatggacatgataatattcttttttttaataataaaagtccataactattcaagctttacagacctggagtcaggtaaaagcattactgtttttgagggattttagttcaattctggctcagcctctacaatccttagccagtctcatagcctctcagtgctcagtttcctgcaacttcctagggttactgtgaaaactgacagtatatgctactatttggggagtgagtttgtattaatcagggttctctagagaaacagaaccaataggatacatatagatgtatatgaggagatttattatggaaatgggctcacgcaatagattatggaggctgagaagtcccacaatctgccatctgcaatgtggagacacagaaaagctaattgtgtaattcagaccaagtccaaaggcctgagaaccaggagtaggggaggaggctgctggtggaagccttggagtctggagagccaggagcaccaaagtctgagagcaggagaagatggacatcccagctttaagaaaagagttcgctttccctttgcctttgtttgttctatttgccccctcatcggattggatgatgcccatctgcgatggcagaggtggatcttctttactcactcagctgattgaaatgctaatctcttccaggaacaccttcacagacacctggaaataacgttttaccagccgtctgagtatcccttagcctactcaagttgacacatgaaattaaccatcacagagttccatgtgtcagacactgttaagcacctatgaacattatctttaatcctgctgatagcttggcaaagagagcagcattgtcctatttctacggagaaaggaactgaagcacagagagaaaactgggattgccctaggtcgtatggcttataagtggcaaagcagaggctagaagtcaggatctgcttgtctccaaagctcatgctccttctctgaggtcctcttgcaatgcagacatgattcacccaggagatttcctctgccacaagaccctgggaacagccacatcaggaataaaatttgtgatgtgggaaagggacgaatcatttggaatattggagggacaccctggcaagcctttccctgtgtgtggtggggactctggatgccttgggaaaaggacaagagggtgtcctgagataaatgacttctcagatcacctgagaccagcctggttatttgtatacatttttttctcacttaatttctttagattaggatggatatttgtattattaaaatacagagtattctggaaattaaaggaaaacagtgtaccttgtaagtcttgctgggggacagaatctcatccatctaactccgagttctgccattcagttgatgtgtagtttaaagcaagttatatttcatcttaatgcctcattttcccatatacgctggtttacaatatataaaatggtcattgcttacttccattttcaagctttgcaaagtgtgcaagagaggacacacacacacacacacacacacacacacagagtattgcccatggtcctttgcatactgggtcagcacactgttgaattagtatccactaagtgtcaggtggtcttcttagctcggcagattcatagaggattcaaaggtgagtcagggaaagtctcagctttatcatgattttcagtctagtaagcagggcaaaggctatagaatagaaaggaaatataacacaaaaaaaagtaatgaccttggatatttccccttgggccacaatttttttttttttttgagatggagtctcgctctgtcacctaggctggagggcagtggtgcgatcttggctcactgcaacctccacctcctgagttcaagagattctcatgcctcagcctccagagtagctgggattacaggtatttgccaccaagcctgggtaatttttttgtatctttagtagagatggggttttcccatgttgggcaggctggtctcaaacttctgacctcaagtgatctgcctgccttggcctcctaaagtgctgggattacaggcatgagcaactccacccagatgggccacaatattaacaatagcatatagcatatgccatgaatcatgaagtattttcttactgaagaaattctaaagaatagtctaaatggaggagaaactgtgagttccttctacggtaactgctcagaaatcatttcctaaagcttttattcctaaagggccccactgtggaaaagctttaaaaagctggcatgtcaggagttaaagtgggctcggggagaaagtgcatgggatagcatgcctcactcagtaactctctgttccctatggtgaatcctttatcccttccaattcttttctttttcttttttctttttttttttttttgagacagagtctcactctgttgcccaggctggaatgcagtggcactatctcggctcactgcaacctctgcctcccaggttcaagctattctcctgcctcagcctcccaggtagctgggactacaggtgcgcaccaccatgtctggctaatttttgtatttttagtagagatggggtttcaccatgttggccaggctggtcttgaactcctgacctcatgatacaccctccttggcctctcaaagtgctgggattacaggagtgaaccacggtgcccagcccttccaatcctttttttccgcagccctgcctaacctcccagggttaccttcagatgtggctagaataagctgccactatatatactgtatatgtgttgtgaaaagcagaattgtctttataaagatggcgctaagcatttctgcagcagaattgtctttatctataaagacagtgctaagcatttctgagttctggacccatattttaactttcacctggttgttcaattgtcactcaaacatttcccagccctgcctcctcgcacctgattgtccttctgtgttccttctcatgattcatggtgtccgtgtttcctggtcactcaaactcaaaatccgttagcccccctcagtccttctctactcttaatccccatatctaagtggtcacaaagttttgtgaactctgccttctaaattatctggtgtctttgcttttcttactttactgccactgacttggttcagaacttcatctctcacctgaactattacggcagttgcccagccagcctccctgtcaacactcactcttcacctgccgttaatcattatatttttaaaaacacaccgcagtactgcactcctgattctccatgtaaaactgctcagaataaatccaaacttgtaaggctggtgcagaagcatcttcctaatgtggcctcagacagcctctttggtgtcattccctacaagcctcctaaagcaccctgagcttcaaccacagtgaatttctttctgttccctaaatactcagcactttgttgttttgcagcctgaaactctctccattatctctgtaggaaaactcatacttatcctttaaaaataaaatcaaaatatcacttccttcctgaatcttccccatcttcttgtggccccatcactgccccactctgtaggataccacaagagaacattgcttgatcattactagactgtgaatcatccctcttccccttccacccatcatattgtgaaatcctcttgaagagaccctcaaccctcctttcataactttgaaactccagcactcagcatggtgcttgttgcccagttgggttggtgtcccatagtatttgctggcagaataaataaaagaatgagtgatcaacttacatgtgaacctgtatctgctagtttcataacaagatatttggagaaagtcagtccaaatattgttaggttggtgcaacaagtggggatcctggtagagtcagacctggcacgcgatggcaaagcttggcgactgggctcgatctcagtatagaacannnnnnnnnnnnnnnnnnnncaccagcctaaccgtacaggatattaggagattatatatcacagagtatgaatttaggggacataagtaaaatcaagtcatcccaaattttcttatatctatttatccacatctgacagctgcttttagaagccaggccaggtggtacatggagatatgggtgttttgaaagcagaccatggcctgctgctcctagagctagacagttatttactaaatacatgcagatgggccagacattcttctaagcactttgcaaatattaactcatttaattctcataacaaacctaggaaatagatactattattattcccattttacagatgaggaaactgaggtcaggtggaatgtgttttttctttgcatctactgttcatttcactgagatttctcttcctgccattcctcttctgaaatgtaagccattgttctctgtgctctcttagcatcttttttatacgtagtgctcacgcctgtaatcccagcactttgggaggccgaggtgggtggattacctgaggtcaggagtttgagaccagcccggccaacatgatgaaaccctgtctctactaaaaatacaaaatttagctgagcgtggtggcacacgcctggaatcccagctacttggggggctaaggcaggataattgcttgaaaccaggaggcagaggttgcagtgagccatgattgcaccactgcactccactccagcctgggtgacacagcaagactctgtcttgaaaaaaaaaaaaaaaaaaaaaaaaaaaaaaatatatatatatatatactacccacgtcattacatgatagttgctatgtcagtctgttccacaagtaaacttgggcacattacttaattttagtttctttgtcagtaaaatgggtgtagtaatccttaccttgcagagcagctgtgaggattaaaagcacctggcccaattctgcggctacaagctcaggaaatgagcttgtcctattgtctttttgtcattcttcacacagttgttgacacatgacaggtgttgtcctgtgagaaactgaagggaagggagaaaaggaaaaccaggacaacccaaagtcagggccactaagggcgcagaagagtgtcagcacttgcaaatctcagaaggtggcttacaattcagagaagaccgtttggtttgatcatcagtaatgttttcgataacagccttagcaggctatgaggtgggaggcagatgcaagtggttaaggagggagtgggtggtaaagaaatgaaaactgagggtgcactgtcttctcttttaggaacagaggagaagggttagagtagcagcaggtgaaaagcatgcttcccggtttggataggagagccctgaatgcgtctgtaggcagggtgggagaagcccttagcagagaatgaccagagaggatgtccttccttctccctgctctggtggaaaggctgcttagaaccccttttgtccatggtgggacttggctccatgagtcctcttactgctttgcatctcgggcatctctcacagtctagctggctttgggtaatgtacccaaaatgtaccctttcagctcagggcctgggtaatgtacataacttgtctcagctgcagtttcctcatctgtaaaatgaggagaataatgtgtacctcacagggatattgtgagcacagaatgagataacatgtgttcagtgccaacgatagtgtctcaaccattgtgtctttttaacttttctcttagagacagggtaaaagaaaagcaaaaagggtaaaatcttagcattttcttgaactgcagaaggaagaatttggggatgtgcccctggataactgctgtctcctctgtaaagcagagagggagtgagtccaccgaggcaaagggaatgggaagtttgtagttttgagggcactggtagtttgaggccgctgggttctcttcactacacaagggctgatgagcagcagcgaaagcctggctgggcatagagatggcagttaggattgtgtgtgtgaccttccatagccaggcatgaagggaatagggaaaggtgtggacggaactggggactgacaaaactgttgtattagtccattctcacactgctataaagacataccaaagactgggcaatttataaagaaaagaggtttaattgactcagttctgaatgactggggaggcctcaggaaacttacaatcatggcaaaaaggaaagaggcacatcttacatggcgtcaggcaagagagagagagcgagcagaaatgagtaaaagggaaagagccccttataaaaccatcagatctcctgagaactcactcactgtcacaagaacagcatgtgggaaactgcggccatgatccaatcacctcccactaggtcctgccctcaacacatggggattgtagggattacaatgctgagatgagatttgggtggggacacagagccggaccatatcaagtgtcaagggggtgtggggttctagtgtgtgcatatgttgggggatataaatatgcactggggagatgacagccagtcctttagtcagatgggaggtgctgatggcccaggtgaatgaggcaggtgtggaagtcctgtggtgacaatgaggatgcagagcaggttcctgggagtggggtggggaccccaaagcttgtggctagagctggggtttcagaacattagataaaagaattttcagagactaaggccaagggatggctggcatctcaaatacgatgttcttaatttctctactttttcttctattctttgtcatatgaatacctaccaatgaagaaaaagtaaccttagtctttatgcaacttttgtgtggaattcatctgttaatattattcagcaaatattttttatttctacattgtgtttgtaataatttttagtggctgcattatattatctttgcacatactgctttgtcttcttttagatttttccctaggataaattcccaagtgtgggataactatgcttaaaggtgtggatgattttggagcagggagtcttgatgggctgttagttaattgctgcaggcagatctacagcaggcagggagggcaggcaaatggggaagaaaattagaatatttaataatagactctgaatggaagctttctgtgaatattttaagtccacctcacataactctcaattctgtgtgctgcctctactggaggcatttaccccagtgaaggggaaaacagagctggctggaagttgcatgtgtgattgagtaaatggaattttgcttggcttggtctttgacgctttctttttggggactatcatcaagaacatgaagaagttgaacaaattgtgtatctggcaggggcaggtagcaatgaaagggagtttttctgttctggagttatgtatttttttgaaatagagtcttactgtgtcacccaggcctgaggtacagtggcccagtctcagctcactacaacctctgcctcctgtgttcaagtgattctcatgcctcagcctcctgagtagctgggattacaggcgcacagcaccacacctggctaatttttgtatttttaatagagatgggggttttgccatgttggccaggctggtctcgaactgctggcctcaagtaatccacccgccttggcctctcaaagtgctgggattacaggtatgagccacggcacctgacccattctggagtttttttgggggggcaggacagaacagtttcatcttgataaattaaaggatttaataattttgattacaataatcacagtgttagtattttgaataattttagcagttagtgggaaacatgatttagataattttaaagaaattgcaatattttgaatcagagcaaaatttccttaacaatattactgttaatttttttatgtcttatgattctaatgtttctcctttttttcttttaacagaagaaatacagaaaggggtttattgatgtttcaaaaatcaagtgtgtggaaatagtgaagaatgatgatggtgtcattccctgtcaaaataagtatccatttcaggtgagctggtgtatttttgtggcagtgcagtgctgggcttagtcatgtttgctctttgacattacagtttcctgtccttgctttgctggctgatttgtaggttcatttgccactttaatagttgtgacttttcttcatgaactgtttaagtctttgtggaaacattttctgattcttaaggagttggggctaagactgaaaagtgaggttgaagtgttccctatgaatctgagaaactgagaagtgaaaggctcaagtggaaatgagattaaaaggctgcttgtgatgaaaaaaataatattagacatatattaattaaactatgcttcttcggggtaatcatgttattttttttcccgacaatggttctgttgcataagggaggtaaatatctcattattctcatttatgtctgaggaaatcagtgctcacctgttaaatagcttctccaaggtcaccttgtaaatgaaaagtctgccaagcacacacacgcgcatctcctctccagaagaggagggtccggcgtcctgagctactccgcattcctgccagtatcttggttcccacctgccttgagaactcaggaatgtggagttggatcctgataatctggagctctcagcccctccccagcacctcaccacttccttccctgctcaaggatgtttttatgctctccttgagcagtgaatgtccctagtgaaagtcgccttttacccatggctgtggtctcaccatgtcctgaaaggaaagttgcaaaagtctttttcaatgtggtggaatttttgcttgtttttaattgctcttatgaagttatcaattacgttggaattatacatttaccagttttgggggatgaagatgtttgggaagcagtgagccaaaatatccaagctcctggcttattctccgctagagtggcaacatcacaaatggaggaagggctacatttaattttccttttccctgttccttattttatagctaccatttctctgagtgaaggacagggacagtaagtgcttagagaggtgactctgaggccaaactgcctgatttgcttactggctatgtgagcttgtgtaagtcacttaacctctctgtgcctgtttcctctcttaaaaaatgggaataataacaataatagtactcatttcatggggttgttgtgaggattaactgatgtgatatataaatagctttgacatataatcagagcaaggtaagtggtagttgctattattactattgctattctcttactactgctgctgctattaatattacacctaatattacacctaccacctggatctagaagtaagataaatttaaaccttcttcttaagtatgtttaatgcatatataatggaaatttagcagagaaccattcctaccacacttctttttttttttttcctttgagatggagtcttcctttgtcacccaggctggagtgcagtggtatgatctcagctcactgagacctccacttcccaggttcaagcgattctcatgcctcagccacccaagtagctgggattataggcatataccaccatgcctggctaatttttgtatttttagtagagacagggtttcaccatgttggccaggctggtctcgaactcctggcctcaagtgatctgcctgcctcagcctcccaaagtactgagattacagtcgtgagccactgcaccgggcctcctaccacagctttgatggctattagacatgctagggattgacagcattggggagctgtggctgtcatgattctggacccagcattaggatttttgctgtccaagaaagagagattcactctgcaagttttgggttgcttttaagaatgataatacaagtagaacagaacgcattccatccctgaactactaaaattgttgagatgaataaatatgagaaaagtttgaaaacaatctgaaaaattaatcaagaagggataagcttgagctttatacaatttaaagcagcatgatttaaaaggtgaaaaataccctctcttattataacttaagtataactaagaaagtatagatcctagtttcacattttcatagtgaaattttacattaggttcagatgcaaagtgaaaacaataaaagtagaagtagacattttcaaaagacactgggagaagaaagtaggacggatggagagaatggtggggaatccacaccagctgcctagatgggatggttgctccttcatgcttttctagatgagtcattctgatggcagctgggagatccccaggagctggcatgtcttccctgggcttcaaacccagatctgtctaccttttgtctgtgctgtttctcctacaccacactattaagtctatggaataaatgaatgagtggatggaagatataaataggagggtgggtaactaccagtgggtagtgttactgagggagagtattccctccttgtttaaatggtttctgcacttgaagtttgcaaagctcttccctcccaacagcctctgctgtggtaggatgactcagcacaagaattaaggcagagagaaacacagctccctggatccttctccccaagaggccaacattgtgtgatctgaggtttgctcagggagatactggcccacaaatacctcttcagcctgagatgccaaaacagggtgctattcctagaaacttctcgtagaaatacaaatgccccaagttagctaggtaatatatcaagctagttttagttatcgaaactctgaatttggattaggttttttttggtggggggaggcggttagctagtctaacaaactttaaggaagtttcacaggctcacggtactgacacgagatgagttttgtggggaagttagactgcttggagtctggaaaggcagattccaggaggggaatagtcaagggatatttgggggttaaatatcctactcatatgacttaacctcagccactttggttttgtcatttgaaaaaagaggattctaacactaagaaagaactggattgctgtatggatgatatgaggcagtgcatataaagtgcttagcccaattgtggggactcagtaaattattataataaattaaattgttattacaatacaccacaggtttctggaaggtccaaggccctagcagtcttttccagacatctcaatgtcaattcagaatgactagttcacggtgcatagttccttctgtacagagttggttgtgtgggcaagcctgcataaatgtgaaaatcatggagcaaatgaggaaacacatctcttcacatctcctttagcactttatcgctctgatatcatggctcactttctgtcttgtaataaggtatttctatatttgtcttagaaacaggcttcatgtccgattcatttttgtgtcttatgcagttccagcaaggtgcgaatggtatatagcatcatttgttctatggtgttcacattactattacagtgcatttctggctggttaccgtggctctcacacctgtaatcctagcactttggaggctcaggtgggaagatcacttgagccgagggggttccaggttgtagtgagctgtaattccacccctgccatccagcatgggcaacagagcaagaccccatctctaagaaaaaaaaaaaaagtacattcctttgatttaaatgaataagaaggaattctctattgaatatggtcagtgataaccatttatcaatgaaagagctatttggttttcaatccagtgggtgtggacgtgacaaagggaggtttctagccatgtattaactttttagccagtctaaacagatttctgccttgtgactgaccatgaagaataaaatgaaaaaatttctggcttagtttcccagggttatcttattaataatattagaaatgttaaaaataagactgtctaattgcccaccaaggactacctctaagtgaggcactgtgattaagaggctgggctctggagtctgaattctggctttctggattaccagccaaatggcaatgggcaggttaggcagtgcaacatcaggggacagcatctgcagtgcatggtgcatgagtggtatctgctgaagttacacaggagtgggggcctgggtaggcctttattttctcatttataaaatagaaaaactcgtaccttgatggcaggattaattgagttaaggtctgtaaagcacacagcacagtgctggcgtagtcggtgcttaatccagttagctactgcaattattgatagtggcaaaaggaaactataagagtgatgctgaaggagtagtccattcatctaaaatattatttagagaaatactgaatctctgttacagtttagttaattggattgaaagaaatactgagattaatgaagtatcctggcctttatatttttttctataaaacatggtcttttgcaaaacgtgtattctacttaatgtagaaatgaagaagtacttgtgcttttgtaagaaagtaacctgggttttctggatatgaagttattgactttcagttatttgagaatcatttattggtgtctgtagtaccaagggttctgtgctagacagaagtgctgtgtctaagtcctcttcaccaattccatcttttgttttattttaggttgttcatgatgctaacacactttacatttttgcacctagtccacaaagcagggacctgtgggtgaagaagttaaaagaaggtaaaactcaatgaaatattactctgtatataattttaggagatgtaatattgttatcattaagacagaaatacagctaatgtatctattgcatttgtaatctcttaatctacagtaagtgtttctccaaggatatgctgttgttgtaagttataccagcatattgaagataactttcctttttaaaatctgatttttttctagtagcatatagtttctaagaaaagcacgctctcatttaatgtgtaatatatctgaaggtgataaagcgcaagcttttatgataacagaatttggtgttttcttgttttttttttgagacagagtttcactctgtcacccaggctggagtgcagtggtgtgatctcggctcactgcaatctccgcctcctgggttcaagcgattctcctgcctcagcctcctaagtagctaggattacaggcacccaccaccatgcccggctaatttttgtatttttagtagggacagggtttcaccatgttggccaggctggccttgaactcccgacctcaggtgatctgcccacctcggcctcccaaagtgttgggattatagacatgagccgctgcacccggcccaggatttggtattttctaacaaagtgcccatgtagtcaatatttggtgtggatggaatgacatattcatgaagggtttaaatggatgatttgtcctgcatagtcctcattgcttctcctgaagaacaaaatggtggcaggttgacttttgcatttatccatcattggtgtagcagcagtcatttctgctaacaagggtgcttcacacacaaaaaaagaagaggtcaaagagaactatagagcttttctgaatgctgagtcctgtgatctaagggtgttcttatagtaaacatagtgtccaagaaataagtaatgatcgacactgttatttatgaaacattctgtagttgcttttgtatttcactattaattactatatctgtgaattacagaaataaagaacaacaataatattatgattaaatatcatcctaaattctggacagatggaagttatcagtgttgtagacaaactgaaaaattagcacccggatgtgaaaaatacaatctttttgagagtagtaagtattcattttattccataattatattgtgcttagaatgaacatattattggtatggtaagaaagtgacatggttttgattaagtacagcacactttctagtacagtgaaaatgtagggtaggtgtgttttgtaagaaaaattatatttagttacagtgagaccttctcgtggaatcagaaggtctattttgggaagcttttatcacaatattgaatcttgttcaaaatgaatccattgaaagtgtgagcctaatgtggcactgtcagcagctttgaaaagcattaatgttcttcaacaaataaaccaagatgtggagctagaaacctcgtgtagcagtgcatccacagtctgattagggctgttctcattttgatggggtatagcagtatggatttcagtagtggcttcagtctgttagaacagtaacatgtcataatgatactcacatgtaaatgttgagatgaacaatgtctaaggttaattttgacacctaaaacctttataaatcctgggaatgagagacccttagtcataagctaaaaatacgtggagattgttaagttactagtgctgtagtaggacacccatagtaatgattggatataccgtttcctgctggtgccatgcagaatgctcactgggtccatcagaactgacagagcttctggatatgagcagaactactacttggcagggatgctgtattatgaacgaggccagatcagatgaccttctcagtccatctagccctcagttctatgagtcctggcaccctgattctcttgggatatcctcacattaacttagcacattaaagaggaagcccaagtttctaaggctgttattgttccttattttttttttaatgtcttaaggtttggtattagtgaatgcacagtctgacctgctgtaaaaagggacccaaaagttacagtgacttaaactagagagaaatttatttcagtctcatgtaataacccagaggtgaaaggtgggtgacccggggctgggggtattcctgcagtggttcctctggttgctccagctctagcagtctctctcttcctggaagcagaaagaagggggtcaaggatgcccatggggaatccttttagggatgagatctaaaaatggcacaccccatttgtacacagaatcctttgattagaatttggtcccattgccacacctagctgggaaacattctttatcttgggtagccatgtgtcagccaaaactctaggactgtggactgtagaggaatggacagccaaagctgattaatttctcagtgttgtcatgatttcaatgtttgattccatgagcattattgagtgcccagtttatgcagtggtaggaatacaaagaactggcctggcttcaatccctgtggcatttattgtgcgttcagaaaggcagaaatacaaaccagctataatagcagtttttaattctgttctagaatagagatacaagcagcatacaccagagttggtcagagtgtgctgcttgtctatgtgttaacttccacttttccttaaaactacccatatcttatttttatcaattattggtagatagcattttaacctgtttttgttgttggcattttcaggtataagaaaagcactacctccagcaccagaaacaaagaaggtaggtggtctttagcttttgatagttaatctttacattttaagcctttaagtcttaagttttggtagtgtttgtgacttactgagtatgcggtttattcattgatgtgacacaatttttccctaggatcgtctcagaagcagatgtgctgtagcttatttcaattttttgtggtgtcaaataataccaatttaattgtatgagattttatcattggagatcctgttatcatctggcattttgcctctattttcacttaaagagttgtattaagaggagtgggatttagataaatatttcagtcttaagaccacagtgtgacaaagaagtgacttcactgatataatgatatgcctttcaggagtggggtatagtggaggaaacatgcactttggactcattcaagacttgatctgatatgagtgactttgagtgggttaattaaatcattgttaccttagttatgaaacaggaattataatactcttcttcatgagagtttgttggattatagtaagtagacttgaagtttctagtttattctgtggtgatgtatgactcatttagtgttttgattcatgatcagtttcatatagaagactaaactttcaaatgttatcttccttgtctagcgaaggcctcccccaccaattccactagaagaagaagataatagtgaagaaatcgttgtagccatgtatgatttccaagcagcagaaggacatgatctcagattagagagaggccaagagtatctcattttagaaaagaatgatgttcattggtggagagcaagagataaatatgggtaagtattccctctatgtgtgtgacatgcagtgggtaggtgggagtcaagtgttgagtgagaagtagataagtcgtaactatcgtgtaatgagactaatttcaccagccataaatggaagcacaccttattacttggtagtaacacagtcctttcttagtggtcactcagtaaatgcgaattgatcaatcacttcttttcaaaagttagaatacattggtctctttctcatctgatacatgtttaatgtgattattttgaccttgagggaaattaaattttatattttgtccccacctgccataagtaagtaatcttagatttttctaagagtttattgtaatttttttcttagactctctctctctatatatacgtatgtgtatgtgcgtgtgtgtatgcatacacatacacagtataatgaagcctcttctcacttctttctctctctccatgaatatatggaggaataagagaatatatatatatgtatatgtgtgtgtctatatgtgtgtatatgtgtttgtgtatgtatatataaaatatatatatgtacatgcaggaaattaaacagcaagcttttttttgtacaagttaatttaggatttaaagaaaacagtcctttcaaccctatcattgataaatatatgggcagataggggtaactgtaggggatgagtatcttgcaggcttcataagcaaactctgtatcctgtgtttacctctgcagtgcaatcccacttatactctgagttccagtggatgagaagaggagaactttttgtcctgccagagcacactcttcttccacctgccctctcacctcccagccccagccccaatttcaagtcactgttcctcagttcacttctggagaagcagtggaaacctctagtttaggcggggtccttttcttctgcttgattcctaggcatggtgcatatatgagtgctgttttgctgtgcattattaacttatttgcaactcttaaccttttattccatgtttacaggaaggttgtcactgcttctctttatcggatgctgtataagattgatttctatttttaatttttttttgttgtagaaattttcaagcatccaaaaagtatataatagtataatagaatctctttttgcttgacttcaaaaattaccaacattttgccagtctaatccttccatttttttctagaatatttaaaagtaaattcaagtcatcatgttatttcactcctaaatctaaattctaaagacttaaaaaaaacaccaccatgtcattatcattcttaataacagtattttaaataagatcgtctgtagactttcccttaatatttttgtacctggaggaagagtacaaatgagaatccacataacatatatctaagtatttaggagttataaatcaagctagcaaactttatcctccaacttgacaaataccctttcatagtgacaagaaaggcacggtttggatttagagctctgtgccagaatgttgcagtgcatggaaagctggctctgggggggctacctctcttctttcttccctcctgccctggctctatctctcatgtaccatatggatcttccaacctgtacacccacactcttactgcgtggcttgcaaaagctaccccgcatcatggccacaccttcagcctcagtgaaagggaatgcacatggccagccagcacaatttgttttttagaagatggacccagtagaaggcccatgtagaccttggaaatgagcagggagttctggggtcctagttacccagaaaggagcatgggaacacaggtcagagggaacacgcacttttgcagagctctcaaaagtgtggggttagagcaagagcttctctggcccaggtctaaggatggaaccaattatgtaattccagtttccccgattagctctaatacttatttttactgttggtttattcaaatcaggacccacacactgcattttggttaatatatctcttatgtttctcttattctacatttttgatttattgatgaaagcaggtcatttaacactaaaatgagccataatctagatgaaacagattgttttcttgtggtgtcacttaatatgcctgtgtttcttgtatttcttgtgaactggcgagtagagctagaggcttgatcacattagaaggtgatctctggatgtcctacttttagtaatgctaagattgcttagtggttcaggtgtcagacttgttcctctgtcataaagttcttcattggtatttaccctgatgatttgggggttcattaatgattctttcttagagtcattatttcattaggggttacaaaatggtgatttcctaattttgtcattccatctgcatttagtagttctctaaagaagaactgcctcatataccagttcatttagttcatgaaggaaaggaaagatgaaatttggattcttaaacttttactagttttcagaataatgagttgatgactgagctttctctagtgataacaatggtaaccaacagtttatttttagtgttattatggatacttatatatttggttccaatccattgccaccattattctctttgcttgaattggccaaattaggtcgatggtggctgtttttggtagaggatcctgttagtttttctttcctactttctggctcagtgaaatggctcaagttatcttgtatttatttttctggccaaacttacaatttgacatttttcttttcttttctttttctttcttttttttgagatggagtctcgttctgtctcgcaggctggagtgctggagtgcagtggcgtgatctcggctcatttcaacctccgcctcctaggttcaagtgattcttgtgcctcggcctcccaagtagctggaattataggcatgttccaccacgcccagctaatttttgtattttttagtagagatagggtttcgccatgttggccaggcgggtcttgaattcctggcctcaagtgatctgcttgccttggcctcctaaagtgctgggattacaggcgtgagccactgcacctggacacaatttgacatttttctaagggggactggctccttttagtcacaaatggtatttagagacagtggcaatgctaagatcttaactgctgctggattgccgttccttctgggcctttctcagtgcaacagagctacctgtatgcacacatttgtgtgtgtgtgtgtgtattatgagttcttactaatactttaaattcaaatttaagattataaggtttctactcaatttttaaattttatatgtatatctgttttcttatgctgaaaaccttagctcctacttacataagagtgcatcttaaattgtgatgtgtgtgaaagtcatttggggtaaaatcggacattttttgacctcacataggtcttctcagttcacatttattgggttatgacccaagaatttgctgttttaacaggtgccccaaatgatactgaccgaaaggccaggaattatcctttgtgaaactattctataagaactattgaggtattagagtggtgggtatttttaatccaacactttgacttttctcaagtaatggtttctttaacacatatcagcaaaactgtgaattctggagaagtattgtggaatgttggaggagcacaggagctagtcacaagtccagagtttgagttctggccctgttgctggctaactttaggacctttgggaaaaaaaatcctataacctttctaagctttagtttccccaccagaaaataggtacaataatgcctgcctaccgcagaatttttatggagaccaaaagtgaaagtactttgtaaaatgtcaagtgaattacagatactgcattttggggggtcagctagtctttcttataagctttaagcaatgtcatgctttatttcaaaaggcaataatctttctttctttcaataacctcccagtaaagtaagtttacctaaagtatttttcttatttctaggaatgaaggatatatcccaagtaattacgtaacgggaaagaaatcaaacaacttagatcaatatgagtaagtaaatgtttattttgtgaatgtggaaaatcagaaacttttcattttcctaattatgtaaggcattttgaagattaatggatatctttcatgattctttgaagggggtgctaaaatatccttaactcaattgcctgatgtggtaaaagactgagaattaatctctataatatatttttcctgaaggtactgtgtgaatggagttacataggcttatgtacataaattacataagcataattgaattgatttgaaataaatcacagattagctgactttgaaatacagatcatgtccattcattcaggacataagcagaacagtttccagagtggaaatgttaataagaaaaaattactgaaattaattagagttgacctttgtcagcattagtatatttcctttcaatctttttactatttttgaaaagatagaatcatgcttatttcctcatacactttaatattctttgaaaacattttcctagctacattttatttcatttgatcataaatttattaaatatttactgagatcttagcatgtatcaagcattatgtatggccttagagacataaccaggcagatggcacgtggatgtccaataatttatgtaatcatttccttatttgtgtggtttaggttgttttaggtacctttgctatattaaaaaaaaaatgggataacgtcttgtttcttatcttaaactggatctctaaaatctatgtgctgggctacaggctgtacgtgaacattgttagggttcccaacgcatgctgtcaaattgctttccagataacttgtattatttatatacccactagcagtgtgtggccaagttgtaacgtgaggctcatatacattgaacgctcttttatggtcattctgaggtggtgtattgatgcttcattcacttccttgaaaacaatagcaacaacaagctgttcctctcttcatgtcacttgctataccataagtgtaccttaacatctaggaaagggttaacaagttcaaaaagccacagcgctcagtggatgtgatctctcaaagtaattttagaagtagaagagagtataaacaatgtataaataaagtagcatttctgcccttaagtcaaatagatttttggaaaaattataaaatccttagaattagggaaggtgctaaaaggtgaaaacctgggcctggttttaaagcgatagcgtggagaactgattgaatttggggaaagaggatgcttggaagccagataatccttatctaaatatgagaactccttttatgactcatgtgatttcagttgaggtttttcaatattgaagtttatgattcatggcctcgagtgtttcaaatgtaccttaatttggaaattttctctcttccaagaaattttcttcctctgcataactctgtacttcagcctccagcgtgggagtgccactgcattctgttcagaggccagggaatccacatggcctttgtaccatgcccagtagatgaccaaggggaaacctgttcccatgtgggcaggcagagaccctattctgtcttcctactccatgttctgttttgttttgttttggccaaagcccaccctgtaacacaattgtattagtcagggttctctagagggacagaactaataggatagatgtatatataaaagggagtttattaaggagtactgactcacgatcacaagctgaggtcccataataggccgtctgcaagctgaggggaaaggaaggcagtctgagtcccaaagctgaagaacttggagtccaatgttcgagggcaggaagcatccagtacgggagaaggatgtaggccagaagactaaaccagtctagtctttccaagttcttctgcctgcttttattctggttgtgctggcagctgattagattgtgcccatccagattgagggtgggtctgcctttcccagtccactgacccaaatgttaatctcctttggcaacaccgtcatggacacacccaggagcgatactttgcatctttcaatccaatcaagttgacactcaatattaaccatcacaacaacttaaatgttctcaagtattaaaaaaaaaaaaaaaaaaagcctctggcagctgtggagtgaatagttctctttgcttgggcccaggaggaatcccaggccacagactgtcactgggctgaactcaggatttccaggcccgcagctcctagtgttatcagtaacctagttctaacttccatacccagtcaacagtgtagggaggagaagatcggagagatcagtgctggaaaagaaagcagattcgttgtgatggttaataacaggatgttcttggtggaaagatggtaaagggagaaggtgacagaaatgaaagcgcccttaggactggaaaaagcttaggataaaggctttgagtgggtggcatagttagaagggcagaattagagaacaagctaagatgtataactggttggttttatgtttttcctttgttctacctcttgtcttcttttcatgatttattctcacccattctcaccaagaagcttggcaagggtctgacctttccgggttaaaagatgaaatgccctcaaacctcttctttccttattgacactgctattttggggtaactagctaatctgaaaaactaattcacattagggatttaatatctaagaagaatctgacaaatgacctacaaattcagggcctaatttctagatgtatagttccttcatcaaaaggtattagcctctaataaagcttttctgtggcatgctttttttttttaaatccctacttttcaacccgctgcttttgaattaattccttcctcccttcctccctccctctctccctccctccctctgtctctctctctttctctttctctttctttcttcttttcttttctttctttctttttttcttttctttctttctttctttctttctttttttttttctggagacagagtcttactctgtcacccaggctggagtgcagtggtgcaatctcagctcactgcaacctctgcctcccaggttcaagcgattctcctgcctcaacctcctgggtagctgggattacaggtgcccactaccacacccagctcatttttgtatttttagtagagacagggtttcaatatgttggccaggctggtctcaaactcttgacctgaagtgatccactggccttggcctcccaaagtgctggcattacagacgtgagccacctcccctggccaaaggtttttctttcaattgttgggccctctttctcctgtctctggactgctgcgctggcaacatggttgttcccagcattggaattaggcttgggtgtgtgttctacttcaggaccccattgattagcataacagtaggcaaattttaacctcttagaatcagttttctcatctttaaaaggtcaataggaaccattttagcactgcacaggctttgagaccagacctttggttcagtttttggctttgctgtttcccagctgtatgcccttgagatatattttgcttctctgtttctcagttttttcatttgcaaaacagtggtgataatactacttaacctcctaagagttgtgaggatgaaatgaggtaataaatgtaacgtgcttagagcagcacctgactgctgtggcttggatctggagaccttgccaagtctcatgttgaaatttgatccccaattttggagcaggggcctgggggaagatgtttggattatggaggtagagatctccctcatgatgaatggcttggtaccattctcaaggaagtgagttctcacgcttagttcccacaagaactggttgttgaaaagagcctgggcttggcacagtggctcacacctgtaatcccaatactttgggtgctgaggtgggcagattgcttgaggtcagtagaccagcctggccaacatggtgaaaccccatttctactaaaaatacaaaaagttagctgggcgtggtggcgggtgcctgtaatcccagctacttgggaggctgaggcaggagaatcgcttgaacccaggaggggcaggttgccaagattgcgccattacactccagcctggacaacaagtgtgaaaccccatctcaaaaaaaaaaaaaaaaaattagcgtggtggcatgtagttgtagtcccagctacttgggaggctgaggcaggagaaccacttaaacccaggaggtggaggttgcagtgagccgagatcgtgccactgcactccagcctgggcgaaagagcaagactctgtcccaaaaaaataaaaaagaaaagagccaggtgcctctctcttctcttgctttctctgtcttgccatgtaatgtctgcacgccagctcccttcatcttcggacgtgagtggaagcagcctgaggccttttttcagatgctggtgctggcaccatgcttcttgtacagcctgcaggaccatgagccaaatatacctcttctctttataaattagccagcctcaggtattcctttatagaggtgtgtggtatctgtgtcacattttacctgtgtgtatagttattcctgacaggagaattcaggggagcctttgttgtcttttttttttttttcttgcctggagatagataatcacaggagaggagaaagaagccaccaagaactgaactgttagaaaatcccgaccatgagttaattcatttatttatttgtgtatgactccttcctcctttctgtctttcaacagacacttaaaggtctgaattgatatcccaaagaagggaacatcctttccagggaacatcctttccagggaacttgccaacaccataaaaatgatccctcagaacaggattttcaagagccttccttttgtgcagtggattccttctttcctcctccttctgaggagctggaaacagtagatgaggaagggacctccttctttttctgagtatcttatgtttggtttcctcttgagagctacaatttagcttcactgatttcttgtatctgaacccaagatgaaaccacctttgcttactcttattgtgaagatggactggatcttctgtttttaataactttttttcagtctctcaaatcctgctactttataattcataattaaagctccaggtgtgtttccttagttaatttttgtgaatgtttttggcacttgacaaatgtttcttatatcagtggaaaagcgttagggtcagaattctgttctcctaatttactatatttcttaattgcattcagaaatgtattgatcacaactgcaattttgttgaacttggtctcattttataaagcgggatccatgtaatgagatgtttgcaattctgaggcctggttcaacacctccgattccaaataaaatatctaacagtctttagcttggattgaggctgtaatttgcatttggctactatataaaagaatctggacagaaaaagatcttgtattgtcttttttgttctttgtgtttttcccttctttagtcagggaaggcctgtgtttccctgttttagggtttttgctgggccaaaagcaggtgctggttctcttatggaaggctgaagcagtactgggaaatttaaatgtccagaggagctgagctgattttataacatttgaattctcagggtatatgactgtggtggagaattctttgccaacaagtaaggatctaacaaaataagtttaaaaccaaagaccgaagaaaattgtctatgttcttatagcctatttgcttaaatcacatggagggattgattatgctggggaaagtagagagaggcaagtatctctgaggatgaggtggttaatgacagtatcaagaaaagggctttccaaaggataagaagaggtacagggccaggcatggtggctcatgcctgtaatcccaggattttggaaagccaaggtgggcagatcctttgaggccaggagttcgagaccagcctggccaacacagtgaaaccctgtctctactaaaaatacaaaaattagctgggtgtggtggcgcatgcctataattccaactactcaggaggctgaggcaggaaaattgcttgaacctgggaggtggagtttgcagtgagttgagatttcactactgcactttagtctgggtaatggagcaagactctgtctcaaaaaaagaagaagcggtgcagattggcagggccttgggatgtggcacagggtggtggaaagatctggtgggagggaagaccagctgcttggtcatggtagacatttctacaatagagtcttgggcaaccacagggcttggggttctgctggaaaccagtaagtctgaagacccaggaggcctgtgcttatgttttgccgtttcttttgtcacctgggacctttgtgaaattcattgagggagcctccattatgacttgagatgaaatctgctgccatattgataggaggagggcttggaataagatttagtttgaattacagacaataatacaaagggacacttcctgcatgttttagtcagtggagtaaaattcattcttgccatgattctagtagtgaaaaattaaaaatgatttttatgttgaacagtgaagaagagcttaaataaattatgacacatgcatactatcatatgtagacctatattgatttgcaaaaatatcctataatgttatatgaaaaattcaggttatcgtatagcctatgtagtttgatctcactttaatgaaacataagaatatgggcatacatacatgttttcatagaaatatgggtagaaaaagtctggaagtatatacatcaaaattattagttgtctattattgaaattatgagtgatatcttgttcttatttgttatatttattattgatgagcagaattactttattaattctgaaaagaataaaatatatcctaaaaacctgaggcctgaaatgtattgttttttctgttcagatggtattgcagaaatatgaatagaagcaaggcagagcaactcctccgcagtgaagtaagtgtttgtacttgtgggtttggcttaagggcaaattaattttaatgagtccataataagtagttccacatatctctctttctaaatgtgttcagcagtgagcaagtctatgcaaaactattcccagaggctgagggagctgagaggctgaagaaagaggctgacaaatccagtttctagaaataaatatttaatagggacttacaaacagaagtaatcatgggtggcctcaggacagttatccccacacctgccctctggacattattctttatatagcaaacttttagggtgaaacatgtgcagctggacatgtcttcagcctttcttaccaacacacatgaccactggtgaggttagataaacatctttatgaaagcattgtttaaacaccttgctgcagaacaccttgataagtggggatcgagcactggtcatcattgcggtttcacttcaaggttacatcactcttgccatgtaacaggctgttttcctacacgctacaccttgaaactggcccttacaatttcatatacccaaagccttggtaaaataaccagtgtggttattgtagcagtggtgtccccagtatgtcctgttacaaaagaaaacatattcttattgaacttatgcaagtaactgtattgccacaaaataagaatactcacaaatagcttctaaattttgaagaaatcaggtagagagaatagttagtgcttcagtttggctctcaaaagtatactttactcaattgctgtaagttttaaatagttcaaaacacacaaaaacacattttcttgactcttcttcagagtagcagtcttctgcacaggatgttgtccattcaccttggaactgccatccacaaacctagcaactcttggtaggtcagttgagagctgtttattgggcactgtagaatccagcagctactcacacagttccagagtcagtctttgggttagagaagccccctgctcatgagtgtctcctccttgcacccaccagatagtgtgatcctgtatcaactatttccattttatgatggaactcttttagatactgctgtctctattagagtgttcctctgacatcacctgaaacagcatggacatttcaggtgtcaagatcattttatattcttcagtcatagatgtagctatagttagcatccatagcaaggcagtaaatgcccgtctagtagaagttctgtagtccagagtcccagtagttgtcactgggaggtgctaactggcttttgccataagacctactaaacactcaacaaaagactatcaagtagaaaatttgtccctaccagcattccaacttcctctacgctatgagcttgggcagttatactggctcccatttatcatgtccaattaatattgcttgaaaggcagatttacatgccctctgttttacaatagaagaaacattccctagtcagatacaatgttcattcccataaaacatatagataaaggagacacagctactttacataaagcctgttcaaacattccaactttcatagtcttataaacctttatgattttatgttttagtcctaggaacttcttttctctacctccagaacattttaccctctgttgtgcaaaaggctttaggttcccagtagggggttgagccaagggaccctggcccttttgtcagtctttatcttgattaacctgcttcagttttgccctgaaacaattgttggtcagccttatcattataatccctgtcttttagctttttaagtttctgcagactggggatatagcaaactaattttgggctctttaatgttggggactcagcaggggcttcttttagtccacacaaccttcaatagtgttgtattaagacccttgttttaaccccataaatttccattttattcatttgatttttttaataaccatccaaagatttcctccctgctgggacaagttccatgactctttcctttctttttcttcattctctttctacccatttagttttatctatatcattttttcccttcattttgaaacaacctttaaataacctctaaactagaaaaaattactttttcttaagcaaaaaccatatcctatcttttatgtagccttcttcaccaaaaactcatcttcctttctttatacactgtgtatatagaattgtttctcttacatgtggtagttttaattacatacactaactactattgtaattcttagtagtactaatttccagtaaaaaatctaggaagtgattaattttaattaagctcacatgcaagtcaagcaagtgtcaagaaggtcacagaagcagcagttttatgaccttaatcagagacaacctaaacctgtctgaccagtaggtctaggcaaaatgtctgaattaaattctgaagatgtttctattttattttaccaacaatttaaaaactagtttcatttaccaaaagttttcttagatcacatagaaatgtcacacacacataacacatatagacatataggcatacaggcacacaggagcaaaccttacagctttcataaggagttgtcactgccagctttcagatagttttcattttcccttttgttagcacagcataccctgtagcaatttatttttcatcctgaaagtaaaagttgctttatcaagtcccatgaaaacctgagcatagatggtttacctcattcttaattcttagagaagcccctggggctttccactgaccaccacaaggttgtccctcctggtaaatttccttcattaggccaaacctctgtcacagccagaatgatccaggccataaggctacaattcccttgtgtatgccttgcattatgaaggcgttgctgcagggctgggtgggtagtaatgtcactcatttttttctgcttcattcctggctagggaaataccatcacccactgtgtcccgcagttagaccatccaagcagccaggggttccctaggtagttgttgttgttgttgtttttaactcatttgtgctggaggttgcaaattttttgtgtgtgaaaaatcagaccttggtgatgactttgagcagtagaatataaataactcccacagcttagtgttccaataatggaacactaggcataaatgggttaaaggctaatcaagtgacgcagtgggagtagagaaggaaaaaagaaatctgtaactggttgtcatcaattagtagtaaacactactgtgctaggaccacccagtagttggttaaaggtctttgcaatctctgagttctgcagcagtgtattccctggccgggagagtctcctgtagtggctcatcctcattttcctgcaattgttgcactttcactttccttagcatgaggggcaagcttactctaatgctttcttcctgattgatcatttgctcccttgacttttagtacttaagtatttcttttttttttttggcttgaagttagttattttaaaataatttacattgatattacataatgtcttttataaataaagcgttaatagatgtttaattccatttagaaataaatgtgctgaaattgctatacctttaaaaagaaataaaatgaaagggtaaaatgtatagagggaactactctgtgctgagtaaggggacctgggtctacctgtgacttttctagtctactttttgcatctgtaagaaaaggagttagactagaagatgatctctacaattctctgcatttctgatttagtattctatttagttattgtttccagccttttaaactcatgctttctcattttacctcctgcttattatcatgctcaagattttgttgagtgcttgtttttgtagttgatgttaaaaaaacaatagtaggtgactttgcttgacaactacacataaccatgcccacaggattcttccatgactctctggagaccctacagtgagaggcagatgtaggggagtgagtagctaaatggcagcctggggaccaaatcctggctctgctacttactagctgcatgacctggtgcaaattacccagccagtctttctgttctcatttccttacctgtgaaataatgtgggaataacaatagtacctatgtaataggactgtttcgatgattaaataaattaatatgctagaacattagaacagaataaattttcgataaataagtgggttgctgttagactgtatttatttatttatttatttatttatttatttatttatttatgatagtatctctctctgtctcccaggctggagtgcagtggtatgatctcagcttactgcaacctccacctccaggattcaagtgattctcttgcctcagcctcctgagtagctgagattacaggcgcgcaccaccacgcctggctaatttttagtaaagatggggtatttttagtagaggtggggttctgccatgttggccaggctagtcttaaactcacgacctcaactgatctgcctgcctcggcctcccaaggtgctgggattacaggtatgagccgctgtgtccggcctctgttatactttttactgaccagttacaattattatccctaattgttaccagatatttttgtggagccttatttatttaattccattgtttttcctatcaagaagagtacaatttattttatttttcaactaataaaggacacacttttcattttaaagcaatttaaatactagagattgatggtagtgttactggacagagaggtatttgaggttcgtagggtctatttcttgcttttcagtttggaagctgagaaagatttgacctttagtgctttagcattgtttccaactattgattttctctgtttaagttacttgtgcctccatctctccttttgtaaaggctgatatttggctgggtgtgttggctcacgcctgtaatcccagcactttgggagatcaaggcgggtggatcactggaggtcagaagttcgaaaccaagctggccaatgtagtgaaaccccggctctactgaaaatacaaatattagctggacatggtgttgcacacctgtaattccagctactcgggaggctgaggcaggagaactgcttgaacccaggaagtggagattgcagtgagctgagatcgcaccactgcactccagcctgtgcaataatgtgagactctgtctcagaaaaaaaagaccgatatgactgatatttaacttcaacttctagagaattaagaatttttaaattcattcttataaaaagcactgagacatttttaggaaaattcagcatggattgaaaatcatactgagtcaggaatcaaagcttataacaaatacaaaaaatgtatgaaatgaaacccaatcattaagaaatacattttttcatgacagttttcctacatgtccaggccttacaggaattgcaaaatcttgtctctcagttctggaagggcactgagagattatctgattgaaatgtctcaccattcatgaggatttgtgattgtggggaattgagtgtgatttccttaactactctcctagcgcagtaatttgaagtacaaagtcatgtgggtgggagaaaccaaggggccctactggtaagttgtgcttcttcaaagcatttttttctgggaaagaataataatcataaaattataatattaggttctttagtcttctccatggcaatgctattagtaattagagtaaaaaaaattttttctgaacttggattttaggataaagaaggtggttttatggtaagggattccagtcaaccaggcttgtacacagtctccctttataccaagtttggagggtgagtaatcctgccatttttttttataatttagagtttttgtatgaacttcctatgtagtttatatggattcctaattttcataaaaatatgcagcatttcaccattaaaaagaaaacctgaacttgatttctaaagtgtatatactgttttttgtatttatattttcagtaattttccttatagtttttcatatatatttgttgagtatggctataataactttagtaacattcaacaaacatttatagtgaactgtgctggtcactaaggataaaaatatgagcaaaggaggcagagaccctgcccaccagtaggttagtagatgctgcagcccagtaacagagagtgatggtagtaagtgccatgtgggagggtaatgtgtgtgtgtggcgggtttggggatgggggatggtacatacacagcccaggcacatcttgagttagtcatgaacgctctcccaagtgatatccaggctgagacctgataggcgagcaggaaaaacttggagggaggagacggagtgtttctgacccaggaaattgcctggacctagacgggagagagtatatggtgagttcaaggcactgaaaagtatgttgtagctgcaggtagaatgggagcacagagtgaagggaggagagagaagcctcagagttgaagcagaggcaagttcatgtcaatgtcagtgactctgagctttaccctaagagcaacaggagtcatcttgaaagtatttttagcaagagaggactagagaagatctgtgctctagaaaggtccctcaagttgaatatttaaaagtctaatttattcactattggtgatttaagtgttctagacatttgtaagtttatgcaacagcaggaacaaaaagcagtagctgctaatagctattttaagacttccaactgttgttaaatggaattcataaatgttctctttcaaaatctcatgcaaagggccaagtatgttttcagtgagtaatttaaaaactttgacatgctaatatgaaagacaaagctaagaagaacaaggggaaagtaaaatttgtgccaggaatagatgggatcatatggagagacactgtggttgcccttgtagaaaacatcttaagaatgaagttctattatttcaacttggttctgacacattttgatttttgttctagagaaggttcatcgggttttaggcattatcatataaaggaaacaacaacatctccaaagaagtattacctagctgaaaaacatgcttttggctccattcctgagattattgaatatcataagcacaatgcagcaggtaagtgagctgtgaaaacctacttcaaatataaggtagtgattaaaatgatcagatactgtgattaattccttgagcagttttattttatagttagttcattgtagaatgtggttgatttaaaattactgcatattaaaggaatgatatatacaaagaaaatttagaaataatatcaagttttataaaaagctctgtcttgaccttaggacatgagttattccagtggtatatagtaaatgttcacattacatttatacactgttggtggcagtgtaaattagttccgccattgtggaagacagtgtgatgattcctcaaagacctaaagacagaaacaccattcaagccagcaatcccattacttgggtatatacccaaaggaatataaatcattctattataaagacacgtgcatgtgggtgttcattgcagcactattcataatagcaaagacatggaattaacctaaatgtccatcagtgatagacaggataaagaaaatctggtacagatacaccatggaatctatgaagccgtaaaagaagaatgagatcatgtcctttgcagggacatggatggagctggaggccattatccttagctaactaacacaggaacagaaaaccaaatactacatggtctctcttataagtggaagctaaataataggaatacatggacacatagaggggaacaacacacactggcatcttttggagggtagaggttgggaggacagagaggatcaggaaaaacaactaatgggtactaggcttaatacctgggtgatgaaataatctgtacaacagacccccatgacacaagtttacccatataacaatttgcacttgtaaccctgaacttaaaagtttaaaaagttcacatttatgtggtatatatgtccttgacactaaagtccaagatatgtctatttcagaatagtcacagaagatgccagataagccaggattcagtcctatgctataggtttccagagactagagtaatcatgtcccacaagttaaccgtcttgaatctctggtacacttaccaccagagtgggaacaaactgaataccaaaaaataacagaaaccacattcatgaaaattagagttccacaggattatatagaaagatttccagcctttgactttaaaaatgtaactgggcagggatagcccagtgcttcacacaacttatgaaaaattttgaaattttattgaaggcaccctttgcaaagcctattattttgtgactgttcacttttttttcagataataataatggttatttagataaaatttacatactataaagctcacccatttaaagtatacaattcagtggtttttagtatatttacagagttgtgccaactatcagcataatctaatttttttaaagaacattgtcatcatcccaagaagaaatcttgtgtcaaataattgtcatcccatcccccttcaccagcccagccccaggcaactattaacctactttctgtctctcttatagatttgcctattctggacatttcatataaatggaattatacaatatgtggtcttccgtgactaagcttctctgacttaactgtttttgacattgtcatgttgtagtatgtagatgtattccattcccttttttaaaaacatacatcacaagtttattgaaataatcagataatataaacaaaatgaacagggcttgacacatagtaattgcacaataacttctacctattattgagttacaacccagagcctaacacaatatttgtggaatgcttaggttctcaggccagcatacaagtctacatttaactcttaaataaaataacagtttcaaattgagtataataatgctaaatggtgagacaggatcaacccctctatctccaaatatagggggattatcttaccatccacctgttgtattagaaagtcatgcttcatctacttatggaagccaagacatagcctagatatgtacaaactatagatataacgatgttaaggaaaaaaattgctgacaatatcactagggattctagacaatgtaaattgccattaatgtttattgctgtgatggacttcctgaacacattgttagaaattggtttgtggccaggtatacaaataattcattgtatggattttattattcatcagttgatggacatttgggttgtttccacatttgttctcttatgaataatgcttctgtaaacagttgtgtactagtttttgcatggaaatatgttttcatttcttttgggtatttacctagttatgggtatgctgcgtcatatggtaactctgtgtttaacatttcaggaactgatttcatatcaatttatatctcattctgttgttttcttttttggtgtttttgctccctaattttttcttccgtgttcctgtataagttttatttttcaccgtcatctcaattcattcaacaaacatatatcaagtgcctactgcatgccagaaacagagccaggctttggggagacttcaatatttcagtggtggactaggtgtagtcactgatcctgattttcccagaccctaccacttgtggggagacagagaagtacataacgattttaaattgctttgagatatcttgtagtagaggaaatacagagtgctatgggtgtttatggaagagacatctcctgtttcttatttagtgctgtatgcgacttgggttaaaagatccacactgatttccagtagttggtattcccagttgttgctatcctagagcccgatttgtatgctaagattgctaatactgagtcatgtcaggtgaataacttccatttttagcagactaatctaattccctttcatagttcagctctcatattggaaaagaacacgaaataactgttagaaaccttttaacatcctttaaaatatttgaaaaaagagaaagctggcatggtgcctgttaaacactgtagtatttaaaagaaaatgtttgttgaatgaataaaagcatatagcagagtgctgtatgtacacacagaggatgagcagtaaatgaataaatgatgaattttctaagtgagtttcctgtagcatgtgaccaagcagaatgattatgaatgagtttgactgcaacgctttctttgattattaggacttgtcaccaggcttcggtacccagttagtgtgaaagggaagaatgcacccaccactgcaggattcagctatggtaactcttattttgtggttgcatgagctaattttccttgaaaagaatccattgtcataagataaatttggatgtgtactatttcacatactggaactgttttttataagtttatagtataggtttttagataattatacttaagaccatagcagcctaggtattcaattttcatcattattcataattccatagaaaactttctgtcagtgaaaaataagcattatcatgttaacatctaaaataaatcaaagcccttcctggttctcactagctttattggctacaagaacgtgagtaaggatggaggtaagaaagcaagcttccaacttaattgtctttgttgcttctggcaaaagcctttaaaacagcaaattagattatttccaacttgatggaattgaaaaagaacaacaacaaaaaaaaaacctgagaaggaagagtggtaaagaaggaagtatttgtttgacaaaagtacctttaactttcaggctatattattattagcttgttatgcagaattgtcttgccttcttcatttcacgttggttagaagggattcatcctccccacctttggcagttcagatgcaggtttcaagtctgttctgtgttttaccaggaattattacagtgttatcctgtaattttgaggttgatcttggttgtaggttctttttccccctctctgattcatgctacattttcctttttaaatatgaacactttccctttctgtcctgcagagaaatgggagattaacccttcagaactgacctttatgagggaattgggaagtggactgtttggagtggtgaggcttggcaaatggcgagcccagtacaaagtcgcaatcaaagctattcgggaaggtgcaatgtgcgaggaggactttatagaagaagctaaagtgatgatgtaagttgctatcatctttctggctcatctttttgtattaagaagtggccccttaccaaaaacttggtagtttcttttcctatagtaactatatatatgtcttccttcccaggaaactgacacacccgaagttagtgcagctttatggtgtgtgcacccagcagaaaccaatatacattgttactgagttcatggaaaggggctgccttctgaatttcctccgacagagacaaggtcatttcagtagagacgtactgctgagcatgtgtcaggatgtgtgtgaagggatggagtatctggagagaaacagcttcatccacagagatctggtaaccctagccacccatattcccactcattggctgaattcctttgtaacactggctcagcaaatgtgcaatgatgtattaatagccaatttttgttcttaacaatctttcaccattatttttaaagttggtaaatttaacttgccctgtaattttaaacgaaagatctttattcaatctaatgatttacttagttaatatctccaagcaagtttccatgttttaatttttcgatctccataagaatcccatgagatagctactcacagtggattctcttaccatcattcttgtacagatgagaaaattagcttcagggaagtcaaaaggctcgcctactgtgataaatagggaaattggggttggccttgactttctaactagagcccaagttcttttccacctcacacactataaaaagaaactataagagaaatcctttggatttttaaaaaatctctcaaatcactgggaaaacatggaggttcatgttaacttctcaaaatgctagaaaaagaaatccgttaccagttctaaattatgatggagacaatttttcccttctcacctgttctcactctctcctccattcttcttttccttctgtttttcttctctacctgttctttacagatgctttcagctatcagtagcactctgtcccctgaaaataatcagctgaaaatgtctgttttcagcatatcggtagcactgtctgtcccctgaaaataattcttttaccaagaagagtgtaattttcatttgggactttctcccatattttagttttagctttctagtgataaagcatggacacatttcttttagaaagcagaaaaactttaaaaaaatttttttttcctttgagacaggtctcactttgtcttccaggctggagtgcagtggcgcaatcttggctcactgcagcctcaacctcccgggttcaagcgatcctcctgcctcagcccccaagtagctgagactataggcacgtgccaccatgcctggctaatttttgtagagatggggtttcaccgtgttgctcagactggtctcgaactcttgagcttaagcaatctgcctgcctcagcctcccaagtgctaggattacaggtgtgagccactgcacctggccttagcaaaacattttttaaagttaacagtcaccttagacagacattgttctgataagtattttacaaataaacttgtttaatcataattctgggaagtagattttcttattattccctttttacagatgaggaaactgaggtgcaaataggataaaataacttccaatgggcaagtaaattgtagagccaggatttgaacccaggaagtttggctctaaagtccctacttaactactatgctatgctctctagaattaaaacatattagagaattgaagatttggagatggaacactttatttcctaggtgtgttttgggatacttaccttatcttatattcagtttctgtgtctgtaaattgtgggttataatgttgtttggcttccaggactgttttaaaggtcacattatttgactggggcaatgggctttgtaaaatagacatgctgtagataacatcagttattgttatcattgtgtcagggatgatgaagaacatctcgtcagttaaaacttgtgaactaagaactaagaacaaaatagatgtccttataaaactgataaaaactgagtatctacgtgggtgtggcagattacacctgtccacacagatgatgttttggcaaaaacgattcttacatttctgtgcctgtgatattggtattactatggtaggtttgtgtcaccccttatgggaaactttggatgctcttgtctccttggtaaagaatcctgttgaccatccagtgcaggcattgtggagttgtgaagtgttttcataggaagatgcaggcagtccagggaatggatattaactctcactttataagactcttaaaatgcactcagcaagaaggaacctcatatgagtggaattgccacatagagaaaatagaattatgaacagtcaggaagaaaaacatatcttggtctatgggttatggtattaaaaatattatcggccaggtgtggtggctcacgcctgtaatgccagcacttttggaggccgaggcgggcggatcacgaagtcaagagatcgagaccatcctggcaaacatggtgaaaccctgtctctactaaaaatacaaaaaaaattagccaggcgtggtggcagacgcctgtagtcccagctactcgggaggctgaggcagaagaatcacttgaacccaggaggtggaggttgcagtgagccaaggtcgcaccactggactccagcctggtgacagagcgagactcagtttcaaaaataaaaaattaaaaaattaaaaaaaaattcttgtcttccttttgagaaataccacgtctttctatcaaactattttcttaaaccttgtaaccttgaagaacatgcaagaaaatataaattaaataatccacaattgtatttgaccaattttgtacatcatgttataatatactgggaacataaatgaaaaagcaaactgtatttacacatagctgttctttttgagacggagtcttgctctgtcacccaggctggagtgcagtggcgcgatctctgctcactgcaacctccacctcatgggttcaagcaattctcctgcctccagtcctaggtagctggtactacagttgtgtgccaccacacttggctaattttttttgtatttttagtagagaaggggttttgtcatgttggccaggctggtcccgaactcctgacctcaagttatccacccgccttagcctcccaaaatgttgggattgcaggcgtgagccactgcacccagcctgttctttgactgggatgagatgaccaatcactgagcagaaatattggataagagattggtcgcccatcattttgatggttgtgtgttattaagctcacctagtgagaaccggattaaggacttcaagagatgttctcattgtcagtaagaaaattggatagtttaataagaacaggtctgggaaggagaaaagtgagttgacccttctattagcccttgtttaagaatgacagttggccggtgaggttgctcgtgactataatcctaacaatgggggaggccgaggcagatggatgaggtcaggagttcaagaccagcctggccaacaaatacaataattagctggctgtggtggtgggtgcctgtaatcccagctactctggaggctggggcagaagaatcacttgaaactggaaggtggaggttgcagtgagccaagattgtgccactgcacttccagcctgggcgacagaggcagactctgtctcaaaaaaaaaaaaaagaaagaaaagaaaaaaaaaagacaattggtaaagattatgtaataatgccttattgcaaatacaactttctgacctgcctattcatttttttcaaatacacaatggaaatacttccataggggtaaaaacaacttattaaagggtgtttccactctctgcaaatgttgactaggttacactaaatttaatataaatagaacttacattttcctacttaaatgatagaatttttaaactaatataccatcataatgttgttttccaggctgccagaaattgtctagtaagtgaggcgggagttgtaaaagtatctgattttggaatggccaggtatgtccaagtatacgtggttttaggtgatgtttgcatttttttggtggaattaataagtgtgggaataatttgcactgatgaagcagaaaggaaatcttgttaactggttctcagattaaattaagtatatattgtgatggtagtaattctctccactaggtggtagtatagcctgttaaatacactgtatttcctggtgtggattagatttctagaatcttttgttttcacaaaaacatatttggtggtgaggttcttagtatgtccatgtctgcagtgtttttcttctcttaatttttataatttaatagtattataaaataccttttaaaggtatttagtttattttttctctcttctccctccgtctatccattcattcatccatacatccacccataaaaaatcaggtgcctgctctgtgccaggcataatgataagctgaaccatatagagaataagacctacaagtccttgcccgcatgcagcttacattgaggaagagggtgaatcagaagacctgataaagttacatgatcgagcatggtcgatactggtaaactgtggctgtcagtctgacccaaacctcatttgggtttcacatttttaaatggatgaaaaaaatgaaaagaatattatgacatgtaaaaaaaaatctgaaattccaatgttgctgtccataaaaatagcgtgattgagacacagcctcgctcattcatttaggtgttacctgtgactgctttcctgctacagatgcagagtcaagtagttgtcacggggactgtatggcctgccagatctgaaatatgtgttatctggccctttacataaaagttgactgatccctgtaatagagataatttggggtggtgctgaatgatgatgcagggcaagagtgagggtggctacttgatctgatgttcaggatgacctctttgtgataggcagatttgactggagacgaaaaggtaggaagtagccagtgtaggtgaaaataaaaggataaactatttcaggtaggaagaaaaagtgaaaaagcttgaagtctgggacacgtctggcctgctcaaggaacggaaaaagcgccagggtagctggccaacgggcagcgccaggaatgctcataaatgcaggcaaagaccaggccatgtagggccaagtttaactcctaaggaaactcaggcccagggagattagaaaactgttactgtcagaaatgggaccagaacttccaactcttaggatattaattacccaatgctctttatttgcttttatatacagatactatatatttgacaggctgtctgccgctttcatctgttcaatcttcatatgttaggctttcagaaaatctgcacttttgtatcaaccactcaaaaacctctttataccctaaattcagactccactggctgacagtttgatccagcccacagtggcattgtctgccagccagcagctggctttgtgccgagtcaccatctttgtctacatagcaaaggatgtttgtgcaattcttcgaaaattttctcatggaaccttttagaaattaatggtatattcacacacaatacagagatacattccttttgtaaatatgtgctgcccaccttacagaaagggctgaagtcttttcatctaccaaccctaatcaaggattctcccctaaagttagctactgttaccagtttttgtatgttcttccagaaggacattgtatgttcacatagaaaaattatatagtattgttttgagtgtatgtatgtatgtggggatgttatgtataaatacatactccaccatttacatgtggcattttgtgttgtgtttttgtttttgtttttttgcatttgctattttcatatgctgtagttttaaattgtgctctgtggaattggaggcctgaaagcctgtgtgtttctagatgctttataccacttcctctggagcagctctgctttagattttttacatatggggcctttgggtaaaattttatttaaagaacaaaattgcttacaaagaaaagcttgcaaactattttatgataccttgtctctactgccttataaaaagaaagaaaaacagaaaaatgaaagtgcagatggtaacgtggtgatggatccatctcatgcacttaaattaagctgagaggaagttggaaatcaccaggtgtggccactgaggtgaacatttagcttcaaccggatgcttgttggacttcagtcaactgtgtttttgattgcaaggggaaaaaaatgaaagagcaagtagaaaaaacagattgttcttcagaggtgtaaacccatggtgtgtcttactctaggtatgttctggatgatcagtacacaagttcttctggtgctaagtttcctgtgaagtggtgtccacctgaagtgtttaattacagccgcttcagcagcaaatcagatgtctggtcatttggtaagatccatgtttcctcatgtccgtccgccctgaggagaaagtggatacatccatttggtaatccttatccttttccaggtgttttaatgtgggaagtattcacggaaggcagaatgccttttgaaaaatacaccaattatgaagtggtaaccatggttactcgaggccaccgactctaccagccgaagttggcgtccaactatgtgtatgaggtgatgctgagatgttggcaggaggtatagattttttgtgtgctttctttttgaatctcttagggattgggcttggtagatggataacatgcagtctttatagcctagtgaggtggtgcatctttatagtgatttcaagctctaggtaggaagccaaccctctcaactcaagttctgaataacgggaagaagaatgtaaagatgtggaaaatgctaataactacctcgatacattcaggctgcttcctcacttccaagtgggactccttccatggttgcctgagatagggacttggggaataagcctggataagtagctcttttttcattggttcacttgtagagttgaagtattatttttttaccagagttggtttctttctctaaacctcaactttccgaggtctttgaaagtattgaaatgttacctcctaaaagagattagataccaaatgacttctgaaagacagtaacattagctcacatgtattatgtaccaggcactatacttagtgttttggatttagttctcaaaacaacactttgaggtggagatactttgactgtagccactctgtagatgagaagattaagggtcatgaggttgctgcttgcctggggtcacttagctacagaacagtataggcctgtctgattccaaagcccagagtctcaaccacttgctgtactgcctcccaagagcattgattgggatgggcagagacattctgggcaggaagtggtgctaaagggagagagaacagcttgagcaaaggtaaggaggtggttataaacacagtgtgcacaacagtggagacagtggccctatttaacagacagcccatgtgagggattttgtggggaacaagattgggtaacaagagggtcgggaagtggcagattatagaggctcctacaaatttgcaggacttgatttcacaggcagtaaaaagatctatcagggtcttgaagagagacatgaaagcagtgtcttagaaacgttagcctagcagcagtacatgcagggtaaattagggtagagacaagacccctttggagatgcctgtatgtcctagtcccaaagcagtgaagtctctctgtaatatgctgtgtttaggagttggagcagtgagaggttttttggaatggattctggaacccacagcttctctttgacttttaattgtagaaaccagagggaaggccttctttcgaagatctgctgcgcacaatagatgaactagttgaatgtgaagaaacttttggaagataagtgatgtgtgaccagtggctcccagattcccaagcacaaggaaggatgggcattttgtggcttttaatttattgagcacttggacatgtagatcattttacttatacagtggaaacacataatttgcttctagaccagcctctgtctagacttgcttctagacagaatctcccagagtgtggaaatgttgccttagaaatggtgattaaaatcactcatttctattcattcctcaggcacttgagtgacagttgtttaccaggcactgtgtgtagccccagggtttggccattcaggggtgcacacatgggaccatgttagctgatgccagttgaaggccagggtatttgggaaggggaagggtattagagtcatgaccaagcaacccttctttttccctttgacttctacagaaatctgggcctgagacattgtctacaattgggttctagatacatcaggaacccatcttggataaataaatacctatcttttgttttgaaaacatctcagttttcaagactgctcttagtattacatgaacaatatttgtatgctgtatatattgtaaatatatataatatataaagttatatatttatgagaaacacgaattgtcttttaattgaaacttttaatcctgtagtataggagttcaccttcttaggactagagactgtgccttatagctgttaattcatttccccctgaacatcaaatatgcctgaagagaagaaagtctagattcttctatgagtaacgccccctcctcactcaggtaaatgtgtctggggatgcctgtccagcttaaccacgtgcatttggcctatgtaatcctgcccatggtggccgcagctaatcagaatcagatggaaaattaaaccgggtaatctgcttctaagccttaagaatattccctgggacacagacactataattggaagtgctgagctctggggcagaaggatcaggtgaccttcgcaacaaagtttgcccccacctcacataggacccggaagcagcctgagctgtggcggaggatccaggaagctacggagagaagcagccagcatggtgttccgtgcctcccggacgtttttcaggaggcctggttggacttgggttcctggatggtgggattgttgtacagcctctcaggagaccctgctgtcaagactgtgtgtgtggatttcccacccttagaagctctactaagacatcaacggaattagggccttcctttttgccttgtgagcgccaaggaaaagaaactatctcggtcacgtgagcgccagcgaaaagaaactgtatcagtcatccagagaccgtttattgcccaacacgttattcttgctgttggtggggtaactagccgaggaagacacagcgccttcccttcaggagttgcgtctcctctgcaggccacgatggtctgctctggagcattgggtgaacacacaggctggctgctctgggcagcgccttcactctgaccctggagaaccatttcatttcatcctggtcagtctagagtctgtgcaccaggcagtccatccactgaaggctgtgtttattcttttcctgtgcccctcataatggaagaaagtaaactgcttatcccgagccttatcacaatctgccacattccttcttgtctacctgtttaactgtacccccatcacaaaaacaggcacaactttttttttacattccagggtacatgtgcaggatgtgcagttttgttacataggtgaacgtgtgccatggtggtttgctgcacctatcaaaaactcatcacctaggtatgcattagctatttttcctgatattagcctgatatatatatttcctgatattagcctggcatgcattagctatttttcctgatgctctcccctcatctgccctccccaacaggccccagtatgtgttgttcccctccctgtgtccatgtgtttcatggttcagttcccacttataagtgagaacatgtggtgtttggttttctgttcctgcattactttgctaaggataacggcttccagttccatccatgtccctgcaaaggacatgatttcattctgtatagctgcataatattccacggtgtatatgtaccacattttctttatccagcctatcattgatgggcattttggttgctaaccatgcacaacttttaactgacttgtagctcattgaaggagtcggtcctggcacactctaccttactatcactgtcagccttttctccttccttcctgaccttccctcctcccatcccatacttcccttttcaccttgaggagctacgggaagtactaggtggtatgaaagagagtgaggagaagatagagtccctgtcctaatggtcagtgtatgctttttatgggaaaacaagatagatagcacctggcaacatttgtcaacatttccttcaaaaatctttaaatatttttcactaagacttagaaaaaaagttttatacgaaagcataacaaaggcaaaaggtgaagtaaaaataacagtcatcacccagaatgctaaggagaccttaatctaaaccaggaaattggaagggcgattagaatatgctgtgtcttcattaaagttgctctgttaattagttgacacatggttatgctttccagtgggatgaagtgaaactcccaagtgtgttttgtattgttggtgtttttatatttctcagccatcccccaatcacattttagggttattactagattgacttcccccaaataaagtgtctgctgagtgggaggatggaacattctaaactcaatattccagagcctagaatctaattgtttctgccactcacggtgtggccttgggcaagtcccttattctgtctgtgccttcatttccttcccagtccagagagggcagtttgatttgataattttaaaggtgccttttaccaaaattttgtgatttcttgaaaatgatgtttgcgagtcacccacacctttggggatgagagactaatagcagataccctcagagattgggatggagattactgagctttcttatatatgccattggttgtcatttatactcttctgaggttttcagaacaggaaaataggtggggttaactctgcccgtgagaaacatcttgagcgaactatgatttcagttgaaagatgtgtttttgtgagtagagcaccgcagaagaactgaagactgttgtgtgctccccgcagaaggggctaccatgatcctttcctcctgtgagtaagatgggctttgtcatttatttttggggcttgttctggggcctgttattcttgaacagcagaggaagttttttttttccaaggcatagagcttggggacattaaaagataatttcctcagatgttgtgacagagttttgtttcttatttaaagaaccacagtgatgatgtaattctaataaaggttcagcattgagaacataaatgaaagaaaaacagaaagagtgtccagaaatctgcatatgtgtgtgtagaaatgcaatcagtatgaagtacttgtttttagaatgagactgtaatgagctctgggctgaaggccaggagaccaagttctagttctggatttgctccagcagtggtggatc

SEQ ID NO: 12197 - DNA, 44952 bp, Human
  misc_feature (1)...(44952): n = A,T,C or G
cctcccatttggctgggattacaggcacccgccaccatgcccagctaattttttgtatttttagtagagacgggggtgggggtggggttcaccatgttggccaggctggtctcgaacttctgacctcagatgatccacctgcctctgcctcctaaagtgctgggattacaggtgtgagccaccatgcccagctcagaatttactctgtttagaaacatctgggtctgaggtaggaagctcaccccactcaagtgttgtggtgttttaagccaatgatagaatttttttattgttgttagaacactcttgatgttttacactgtgatgactaagacatcatcagcttttcaaagacacactaactgcacccataatactggggtgtcttctgggtatcagcgatcttcattgaatgccgggaggcgtttcctcgccatgcacatggtgttaattactccagcataatcttctgcttccatttcttctcttccctcttttaaaattgtgttttctatgttggcttctctgcagagaaccagtgtaagctacaacttaacttttgttggaacaaattttccaaaccgcccctttgccctagtggcagagacaattcacaaacacagccctttaaaaaggcttagggatcactaaggggatttctagaagagcgacccgtaatcctaagtatttacaagacgaggctaacctccagcgagcgtgacagcccagggagggtgcgaggcctgttcaaatgctagctccataaataaagcaatttcctccggcagtttctgaaagtaggaaaggttacatttaaggttgcgtttgttagcatttcagtgtttgccgacctcagctacagcatccctgcaaggcctcgggagacccagaagtttctcgccccttagatccaaacttgagcaacccggagtctggattcctgggaagtcctcagctgtcctgcggttgtgccggggccccaggtctggaggggaccagtggccgtgtggcttctactgctgggctggaagtcgggcctcctagctctgcagtccgaggcttggagccaggtgcctggaccccgaggctgccctccaccctgtgcgggcgggatgtgaccagatgttggcctcatctgccagacagagtgccggggcccagggtcaaggccgttgtggctggtgtgaggcgcccggtgcgcggccagcaggagcgcctggctccatttcccaccctttctcgacgggaccgccccggtgggtgattaacagatttggggtggtttgctcatggtggggacccctcgccgcctgagaacctgcaaagagaaatgacgggcctgtgtcaaggagcccaagtcgcggggaagtgttgcagggaggcactccgggaggtcccgcgtgcccgtccagggagcaatgcgtcctcgggttcgtccccagccgcgtctacgcgcctccgtcctccccttcacgtccggcattcgtggtgcccggagcccgacgccccgcgtccggacctggaggcagccctgggtctccggatcaggccagcggccaaagggtcgccgcacgcacctgttcccagggcctccacatcatggcccctccctcgggttaccccacagcctaggccgattcgacctctctccgctggggccctcgctggcgtccctgcaccctgggagcgcgagcggcgcgcgggcggggaagcgcggcccagacccccgggtccgcccggagcagctgcgctgtcggggccaggccgggctcccagtggattcgcgggcacagacgcccaggaccgcgctccccacgtggcggagggactggggacccgggcacccgtcctgccccttcaccttccagctccgcctcctccgcgcggaccccgccccgtcccgacccctcccgggtccccggcccagccccctccgggccctcccagcccctccccttcctttccgcggccccgccctctcctcgcggcgcgagtttcaggcagcgctgcgtcctgctgcgcacgtgggaagccctggccccggccacccccgcgatgccgcgcgctccccgctgccgagccgtgcgctccctgctgcgcagccactaccgcgaggtgctgccgctggccacgttcgtgcggcgcctggggccccagggctggcggctggtgcagcgcggggacccggcggctttccgcgcgctggtggcccagtgcctggtgtgcgtgccctgggacgcacggccgccccccgccgccccctccttccgccaggtgggcctccccggggtcggcgtccggctggggttgagggcggccggggggaaccagcgacatgcggagagcagcgcaggcgactcagggcgcttcccccgcaggtgtcctgcctgaaggagctggtggcccgagtgctgcagaggctgtgcgagcgcggcgcgaagaacgtgctggccttcggcttcgcgctgctggacggggcccgcgggggcccccccgaggccttcaccaccagcgtgcgcagctacctgcccaacacggtgaccgacgcactgcgggggagcggggcgtgggggctgctgctgcgccgcgtgggcgacgacgtgctggttcacctgctggcacgctgcgcgctctttgtgctggtggctcccagctgcgcctaccaggtgtgcgggccgccgctgtaccagctcggcgctgccactcaggcccggcccccgccacacgctagtggaccccgaaggcgtctgggatgcgaacgggcctggaaccatagcgtcagggaggccggggtccccctgggcctgccagccccgggtgcgaggaggcgcgggggcagtgccagccgaagtctgccgttgcccaagaggcccaggcgtggcgctgcccctgagccggagcggacgcccgttgggcaggggtcctgggcccacccgggcaggacgcgtggaccgagtgaccgtggtttctgtgtggtgtcacctgccagacccgccgaagaagccacctctttggagggtgcgctctctggcacgcgccactcccacccatccgtgggccgccagcaccacgcaggccccccatccacatcgcggccaccacgtccctgggacacgccttgtcccccggtgtacgccgagaccaagcacttcctctactcctcaggcgacaaggagcagctgcggccctccttcctactcagctctctgaggcccagcctgactggcgctcggaggctcgtggagaccatctttctgggttccaggccctggatgccagggactccccgcaggttgccccgcctgccccagcgctactggcaaatgcggcccctgtttctggagctgcttgggaaccacgcgcagtgcccctacggggtgctcctcaagacgcactgcccgctgcgagctgcggtcaccccagcagccggtgtctgtgcccgggagaagccccagggctctgtggcggcccccgaggaggaggacacagacccccgtcgcctggtgcagctgctccgccagcacagcagcccctggcaggtgtacggcttcgtgcgggcctgcctgcgccggctggtgcccccaggcctctggggctccaggcacaacgaacgccgcttcctcaggaacaccaagaagttcatctccctggggaagcatgccaagctctcgctgcaggagctgacgtggaagatgagcgtgcgggactgcgcttggctgcgcaggagcccaggtgaggaggtggtggccgtcgagggcccaggccccagagctgaatgcagtaggggctcagaaaagggggcaggcagagccctggtcctcctgtctccatcgtcacgtgggcacacgtggcttttcgctcaggacgtcgagtggacacggtgatctctgcctctgctctccctcctgtccagtttgcataaacttacgaggttcaccttcacgttttgatggacacgcggtttccaggcgccgaggccagagcagtgaacagaggaggctgggcgcggcagtggagccgggttgccggcaatggggagaagtgtctggaagcacagacgctctggcgagggtgcctgcaggttacctataatcctcttcgcaatttcaagggtgggaatgagaggtggggacgagaaccccctcttcctgggggtgggaggtaagggttttgcaggtgcacgtggtcagccaatatgcaggtttgtgtttaagatttaattgtgtgttgacggccaggtgcggtggctcacgccggtaatcccagcactttgggaagctgaggcaggtggatcacctgaggtcaggagtttgagaccagcctgaccaacatggtgaaaccctatctgtactaaaaatacaaaaattagctgggcatggtggtgtgtgcctgtaatcccagctacttgggaggctgaggcaggagaatcacttgaacccaggaggcggaggctgcagtgagctgagattgtgccattgtactccagcctgggcgacaagagtgaaactctgtctttaaaaaaaaaaagtgttcgttgattgtgccaggacagggtagagggagggagataagactgttctccagcacagatcctggtcccatctttaggtatgaagagggccacatgggagcagaggacagcagatggctccacctgctgaggaagggacagtgtttgtgggtgttcaggggatggtgctgctgggccctgccgtgtccccaccctgtttttctggatttgatgttgaggaacctccgctccagcccccttttggctcccagtgctcccaggccctaccgtggcagctagaagaagtcccgatttcaccccctccccacaaactcccaagacatgtaagacttccggccatgcagacaaggagggtgaccttcttggggctcttttttttctttttttctttttatggtggcaaaagtcatataacatgagattggcactcctaacaccgttttctgtgtacagtgcagaattgctaactcggcggtgtttacagcaggttgcttgaaatgctgcgtcttgcgtgactggaagtccctacccatcgaacggcagctgcctcacacctgctgcggctcaggtggaccacgccgagtcagataagcgtcatgcaacccagttttgctttttgtgctccagcttccttcgttgaggagagtttgagttctctgatcaggactctgcctgtcattgctgttctctgacttcagatgaggtcacaatctgcccctggcttatgcagggagtgaggcgtggtccccgggtgtccctgtcacgtgcagggtgagtgaggcgttgcccccaggtgtccctgtcacgtgtagggtgagtgaggcgcggcccccgggtgtccctgtcccgtgcagcgtgattgaggtgtggcccccgggtgtccctgtcacgtgcagggtgagtgaggcgccgtccccgggtgtccctgtcacgtgtagggtgagtgaggcacggcccccgggtgtccctgtcacgtgcagggtgagtgaggcgcggcccccgggtgtccctgtcacgtgcagggtgagtgaggcgcggtccccgggtgtccctgtcacgtgcagggtgagtgaggcgcggtccccgggtgtccctgtcacgtgcagggtgagtgaggcgccgtccccgggtgtccctgtcacgtgcagggtgagtgaggcgccgtccccgggtgtccctgtcacgtgcagggtgagtgaggcgcggtccccgggtgtccctgtcacgtgtagggtgagtgagttgcggcccccgggtgtccctctcaggtgcagggtgagtgaggcgctgtccctgggtgtccctgtctcgtgtagggtgagtgaggctctgtccccaggtgtccttggcgtttgctcacttgagcttgctcctgaatgtttgctctttctatagccacagctgcgccggttgcccattgcctgggtagatggtgcaggcgcagtgctggtccccaagcctatcttttctgatgctcggctcttcttggtcacctctccgttccattttgctacggggacacgggactgcaggctctcgcctcccgcgtgccaggcactgcagccacagcttcaggtccgcttgcctctgttgggcctggcttgctcaccacgtgcccgccacatgcatgctgccaatactcctctcccagcttgtctcatgccgaggctggactctgggctgcctgtgtctgctgccacgtgttgctggagacatcccagaaagggttctctgtgccctgaaggaaagcaagtcaccccagccccctcacttgtcctgttttctcccaagctgcccctctgcttggcccccttgggtgggtggcaacgcttgtcaccttattctgggcacctgccgctcattgcttaggctgggctctgcctccagtcgccccctcacatggattgacgtccagccacaggttggagtgtctctgtctgtctcctgctctgagacccacgtggagggccggtgtctccgccggccttcgtcagacttccctcttgggtcttagttttgaatttcactgatttacctctgacgtttctatctctccattgtatgctttttcttggtttattctttcattccttttctagcttcttagtttagtcatgcctttccctctaagtgctgccttacctgcaccctgtgttttgatgtgaagtaatctcaacatcagccactttcaagtgttcttaaaatacttcaaagtgttaatacttcttttaagtattcttattctgtgatttttttctttgtgcacgctgtgttttgacgtgaaatcattttgatatcagtgacttttaagtattctttagcttattctgtgatttctttgagcagtgagttatttgaacactgtttatgttcaagatatgtagagtatcaagatacgtagagtattttaagttatcattttattattgatttctaactcagttgtgtagtggtctgtataataccaattatttgaagtttgcggagccttgctttgtgatctagtgtgtgcatggtttccagaactgtccattgtaaatttgacatcctgtcaatagtgggcatgcatgttcactatatccagcttattaaggtccagtgcaaagcttctgtctccttctagatgcatgaaattccaagaaggaggccatagtccctcacctgggggatgggtctgttcatttcttctcgtttggtagcatttatgtgaggcattgttaggtgcatgcacgtggtagaatttttatcttcctgatgagtgaatcttttggagacttctatgtctctagtaatctagtaattctttttttaaattgctcttagtactgccacactgggcttcttttgattagtattttcctgctgtgtctgttttctgcctttaatttatatatatatatatattttttttttttttgagacagagtcttggtctgtcgcccagggtgagtgcagtggtgtgatcacaggtcagtgtaacttttaccttctggcctgagccgtcctctcacctcagcctcctgagtagctggaactgcagacacgcaccgctacacctggctaatttttaaattttttctggagacagggtcttgctgtgttgcccaggctggtctcaaactcttggactcaagggatccatctacctcggcttcccaaagtgctgaattacaggcatgagccaccatgcctggcctaattttcaacacttttatattcttatagtgtgggtatgtcctgttaacagcatgtaggtgaatttccaatccagtctgacagtcgttgtttaactggataacctgatttattttcatttttttgtcactagagacccgtctggtgcactctgattctccacttgcctgttgcatgtcctcgttcccttgtttctcaccacctcttgggttgccatgtgcgtttcctgccgagtgtgtgttgatcctctcgttgcctcctggtcactgggcatttgcttttatttctctttgcttagtgttaccccctgatctttttattgtcgttgtttgcttttgtttattgagacagtctcactctgtcacccaggctggagtgtaatggcacaatctcggctcactgcaacctctgcctcctcggttcaagcagttctcattcctcaacctcatgagtagctgggattacaggcgcccaccaccacgcctggctaatttttgtatttttagtagagataggctttcaccatgttggccaggctggtctcaaactcctgacctcaagtgatctgcccgccttggcctcccacagtgctgggattacaggtgcaagccaccgtgcccggcataccttgatcttttaaaatgaagtctgaaacattgctacccttgtcctgagcaataagacccttagtgtattttagctctggccaccccccagcctgtgtgctgttttccctgctgacttagttctatctcaggcatcttgacacccccacaagctaagcattattaatattgttttccgtgttgagtgtttctgtagctttgcccccgccctgcttttcctcctttgttccccgtctgtcttctgtctcaggcccgccgtctggggtccccttccttgtcctttgcgtggttcttctgtcttgttattgctggtaaaccccagctttacctgtgctggcctccatggcatctagcgacgtccggggacctctgcttatgatgcacagatgaagatgtggagactcacgaggagggcggtcatcttggcccgtgagtgtctggagcaccacgtggccagcgttccttagccagtgagtgacagcaacgtccgctcggcctgggttcagcctggaaaaccccaggcatgtcggggtctggtggctccgcggtgtcgagtttgaaatcgcgcaaacctgcggtgtggcgccagctctgacggtgctgcctggcgggggagtgtctgcttcctcccttctgcttgggaaccaggacaaaggatgaggctccgagccgttgtcgcccaacaggagcatgacgtgagccatgtggataattttaaaatttctaggctgggcgcggtggctcacgcctgtaatcccagcactttgggaggccaaggcgggtggatcacgaggtcaggaggtcgagaccatcctggccaacatgatgaaaccccatctgtactaaaaacacaaaaattagctgggcgtggtggcgggtgcctgtaatcccagctactcgggaggctgaggcaggagaattgcttgaacctgggagttggaagttgcagtgagccgacattgcaccactgcactccagcctggcaacacagcgagactctgtctcaaaaaaaaaaaaaaaaaaaaaaaaaaaaattctagtagccacattaaaaaagtaaaaaagaaaaggtgaaattaatgtaataatagattttactgaagcccagcatgtccacacctcatcattttagggtgttattggtgggagcatcactcacaggacatttgacattttttgagctttgtctgcgggatcccgtgtgtaggtcccgtgcgtggccatctcggcctggacctgctgggcttcccatggccatggctgttgtaccagatggtgcaggtccgggatgaggtcgccaggccctcagtgagctggatgtgcagtgtccggatggtgcacgtctgggatgaggtcgccaggccctgctgtgagctggatgtgtggtgtctggatggtgcaggtcaggggtgaggtctccaggccctcggtgagctggaggtatggagtccggatgatgcaggtccggggtgaggtcgccaggccctgctgtgagctggatgtgtggtgtctggatggtgcaggtcaggggtgaggtctccaggccctcggtaagctggaggtatggagtccggatgatgcaggtccggggtgaggtcgccaggccctgctgtgagctggatgtgtggtgtctggatggtgcaggtctggggtgaggtcaccaggccctgcggtgagctgggtgtgcggtgtctggatggtgcaggtctggagtgaggtcgccagacggtgccagaccatgcggtgagctggatatgcggtgtccggatggtgcaggtctggggtgaggttgccaggccctgctgtgagttggatgtggggtgtccggatgctgcaggtccggtgtgaggtcaccaggccctgctgtgagctggatgtgtggtgtctggatggtgcaggtctggggtgaggtcgccaggccctgctgtgagctggatgtgtggtgtctggatggtgcaggtctggagtgaggtcgccaggccctcggtgagctggatgtgcagtgtccagatggtgcaggtccggggtgaggtcgccagaccctgcggtgagctggatgtgcggtgtctggatggtgcaggtctggagtgaggtcgccaggccctcggtgagctggatgtatggagtccggatggtgccggtccggggtgaggtcgccagaccctgctgtgagctggatgtgcggtgtctggatggtacaggtctggagtgaggtctccaggccctgctgtgagctggaggtatggagtccggatgatgcaggtccggggtgaggtcgccaggccctgctgtgagctggatgtgcggcgtctggatggtgcaggtctggggtgtggtcgccaggccctcggtgagctggaggtatggagtccggatgatgcaggtccggggtgaggtcgccaggccctgctgtgagctggatgtgcggcgtctggatggtgcaggtctggggtgtggtcgccaggccctcggtgagctggaggtatggagtccggatgatgcaggtccggggtgaggttgccaggccctgctgtgagctggatgtgctgtatccggatggtgcagtccggggtgaggtcgccaggccctgctgtgagctggatgtgctgtatccggatggtgcaggtctggggtgaggtcaccaggccctgcggtgagctggttgtgcggtgtccggttgctgcaggtccggggtgagttcgccaggccctcggtgagctggatgtgcggtgtccccgtgtccggatggtgcaggtccagggtgaggtcgctaggcccttggtgggctggatgtgccgtgtccggatggtgcaggtctggggtgaggtcgccaggcctttggtgagctggatgtgcggtgtctgcatggtgcaggtctggggtgaggtcgccaggcccttggtgggctggatgtgtggtgtccggatggtgcaggtccggcgtgaggtcgccaggccctgctgtgagctggatgtgcggtgtctggatggtgcaggtccggggtgaggtagccaaggccttcggtgagctggatgtggggtgtccggatggtgcaggtccggggtgaggtcgccaggccctgcggttagctggatatgcggtgtccggatggtgcaggtccggggtgaggtcaccaggccctgcggttagctggatgtgcggtgtctggatggtgcaggtccggggtgaggtcgccaggccctgctgtgagctggatgtgctgtatccggatggtgcaggtccggggtgaggtcgccaggccctgcagtgagctggatgtgctgtatccggatggtgcaggtctggcgtgaggtcgccaggccctgcggttagctggatatgcggtgtcggatggtgcaggtccggggtgaggtcaccaggccctgcggttagctggatgtgcggtgtccggatggtgcaggtctggggtgaggtcgccaggccctgctgtgagctggatgtgctgtatccggatggtgcaggtccggggtgaggtcgccaggccctgcggtgagctggatgtgctgtatccggatggtgcaggtctggcgtgaggtcgccaggccctgcggtgagctggatgtgcagtgtacggatggtgcaggtccggggtgaggtcgccaggccctgcggtgggctgtatgtgtgttgtctggatggtgcaggtccggggtgagttcgccaggccctgcggtgagctggatgtgtggtgtctggatgctgcaggtccggggtgagttcgccaggccctcggtgagctggatatgcggtgtccccgtgtccgaatggtgcaggtccagggtgaggtcgccaggcccttggtgggctggatgtgccgtgtccggatggtgcaggtctggggtgaggtcgccaggcccttggtgagctggatgtgcggtgtccggatggtgcaggtccggggtgaggtcaccaggccctcggtgatctggatgtggcatgtccttctcgtttaaggggttggctgtgttccggccgcagagcaccgtctgcgtgaggagatcctggccaagttcctgcactggctgatgagtgtgtacgtcgtcgagctgctcaggtctttcttttatgtcacggagaccacgtttcaaaagaacaggctctttttctaccggaagagtgtctggagcaagttgcaaagcattggaatcaggtactgtatccccacgccaggcctctgcttctcgaagtcctggaacaccagcccggcctcagcatgcgcctgtctccacttgcctgtgcttccctggctgtgcagctctgggctgggagccaggggccccgtcacaggcctggtccaagtggattctgtgcaaggctctgactgcctggagctcacgttctcttacttgtaaaatcaggagtttgtgccaagtggtctctagggtttgtaaagcagaagggatttaaattagatggaaacactaccactagcctccttgcctttccctgggatgtgggtctgattctctctctcttttttttttcttttttgagatggagtctcactctgttgcccaggctggagtgcagtggcataatcttggctcactgcaacctccacctcctgggtttaagcgattcaccagcctcagcctcctaagtagctgggattacaggcacctgccaccacgcctggctaatttttgtacttttaggagagacggggtttcaccatgttggccaggctggtctcgaactcatgacctcaggtgatccacccaccttggcctcccaaagtgctgggtttacaggctaagccaccgtgcccagcccccgattctcttttaattcatgctgttctgtatgaatcttcaatctattggatttaggtcatgagaggataaaatcccacccacttggcgactcactgcagggagcacctgtgcagggagcacctggggataggagagttccaccatgagctaacttctaggtggctgcatttgaatggctgtgagattttgtctgcaatgttcggctgatgagagtgtgagattgtgacagattcaagctggatttgcatcagtgagggacgggagcgctggtctgggagatgccagcctggctgagcccaggccatggtattagcttctccgtgtcccgcccaggctgactgtggagggctttagtcagaagatcagggcttccccagctcccctgcacactcgagtccctggggggccttgtgacaccccatgccccaaatcaggatgtctgcagagggagctggcagcagacctcgtcagaggtaacacagcctctgggctggggaccccgacgtggtgctggggccatttccttgcatctgggggagggtcagggctttccctgtgggaacaagttaatacacaatgcaccttacttagactttacacgtatttaatggtgtgcgacccaacatggtcatttgaccagtattttggaaagaatttaattggggtgaccggaaggagcagacagacgtggtggtccccaagatgctccttgtcactactgggactgttgttctgcctggggggccttggaggcccctcctccctggacagggtaccgtgccttttctactctgctgggcctgcggcctgcggtcagggcaccagctccggagcacccgcggccccagtgtccacggagtgccaggctgtcagccacagatgcccaggtccaggtgtggccgctccagcccccgtgcccccatgggtggttttgggggaaaaggccaaagggcagaggtgtcaggagactcacgagagctgattctgctccttggctgagctgccctgagcagcctctcccgccctctccatctgaagggatgtggctctttctacctgggggtcctgcctggggccagcgttgggctaccccagtggctgtaccagagggacaggcatcctgtgtggaggggcatgggttcacgtggccccagatgcagcctgggaccaggctccctggtgctgatggtgggacagtcaccctgggggttgaccgccggactgggcgtccccagggttgactataggaccaggtgtccaggtgccctgcaagtagaggggctctcagaggcgtctggctggcatgggtggacgtggccccgggcatggccttcagcgtgtgctgccgtgggtgccctgagccctcactgagtcggtgggggcttgtggcttcccgtgagcttccccctagtctgttgtctggctgagcaagcttcctgaggggctctctattgcagacagcacttgaagagggtgcagctgcgggagctgtcggaagcagaggtcaggcagcatcgggaagccaggcccgccctgctgacgtccagactccgcttcatccccaagcctgacgggctgcggccgattgtgaacatggactacgtcgtgggagccagaacgttccgcagagaaaagagggtggctgtgctttggtttaacttcctttttaaacagaagtgcgtttgagccccacatttggtatcagcttagatgaagggcccggaggaggggccacgggacacagccagggccatggcacggcgccaacccatttgtgcgcacggtgaggtggccgaggtgccggtgcctccagaaaagcagcgtgggggtgtagggggagctcctggggcagggacaggctctgaggaccacaagaagcagccgggccagggcctggatgcagcacggcccgaggtcctggatccgtgtcctgctgtggtgcgcaggctccgtgcgcttccgcttacggggcccggggaccaggccacgactgccaggagcccaccgggctctgaggatcctggaccttgccccacggctcctgcaccccacccctgtggctgcggtggctgcggtgaccccgtcatctgaggagagtgtggggtgaggtggacagaggtgtggcatgaggatcccgtgtgcaacacacatgcggccaggaacccgtttcaaacagggtctgaggaagctgggaggggttctaggtcccgggtctgggtggctggggacactggggaggggctgcttctcccctgggtccctatggtggggtgggcacttggccggatccactttcctgactgtctcccatgctgtccccgccaggccgagcgtctcacctcgagggtgaaggcactgttcagcgtgctcaactacgagcgggcgcggcgccccggcctcctgggcgcctctgtgctgggcctggacgatatccacagggcctggcgcaccttcgtgctgcgtgtgcgggcccaggacccgccgcctgagctgtactttgtcaaggtgggtgccggggacccccgtgagcagccctgctggaccttgggagtggctgcctgattggcacctcatgttgggtggaggaggtactcctgggtgggccgcagggagtgcaggtgaccctgtcactgttgaggacacacctggcacctagggtggaggccttcagcctttcctgcagcacatggggccgactgtgcaccctgactgcccgggctcctattcccaaggagggtcccactggattccagtttccgtcagagaaggaaccgcaacggctcagccaccaggccccggtgccttgcaccccagtcctgagccaggggtctcctgtcctgaggctcagagaggggacacagcccgccctgcccttggggtctggagtggtgggggtcagagagagagtgggggacaccgccaggccaggccctgagggcagaggtgatgtctgagtttctgcgtggccactgtcagtctcctcgcctccactcacacaggtggatgtgacgggcgcgtacgacaccatcccccaggacaggctcacggaggtcatcgccagcatcatcaaaccccagaacacgtactgcgtgcgtcggtatgccgtggtccagaaggccgcccatgggcacgtccgcaaggccttcaagagccacgtaaggttcacgtgtgatagtcgtgtccaggatgtgtgtctctgggatatgaatgtgtctagaatgcagtcgtgtctgtgatgcgtttctgtggtggaggtacttccatgatttacacatctgtgatatgcgtgtgtggcacgtgtgtgtcgtggtgcatgtatctgtggcgtgcatatttgtggtgtgtgtgtgtgtggcacgtgtgtgtccatggtgtgtgtgcctgtggtgtgcatgtgtgtgtgtctgtgacacgtgcatgttcatgctgtgtgctgcatgtctgtgatgtgcctatttgtggtgtgtgtgtgtgcatgtgtccgtgacatatgcgtgtctatggcatgggtgtgtgtggccccttggccttactccttcctcctccaggcatggtccgcaccattgtcctcacgctctcgggtgctggtttggggagctccacattcagggtcctcacttctagcatgggtgcccctgtcctgtcacagggctgggccttggagactgtaagccaggtttgagaggagagtagggatgctggtggtaccttcctggacccctggcacccccaggaccccagtctggcctatgccggctccatgagatataggaaggctgattcaggcctcgctccccgggacacactcctcccagagcggccgggggccttggggctcggcaggggtgaaaggggccctgggcttgggttcccacccagtggtcatgagcacgctggaggggtaagccctcaaagtcgtgccaggccggggtgcagaggtgaagaagtatccctggagcttcggtctggggagaggcacatgtggaaacccacaaggacctctttctctgacttcttgagctatcgcagctacttgcaaatctcagcagaattttaccctcatggaaagctgatggccaccacctgtgcccaggtgtagaaagtcactagagcccaggagacccccccgtccccaccgcccacctgtgcccgggtgtagaaagtcaccagagcccaggagacccccccccacatccccgctgcagcggaagctaccgcccccaccgtgaccctcgttccgacctcgacctccatggtctccctctcccggtcttcatgtgagtgagatcaggcaggaggtgggttctgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttttcatgtgtggggtaggtggggatctgtggagttggtttttatgtgtgggggtaggtggggatctgtggagttggttttcatgtgtagggtaggtggagatctgtgggattggttttcatgtgtggggtaggtggggatctgtgggattggttttcatgtgtggggtaggtggggatctgtgggattggtttttatgagtggggtaacacagagttcaaggcgagctttcttcctgtagtgggtctgcaggtgctccaacagctttattgaggagaccatatcttcctttgaactatggtcgggtttatagtaagtcaggggtgtggaggcctcccctgggctccctgttctgtttcttccactctggggtcgtgtggtgcctgctgtggtgtgtggccggtgggcagggcttccaggcctccttgtgttcattggcctggatgtggccctggctacgctccgtccttggaattcccctgcgagttggaggcttgctttctttctttttttctttctttttttttttttttgataacagagtctcgctcttttttgcccaggctggagtggtttggcgtgatcttggctcactgcaacctgtgcttcctgagttcaagcaattctcttgcctcagcctcccaagtagctggaattataggcgcccaccaccatgctgactaatttttgtaattttagtagagacgaggtttctccatgttggccaggctggtctcgaactcctgacctcaggtgatcctcccacctcggcctcccaaagtgctgggatgacaggtgtgaaccgccgcgcccggccgagactcgcttcctgcagcttccgtgagatctgcagcgatagctgcctgcagccttggtgctgacaacctccgttttccttctccaggtctcgctaggggtctttccatttcatgactctcttcacagaagagtttcacgtgtgctgatttcccggctgtttcctgcgtaattggtgtctgctgtttatcgatggcctccttccatttcctttaggctttgtttattgttgtttttccggctccttgaaggaaaagtttcgattatggatgtttgaactttcttttctaaacaagcatctgaagttgccgttttccctctaaagcagggatcccgaggcccctggctgtggagtggcaccggtctggggcctgttaggaacccggcgcacagcgggaggctaggtggggtgtggggagccagcgttcccgcctgagccccgcccctctcagatcagcagtggcatgcggtgctcagaggcgcacacaccctactgagaactgtgcgtgagaggggtctagattctgtgctccttatgggaatctaatgcctgatgatctgaggtggaaccgtttgctcccaaaaccatccccttccccactgctgtcctgtggaaaaatcgtcttccacgaaaccagtccctggtaccacaatggttggggaccctgtgctaaagacctgcttcagcagcctctcgtcagtgttgatatattggcttttctgtgttgagtccagaataattacggatttctgtgatgctttccgccgacctcagacccatgggctatttgtgggcgtgttgcctgctcctgggttgggaagggtgcaggccccatgtaccttcctgttactgccttccaggttggttctcagggttgaatcgtactcgatgtggttttagcccacggccctgccgccagctcctgggggctggggaacatgctgaagcacagagtcaccgtgcgcgtcttttgatgcctcacaagctcgaggcctcctgtgtccgtgttagtgtgtgtcacgtgcctgctcacatcctgtcttggggacgcaggggcttagcaggtcccgtagtaaatgacaagcgtcctgggggagtctgcagaataggaggtgggggtgccggtctctctcccgcgtcttcagactcttctcctgcctgtgctgtggctgcacctgcatccctgcaatccctccagcactgggctggagaggcccgggagctcgagtgccacttgtgccacgtgactgtggatggcagtcggtcacgggggtctgatgtgtggtgactgtggatggcggtcggtcacgggggtctgatgtgtggtgactgtggatggcggtcgtggggtctgatgtgtggtgactgtggatggcgatcggtcacaggggtctgatgtgtggtgactgtggatggtggtcgtggggcctgatgtggtgactgtggatggcggtcgtagggtctgatgtgtggtgactgtggatggcggttgtggggtctgatgtgtggtgactgtggatggcggttgtgggggtctgatgtgtggtgactgtggatggcggtcgtggggtctgatgtggtgactgtggatggcagtcgtggggtctgatgtgtggtgactgtggatggcggtcgtggggtctgatgtgtggtgactgtggatggcggtcgtggggtctgatgtgtggtgactgtggatggcggtcgtggggtctgatgtgtggtgactgtggatggcggtcgtggggtctgatgtggtgactgtggatggcggtcgtggggtctgatgtgtggtgactgtggatggtgatcggtcacaggggtctgatgtgtggtgactgtggatggcggtcgtggggtctgatgtgtggtgactgtggatggtgatcggtcacaggggtctgatgtgtggtgactgtggatggcggtcgtggggtctgatgtgtggtgactgtggatggcggttggtcccgggggtctgatgtgtggtgactgtggatggcgatcggtcacaggggtctgatgtgtggtgactgtggatggcggtcgtggggtctgatgtgtggtgactgtggatggcggtcgtggggtctgatgtgtggtgactgtggatggcggtcgtggggtctgatgtggtgactgtggatggcggtcgtggggtctgatgtggtgactgtggatggcggtcgtggggtctgatgtgtggtgactgtggatggcggttggtcccgggggtctgatgtgtggtgactgtggatggcggtcgtggggtctgatgtggtgactgtggatggcggtcgtggggtctgatgtgtggtgactgtggatggcggtcgtggggtctgatgtgtggtgactgtggatggcggtcgtagggtctcatgtggtgactgtggatggcggtcgtggggtctgatgtgtggtgactgtggatggcggtcgtggggtctgatgtggtgactgtggatggcggttgtggggtctgatgtgtggtgactgtggatggcggtcgtggggtctgatgtggtgactgtggatggcggtcgtggggtctgatgtggtgactgtggatggcggtcgtggggtctgatgtgtggtgactgtggatggcggtcgtggggtctgatgtgtggtgactgtggatggcggtcgtggggtctgatgtgtggtgactgtggatggcggtcgtggggtctgatgtgtggtgactgtggatggcggtcgtggggtctgatgtggtgactgtggatggcggtcgtggggtctgatgtggtgactgtggatggcggtcgtggggtctgatgtggtgactgtggatggtgatcggtcacaggggtctgatgtgtggtagctgcaggtggagtcccaggtgtgtctgtagctactttgcgtcctcggccccccggcccccgtttcccaaacagaagcttcccaggcgctctctgggcttcatcccgccatcgggcttggccgcaggtccacacgtcctgatcggaagaaacaagtgcccagctctggccggggcaggccacatttgtggctcatgccctctcctctgccggcaggtctctaccttgacagacctccagccgtacatgcgacagttcgtggctcacctgcaggagaccagcccgctgagggatgccgtcgtcatcgagcaggtctgggcactgccctgcagggttgggcacggactcccagcagtgggtcctcccctgggcaatcactgggctcatgaccggacagactgttggccctggggggcagtggggggaatgagctgtgatgggggcatgatgagctgtgtgccttggcgaaatctgagctgggccatgccaggctgcgacagctgctgcattcaggcacctgctcacgtttgactgcgcggcctctctccagttccgcagtgcctttgttcatgatttgctaaatgtcttctctgccagttttgatcttgaggccaaaggaaaggtgtccccctcctttaggagggcaggccatgtttgagccgtgtcctgcccagctggcccctcagtgctgggtctgaggccaaaggaaacgtgtcccccttcttaggaggacgggccgtgtttgagccacgccccgctgagcgggcctctcagtgctgggtctgtccacgtggccctgtggccctttgcagatgtggtctgtccacgtggccctgtggctctttgcagatgcctgttagcacttgctcggctctaggggacagtcgtgtccaccgcatgaggctcagagacctctgggcgaatttccttggctcccagggtgggggtgggggtggcctgggctgctgggacccagaccctgtgcccggcagctgggcagcaactcctggatcacatatgccatccgggccacggtgggctgtgtgggtgtgagcccagctggacccacaggtggcccagaggagacgttctgtgtcacacactctgcctaagcccatgtgtgtctgcagagactcggcccggccagcccacgatggccctgcattccagcccagccccgcacttcatcacaaacactgaccccaaaagggacggagggtcttggccacgtggtcctgcctgtctcagcacccaccggctcactcccatgtgtctcccgtctgctttcgcagagctcctccctgaatgaggccagcagtggcctcttcgacgtcttcctacgcttcatgtgccaccacgccgtgcgcatcaggggcaagtgagtcaggtggccaggtgccattgccctgcgggtggctgggcgggctggcagggcttctgctcacctctctcctgccccttccccactgcccttctgcccggggccaccagagtctccttttctggcccccgccccctccggctcctgggctgcaggctcccgaggccccggaaacatggctcggcttgcggcagccggagcggagcaggtgccacacgaggcctggaaatggcaagcggggtgtggagttgctcctgcgtggaggacgaggggcggggggtgtgtctgggtcaggtgtgcgccgagcgtttgagcctgcagcttgtcagctccaagttactactgacgctggacacccggctctcacacgcttgtatctctctctcccgatacaaaaggattttatccgattctcattcctgtccctgtcgtgtgacccccgcgagggcgcgggctcttctctctgtgactagatttcccatctggaaagtgcggggttgaccgtgtagtttgctcctctcggggggcctgtggtggccatggggcaggcggcctgggagagctgccgtcacacagccactgggtgagccacactcacggtggtagagccacagtgcctggtgccacatcacgtcctctggattttaagtaaaaccacacacctcccggcaggcatctgcctgcgaccctgtgtgtgcctggggagagtggtagcacggaggaaattcgtgcacactcaaggtcatcagcaaggtcatccgcagtcaggtggaacgtggaggcctctctctgggatcgtctccagcggataaaggactgtgcacagcttcggaagcttttatttaaaaatataactattaattattgcattataagtaatcactaatggtatcagcaattataatatttattaaagtataattagaaatattaagtagtacacacgttctggaaaaacacaaattgcacatggcagcagagtgaattttggccgagggacacgtgtgcacatgtgtgtaagcggcccccaggcccacagaattcgctgacaaagtcacctccccagagaagccaccacgggcctccttcgtggtcgtgaattttattaagatggatcaagtcacgtaccgtccacgtgtggcagggctttggggaatgtgaggtgatgactgcgtcctcatgccctgacagacaggaggtgactgtgtctgtcctgtccctaggacacggacaggcccgaagctctagtccccatcgtggtccagtttggcctctgaataaaaacgtcttcaaaacctgttgccccaaaaactaagaacagagagagtttcccatcccatgtgctcacaggggcgtatctgcttgcgttgactcgctgggctggccggactcctagagttggtgcgtgtgcttctgtgcaaaaagtgcagtcctcttgcccatcactgtgatatctgcaccagcaaggaaagcctcttttcttttctttctttttttttttttgagacggaacgtcactgttgtctgcctgggcttgagtgcagtggcgcgatctcaactcactgcaacctccgcctcccgggttccagcatttctcctgcctcagcctcccgagcagctgagattacaggcacccaccccctgcgcctggctaatttttgtatttttagtagagaggggtttttgccatgttggccaggctggtctcgaactcctgacctcaggtgatccacccacctcggcctcccaaagtgctgggattacaggtgtgagccatcacgcccagccggaaagcctctttttaaggtgaccacctatagcgcttcccgaaaataacaggtcttgtttttgcagtaggctgcaagcgtctcttagcaacaggagtggcgtcctgtgggctctggggatggctgagggtcgcgtggcagccatgccttctgtgtgcacctttaggttccacggggctattctgctctcactgtttgtctgaaaacgcacccttggcatccttgtttggagagtttctgcttctcgttggtcatgctgaaactaggggcaaggttgtatccgttggcgcgcagcggctacatgtagggtcatgagtctttcaccgtggacaaattccttgaaaaaaaaaaaaggagtccggttaagcattcattccgggtcaagtgtctggttctgtgaataaactctaagatttaagaaaccttaatgaaagaaaaccttgatgattcagagcaaggatgtggtcacacctgtggctggatctgtttcagccgccccagtgcatggtgagagtggggagcagggattgtttgttcagaggtctcatctggtatgtttctgaggtgtttgccggctgaatggtagacgtgtcgtttgtgtgtatgaggttctgtgtctgtgtgtggctcggtttgagtgtacgcatgtccagcacatgccctgcccgtctctcacctgtgtcttcccgccccaggtcctacgtccagtgccaggggatcccgcagggctccatcctctccacgctgctctgcagcctgtgctacggcgacatggagaacaagctgtttgcggggattcggcgggacgggtgaggcctcctcttccccaggggggcttgggtgggggttgatttgcttttgatgcattcagtgttaatattcctggtgctctggagaccatgactgctctgtcttgaggaaccagacaaggttgcagccccttcttggtatgaagccgcacgggaggggttgcacagcctgaggactgcgggctccacgcaggctctgtccagcggccatgtccagaggcctcagggctcagcaggcgggagggccgctgccctgcatgatgagcatgtgaattcaacaccgaggaagcacaccagcttctgtcacgtcacccaggttccgttagggtccttggggagatggggctggtgcagcctgaggccccacatctcccagcaggccctcgacaggtggcctggactgggcgcctcttcagcccattgcccatcccacttgcatggggtctacacccaaggacgcacacacctaaatatcgtgccaacctaatgtggttcaactcagctggcttttattgacagcagttacttttttttttttaatactttaagttctagggtacatgtgcacgacgtgcaggttagttacatatgtatacatgtgccatgttggtgtgctgcacccattaactcatcatttacattaggtatatctcctaatgctatccctccccactccccccatcccatgacaggccctggtgtgtgatgttccccaccctgtgtccaagtgttctcattgttcagttcccacctgtgagtgagaacatgtggtgtttggttttctttccttgcaatagtttgctcagagtgatggtttccagcttcgtccatgtccctacaaaggacatgaactcatccttttttatgactgcatagtattccgtggtgtatatgtgccacattttcttaatccagtctatcatcgatggacatttgggttggttgcaagtctttgctactgtgaatagtgccgcaataaacatacgtgtgcatgtgtctttatagcagcatgatttataatcctttgggtatatacccagtaatgggatggctgggtcaaatggtatttctagttctagatccttgaggaatcaccacactgtcttccacaatggttgaactagtttacactcccaccaacagtgtaaaagtgttctggtgctggagaggatgtggacagcagttatttttttatgaaaatagtatcactgaacaagcagacagttagtgaaggatgcgtcaggaagcctgcaggccacacagccatttctctcgaagactccgggtttttcctgtgcatcttttgaaactctagctccaattatagcatgtacagtggatcaaggttcttcttcattaaggttcaagttctagattgaaataagtttatgtaacagaaacaaaaatttcttgtacacacaacttgctctgggatttggaggaaagtgtcctcgagctggcggcacactggtcagccctctgggacaggatacctctggcccatggtcatggggcgctgggcttgggcctgagggtcacacagtgcaccatgcccagcttcctgtggataggatctgggtctcggatcatgctgaggaccacagctgccatgctggtaaagggcaccacgtggctcagagggggcgaggttcccagccccagctttcttaccgtcttcagttatttttccctaagagtctgagaagtggggccgcgcctgatggccttcgttcgtcttcagctggcacagaattgcacaagctgatggtaaacactgagtacttataatgaatgaggaattgctgtagcagttaactgtagagagctcgtctgttggaaagaaatttaagtttttcatttaaccgctttggagaatgttactttatttatggctgtgtaaattgtttgacattcagtccctcgtagacagatactacgtaaaaagtgtaaagttaaccttgctgtgtattttcccttattttaggctgctcctgcgtttggtggatgatttcttgttggtgacacctcacctcacccacgcgaaaaccttcctcaggtgaggcccgtgccgtgtgtctgtggggacctccacagcctgtgggctttgcagttgagccccccgtgtcctgcccctggcaccgcagcgttgtctctgccaagtcctctctctctgccggtgctggatccgcaagagcagaggcgcttggccgtgcacccaggcctgggggcgcaggggcaccttcgggagggagtgggtaccgtgcaggccctggtcctgcagagacgcacccaggttacacacgtggtgagtgcaggcggtgacccggctcctgctgctctttggaaagtcaagagtggcggctcctggggccccagtgagacccccaggagctgtgcacagggcctgcagggccgaggcggcagcctcctccccagggtgcacctgagcctgcggagagcaggagctgctgagtgagctggcccacagcgttcgctgcggtcacgttcctgcgtggggttgtttgggatcggtgggagaatttggatttgctgagtgctgctgtcttgaaccacggagatggctaggagtgggtttcagagttgatttttgtgaatcaaactaaaatcaggcacaggggacctggcctcagcacaggggattgtccaatgtggtccccctcaagggcgccccacagagccggtgggcttgttttaaagtgcgatttgacgagggacgagaaaccttgaaagctgtaaagggaaccctcagaaaatgtggccgccaggggtggtttcaggtgctttgctgggctgtgtttgtgaaaacccatttggacccgccctccaagtccaccctccaggtccaccctccagggccgccctgggctgggggtatgcctggcgttccttgtgccgcagcccggagcacagcaggctgtgcacatttaaatccactaagattcactcggggggagcccaggtcccaagcaactgagggctcaggagtcctgaggctgctgaggggacagagcagacggggaacgctgcttctgtgtggcaagttcctgagggtgctggccagggaggtggctcagagtgtatgttggggtcccaccgggggcagaactctgtctctgatgagtcggcagccatgtaacaggaaggggtggccacagggagctgggaatgcaccaggggagctgcgcagctggccgaggtcccagggccaggccacaggaagggcagggggacgcccggggccacagcagaggccgcaggaagggaaggggatgcccaggccagagcagaggctaccgggcacaggggggctccctgagctgggtgagcgaggctcatgactcggcgagggaacctccttgacgtgaagctgacgactggtgttgcccagctcacagcccagccaggtcccgcgcctgagcaggaactcagaaccctcccctttgtctaaagcacagcagatgccttcagggcatctaggagaaaacaggcaaagtcgttgagaaacgtcttaaaagaaggtgggatggtggcaatttcttgtccagattttagtctgccccggaccacagatgagtctataacgggattgtggtgttgccatggggacacatgagatggaccatcacagaggccactggggctgcacctcccatctgagtcctggctgtcccgggtccaggccaggttcttgcatgctcacctacctgtcctgcccgggagacagggaaagcaccccgaagtctggagcagggctgggtccaggctcctcagagctcctgccaggcccagcaccctgctccaaatcaccacttctctggggttttccaaagcatttaacaagggtgtcaggttacctcctgggtgacggccccgcatcctggggctgacattgcccctctgccttaggaccctggtccgaggtgtccctgagtatggctgcgtggtgaacttgcggaagacagtggtgaacttccctgtagaagacgaggccctgggtggcacggcttttgttcagatgccggcccacggcctattcccctggtgcggcctgctgctggatacccggaccctggaggtgcagagcgactactccaggtgagcgcacctggccggaagtggagcctgtgcccggctggggcaggtgctgctgcagggccgttgcgtccacctctgcttccgtgtggggcaggcgactgccaatcccaaagggtcagaggccacagggtgcccctcgtcccatctggggctgagcagaaatgcatctttctgtgggagtgagggtgctcacaacgggagcagttttctgtgctattttggtaaaaggaaatggtgcaccagacctgggtgcactgaggtgtcttcagaaagcagtctggatccgaacccaagacgcccgggccctgctgggcgtgagtctctccaaacccgaaacacaggggccctgctgggcatgagtccctctgaacccgagaccctggggccctgctgggcgtgagtctctccgaacccagagacttcagggcccttttgggcgtgagtctctccactgtgagccccacactccaaggctcatccacagtctacaggatgccatgagttcatgatcacgtgtgacccatcaggggacagggccatggtgtggggggggtctctacaaaattctggggtcttgtttccccagagcccgagagctcaaggccccgtctcaggctcagacacaaatgaattgaagatggacacagatgcagaaatctgtgctgtttcttttatgaataaaaagtatcaacattccaggcagggcaaggtggctcacacctataatcccagcactttgggaggccgaggtgggtggatcacttgaggccaggagtttgaggccaacctaaccaacatagtgaaattccatttctacttaaaaaatacaaaaattagcctggcctggtggcacacgcctgtagtccccgctatgcgggaggctgaggcaggagaatcatttgaacccaggaggcagaggttgcagtgagccgagatcacaccactgcactccagcctgggcaacagagtgagacttcatcttaaaaaaaaaaaaaaaagtatcagcattccaaaaccatagtggacaggtgtttttttattctgtccttcgataatatttactggtgctgtgctagaggccggaactgggggtgccttcctctgaaaggcacaccttcatgggaagagaaataagtggtggatggttgttaaaccagaggtttaaactggggtcctgtcgttctgagttaacagtccagatctggactttgcctctttccagaatgctccctggggtttgcttcatgggggagcagcaggtgtggacaccctcgtgatgggggagcagcaggtgcagacgccctcatgatgggggagtggcaggtgcagacacccttgtgcatggtgcccagcatgtccctgttgcagctccctccccacaaggatgccggtctcctgtgctccccacagtccctgcttccctctcacagccttacctggtcctggcctccactggctttgtctgcatgatttccacatttcctgggctcccagcacctcttcgcctctcccaggcacctctgcagtgctggccataccagtcagctgtgaactgtccactgcttattttgctccccatgaaatgtattttttaggacaggcacccctggttccagcctctggcacagcatcagtgaatgttattgaaggacaaaggacagacaaacaaatcaggaaaatgggttctctctaaacacattgcaaagccacagaggctagtgcaggatgggtgggcatcaggtcatcagatgtgggtccaatgccagaatattctgtgctcccaaaggccacttggtcagagtgtgtgcttgcagaggtggctctaaaagctcagcagtggaggcagtggttcgccatactcagggtgaactcacatcctctgtgtctgaagtatacagcagaggcttgaagggcatctgggagaagaaaacaggcaaaatgattaagaaaagtgaaaaaggaaaagtggtaagatgggaattttcttgtccagattttagtctcccaaaccacagctcagatggtagaatgtggtcagaactgatggacagaacaatagaacaaaacggaagccctatctctcagaaacgtgtgttaatgtggtatgtggcacagctgatggaaaagagagtgtgtgtgtaatttttttttctgagaaaactgactggaagcaaataagttgtgtctttacagcatataccagagcagattctaggtagaagaggagacacatgcaaacaacaccagcaacagaaataaaacaaaagactcaaagggaagggaggtgaacgttccctggtttggtgttggggaaggacacacagggaggcggatgaaaccagtgaggcaacgggcattgctttcactgcagagaaactcagcttgcctgagccacagtgaaaatggccattccctggagcgtttgtgcacgtgatttatttaaggcgccctgtgaggtcctgcacattcatcctctcactttgttctcctaaccacctgagaggtagaggaggaaaggctccaggggagcagccgcccttggtcacccagctggcaaagggcatgcatgattgcagcctggcctcctgctccggggcccttgctctgcccgaggaccccacacaagtcagacccataggctcagggtgagccggagcccaaggtcgtgttggggatggctgtgaaagaagaaatggacgtctgatgcacacttgggaaggtcctaccagcagcgtcaaagaaatgcatgtgaaactgacagcgagacccatccctcaaagaaacgcacgtgaaactgatggcgagacctgtccccatccctcatgctggctccttttctgggcttgccaagagccagcatcaggttgaggcaagctggaaagacttttctggaaagcagcttgtttgcatggaagtcctcacaatgtcctgtgtcttcccagtaattccacttctgaagtgaccagacattatcacgggtcttatttaccatttccagtgttccaggcagggggacttgccacagcaagtcacgaacctgcccaaatacagggctaaggagatattatgcatcacaaaacttgctctgccattaaacatttttcaaagaatttttgaagaatgtttaatggcacaaaacgtttatttcaatgtagcagtgttcaaagctggatgtaaaagaacacaccccaggagcctgccgtggatgtcatgtgtgttcatctttggacatggacatacatgggcagtgagtggtggtgaggccctggaggacatcggtgggatgcctccatcctgcccctctggagacaccatgtgtgccacgtgcactcactggagccctgtttagctggtgccacctggctcttccatccctgagattcaaacacagtgagattccccacgcccaactcagtgttctcccacaaaaaacctgagtcacacctgtgttcactcgagggacgcctgggagccagggctccacagtttattatgtgtttttggctgagttatgtgcagatctcatcagggcagatgatgagtgcacaaacacggccgtgcgaggtttggatacactcaacatcactagccaggtcctggtggagtttggtcatgcagagtctggatggcatgtagcatttggagtccatggagtgagcacccagccccctcgggctgcagcgcatgccccaggcaggacaaggaagcgggaggaaggcaggaggctctttggagcaagctttgcaggagggggctgggtgtggggcaggcacctgtgtctgacattcccccctgtgtctcagctatgcccggacctccatcagagccagtctcaccttcaaccgcggcttcaaggctgggaggaacatgcgtcgcaaactctttggggtcttgcggctgaagtgtcacagcctgtttctggatttgcaggtgagcaggctgatggtcagcacagagttcagagttcaggaggtgtgtgcgcaagtatgtgtgtgtgtgtgtgcgcgcgtgcctgcaaggctgatggtgactggctgcacgtaagagtgcacatgtacgcatatacacgtgagcacatacatgtgtgcatgtgtgtacatgaaggcatggcagtgtgtgcacaggtgtgcaagggcacaagtgtgtgcacatgcgaatgcacacctgacatgcatgtgtgttcgtgcacagtcgtgtgggcattcacgtgaggtgcatgcgtgtgggtgtgcagtgtgagtagcatgtgtgcacataacatgtattgaggggtcctcgtgttcaccccgctaggtcctcagcaccagtgccactccttacagggtgagacggggtcccaggccttggtgggctgaggctctgaagctgcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggctgatggtgactggctgcacgtaagagtgcacatgtacgcatatacacgtgagcacatacatgtgtgcatgtgtgtacatgaaggcatggcagtgtgtgcacaggtgtgcaagggcacaagtgtgtgcacatgcgaatgcacacctgacatgcatgtgtgttcgtgcacagtcgtgtgggcattcacgtgaggtgcatgcgtgtgggtgtgcagtgtgagtagcatgtgtgcacataacatgtattgaggggtcctcgtgttcaccccgctaggtcctcagcaccagtgccactccttacagggtgagacggggtcccaggccttggtgggctgaggctctgaagctgcagccctgagggcattgtcccatctgggcatccgcgtccactccctctcctgtgggcttctgtgtccactccccctctcctgtgggcatttacatccactccactccctctctcctgtgggcatccgcgtccactccccctctctgtgggcatctgcgtccacctcccctctctgtgggcatttgcgtccactccctctcctggttccttcctgtcttggccgagcctcgggggcaggcagatgacacagagtcttgactcgcccagggtggttcgcagctgccgggtgagggccaggccggatttcactgggaagagggatagtttcttgtcaaaatgttcctctttcttgttccatctgaatggatgataaagcaaaaagtaaaaacttaaaatcccagagaggtttctaccgtttctcactctttcttggcgactctaggtgaacagcctccagacggtgtgcaccaacatctacaagatcctcctgctgcaggcgtacaggtgagccgccaccaaggggtgcaggcccagcctccagggaccctccgcgctctgctcacctctgacccggggcttcaccttggaactcctgggttttaggggcaaggaatgtcttacgttttcagtggtgctgctgcctgtgcacagttctgttcgcgtggctctgtgcaaagcacctgttctccatctctgggtagtggtaggagccggtgtggccccaggtgtccccactgtgcctgtgcactggccgtgggacgtcatggaggccatcccagggcagcaggggcatggggtaaagagatgtttatggggagtcttagcagaggaggctgggaaggtgtctgaacagtagatgggagatcagatgcccggaggatttggggtctcagcaaagagggccgaggtgggtgcaggtgagggtcgctggccccacccccgggaaggtgcagcagagctgtggctccccacacagcccggccagcacctgtgctctgggcatggctgtgctcctggaacgttccctgtcctggctggtcagggggtgcccctgccaagaatcgacaactttatcacagagggaagggccaatctgtggaggccacagggccagcttctgcctggagtcagggcaggtggtggcacaagcctcggggctgtaccaaagggcagtcgggcaccacaggcccgggcctccacctcaacaggcctcccgagccactgggagctgaatgccaggaggccgaagccctcgccccatgagggctgagaaggagtgtgagcatttgtgttacccagggccgaggctgcgcgaattaccgtgcacacttgatgtgaaatgaggtcgtcgtctatcgtggaaacccagcaagggctcacgggagagttttccattacaaggtcgtaccatgaaaatggtttttaacccgagtgcttgcgccttcatgctctggcagggagggcagagccacagctgcatgttaccgcctttgcaccagctccagaggcttgggaccaggctgtctcagttccagggtgcgtccggctcagaccgccctcctctctgccttctctctctgcctcaaatcttccctcgtttgcatctccctgacgcgtgcctgggccctcgtgcaagctgcttgactcctttccggaaacccttggggtgtgctggatacaggtgccactgaggactggaggtgtctgacactgtggttgaccccagggtccagctggcgtgcttggggcctccttgggccatgatgaggtcagaggagttttcccaggtgaaaactcctgggaaactcccagggccatgtgacctgccacctgctcctcccatattcagctcagtcttgtcctcatttccccaccagggtctctagctccgaggagctcccgtagagggcctgggctcagggcagggcggctgagtttccccacccatgtggggacccttgggtagtcgcttgattgggtagccctgaggaggccgagatgcgatgggccacgggccgtttccaaacacagagtcaggcacgtggaaggcccaggaatccccttccctcgaggcaggagtgggagaacggagagctgggccccgatttcacggcagccaggctgcagtgggcgaggctgtggtggtccacgtggcgctgggggcggggtctgattcaaatccgctggggctcggccttcctggcccgtgctggccgcgcctccacacgggcttggggtggacgccccgacctctagcaggtggctatttctccctttggaagagagcccctcacccatgctaggtgtttccctcctgggtcaggagcgtggccgtgtggcaaccccgggaccttaggcttatttatttgtttaaaaacattctgggcctggcttccgttgttgctaaatggggaaaagacatcccacctcagcagagttactgagaggctgaaaccggggtgctggcttgactggtgtgatctcaggtcattccagaagtggctcaggaagtcagtgagaccaggtacatggggggctcaggcagtgggtgagatgaggtacacggggggctcaggcagtgggtgaggccaggtacatggggggctcaggcactgggtgagatgaggtacacggggggctcaggcagagggtcagaccaggtacacgggggctctgatcacacgcacatatgagcacatgtgcacatgtgctgtttcatggtagccaggtctgtgcacacctgccccaaagtcccaggaagctgagaggccaaagatggaggctgacagggctggcgcggtggctcacacctgtagtcccagcactttgggaggccgaggcgagaggatcccttgagcccaggagtttaagaccagcctgagcaacatagtagaaccccatctctatgaaaaataaaaacaaaaattagctgagcatggtggtgtgcgcctgtagttccaatacttgggaggctgaagtgggaggatcacttgagcccaggaggtggaagctgcagtgagctgagattgcaccactgtactgcagcctgggtgacagagtgagagcccatctcaacaacaacaaagaagactgacaaatgcagtttcttggaaagaaacatttagtaggaacttaacctacacacagaagccaagtcggtgtctcggtgtcagtgagatgagatgatgggtcctcacaccatcaccccagacccagggtttatgcaccacaggggcgggtggctcagaagggatgcgcaggacgttgatatacgatgacatcaaggttgtctgacgaagggcaggattcatgataagtacctgctggtacacaaggaacaatggataaactggaaaccttagaggccttcccggaacaggggctaatcagaagccagcatggggggctggcatccaggatggagctgcttcagcctccacatgcgtgttcatacagatggtgcacagaaacgcagtgtacctgtgcacacacagacacgcagctactcgcacacacaagcacacacacagacatgcatgcatgcatccgtgtgtgtgcacctgtgcccatgaggaaacccatgcatgtgcattcatgcacgcacacaggcaccggtgggcccatgcccacacccacgagcaccgtctgattaggaggcctttcctctgacgctgtccgccatcctctcaggtttcacgcatgtgtgctgcagctcccatttcatcagcaagtttggaagaaccccacatttttcctgcgcgtcatctctgacacggcctccctctgctactccatcctgaaagccaagaacgcaggtatgtgcaggtgcctggcctcagtggcagcagtgcctgcctgctggtgttagtgtgtcaggagactgagtgaatctgggcttaggaagttcttaccccttttcgcatcaggaagtggtttaacccaaccactgtcaggctcgtctgcccgccctctcgtggggtgagcagagcacctgatggaagggacaggagctgtctgggagctgccatccttcccaccttgctctgcctggggaagcgctggggggcctggtctctcctgtttgccccatggtgggatttggggggcctggcctctcctgtttgccctgtggtgggattgggctgtctcccgtccatggcacttagggcccttgtgcaaacccaggccaagggcttaggaggaggccaggcccaggctaccccacccctctcaggagcagaggccgcgtatcaccacgacagagccccgcgccgtcctctgcttcccagtcaccgtcctctgcccctggacactttgtccagcatcagggaggtttctgatccgtctgaaattcaagccatgtcgaacctgcggtcctgagcttaacagcttctactttctgttctttctgtgttgtggaaatttcacctggagaagccgaagaaaacatttctgtcgtgactcctgcggtgcttgggtcgggacagccagagatggagccaccccgcagaccgtcgggtgtgggcagctttccggtgtctcctgggaggggagctgggctgggcctgtgactcctcagcctctgttttcccccagggatgtcgctgggggccaagggcgccgccggccctctgccctccgaggccgtgcagtggctgtgccaccaagcattcctgctcaagctgactcgacaccgtgtcacctacgtgccactcctggggtcactcaggacaggcaagtgtgggtggaggccagtgcgggccccacctgcccaggggtcatccttgaacgccctgtgtggggcgagcagcctcagatgctgctgaagtgcagacgcccccgggcctgaccctgggggcctggagccacgctggcagccctatgtgattaaacgctggtgtccccaggccacggagcctggcagggtccacaacttcttgaacccctgcttcccatctcaggggcgatggctccccacgcttgggagccttctgacccctgacctgtgtcctctcacagcctcttccctggctgctgccctgagctcctggggtcctgagcaagttctctccccgccccgccgctccagcgtcactgggctgcctgtctgctcgccccggtggaggggtgtctgtcccttcactgaggttcccaccagccagggccacgaggtgcaggccctgcctgcccggccacccacacgtcctaggagggttggaggatgccacctctggcctcttctggaacggagtctgattttggccccgcagcccagacgcagctgagtcggaagctcccggggacgacgctgactgccctggaggccgcagccaacccggcactgccctcagacttcaagaccatcctggactgatggccacccgcccacagccaggccgagagcagacaccagcagccctgtcacgccgggctctacgtcccagggagggaggggcggcccacacccaggcccgcaccgctgggagtctgaggcctgagtgagtgtttggccgaggcctgcatgtccggctgaaggctgagtgtccggctgaggcctgagcgagtgtccagccaagggctgagtgtccagcacacctgccgtcttcacttccccacaggctggcgctcggctccaccccagggccagcttttcctcaccaggagcccggcttccactccccacataggaatagtccatccccagattcgccattgttcacccctcgccctgccctcctttgccttccacccccaccatccaggtggagaccctgagaaggaccctgggagctctgggaatttggagtgaccaaaggtgtgccctgtacacaggcgaggaccctgcacctggatgggggtccctgtgggtcaaattggggggaggtgctgtgggagtaaaatactgaatatatgagtttttcagttttgaaaaaaatctcatgtttgaatcctaatgtgcactgcatagacaccactgtatgcaattacagaagcctgtgagtgaacggggtggtggtcagtgcgggcccatggcctggctgtgcatttacggaagtctatgagtgaatggggttgtggtcagtgcgggcccatggcctggctgggcctgggaggtttctgatgctgtgaggcaggaggggaaggagggtaggggatagacagtgggagcccccaccctggaagacataacagtaagtccaggcccgaagggcagcagggatgctgggggcccagcttgggcggcggggatgatggagggcctggccagggtggcagggatgatgggggccccagctggggtggcaggggtgatggggggggctggtctgggtggcggggaagatggggaagcctggctgggccccctcctcccctgcctcccacctgcagccgtggatccggatgtgcttccctggtgcacatcctctgggccatcagctttcatggaggtggggggcaggggcatgacaccatcctgtataaaatccaggattcctcctcctgaacgccccaactcaggttgaaagtcacattccgcctctggccattctcttaagagtagaccaggattctgatctctgaagggtgggtagggtggggcagtggagggtgtggacacaggaggcttcagggtggggctggtgatgctctctcatcctcttatcatctcccagtctcatctctcatcctcttatcatctcccagtctcatctgtcttcctcttatctcccagtctcatctgtcatcctcttaccatctcccagtctcatctcttatcctcttatctcctagtctcatccagacttacctcccagggcgggtgccaggctcgcagtggagctggacatacgtccttcctcaggcagaaggaactggaaggattgcagagaacaggaggggcggctcagagggacgcagtcttggggtgaagaaacagcccctcctcagaagttggcttgggccacacgaaaccgagggccctgcgtgagtggctccagagccttccagcaggtccctggtggggccttatggtatggccgggtcctactgagtgcaccttggacagggcttctggtttgagtgcagcccggacgtgcctggtgtcggggtgggggcttatggccactggatatggcgtcatttattgctgctgcttcagagaatgtctgagtgaccgagcctaatgtgtttatggtgggcccaagtccacagactgtgtcgtaaatgcactctggtgcctggagcccccgtataggagctgtgaggaaggaggggctcttggcagccggcctgggggcgcctttgccctgcaaactggaagggagcggccccgggcgccgtgggcggacgacctcagtgggaggttggacagaacagggcggggactcccaggagcagaggccgctgctcaggcacacctgggtttgaatcacagaccaacaggtcaggccattgttcagctatccatcttctacaaagctccagattcctgtttctccgggtgttttttgttgaaattttactcaggattacttatattttttgctaaagtattagacccttaaaaaaggtatttgctttgatatggcttaactcactaagcacctactttatttgtctgtttttatttattattattattattattagagatggtgtctactctgtcacccaggttgttagtgcagtggcacagtcatggctcgctgtagccgcaaacccccaggctcaagtgatcctccggcctcagcttcccagagtgctgggattacaggtgtgagccactgcccttgcctggcacttttaaaaaccactatgtaaggtcaggtccagtggcttccacacctgtcatcccagtagtttgggaagccgaggcagaaggattgtctgaggccaggagtttgagaccagcatgggtaacataggga

SEQ ID NO: 12198 - DNA, 19818 bp, Human
gaggcggaggttgcagtgagccgagatcgtgccactgcactctagcctgggtgacaaagcaagactccgtcttaaaaaacaaaacaaaacaaaacaaaaaaaagaatagcttgctcactaagggcagttaaaaataggcttcccaccagggccatccatggctcatgcttgtaatcccagcaatttgggaggtagaggtaggattccttgagtcccaggagttcaagaccaggctgggcaacacagtgagactcctatctctatttgttgaaaaacagtaaaaaggtttttttttttttttttttttttgagacggagtttcactcttgttgcccaggctggagtgcaatgacatgatctcacctcactgcaacctccacctcccgggttcaagcgattctcctgcttcagcctcccgagtagctgagattacaggcatgagaagccaggcccccggctaattttgcatttttagtagagacggggtttctccatgttggtcaggctggtctcgaactcccgacctcaggtgatccacccgcctcagcctcccaaagtgctgagattacaggcgtgagccaacgcgcccagccgaaagtttttttttttttaagtagaaacatagtaagccttccagagacttttttttggtcaagtggtctgggatctctccttagagaaactgcctaacaggttgcttcaaggattggagagcgtgtatgcaaaactgctcggcatccaccgggtgctggcaacatctaataacaatatttcccaataataacagtaactattgttactagtaggaataagtcaaattaggaggcgcgatttaggcggaacctggaaggcggtgggcaggatccaggacattccaaggcaggcgtgggcttcctgagccaggagccaaccctccaggagccaggggagggcctggggccggaaggtgcggcgtgcgagcggaggacggaagctcgccgccagggtccccgtccctgccccaagtcgtcaccccctcttggggagcgcaccctggcggaggggcaagtcccacacgggctttgttatgaatgggaagctgcagccttcagcccgcggagggaacagtgcgggtctgggggaatagcaggggacccggcagcaaccagcagacctccccgcagcgctggcagcctgcgcccgggggccgctgccgttcaggcccgcctccaccctcccctccctgccggggcccccggcttcctagggcggccccagcatccgaggcgccctttgccgtcccgtcgccgggtccaagattcccaggatccggagtcccggccgtgcggccagctaagcaaggcgggagggaggaagctggccggcctccgaagtcagccccgagttacatgtgggaagcggtggctgtgacgcaagtttccagggggccctgggctcggctcgaagggagcacaccggagaggctccgctccgtgcagctgcaatggtgaaaaagcagaagccccaagcgcgaaccccaggccgccttccttgctgccgctgcacgcccgacccagccgcgccccctcctccctgcgggccggccgagcgcgcggaccctgctctgggccagtcgctgctggactccgggctgcacgggctgggctccctgcgcggtggctggcctttttttttttttttttgcaacgcttgccaacctgtcagctgatggacctcatcacccatagtggcgcatgtagctcggccgcagctcgctccattcacgccgcgccccgcaagcccgcccgcggcccccggccccctgcgccccgcgagaggcctgcagaccccggttgcagccggtccccgggggcccgcgcccctctcgccccggcctcgcgccgcccggggggcgctgcaaatagtcctttgtttacatgcaattccttactccgcggaaggaggccgggggagtgctgagttttcaccagctgtttcccgccttgaaacagacatctgatcagctgcaaacacacacacacacacacacacacacacacacacacacacacacatacacacgcccggggaggcaggccggagagacctccctcccgcccctcccgcccgcctccctcccctcgccgccgccgccgccgccagcatctgggaccggccgattctgcacctccgtccggcgctgccctttgattcggatttccatcttgcattctccggctgatcgcgggacctggctcgtgcagaggaggggggccgatcgctatggagtatttcatggtgcccactcagaaggtgccctctttgcaacatttcaggaaaacagagaaagaagtgataggagggctctgtaggtgtgtactcctcctccccccacccccttcctaccactgcagcccccggccagcccgcccgggcgggcgcgcgtgtgcgcacgcatggcccgcgccgccgaccccgctagcctttcttagctgccgggacggctgcagccccacacgccgggtccgcgccgccccgggaccctccttccttggagcatgggggccccaagcggccccggccacttttgtccgctgcaggcgggcgagtcgcgacgtttgtaaattgcaaacagacccacgtggttctgcagcagtcccggccatgcttggtgctggtggccttcccccccgcgcttcctctttccccctcctgcggcggcttccttcctctccttccttcctcgggatctgaggtcgtccccatccaagggggtctgggggcccggggcgcgcgtgggggtgtagctagggcggctacaatgcagccatgccgcggctcccggcgcggggtgggggcggggagccgggcactgtgcgtgtttgcagagcggggctgcagcggggtcgggggcgtgctcgcgtgtgggtgttgggggtgggcggaccccgaggggcccgcgcggccggtaggggcgccgcggcccggggcacgttggctgccgctcgctcgcccgcccgcgcccgggcgctgtttactagcgaggcctggacgtgactctgcagccctcttggagtaggcggacctctgcgcgcggcctcgcgggagctgtagttctccgtgtcctgctggtgcagcattgtgggatttgtaggcgctcctgggccacgctttccctgcacaaagctcggcccccgcgggcacgatgggcaaggcaggccaggtgggcaggccatttggggaagggacacctgaggccgcccctagcctcgcagggcagcttcccgccgcacgtgggtttcctctgcaaactttcccatccaacgcccctcccccctgccgtaaaccgaaagcgtcgggtcccccagccgggtgggtggcccgaggtccgcaggcctccccagaagccactttgcaagctttggtcctaggttgctctaaacccaaagggtgatggactcaaggaccacacacagccaaaccaccccgcacacttcttaaaatgcacatgcctggaactctgatcgctggggcccggacatctgcattttgaacgaccccctgggcgtggtgtgggggaggtgggcgttctacggcgtgcgcaagtttgggacctgtggcccctttcctgccgcgctgctccaggagcgaaatggctccccagggctggagccacgtgctctgccgcccgaggcagtctgggcggggattgagggaggaggagcccgccggtgtggcacaggctggtggacgctagcgcctgcagaatccggcctggagggaaggttgctgcacacgtgtagacactcctgcccaaccctctgccccgggggtccccaccttaaggctactctgaagttcccagtcaatacctagacttgggccagttgatgggtttggcagctggcagggatgccccgagggctggcccttgcacgaggcccacctggagggcccagtaataataagtaaaaaaaattcttgagctctttttatgttctggggactcactttgctagaattttctcactgagttgtcataatctttctatgagtcaaaagtgtcttttgattccgcttaaagaggcggacacagagactggagaagggaccactacagcaggtggtggaactggaacttgaacccttgtcctggggttgctgctgctgcagggctgggctgggcagcgcggaggtgcagttgagccgctgtgcctactggagaagacattctgggcctgatcctgggcagggttggggggccctctggctgccatgcctgggccttgggtgagtcctctcagggccccctgagattctggcttcaatttatccctgccccaagcgttcctttggagcataccagcagtcccccagggtagctggatcttggtaggccaaggacttgaaggtgtagggccttcgtccagggttggacatggcaacgtccattgcaagacagttgtcagctgtgcattaggcatggagttgggggtccctggatttgtttaccttcagtaggggttgcagggtgaggtgggaagccagtctgggatcaaatgtgttcattaggcaggaccttctggccagatgcatttgcttctcagggtcatctcaggctggtgggctttgctccatccctcagtgaccagcagggatctccctgtctttctgtctcccaggcctgccagaggggattgtagggcacggtgctgcacacacaagctgcaggttttggacctgtcgcctaatggttctcagtctctgggaaacagagcacctgtgagaaaattagctatgggtatggcaagtgcctggtagctgtaaaaatgacactcagtctttttttttttgagacggagtctcactctgtcacccagaatggagtgcaatcttggctcactgcaacctccgcctcctagattcaaccgactttcctgcctcagcctcccaagtagctgggattacaggcatgtgtcagcatgcctggctaatttttttatttttagtagagatggggtttcaccatagtggttggccaggctggtctcgaacccctgacctcaggtgatctgcccaccttggcctcccaaagtactaggattacaggcatgagcaactgcgcccagccactgagtcttaaaagcaggtatatgggcaggtatatggtagtctccatccatatcttgtgttttgtttgtttgtttgtttgttttgagatggactctcactctgtcgcacaggctggagtgcagtggcgcaatctcggctcactgcaacttctgcctccggggttcaagcaattttcctgcctcagcctcctaagtaactgggactacaggcccgctccaccatggccggctaatttttgtatttttagtacagacggggtttcaccattttggccaggatggtctcgatctcctgatcttatgatctgcccgcctcgtcctcccaaagtgctgtgatttcagacgtgagccaccgtgcccggactctccatctgtatcttttttttttttttttttttttttgaggcagagtctcgctctgtcgcccaggctggagtgcagtggtgcaatctcggctcactgcaagctcggcctcccgggttcacgccattctcctgcctcagcctcccgagtagctgggactacaggcgcccaccaccacgcccggctaattttttgtattttaattagagacaggctttcactgtgttagccaggatggtctcgatctcctgacctcgtgatctgcccacctcggcctcccaaagtgttgggattacaggcgtgagccaccgcgcctggcctctgtctgtatcataaagctcctaggcctggctcggtggctcaagcctgtaatcccagtgctttggaaggccaaggggaaaaaatcatttgagcccaggagttcgagaccagcctgggcaacatagcaagaccccacctctacaaaaaataaaaaaattagcccggcatggtggcatgtgcctgtagtctcagctccttgggaggctgaggcaggaggatggcttgagcctgggaattggagattgcagtgagctatgatcatagcactgcactctagcctgggtaacagagaccctgtctcttaaaaaaaacagtaagactgggtgcagtggctcactcttgtaaccctagcactttgggagaccaaggcgggaggatcacttgagcccaggagttcgagaccagcctcagcaacatgacgaaaccctgtttctactaaaaatacaaaaaactagccgggtgtgaatggtgtgcacttatactcccagttgcttgggaggctgaggaaggaggacgacctgggcccaagaagttgaggctacagtaagccgagatcatgccattgcactccagcttgggtgacgggagtgagaccctgcctctaaataaataaataaaaataaattaaaaaaataataaaacttaaaaagctcccataagaaggagttcaagaaaattgaaggctttggagtgtttattgggtccctgatttatttatgaagcaacaacattctgccgggactgaggatacagccacgaacaggatgtgactcctgtcctcagcagctcacagccttgtggtcttaaaaggtcttgtagaccccctaagagtttcatgggttgtcctggacacctgggtgcaaactaactcttgggcctcgacctcccgagtagctgggattacagacacgtcccacaacacccggctaatttttgtatttttagtagagagggggtttcaccatcttggcctggctggtctgaaacttctgacctcaggtgatctgcccaccttagcctcccaaagtgctgggattacaggcatgagccaccgtgcctggcctttcttgatctcttttaaacttcaccatgaccctgtgaagtgaagcagtgtttccatattttacagacggaggaaaccgaggcttggtgttgcacagctagtaagtggcaaggctggactttttcacttgagcccagtgcagggttcccactgatgggctggaggagctttggggaagggagggaggcagggatgtttctgatggcaacagcctgggcatggtgtgttctgggaccgaggggaagggcagcagactggccaggtcagagtacagagtatgggtgagtagtgtagaagcagcggggatggagcatggatgagaacctcgggctgattaggttagagaaggatgagtgccttagtgcttttttgggtttgggagaatcccgtgtggactttcccacgttgactgtgtagatgttaagtgaccctgaggtatgtgagtgacttcagggcagtgtgaaatgaaagttctcagtggccggtttgaggctggagctgggcaggcaggtgtagagggattgggggtacttgactttggcctgggcaggagggataggtacctggcagggttctagacttgaagggcatgccctatgcctccaagtgtctggttgggacgccagcgtcagtctcagcagattctgtgggtgctgtggtggtaggtgtggcggctcttgccttagcatccaaggctggtgcccaaattttgttccttggccattggctgctcagtgaccttattcctaaatctagggcagcccctgtttggacccaggaggctggcttgcaagaagcaagagagccttggtgtggctgggcatggtggctcatgcctataatcccagcactttgggaggccgaggcggatggatcatttgaggtcaacagttcgagaccagcctgaccaacatggtgaaaccccatctctactaaaaatacaaaaattagccgggcgtggtggtgggtccctgtaatcccagctactcgggaggctgaggcatgagaattgcttgaactcgggaggtagaaattgcagtgagctgagattgtgctactgcactctagcctgggcaacagagcgagactccatctcaaccccccctccgccccccataattagccaggcttggtggatcacgcctgtaatcccagttatttgggaggctgaggcatgaaaatcgcttgaacccgggaggtagagattgcagtgagccaagattgtgccactgcactccagcctgggcaatagagcgagactcagtcaaaagaaaaaagagaacctcggtgttggtggacttgggtcacctttgattttcacctggaggagtctgaagtggccagagagaggatagtggacctttactgtgtgtgtaggacgtttacagaccttaaccgtaaatgcaaaaccccagaaagagctatcagaaactttcaggcatttgcagaaaaatccactttattcagtgcagtatcacctggaaatttcaatcaaccatccttcatcaacaggaacccctggttggtcagccatcagaagccctggttggtcagcattccaccaataagaattcctggttagcggcactccaccaatcacaacccctggttagctcctattccaccaatcagaagccttggttagaatgcattctattaaaggactctgtcggcgggtacttccagggcaatttaggtgagttatatttgagggtcttggtggcagattcaggtcccacgaggaactgtaccttttggggggaaatttgctttcttggatttaagaaagtgcttaacctaagttaagcactaggttagccagcagctggtttctgagccaggagactgggctgatggctttggagaggaaggaggcaggatggagcattggagaagctgggccggcagattctgatgcagaggaggaggcgacacaggcccctgatcccagccccagctcctcttccttgtgagaacttccggctggggttttcgggactggggtctggtggtctcctttggtctcccagttagtgggctgccttgcggggaagggacggaagaggctgagggtcagctcccaagagcagaggagttggtgggacttgggccgggaggtgcagaagggtgcatctggctgcaccctgccctgcccagctgctgggtgtgaccttgggcaagtcacctcacttgtgggcttgtgttcagaggggcaggggtgatggctgagcttgcagtcacacacccgcttctgataagtggcgggctgtgtgaactagcagtcagtagaggcgcttcagtgggttggcatctgcaggttgctgttgtgccaggtctggctacttgaccttgggatcatcaccttccttcccacgaccctgcattgcttgctcactgtaatctcggccaccccactgggttttgtgagaatcaggcagggaaaaatgtcaacgaggtctgtgaataataaaaagagttacacgattacagcgatttccgaatgcctggtcctttttttttttttttttttttttttttgagacaaggtctcactctgttgcccaggctggagtacagtgacatgatcacagctcactgcagcctcaacctcctgggcttattacatcctcccaccttagcctcctcagttgctggaacaatagggacactccaccatgcctggctgattaattttttctagtgatggggtctcactatgttgcccaggctggtcttgaactctggggctcaagcgatcctcctactttggcctcccaaagtgctaggattataggtgtgagccactgtgcccggcctagtcttctcttttacagggataactgtcacctgccagttggggcatctggctctgtgggccggtcagagctcattctgccctatggcctgacacctgctctggggtcagggttcacgcccagcgcttgctgcagctggaccctacccaaacctctgtgcccccctctttacatgggagtcttcaggccacctgactcaggaacattgtgacaattcagtgagaaaattctcgccaaaaacttaaaaaaaaaaatgtatccctctgttgtggaccctccaggagggccagctctcaggtggcccaaggctggacttggtgctcccttttcaccccctagtcagctctggcttttgggcattgccaggagggacccaggggctgggtgggcaggggtctctccccacatctctcctgagggggatggtgatgcctcaagattgcacttaccttgtgttgtggcttcctatggacatctcttcccacctcttacctccaaagagccccagctttaagccacccactgcagagcagtcctggtccccttggcctgctggcctctcagacatggtatggtctgagtttgtgccaggcctgggagcctggactccgccctaaggctgggccacacacagccgtgcagcaggcctgctccagtccccctatcacctccacttcagggcaggggaaccgggagaagtgagagcactgacatccagctgaccgaccctaaaaccatcccctctctgccctgcaccctaaagtctcatggaaagtggggggcccgggccccttttgcagtgctgacatttcaagaccctgtaagagacttgtaccctgggtgcaggccctgggcctttgggtcctgatggaggagggggcttggcttgatgaggacggaaggaggctgatttgcatccagacttccggcgttggacacctctctattgggagaggaagccgaggccggggaaggggcagcgatgcgtccagggtcccacagggagccaaggctggacagatgggcaggctgggtggggccaggaaggccacggctgtttccagctgttgcagatgtgctgcctccggggtccgtgcaaactcctttccgcctgcaggctggcgaaggggccagggcacacagcaggggagttagacttggcagccccttgaccccagactgccttcatcaatggagcaggagctgcccagaacccttttcctgttctcccacattcaggggcatgagcccccttggcccagtcctggaacagggcaccccgggagggcccctcaggaagaggccggggctgcggcttcgggtggggccggcagcctctgctgagagcccagcatctggaagccatcaggccaggggcggggggagttgcaggggaggtccagggagggggacatgcctcctccaggccacacacaagcccaaccctcgggagcgtggccttgggcccacaaccgctgcctctgcaccctggcccgcagccccgccccctggcgcacacgccccgccctcgtccgaagccacgcccccagccagcagccacgccctcttcccccaggctgccttctcaccgcactggccactgctcctgcaagggtcagcagcgctccccacagcatggtgggagcctcgcttctccggcgcagggtgggtctatctcttggagtgggtgggctgtggggagccgtgtccccaggggttgttggcttggtgtctttttggggagtgagtggtacttgtcttctgtgaagtcttagcctagcggggctggggcttgtggtgggaggcgtggccgtgagggtaggaagggagtggggacgtcttcctcagtcctggggtggcaaagcctgagacgctgaagaggcgctccaggtgcctagcaaatcactcagaagtgttccaggagcggggacagcgtccctgaatgtcgtctgcatcccgcgtgcatcagaatcacaccacgcacgtttctgggccccaccgggcctgctagtcagacgctggggccagcacccgtcgtctgcatagtttctaagctcttggatgttttgatgctcagacacactgggaattctgttccggaggagagactgctccctgtgaggaaagccagggaggggatgggtttttgttgttgttgttgagacaaggtcttgctctgttgcccagactgaagtgcagtggcgtgatcatagctcactgcagcctccaactcctgggctcaagcgatcctcccacttcagcctcctgagtagctgggactacaggcatgcaccaccacacctggctaattttatttttttgtagagacagggtctcactacgttgcctaggctgatctcaaactcttaggctcaatgatccttggccttgacctcccaaagaactgggattactgtgcctggcccggggtgggttctgagcggactatcttacccgcagccagctgattcagtccgccccggtgtcccagagagcacccctccatcactctctgggggtggcctggcatcttttgcagcaggggagggatgcagtttccactggggccctctggagatgaatgatgaagagggcgccttggccgagcctgtccctgtcctctctggcagccttgccaacattccactaacccccgagactcagcgggaccaggagcggcggattcggcgggagatcgccaacagcaacgagcggagacgcatgcagagcatcaacgcgggattccagtccctcaagaccctcatcccccacacagacggagagaagctcagcaaggtgggtgagagcagggagggcttcctggaggagccggcaggttcccgctgggagaggaaagtgagctctggtaaacactgccagcctgactctcggcttttccacgccctcaggcagccattctccagcagacagccgagtacatcttctccctggagcaggagaagaccaggctcttgcagcagaacacacagctcaagcgcttcatccaggtgcgccctgtccttcatggctccctctccctggcatgggcatgccttggacccagccatgggcctgggactcaggtgtggctgcaggccccttcttgcccactgacaagtacttccaggcactttttttcctgccccggcctcagtttccccatcggtcaagtgcggtggagtgggctctggaaggagccaggtgactgttatgtaaagcagcccattctcctggcatttggctggtttgttggacttgcagaaggggctccctaatgaagattcacctgtgttgggcagctttggggggctgcgatggaaccccaatctccgtggtggtaccgaggtgtcaggcacactgaccgactccttggggtccccaggagctgagcggctcgtcccccaagcgacggcgggcagaggacaaggacgaaggcataggctccccggacatctgggaggacgagaaggcggaggacctgcggcgggagatgattgagctgcggcagcagctggacaaggagcgctcggtgcgcatgatgctggaggagcaggtgaggcagcgccctctgctgggcacggcgcgcggtgcagagggcgtggagcctggggtcgcgcctcttgctctgcggccctcggtggagccctatttacaggagcacctactgcggtgccaggcctaggagtggggagcaagccagacacgtctctgcccttgggggccaccgtctgcgttggggtgggggagattagccaaaggatctcaaaaatgtaaccatgctgtgggaggccgaggcgggtggatcacctgaggtcagcagatcgataccatcctggctaacacggtgaaaccccgtctctactaaaaatacaaaaaaaaaaaaaattagccgggcgtggtggtgggtgcctgtagtccccgctgtttgggaggctgaggcaggagaatggcgtgaacctgggaggcagagcttgcagtgagccgagatcgtgccactgcactccagtctgggagacagagcgagactccatctcaaaaaaaaaaaaatgtaaccgtgatgggctgggtatggtggctcacacctataatcccagcactttgcggggctgaggtgggaggatcgcttgagcccaggagtttgagatcagcctgggaagcatagtgagactctgtctctaccaaaaaagatacaaaaattagccaggtgtggtggggtgtgcctgtagtcccggttactcaggaggctgagctgggaggattgcttgagcccaggaggtggaggctgcagtgagccatgattgtgccactacactgcagcctgagtgacagaaggagaccatggctcaaaaaaaccaaaaaacaaaaacaaaaaaccatattgaaggccaggctggagctgtggcatcaggaggggtttttcaagggacgccccacggcttctccatggaagtgggaagttgagtctcatagttaaccaaaggacagagaaaggtgttcccggcagagggaatagcataggcaaagactcgggcaggagggagcatggtccagtggaggccgaggtgggaggcgagaggagccgggggctgaagggctctggaaaggcttctggcctctgttgaggggggcccgccctgtgctagggttttcagcaggagtgaatgagctgctgtgagactgacagggcagggtgtgctcccggccttggccctgagcccaggttgtcctgcctccaggtgcgctcgctggaggcccacatgtacccggaaaagctcaaggtgattgcgcagcaggtgcagctgcagcagcagcaggaacaggtgaggctgctgcaccaggagaagctggagcgggaacagcagcagctgcggacccaggtgagcaggaggcgcccgggagtgggctctggggaccgggaaggggacaggtgatcttgaatggcggaagcctctccctaggccacgtcctctctgcttcttaatataaaggggcagaggcagttatacattggccagctctgcatgaaagggaggtggatgggccaagagaagccttgagagaaaggctgagggcctctgtcttgcagcttctgccccctccggcccccacccaccaccccacggtgatcgtgccagcaccgcctcctcctccctcccaccacatcaatgtcgtcaccatgggcccctcctcggtcatcaactctgtttccacatcccggcaaaatctggacaccatcgtgcaggtacctgagcttgagaaaggggcagcttgtgggggtcatactccgggaacaggctctttaggggagactggaaaagaggggcagaagcggaggaagatggtgcttgtgtgggaaggggtggagggctggaagccttggggggccccgtccctggatctgcaagtggagaatgtgagggccagagatcggggcagggcctaccacgccagtaggaggagttggccaggaagactgtcccttccctcaatatggggtttccggagagggtcctttgctcccagagccccctggttacagagttcctgcatccagctcttgggttggtccggaacattgtctcagctccatctcctaggacctggatggagatacaggtggcagggctggtgatagttgggcctcctacagaggaggaagctttgtgggtcaagcctgaagttacagttgcattcacccttgaacagggccccttgaggagcccaagatcagaaatcagtaaataataaataaataaccaaaaaagccaaaacaggaaaaaaaatccatcaatctcctcgaattttaattgctcataaactttgcaaattgtgtaatacaattaataacaaacgcctttaataagttaataggcaagctttaaaatacataaacatatggccgggtgtggtggctcacacctgcaatcccagcactttgggaggccaaagtgggtggatcacttgaggtcaggagttcgagaccagcctggccaacatggtgaaaaccccatctctattaaaaatacaaaaattagcctgacgtggtggtgcacgcctgtaatcccagctattcgggaggctgaggcaggagaatcgcttgaacatgggaggtggaagttgcagtgagctgagattgcaccactgaactccagcctgggtgacacggtgagactctttctcaaaaaacaaacaaacaaaaacatatgaaaggtccatattatttctttttttttctttttttttgagatagagtttcgctcttattgcccaggctggagtgcaatggtgctatctcagctcatcgcaacctcctcctcccaggttcaagtgattctcctgcctcagcctcccaagtagctgggattataggcatgtgccaccacgcctggcaaattttgtatttttagtaggcttctggcctctgttgaggggctggtctcgaactcctgacgtcaggtgatcctcccgtcttggcctcccaaagtgttgggattacaggcgtgagccactgcgcctggctgatacatataatataatttctaagcagcactgggactgtcatcttcccagaatggatttttcaacttaacagaggggttttgaaagtttgttcctgggtcaggcgtggtggcttatgcctgtaatcccgggacttttggaggttgaggcaggaagattgcctgaggtcaggagttcgagatcagcttgggcaacatagcaagaaccccctcgtctctaccaaaaatacagaagttagctggggatggtggcgcacccctgtggttccagctactagggagggagcagtaggaggatcgctggagcccaggagtctgactgcagtaagctatgatcatgccactgcactctagcctgggtgatatagcgagagcttgtctccaaaaaaaaagtaaaaggagtttgtttttcctgtactctagcgggcctcccctgctgctttgccaggcttttttctgggctatgtgttttgggggtgacagtggctggctgagagcccccactgtctcctggctggccatgtatccccggccgagccttctcagtggttcgtccctgtccaggcaatccagcacatcgagggcacccaggaaaagcaggagctggaggaggagcagcggcgagctgtcatcgtgaagcctgtccgcagctgcccggaggcccccacctctgacaccgcctccgactccgaggcctcagacagtgacgccatggaccagagccgggaggagccgtcgggggacggggagcttccctgactacccccccagccctcctctcccttctgggggctggagggagccggggcagccacagggagagacatgggcgaatgagtgagaaatttttacaaaattacgatgtcatttgggtctcttttatgacctctttttcaatactgtaaatcgacctttgaacgaagccactcaacccgaggtcccggggctggggtgtcgcagagcgtgtgggagcatcggcaccccagggcggggcctcggccccgggggctggaggaagctgacacggagatgcctggcctctctctgccaaaaagcattttttcctttaaatatgttttttaagaacagggaaaattaaacaaaaccccaggttatttcttccctgcccagagccagcctgggattgtcagccttcaatcccctttccttcctctttttgggttttcttctttctcctttaagcacttacatggttgggggtaagactaggctggggcattctgggggcccggaggtctccgttgcttcttggttggggtttgctgctgctgtgcccccctcccccttccccatctcggcactagaattcgccactctcccaccccccagcccccacctctgcctccaggtctcatcttccaccccaaaaatgtctgtctctctctttttgttttgtttgttgttggttttttatttctttttggtttgctttctgtttttgttttgtttttcttttttttctttctttttttttttttttacaattttgaggtcttcgtgttcaaggagaagctattatattttgttaagaaagtggggagaaaaaaaccaagaggccaccgtgcctttgtaaagaaacaaaataaagtttgtactttgttttttagattctgagtctcctgggtgtgggctggcctgaagaccagggcagggctaccccatctagagtaggggggctccttgggccccccaaagcggactgggtgtgtgtgagcacagttactccctcagcttgtgtgtggtgttgcgatgaaaaattggggtcctcagtttccctgggatgaccctgggtattctgtaaagatggaagatggtgttgaggctggggagtggctctttggtgggcggcaaggagagaaggacaaccaagccaccgattccgaaaacctgggaaaggacacaggtgttcaggggccctgcttggtccctacgctttggttaatccctaggttttgccacttcctgggcttctgtaacttctctgagcctcatcctctcctcccctaggaggggaaccccaccccctccaaccgcacccccccagcacccccctgcccccccgtggtgtggtgtttaagtgctaagatcctggaattggtctgccagaggtcagttccccctctgacaaaccgcttcctctgagcctcaatttcttcttctaaaaattggcgataataacggcacaaggacattgcatcctattggggattggcatggtcctttatttcgagacagagtctctgtctcccagtctggagtgcagtggcgtgatctcggctcactgcatcctctatctcctgggttcaagcaatcttcttgcctcagcctctcaagtagctgggactacgggagtgcaccaccatgcccagctaatttttgtatttttagtagagacagggtttcaccatgttgaccaggctggtcttgaactcctgacctcaagtgatccgcctacctcggcctcccaaagttctgggattaaagggatgagccaccatgcctggctatttttaaatttttattattattttttggtgtgagatggggtcctgctctgtcgcccaggctgcagtgcagtgttttgatcacagttcactgcatccttgacctcctggtctcaagtgatcctcccacctcagcctccctagtagctaggactacaggcctgtaccacaaagcctggctaatttttttttttttttttttttttgagatggagtcttgctgtgtcacccaggctggaatgcaatggcacgatcttggctcactggaacctctgcctcacaggttcaagcgattctcctgcctcaacctcctgagtagctgggactacaggcacccaccatcatgcccagctaatttttgtattgttagtagagatggggtttcaccatgttggccaggctggtcttgaactcctgacctcaggtgatccacccaccttggcctcccaaagtcctgggattacaggtgtgagccaccgtgcctggcctgggcccggctgacttttttatattttattgtagaggcagggttttgccatgttgcccaggctaggccatggtcctttaaatccttcactcttccgtgaccagagatcgatttacaccgtggtcccctcctatgcctcatgctcacagtgctgggtgcttggggactgaggccagagcagaaggcagaatcacagctcaccccacgatgacagtggacacgaactcttcacagaaaggcaggagtctgcaggttttcttggaattttacagtgaacaattcaatggcacttcatacattcacagtgttacacagcctacctggttccaaaacatgtccgtcactccaaaatgactccatgaagcagtcactccttccccctcctcccagtctccagcaaccacctgctttctggttttaatatcttttttaaaaaattaaagtagttggctgggcgtggtggctcacacctgtaatcccagcactttgggaggccgaggcgggtggatcacatgaggtcaggagttcaagaccagcctggccaacatggtgaaaccccaactctactaaaatacaaaaattaggctgggcacagtagtggttcacgcctgtaa

SEQ ID NO: 12199 - DNA, 109038 bp, Human
  misc_feature (1)...(109038): n = A,T,C or G
tgtttcttaaataccaaaacacaggagaaaatggattagatgaagcagaatggagggcctcagttctattcacaatgtagtgggggctcaaaaggagaaagttttttgttttttttttccttcctagttgtcacttagcagcttcaggaggaatccctcttttagggtcttttttcgttttgacttttgggggcttggatttaatgagcatgtctccttgccttgcacagtaggtccagaaaggtatctttaagatcttgaaagtgaaacttgtcgggtattgctatgaaatctgccacaaatgcatcttcctggtgctcttagatatgaaaaatagaaatacgattaatcacctaacagtccacaggagcctctatatctgatatcctgttaaagaaacagcccagcacagtgacaggctctagaaacctagatgcacccctgaccaaatgataaccagattgcagttgccattgtgggcaatttcccagggattcagcccttgaccagtgcttcccaacctttttcagaataaagatccatttttaacatcaaaattgtgtgagaccccacagagagtagttgtgcctttattattaacgtaaattatattaaatgagttaataaacataatggtcaaaagctgctatgagaactcagtgacactttaaaatgaatttgtattttatcaatcacaatagaatttacataataatatgaactaacacttatagagtactccctatatgctgggtgctgctccatttagctttatttatttctacaacaactctaagaagaaggtactactattagctccattttacagttggcaaaattgaggcacagagaagttaagtaacttgcccaaggtcacctagttagaaagtggcagagctgggatttaaacccaggtaactggctgcagaattctaagcacttcaccactatgcttcaaaaacatacacacacacagatacacatacatctcactcagaccacaggtgttatttgaggggagatttacaaacactttgcattaaataactgtgtgactctttttcttccccttccccaagacagattggaaaccactttcttgggtttttaacccttcatttcattaaaatttagacatacagcttaaagccaggtatgtgtgtgtataactatatgtgtgaatgtgcacatgtatacatatataccaatgcacatgtgagtatatgcatgtatgtatatataagcttttatttttatcttatcacaaaactatggaatcttctgtgtgtgtgtgtgtgtgtgtgtgtgtgtgtgtgtatgtatgtatgtatgtgtgtatatatatatatatatatatatatatatatttgttttgttttgtttttggttttggtacagagtcttgctctgttgcccaggctggagtgcagtgacgctatctcagctcactgcaacttccacctcctgggctcaagtaatcctcccaactcagcctcccaagtagctgggactacaggcacatgccaccacacaggctaatttttgtgtttttttagaggtgagtttttgccatgttgcccaggttcatctcgaactcctgagctcaagtgatccacccacctcggcctcccagtgttgggattacaggcatgagtccccgtgcccagcctgtatacattttcttccactcaacaaacactgacttgtttcctgtgatggactttgttctgtggtgtctaggttcttattattgtaaatgtttttgcacaaacctggtcacaaatagatgtttcctaaaagagtcttttcgtgaattgactgaagatgactgtgtcagtaggcttatgaagcacaggggattgaacctgtcagactccaaagtcacaaagtcagtggggatgaaaacgcagtcttccctctccttagcttgattctgtgcacagagctcaccatctgctagccaccttgggtgtatgtccaaggacggggcctctaggtcagagcaaatggatcgcttgatttccgcttctcattaacatgtgaggaaatcatgcctttttattatttaaatttggcttgatgaaaagttgcctacaaataaaaactgtaagtatttgatagcacggtggttaaagtcaggagccagatgacctagatttaaagcttaactgtgccccctggggactatgaccttaggcaagtttctttttttttttttattattattattatactttaggttttagggtacatgtgcgcaacgtgcaggtttgttacatatgtattcatgtgccatgttggtgtgctgcacccattaactcgtcatttacattaggtatatctcctaatgctatccctcccccctccccccacctcacaacaggccccggtgtgtgatgttccccttcctgtgtccatgtgttctcattgttcaattcccacctatgagtgagaacatgcggtgtttggttttttgtccttgtgatagtttgctgagaacgatggtttccagcttcatccatgtccctacaaaggacatgaactcatcattttttatggctgcacagtgttccatggtgtatatgtgccacatcttcttaatccagtctatcattgttggacatttgggttggttccaagtctttgctattgtgaatagtgctgcaataaacatacgtgtgcatgtgtctttatagcagcatgatttataatcctttgtgtatataaccagtaatgggatggctgggtcaannnnnnnnnnnnnnnnnnnnnnnnnnnnnnnnnnnnnnnnnnnnnnnnnnnnnnnnnnnnnnnnnnnnnnnnnnnnnnnnnnnnncccattaactcgtcatttacattaggtatatctcctaatgctatccctcccccctccccccacctcacaacaggccccggtgtgtgatgttccccttcctgtgtccatgtgttctcattgttcaattcccacctatgagtgagaacatgcggtgtttggttttttgtccttgtgatagtttgctgagaacgatggtttccagcttcatccatgtccctacaaaggacatgaactcatcattttttatggctgcacagtgttccatggtgtatatgtgccacatcttcttaatccagtctatcattgttggacatttgggttggttccaagtctttgctattgtgaatagtgctgcaataaacatacgtgtgcatgtgtctttatagcagcatgatttataatcctttgtgtatataaccagtaatgggatggctgggtcaaatggtatttctagttctagatccctgaggaattcccacactgacttccacaatggttgaactagttccgtttcttaaccactctgtgcctccgtcccccatctgtaatgtggagataacagcagaacctaccccacagggtctccgtgagaatgaaatgagagaatatacgtaaagcacttagaacagggcgaggcttacataggacacaggtaagtcctatgtaagtatttgttataattcttttcatttagatttacaaagacagaaagcaataacattcaagtaagaaatggtatctgaaataccaagatggcctgagccaattgatggcagagacatgatttgagcttaaagtcataagggccatgacaggatcaatcgcataactcaacactaaggagttatttttgacacttaaagaacagatcagctgggtgtggtggctcacacctgtaatcccagcactttgggaggccaaggtagcagatcactcgaggtcaggagttcaagaccagcctggccaacatggtaaaatcccgtcttagccaggcatggtgactcacacctgtaatcccagctactcgggaggctgaggcatgagaaccacttgaacccgggaagcgaaggttgcagtgagcctagatcatgccattgcactccagcctgggcaatagagtgagactccatctcaaaaacaaaaacaaaaacaaacaaacaaaaacagatcaaaggaagccacactttggctgttgggaagtagggtcatggaacccgctattccagtagatgccaaaacactgagctttacttttagaattacagcacccaaagcagagaaaacacaccccctcggtgctttcctttacttatgggagacgtggaatgctttgcactattccagcaacaagattcaggaggaacatcgataaattggagggaaccaccagggctgctgtgtggaaaggctgaaggccagagaagcagaggcacaggagggcagaagaggaaggcaaaggaaggtctcagctccctgcaagtgcccagaacctgccacacaagcacagaggtgaaaacggcaggaccatttgcttgaggaagtcatgttctcacttgctcgcttgctccacagaagcccttttcacactgttctttaaaatacaaacaggttgctctcctttggtgtgaaaggttcagggagaggtgatgatcacagatggagactattcatagcactttatgtgagaaaagttagcgcctaatttcccttttgatgctaatgctgtaagaattgaagtgagagtacaggttagaaatgtataaagatggaaaataattagctcattaaatggagagtatacctaattggggaactagagctatttgagtttaaattctttaccatctgggggacaacgtggaagaaaatcatacctgctcaaaaaaagaaaaagagagttcttcggtaccctggagtaacagggtattattatactgaagggctctttggcccaatttaagttgactttctctctttcttgtttaagcatttttgtgagtgagcaggagggcttactgcagagggctgtactgggcatcagagatgaaccaaggacagtcattgcccttgggttcttctcagtggtgaaggtgacaaatagaactgcaaaccattgcctgaattaaatgactgtctgccagacttgtgaacaaaatggtgttaggaaggatgcaggctgtcctctcttgagggcactgaagaagtttccctggaggagaaaaaaaaaaaaaaaattgcaagcaaagagcactttaaaaattttttctttaaaatttttttgaccaaaaaatatatgtggtgtacatgttccaatataagtatacattagggaatggctaaatcaagctaattaacatatgcaggagttcatgtacttaagaccctcatcgcataacaaatacaaaaatcgactcaaaatggatgaagacttaaaagtaagatctgaaactgtgaaactactagaagaaaacagagaaagagctccataacatcagtctctgcaattttttttttttttttggagatggccctaaaagcacaggcaacaaaaacaaaatagagaaaaggattacacccaattaaaatgcttctgcacagccaaggaaacaatcaacagtgtgaagagacaacctatggaatgggagaaaatatttgcaagccatccatctgataagggggcttatatggaagcctacacaaggagttcctgtataaagaactcaaatggctcagagcaagggtgcccagggccagctcttctaggagagagagcccctttgatttaggatacagtggaggtagcaccagacagtctgttttactgcactgggagaaggagctgagttgagcagttcttcctccctactggtcacgtttcaagtcaaaatgatcaaccttggtagagtgttggtactacagggctattcaaatagttgctcttggaaaaaaagtagtactaactcatttagccacaagaattctccaaaagtacattttgccattaagactacaagttaacttttttttttttaaactctgcttaagtagtatcactttgtgagtgaatgtagcccctgaaccaggatgttgtttggggagagagctttgatgataccaatattttaaaatatcagtgtatttttattggtgttcaaaggctgatactattaaaaatctggaccagagaggattctcagttaatatttttgtttttaagtaaaagagttcctgatgcccaggccacttgcatgtggtacctccttgaagaggatatcccgagaagcctctggcagctctgtctagaactgcatcgtccaatatggcagccacatgcagctgtggagtgcttgacacatggctagttccaatggagatgtgttgaaaatagataccatataccatatagtgaagacttagtacattaaaactgaatatcttatcgataaatgtttgtattgcttgtttattgaagtaacactattttgaccttatttggttaaattaaatacattattcaaatcaatttcacctttttatcctaaaggtggctactagaatatatagaattacttatgcggcttatgtttatttcacagttttagaaccttgcgacacatttgttttcactcacatcctttccttcaatcctgggtttctccctaaacgccagccccagggtcatccttcctcagtctcaccccaatattgtgctgcagccagctgttgagtgctttctcatgtccctgtacttgtgaaaatgctctgcatacggatgaacccctagtgcaatgtctgacacaatagatacaaaataaaagttgagtaaataagtgaatactagctctctgtagctcacctatttctttataaagaaacgaagtacagaaagttaatatggcatcgaggttacttctaaaagtgtggaccataggctgttggcataagaatcacccagaacgcttgtaaaaattaagatttactccagactaaaaggttcagtcaggagatgttaggttatgctgcagtgacaaaatttcactggcttaacagcaggtttaactctcggtcactctgtgtccactgcgggccctgggatactccccaggaaaactgatagttcaggttagacctccatatcagcaagtgggatccatcagcaagctgggtactcccgcctagttatgcgttacttgtcagtgctcacatttcattctctgaaacaactcatatggccatacctagctccaaggagaccgggaaggcctctatatacctagaaatagaggtgagtgtacactggtaagcaatgggaatgtctgcttcataggccaaatgcaaatctcagaggtagggcctggggatctgcatttttaactcccctagtgattcatattcactgtaagtttgaggaccattgagtagaactagagttctcaactatggctgcacgttagaattacctggggagttttaaaaacactagtgtcctggccccaccccagagattctaatttacagggcctggggatggcatccaggcatcagtaatttttaaaacctcccccagagattctagtatgcagccagggttgaaaaccacaagtgtaggggaaaaagagggaaggactcttgaatcctgactctaacacagaccgaatctggttttgcatgtctgttgaaggcagtaaagatcaaatgaatgtgaaagcatttgtcaactataatatagaacaaatactggccattatacactggcaggtgtggacttttatgcaaactagatctgtgcaagctgtcatatatgtatgacatgatctcactgccacacacaaaaccaggagaggaggggcagcatccaccacacctttgcacctgccaccttttacagtcagtaaatgggtggtcccttctacctcccctcccctccacttaacttgatgataaaggggataaagagaagaaaaaactcattccttgtcttgatttttttctctccagcctgttccaaaacccttagcccaagccccgttgcccttactctctgttaatctgaaactggtgcctcaaacctctggtcctctgcaacctcatctcctcctcttcctgcagcctatttcccacctgccaccctagtcccatgccaggaaaggcagggccctgggggagccccaagcctgctggctgatggtttgaacagcataaggaatccatattctcagaaaatttgtgcccaacattgtccctggtggtattgttaagaatggcagatttagcagcactctgtttaagaggtgaggtatgcaataggtaagaccagcttttatgagctgctccagctctttcacccactttttgtaatattctgtttcctgtggattctgagatctcaccaaatgatttacaaacaagctcttggaatgctactgttatgtaaactggaaattgtaccaacagtcagttttctttggttataaaaataccacattggctttcttccattggcagagctaagagttaatgctggaataagctgtttttagttatttttcctcttgtatctaacaattttcaaggcagaacaatgcaagagtacctcaagtaaataactgtaacaccttttgtgaaaatacagatttgcgcatttgatatgaattagctttaaaaaatgatggaaagaattgcttagcctggatagctgtgacataggttctgtaaaatgattcttactggtcaggctgacatggccaaggttcttggcagtggaagttttatgtcaagcagcagatcacaggccaccactgtcttttcaaaacctggaggccactttctcttatcctacccaccagcctggccctcctttctacagctggttcttaatcagaagttagcagggctgggatgcaatgtgcccaaaggagaagatgctcaaggacctcagctccttgtaggcagtgaccactggtgcaggcttttcttatttcagtgcctcccatatagtaggtgaagaaagtgcttttcattattttgtgcatggggttaggtctggttgtggaccttggagattcactgaattgaacagaaatgcttagcaatcttaaaatgagcctcctaagttaagatctatgtcatatactttgttgcaaagaaaatagttaaaaatgtgtgtaagcttctggtttaaatggcaaacccaatactgcatctctcatatcaacagctacaagaacatacatagtaacatactctcagagtaaagtccaagctctccattgccctgcagagctctgccgggtgcaacacccattcccactccatctgtagctcatacgtctttcttccttactttctatgctccggttccctggtctcctttctttttcccagatgtatcatgtccttctctaacttctaggctttgcacttgctcctccttctgcctggaatgctctttccccagtttttccagtggctgactcattcatgtccttcgggtctcagatgtgcttcaccatttcagagaagttttccctgcatggtgattctggcagtagctcttcatcacatctctgtgcatttccttagtagcacccagtgctgtctataatgatttcgtttgtttatttacttatttgcctgcctcccccattagacttaagttccttgagggcagggaccttgtctgtctagttaattaatggatccccagtacccagcacagtgcatgacgcatacaagacacttgatattttgttgagtgagtaaatgaatgaaggaagtaaagaaggaaggaacactatgcaccataccaagtgctttatatcacccattttgcctttataacattccctattgattcatggggaaactgagccccagagagtttcagtgacttgcccaaggtcagaattagtaagtcacaaagagccaatatttgctctcaggtttgtctgcctataaaggtttgtgccagagtcaggtctgaggttatggttcaatattaagtttttgcctctttctgtatcttcataggtataatagcatgaagtattctgtttttttttccctgtggctcaaaattttttgtccatggcctttgaaataggtccttttctgctattttctgcaaaagaacttggtggtaacaagaaagggttctggtagaagcatattttggagggagctgtggagatctgccttgagtgtgaagattacgaatgactcttatttgagaagcaatatgtgtcttaaagtctcatttttaaaaaacaataaaaataatttatggcagcaactggaaagcagtgtccaagcttcagataacagtgatactgctctggtaacaccacctccttcccccagtctcggggccttcaggttcacacatgtgggtatggcagcagctttgcagtattcagctgagatctccacggcagccaggctcctcagtgctcaggagcctctggttggaaaagagataaatcactatttctacaaattatatgagtatatatcaaggaagcacgcacaaactgccacaaatgcctattagaaatcttaaaagtagccagtagggtgcaagtaagaaaacagtcagtagttttcctataaaccatcaataaccaattaaaaatatactgagcaggaggggaaaatggggaattattatactattcaaacggtagaatgttccagttatgcaagatgaaaaactttattgatctgctgtacaacattgtgcttatagttaatgatattatacacttaaaagaatctccctcaaataacaataatcatagtaacaataaaaaatatactggagagaatcaccttcaaaatagttgtaaaatatagactatagaccaagtagaaataatctttaaaagatgtgtcagaatctgtttgaagaataccataaaatttccttttaaggtaatttatttgactaatagagagacctgtgcccctgggaaagtaaaaggttatagaactgttcttcccattattactttagaaacccaaggcagttctagttactctttccacaagattaggatgaataagggggaacttaactaaatgattctaaagttcacctttaaggcacaagaaaatgctcatgtaaaatgtggagggatttgtacctccaaatattaataaacattaaaacactgaaataattaaaacattgcaacactgggacaagaatagacacattcatgagccagcatggcaagctccaaaagaaacccagttatgcataagctgacatgtgatagtagtggcatttcacatccatagggaaggagcggaccatgtcacaaattattctgagatggtaggttaaacatttaaaaagaatctagatctaaaaacgtaatgacattctaaaataagttctaggtgattgaaatactttttaaatggaagcataaaatttctccaaggaaataagtggatatttatatagcttacacaaaaggaggtctaatcagagcattgaaaacagaaaccataaaggaaaatagagacataaaaattataattttctgaacatctcctgaaaaccactataaataaaatccgtatttgctagtgtttgaatcctaaagaggatttatatccttaatatgtaaaataaactcacacaccaataacaaaaattttaacacatcaataagagaataagcaaattattggaataggcaagtcacaaaagaaaaactacatacggccaataaacatagaaaagatgtccagccttactagtcatcaaagagatgcaaattaatgaaatatcattttcattggtcaaattagtgaagataaaaataagagctgcgtacaaagcagataaggtcggagacttattgggtatataaattgtacaacatttatgagagccatttggtaatacttatcataaggctgaaaaataagccctgcttatctgttgacccagaaataacacttctaaaaatttatcctaaggaaataagcatgggtggatttgtgccaaaacttagcttagtgttcattgcagccagatacttatcaggaaaactccaagcacagacagatgattgaacaaacagaaggaaattattttcatttggtgcagaaggctgaattgtggtcccccaaagatgtccaactcatattctccagaaactctgactatgctaccttacatggcaaaggggactttgcaggtggggttaaggaccttgaaatgggaagagtatcttggattatctgagtgggcccagtataaccacaagacctttataagaggatgggaagaggttcacaaacagaagagaagatgtgttgagggaagcagagcttggagtgatgcagcctcaagccagaggattcaagcagattctagaaggtggaaaagatgaaacagattctcccctacaatctccagagggaaccatccctcctggtgatgacactttgagtttatccccataagactcatttcagacttctgacatccagaaatgtgagataatgtgggtgattttaagccactaaatttgtggtaatctgttatagcagcaatgggaaactaatgcatttggaaaaggaggaaaaatcaaatttgtactaatgtagagcgtatacacgagttggtcctgagtgggaagttcagaggcctagattctagtcccaaccttaggaagtcacctctttagagctccttttcttcatcactaaggttcccttcttgctctaaagttctgttcctccttaagcatttgttaaccatcattaggtatgtcattgttatggcactggtaagtatgggtgaggctgccgagtagattttagtttatttgttttaaaagctggctacactgttgttagcattttcctttttggggtgggtgcttgggtgaatagtgtgttctcatatgggggattctggaacatttcagagggtactgtggaggcaaacacagaggttagaagccatcagaaccaaaacaaatcgggggtggaggcctcacagagtctcccatggtggtcctaggtctttctgcaaagatgtcctgaaagatccctcctacccagactcctatgctaaaatcactgcaaaattttgtacatacagaataagaagtttgaagctatagtgtcacgtcaaggccatgcagtggaacagcccaggttcccccggtcacttgtccagaagggaaggtgggcctcctgagtctcctcacatgctctctggcccatagaaagccgcagtcagtgctgctgaaggaaactgaaatgtgaatggtgagagttactgcttgatactacagggtatatggcatgtttaataacttggtacgtggagcatttgggttttatcatgtacattctttcatctatatataagcacaggaaccataatcaatattcattaccatttgagattgaatatatgaaagataaatatatacatgtagttttcatatttgtatatgagcctatagggaatgagggctacattttaaaatttttaagtgagaatgagttttaaaatcagaatgaattagtcttataaccattggacacaaattgctatagaatttagcattctaactaaatgtaaagttttttttaatcagggaataacatgaaaggcacctttgtttttcagagcacatttgaagcacaattggtgattaagaaacatgtaaaagggtcgtagttatgacttgttaacccaacatttggaaaagttgtgaaatggaacctgggttttgaagttaaagatgagaatatggaaaacccctactttacacgaattcagttcaataattaaaagggatgtccagaaacatcaaggtgaacaaagcctcatacagtgagagaagaaaacagaagcctgggcctgaatcaccagacagtcgtggcgctctggaatggccctggtgccaaccagcagagagcatccttagacaagtcacttaacctcttgcttctgtttccttgtctatgaaatgggaaaataatgcttgtttgcctggcgatggtgagaaatggggcatgcagccactcatcttgtccacactggacctcaagggaccacagtccagctgagaagatgtcagggccatgctcgattgaccatgatccaagccagagcccattaattcctgctctagagtcctctcctctgggctccaccttcaccaggtgtggagaaggaaatggcgcattcaagtatctgttaaggtgcaattataggttatggggtagctcgcatcaatataggacaagcttgctctctcttcttcccttcccaagccctggctatgtcaggtcccaaagttttgtctatattcttaccttccaccatttcttcccttcttgatactttttcctctccctgtatcatcataaatcttagacctcatgcaggtctaagatcctgtgaatataaggcatgacttgctcatggtttttcttttctgcagcatctagccaagtattcctgcacaaggaaagagctaagttaatatttggtaagaaatttaaaaaatgtagaattgaagttctcacctacaagaagctggagatgtgccattgtgcagctcatttggtgggttttatgcactcttactctatgatgtgtggagtgctgccctgggacttcccaagggatgagggtaggaaactgacagagccatggaatcttgcacagggcagggaagccatatgtgagcctttccttagggggccagaggacagcaaaaagtgtcttttgctcataaaggaagagcccttcaaagaataaaggcagtgccaacagtcatgtgcatgggaccctgttatgccactgtctccggggaaggggcatggctggctgggaacagggtaagagggagacttgacattgtacactttcatactttttgaattttcaaaaagataaagggaatgaacttttttaaaaaccaagtttcatataggccagttcacaatccagagactcatggaagcacaggtgggctttggtggagccatcttgagtggagtgggctttccttgcctggtgtggtatggatgacttctgaatcataccaagctgaaaactttggtttgggttgggagggttttgggccccccacactttactgaactgaaagccactggtcctggccaacctccccacaccttattgttgccatgccccaacatgggtttgtcctgggagaccccattccaaccccatccctgatactacatacctggctgctgaatagcctgaaggaagcaccatcctgaacctccactcattgtcctcagacccaatctcagcaaacttgctgggtttctggtggggccataggagctgacagtgccttcttaataggagttcaattaaaggtagatgggtaggtgggtgggtgaactctgtgctgcctctgggcttggactacagaatgctgtcagtttttctgtgatcaattccccaccgaatatcgtgatatcctatataaaacctgatctgcttggggaaacctgaaccaagagccactttctatttttctgagtcaattttatgaatggcttgaattgaatggaaaggcactaattggtccacagacatatctacactttatgttttgtaagcggactccaggaccagataaacaaaaaaagcatgggaagcaccataagctgagacttgtctttggagctgacatcctgcctaggtggctagaacgttagggcagatgtcttttcataactcacctatgagttgaaagcaaaataaggcaggaagttagagagagaccaattcatacccccttgattatttactcaacatgatgctgaaagacatttgtgttttttggaagttctatcccctggcagtgaaacaaaacctcctttctaagcgggaaagattgatgtccaactgcattaaaggagtgtgtgagtaaaaggaaactctgtattctataagtgaacacaagaacttccactgtacttacgtaactgcagtgcaaagcgcattatccgactgaaatttccagtgctaaaggaaaattgtgctaaggctgaagcacaaaaatgttcccatttgccatcatttgaaaattactatatgaggaggttttgttttaattagtcacaaggtggaaagaagatgggagagagaatatcttatcttttaccttctctgaatagtgcaattcgttgttattttctcaagtgcatcatttattgacactatatggtaaagacatcagattggtggttatatgttcaatttattttcaataaattttgctacagttgtttataaactttctatgattctatttatagtccaggaagggatttctcattttttcttttaatctatttgtgtgtatactagaccagttgttctcaaactttgctatatgttacaatcacctgaagagtttttaaaaatcccattgtcctggctgcaccccataacaattaaatcattatctctgggtgtgggggtgggccctggcatgggtacttttccaaggtgactgcaatgcgtgtggaagattgaaaggcggtaaaccagagctacatatctcagcctacaatgtgtggaggactctcctgggggcctggttaaaatgcagattcagattcagtggctcaggggtgaggcctgacactctgcatttctaacaagctcccaggtagcaccagtggcacttgtctgtggaccacattttgaacagcaagttcctagactataaaagagaacctatagctagaccctacatggtagacacagtgagtataaaatgccacacaggttctcacttgtcccttgactgctttgtaaacaaacagcaaagccaccacagcctttatcctccttttcctgtgaggatttttgtattttatttgtaagcaccgaaggaaaagcccctctctcagacattgtctgatggttttcttgtccttgagcacatcagtgacccctgagttggagactggggcgcccccgccttgaatgggtggcaaccgtgtgattctctgcccagcggctcaccgttgtgggaacattccccaggcagcccagaacatcctggtcttgtgcttcgtctggtgttgagagattttagtaaacactgcgtgggaagaggaatgaaatagggagagaatgaggttaaggaatgggtgtgtgaaactccaggttgagcgaagccagggtgcctctgagcagcattccaacgcccacctttttctaacagctggtgggagaaggcgctcacctgcccagggagcctctgcctgtggcacagagccaggcaccctctccccaggaacagacaggcagcacagtttacagaggagtaaactgagacccagggatgggaaggacttggccaaagtcatctagagtgagtgtgacagagctgctactggggcccgtgctgctgactcggaatcttttgtgccatctttccagccctggaacacccttccagcctccaatgtatggtattatagcagggcttggtggctggaggcctttcctttttctgtcagggatggttaaaagtaagctgacggtgttacagagaaataataaatccagcagtggtggttgtatgcaggacttccatggaactttactgcagggtgcatcacagaaatgcgaataaatggagaagcatagcacatttgtgactaggaaaactccttgttgtaaatgggccagttatctctaacttgatgtataattataatgtcagtcctctaacggtttggatatggggaagagaacttataaatgattctaacggtcacctggaaaaacaaacgggagagtattcaaagtgttttcaaaaaaatgaggggtaggggcaagggaagatgacaaatttgtaaatttgtactgccagatattaaacatattgcaaggttacagtaaatgctttggtgctggtacagaaacagaatctcagtagaactaagtagaaagactgaaagtgagttattagcctatgataaaggtaacatttcaaatcaataaggagatgataaactgttcaacaaatggagttaggataattggttggctgtttagaaaataatgaaatacgtcttatgcactaaatatagatggtttagaattaaatataagcaataaaataatggaaggaagtgtaggtaaatatttatataatcttaagaaagggaaggcctctaataatgtcagggtgacttctgcataagcaaaaggaagacacaaaccacaaattatttgtaacatatataacgggatacagagttattagtattttaaagagtactttcaaatagacaagaaagaatgtatcactagaaaagtaggcaaaagatataaacagctaattaaccaaagttgaaatacaaatgttaataatcatatgaaaaaaatctacatcaagaaattaagaaaatgcagttaacataagagattcttatacattgccacgaaattgacgagaagggaaatgaaaaatatctagcattggaacggttatgaagaaacactcatctcctcctcaggggagtgtaaattgttacaaatttcctggaatgcagcttgataatgtgtctcagaaaaaggagcattcctttgccacactaattctactctcagaaaaataatcataaatgtgcgtgaacaaagatctatgtagaaggatattcggtttcatataatgtttcataatagtgagatattgggaagctatcacaatgcccaataagaggagattggttaaacagtatatattagatgaaaacttcagccatcaaagattaccatgtccagactaagcatccctaatcccaaaacctgaaatctaaaatcctccacaatctgaacctctttgagcaccaacatgacaccacaaatggaaaattctacacctgacctcatgtggtcacagttagaatacagtcaaaactttgtttcatgcccaaaattatctacaatattatataaaattaccttcaagatatgtgtataaggtatatatgaaacaaatgaattttatgtttagagttgggtcccatccccaggatatctcatatctcatatatgtatatgcaaatattcaaaatttgaaaaaatccaaaatccaaaagacttccaatcccaggcactttggataaagaatactcaacctgtagcataatacttaattgagttggggaagtgttcatgagtagtatcgttttattccctgttgggcacacagaacacaaaataaagacaatatttatattccaaagttttaatagtggttatctgtgaatggcttttgcatgctttgagtttattctttctttgtactcttctgttctctcaagttttctctcttaaacatgtattgcttttgcaatttcaaaagtgattaaaaacaagaaatagggctgggcgcagtggcacatgcctgtaatcctagcactttgggaggccgaggcgggcagatcacgaggtcaggagatcgagaccatcctggctaacacagtgaaaccccatctctactaaaaatacaaaaattagctgggtgtggtggcgggcttctgtagtcccagctactcaggaggctgagacaggagaatgagtgtgaacccgggaggtggagcttgcagtgagccgagatcgtgccactgcactccagcctgggcaacagagcaagactctgtctaaaaaaaaacaccaagaaataggcaggcatggtagctcacgcctataattccagcactttagggggccatggcaggcagatagcttgagctcaagagtttgataccagtctaggcaacatgcaaatcctcatctctacaaaaaaacacaaaaagtagcctggtgtggtagcgcgcacctgtagtcccagctacttgggaggcagaggcaggaggatgacttgaacccaggaggctgtgtttgcctcactgcactccagcctgaacaacaaagtgagaccctgtctcaaaaaaaaagacaaacaacaacaacaaacaaacaaaaaacacaagaaatgaataaaggcagggggtgcaattataaggatcttgttgcaatttgcttagatgtttttgagagacagctttggtgtttgtggttggggtctcatacaaccaagaggagtataccttagaggtactcagacacggatggaaggaggcaaaatatcctgcctttgttccctgtacccttcgtcccttaagggccactgtggaataggtcagaatattcattgtttcaccatctaagtctacagaggtcatttttgccatattggctggaggcaaaatatagacctccatctgcaagaagagtgtcacaagtgggtaggtgagggaaaagtccactccagtgggcagtagaaagcaatgacttcctgatgtagcaggctaggaaaaatatgttcagggcactgtaattaagatatatattttgtgagcttttgcctttcaaatactatcagcttggcatttgggagtgtagaagagtcctcggttccaggaggaggaaatatgattgtgaattgtgacttcctgctgaaggatacagcgttgcccctgatgtagccaattagtaagtatctggtctttcttgactgttcatctgagacttgatggagaagggccaacacagccagccaccagagtggggtggttgcctgtataaatgcaatatatgaatataatttcagctataatgtctttgtagcatacaaagacagggaagtaagtaagtacatgtttggcaaaagagccactgagctgatcagtatgtccctaagctgaaattgcagggagggaaaaaagtctcaaaatggtcaagccagatgctatgggaagggtagcagggatggtttgaaaactaagcagtgctcggttcctttggattgattctcagtcttcagaggtgatcctggatttattttctaatttcataaaacactaaaagggactgtgccagcactttgggaggccgaggcaggtggatcatgaggtcaggagttcgagaccagcctggccaacatggtgaaaccccatctctactaaaaatacaaaaattagccaggcacggtggcgggcacctgtaatcccagctactcgggaggctgaggcagaagaatcacttgaacccaggaggcgggggttgcagtgagccagatcgtgccactgcactctagcctgggtgacagggcaagagtctgtctcaaaaagaaaggggggggatgactgtgaaggtaggcgtatcaatttaggaagggtgagcttgagagaagaaggaagagcggtaaggctacagaacacagtattgctataaacaagacttaccaccttgggtaactacagatttatagctcactttgggggcagtgaatagatgaaacttggcattttaattcagtttctgcctgtgggcttgttgaggaaatgtttttggaaaactgaagcgaatcaatggttgcagtgagttgaatgggtgattccatgatcctgtgggcactggagaattggtgacaaggaatagcattataagaagtcagttgaagaacagatcttgttccgaatacatcaactagggttctttggttgcaacaatcaattccaactaacttgaacaaaagcaactttgttggaaggctgttgggagcacacagaatctgtgggaaagctggagaatcacccttagaacagaacagtaacccagatgactccaggaagccaggaatcaggaatggcagattctatctcagaacagaaactctgctcaacatgccacagttataatgcatgaattccatcagcattatctttttgtctttcttatcaagattcatatttgaggtaaagaggatggaagggtgggtagcacatctgaacatggtgataagccaatgtaaacctgtaggggaagaggtaattccctaaaagaaaacctgagtgctgttatgaagtaaagaaatgtttgccaggcagccccaaataaacaaataggctcaataatgacatggacagttgcttcaagaaaaaataatcgggatatcaaaagttaaatcatcatagatcaattctgtagatagatggttgatctaagaaattaatattgtctggatcttgatgacaaagtagtcataaggatagaatgtggtttggcaacaaacttcagatgggtatattttctggaaatctcagcatgctgcaaattgaacacctgaagaattctttacatacttgttggttatgtattactcagaagataaagaagacaacagggacacctgcttctgtgaatgcagtcttgatcagaaaggataacaggttgatatctatatgtgctatagaagtgagagaaggaaacactaggtagagttcaatttcaggcaatcagagtgtccaaaaattcagggtaaaaccacatgtgatcccacaagcatgattctacaagggaataaggccaggccagttgagaggctcatagagttctgagtttgtagtcaaagggttcatgagaaagtaaaggggagagagactgtaaggaacccaaatgtggctgcagaaggaattctctgatacatcatctagtaagttatgcaagaacatcaaaagaaggatgtgtcccaagaggtgacaaagaatagaatggaagagcactttgttgagggaacaagcacgttagtgcctcctaggtggcaggtgtttatgagaatgtcaggaaaactgaaggacagaaagaactagagttgtggctattggccacaaaccaatggttttctgaggctatctttgggagcagacaggtaaaaaaaggaaggaataagtccatctcttgtggcaggtagaaaaggttagtgcaaaaccaggaaaagactattattgacataattttgcttttatattttctgtcaaaaagaataaaacaaacatagtaaatatgaaataaaaggttgagtgagtatcctagtaaaagacccctaataccacagatgagtttactcatcacaggtacagatgaattttacttcaatgtactgagaaacctgtagcaaaaatcacccatccctgttggtgatttttaagaaatagcagcaaatgtaaaaattgctcagagaatggaaaaagacaaatacatttctgactttaatgatgtaaaaatgcctgaagattgtttagaatgtagattataaaacttgacactcccaggaaaacattagaccaatttattacagcaaataaagaatgaaaagtcacagcagattaactttacttcttttttagtgttgtaagactgatgagggaaatgccaccagcataaggctgtataagaggatacacgttgagttcaacaaggcacatgacaaaatcaaaatattcagttggacaaaatggagaaatatgagttacaagagttcacagttggctagttggtgagaaggaacaatgccagtgacctctttaaatgaagagatccccaaacatactcaacatgggtttacctagaagcttttgggaagggtaggacgtttttaactaggtcatcttcagaaaacatttgttgatgtattcgcattgacctagaagggggactcctgggtgtgccagcaggctttatccttctttcctgttgagacttttatgagcaaatcaaaggaagacatataaggaaaagtttatcagatttagagacaacacagtgcccagaatgatagctgaagtattggatgatagaataaagactcaagagaaaaaaaaaaagttttgagccagaacaatggatcacagccaaccaaccaagttaaattgaacagtgacacatttataataacagtcagtatttaggttaagagtaatgatttaatcaggaagatatgaggccaaatttgacagtagtttaagtggagaaacagccagaggccttagctgaccacaaatttatataatccaacagcattccaggactgctggcaaaattgatggagaactaagttctatcaatgtagaaatcaggtcatgggaggtggttttcctactgtactctgttcctgtaacctagagctttagagctaggactctgaggtcacactgcctgtttttggatttcccttctgcctcttcctagccctacatctttaggcaaggcttttaacctctctaaacctgtattcctcatctgtaaaatggatagaataatagaacctatatcacagggcttttataagaattaacttaggtagtacgtataaaactgttagcacaaaggccaacatccaacgtatttggtaaatgtgttttgttgttgttgttgtccccattactctatagtagactattttaagaaaggcactaaaaaaaaaaaaaatcagaattttccctgaggtgagaggtttgcagactttcttgcttaaagaatacttatagaaactcaaagtgtatgttatttattgctatatgacaaattaaaatttagtagcttaaagcaataaacatttattttcccacacagggtctgagaggaattcagaagtggctttgctgggaggttctgggtcagggtctctcattgaggttgctgtcaagatggcaactggggctgcactgtcatctgaaggcttgagtggggctgaagaatggctcacttacaagctattgttgggaggcctcagtctttccacatggacctctccattgtgtgtctcaatgacttagcaactagcttcctccagagtgaccaatccaagagagagagacaaagagaacaaggcagaagttacagtgccttttatgacctagtctctgaagtcacatcccattcatattctattggtcgcacagaccagccctgagacagtatgggaggggacttcacaaggctgtggataccaggaggtagggatcattgggagctaccttggaggctggatgtcaaggggagtttaggaccacaaagacccagaggtttggtggctgactatagaaatgggaaaggactgctgtatagaagagggagacttattctgtgtggcttccaaggatggaattcaaaacaatacacagaggtttctgggaggcagatgttaatgtgtttaaggaagaacctcctagcaataatctgcccaaatagaatgccagtactaaggcagctcattctatttggggcagtagtacttagtactaccttagagactgagcccctgagtactggaagagtagagcacaggctgggtgtcctctcccagggacaccatatgcagaaccctgactgggtagaaagttagctgtgagtacctccaactctttgatatttcacttctggactaggggagaattttgtgaaatgagacccttagggcttcatttcttttagttttgaggaaaaacaaatttttcatggaactatgaggtctttgcttctgaaccagtatggcttggagaaactattaagaggtaaaatgaccctggtgtttctggaatcccccaacatttctccttgtaagagcagagctccaagttgcttgatttacacttagcccaggggatttaaaccaggaattcccaacttttttatgaggcagagcctttagatcatggaagaggcaggaatgttggcatggagttttcctcacggggaatcctggcacaccttggagagagggaggggggttgcagctctgggggatattatccagggaaggctcagatatccaccaacggaaatcagtccactctttgagcatgcaaaaatactagctgatgctttgctggggattcccatagagagaactgagaatgcactcatttttaaaatagcctcatggagaaactttttaagtggttggtgggggtggcgaggcactgttatattggtcaccatgtgggcatataatgtagaaaacgtccataagcaaagggtttccagggaaattaacactacagcataccacgtttactcctcccttagtccaatctacccttggacactcactgaaatgatctgtgaaatatgaaaccatttctaaatgtatatcagtactagaagctctgaagaatttctgccagtgagcgtgcaggtggcagccctcctaccctagtccaacaatcactcctctggaagacaggattgtcaggagcagaatcacccaaacagcccaaccttggaaggccaaggtatgagggtgagggcaggccatctggatcctgccaatgccttaagaaaggacacagtcaaggccacaataagtgacaaactcagtcagctctcactactggcatggcatgaatgtctggaaaacacaggggaaaagagaaaactctttggtgtgtacctgttgtctcctgcttctaccaaatagatttcttaggtatttgaaggcgctacagttaaacttccccttttctgtctttatctagccccaaaatattgaatagggccattgtctctgttgaagcccaaattaactccccatgatgctacacgaaagcagatctttctctgtaaagatgatgatgcaagaaatcgctggccacaagaaaggatttcatcatatgagaagattttttgaggaatttcaactaatgcctctattcctaagaaatgggtaaagatattgaataatctaatttatgtcttcaagactgaagctgacactgcatctatgaaacaagtaagaaacagctacaaagagatgacagaatatggtgaccaattttaaatccataatacactaatgagcagaagattagatatcacagtaaagtcagtaattttttttaatgggctggaaaatttctcccagaactcaggactgaaaaacaaaaataatgagaaaaaaaggaaaaaaggacccggtgatccaatatacagataattccaaaaggaaaaaagaaaactaaggctgacacaatcatcaaagatcattaaagagaactttcttaagctgaaaaagacttgtccttaagattgaaagcattaacttcagggtaatttaaccagttctcattgcaaagaaaaggtcttataagcactgaagtgaaaataaaagcaggttacaaaggaatatagtaaatctagcttcagttttttcatcaactacaagccagaagtcagtggtgggaggcctatggggtccaaagctcatgacccaagttgtcattcatatgcaaagccatgtacatgaatgaaacacagatgttctcagacatataatatttcgttatatggatatacttttcacatgcccttcctggaaaaaatgtccaaagagcctcttcaactagataacagctatatcaagataaaaacccccaaatggggaggatataattttttcaaaaccagcgataatgtgtccaagcaactgttgtcagtttagttatactagtacagatgtcaaaattaattactgaaatataagttttatatataaaataatgaggatatgaaatcagatgacaaataaaaactggtaactgggaagaaaaagaaggaggaagtaagcatgctaattttttatcaaatgacacatcaaatttcatttttaacattgataattgagaaaataaactaaatttttttaaaatgtaaacaaattaaaaagagtatttatattctaaatcaccacaaaaggggaaagaagtcaaagaaacatgatcttttatacaaaagacaaaaaaggcaacctactaaaaataataagcatttgtaaaatgttttctaaacacaggttatttcttctcagtgataagacagcaagtcatttgcttaggatatttgtatttccaaaaattatacaatgaagatgcataacttttaaataacaaattataaaatcccttgtgggggctgttataaaaagttgtttgatgtgtaacacattgccagtaaaactaaagaatggatggatgagaagttcccagttataacaagatatgatcaagatattctgggccaggatggtcatgctttttttttttccagtggtatcgatttaagattttgcagctggtgagatacatgatcatggccatttggagaactgtagggcatccatcttctatgtcaagaagattgatgttatagtagttaccatgctgtcctgccttggcgatttctgcccagagggttttgagaatgcagtatatttgcatcagctgtatagcatttccatcaaaacagttgtgccctgcctgctgtcaattgtggcggcaccattttatattttgttttatagagttgcagaagcagcctttgccccatccacactttgttcaattacaaagctgatctcactcctcaccccaaaagactgttactactcctggagaggtttgtgaaggtcgacctgatccctccaggatggagaacggacagaacagaccttaagctggggaccagggtttcaaagtggagcctcccaatcagggccagattgacttcagattgtaagcacagggcatgttgatgtttggatgaggctcccagaagagacagagaaagagagaaaaggatatgatttattgtgaggattcatcccacatcagaaattctctaaccaacccctaatgccagacttcaggcttggcattagagtaacactccctgctgtaacagataaaccctgaatattgtttatttcctgctcatgtcaaaggctctgcaggttttcctggccctgcagacttctttccatgtgcttattcaaggacccaggcttcttccatcctgtggctcctccctcctccatgtcctgcaggagcctctctaatcagacagcagctgggaaaagacaaagggaggtcacaccgggaggttcttatggaccaagcctgcaagtggagcatgttacctctgctgagatccactggccatatatcctggtcacatggtcacacctaactgcaagggaggctgggaaatgtagtctctattctcaggagaaaaaggactttggatttaggggaactcctgggagtctctggcccacactttatcttttgcatattccctgcctccttcagagagcagtttcccagctgaactctttcaattaaaagaaaaaaagtgacataagtatagtggttggaaatggatcaaataggctgtactcttttgggattttgttgtttatggtaggagtgtgtgaggtttctgtccatagagaccaagcccgaggtcatctcttaccaaacatctttcttctaagcatcttctgtcttctctaaatgattattttgtctccttcctccttcttcctttttattgataaaacatgaggcagtaacatgatttttcttgtgcagattaaatctagattcctcaaggccagtcttctataacactacaattctgtctgtgaataaaacactaacaataaaaattggttaagctttaactgtgtttatagtgttatggggttttaattttaaatggttgtgttcaaactctaaaatgctcacttcatgaaattcgaaaatttataaaaaaaaataattgcgtataattcgaccactctcttacatctcagcttctttcctcttgaatataatcttgattgaagggcttttatctaaggacaagcaaaatcatctgtacaaaactcagagggaataggaaagagagtcacatctttgtcatgggacatagtcccaactacaaattcacttctatgtttttaagactgttgagctttgccttaaatttacctctgtattcttcagtttcctcacttaaaatgaggagtatccttcttccacccacacggcatctgcaaactgccgatgaaaaaaggcacctgtcaaaagttctgaggacataaaatgttctagaaaaacaatcatcccaatagcgcttatatgtgctcagtgtagagggtttaaggggattatggttcaaagactcaacaagaggaagcattttttcctaagggtggattgagagtttcctgccaaccactttacctaacaattttgatatttataaggagaatagaggcacacagagactgcaaaggcaggtagccctgggctctaacggggctgttcctccaacaaagccagaacagaattccccatccagcaggactgggctccagttcccagagccattcacattctcgttcaaagccagctgatgaaagccaaacataaacctccttgtttaccttgtgaatggaacttggaagtaaagtattttccaaatgctggttgacaccaagaggatgtaattacaataaggggctttctggtttgaagagatgaaagaaggaaatgatttgtctctttgaaatcaaattatcacatattaaaagaaaagggggaggcttagcttccagtcctcaaagcaaaatcgtgacctgtaattttcttaatttttttttttttttttttttttttttgcttaaaattactaagaccaaggtagtagggatagaagaagcaacctgggagctggagaaatggggtcatgaggaggaagaggagcttagtggcagagagtgtgatcttcgtccagtatatttcctgtctatttccattgcattttaatccataatgaatgtagaatggtgattggcaggctgcttgtggagtctcatacctgcctctctcctccttgtgccttttgggggaggtagtggtcttcccagggggagtcggggtacaggtaacaggccaagttgaaatatgtatgtcgtgcatctttggatggatacagtctctggttttagcctgcacttaacatgattccactgaggttttattttaatttcccaaagcctctttgctaattaaagccatttgccttgggactcttagcccttttaattctaaaatgcccctaaattttcctggtaattcctgatttgttattttccaaatgagagtcatcttgagtgtgtggaagatgcccataaggacttcttaactctcaactctctctcacacacatccacacacgcaccatgccctctgaagtgacagtgtgctgtattagaaagggcgagagctttagaggaaaccaaccatgagttctggtttccgctctgccatttgctgacttcgcatcattgaacaactttaacccccctcagctccactttcttcatctgtaagatgagatagtgaggatttccttgcaagatttttgtggggattaaatagaattcgctctataaaatgctgggcatagcacttgcagtaggtggacaatccaatagtagctgctcctaataataatgtcatcatcatcatagtccaacctcagaaaattctacattgggttaaaaactctaagaccaggtactttagataaaattgaaagctggcaaaatacttctgtgttcatgttatctgattttcttctccctgttggaaaatgaaaaggtaccaaaatgatgcaaactctgcttttgccttcaaagtaagcatgatgaaccccactggggcttctctgactctatcttttttcccagtacacacacacacacacacacacacacacacacacacggctgctgtgttatcaataaccagtatctttgtaggaaagtagaaactaaattgtgtgtttctttaccaatatctttgtttgaatttggttccatcacatctgatgccccttgggtttttcccaaagggagaaatggtcagagggaattaaaatggctcagatgttcccttaggtttcccctacagcatcttgtttgaagctgcaaaagcaattcagaagtccatcttaggcctgctctgagctcctggacaagagcactgtgtagcccagaggttcctgcccttagtggaaggcctgatagcatctcatgttccagccaccaccctacttccagcagctcctcaattaaccatcatccctggacatgtagaaatctcttttgcatctgtattttcaaccactgctcccttgtgagaataataagttccatatgtatagttccccactcctcccccaaataaagtaatacttcctcttgtttctcctgaaagtgcccctttctgattactagaagatgttcactagttaagtgttccccttcctcactgccagcgtgatttgtgggttgggatcatgtgccttctcagcatttgtctttctggacttgaatagcatcctaattttctatagctcttcagtatctcaatatcagagaaaactgagatcaaatttcagttctactacattccagctatatgtccattgacaaggttatctaagcttcagttttgttttcttatcttaaaaatagagactaataatgctaaccccacagggtgcttttgatgtttggtgagataatatggagtctctgcccttcagtggggatggaggggtgggtaggatctaaagtcagtgtatgatcagggaaagttaaaaagcaaatagggtcagatttggtcaatattggaaaagatcactgaagaattaggagatttttcagggattatgttataggaaaaatatgttctcttttaagcataggagttctctcagtaaattgtgaatctggggttggggaatgatagagacaaaaatggccctgccccaccccacccagctgaacaagtggaacagcaagagaactgtagcactatagttacctttctctctttcactgcttaactacaacgaaggccccttccctcttaaatgatggtactgcaggctaaactctgttttcaaatggttttatatccatcgtttaaaagatagtgatcttgggtttaataatgaatgagttgcataattatatttatctcatctccaccatcccacacacccccctctaagacagcaaaattgaattcccctcattagttggtaacacttgagatcaatttcctactgtaaatgtgacagggattccctttccgtaactctgctgacatccgctgctcatttgaaaaccctcttgttcttctgcctgcacacacagccccaggaaatgcccctgtcgatcagtttccttgatagggcattgctctctctgcaaaggtcagtagcattgccacactagatgctgacagtgcccttcctcttcgggatcattcacaaaaagtaagaattattctcacctccccccacctgcccaggggagcaggatccctgctcaccaagtctctctgggcagccactgggttctagaccatttacttctctaagctctggcttagcagttctgccacccgagtgtaagcctccgcaccagcctctccttcactccatagctgcttttgcaggttcacgcatcacctcccaagcttggagttccacccttgtaaactgggcctgctgctgccctgaagccagcctcccatcccagagctgagtccagagctttgggtgactccagcctggcctcagggtggaatggaggccttgatacctgggagtatcagatttataccccccgccagcttccccagtagctactgctgactcccatctttactaaattaatctactgccttttctcctagacatccaaaaagtattagttggctttgccattgtagtatctgaagacaaaatatttagtcccaggtcagaaactttggctgaaagttcctactaaaaagccagacgtcatgattaaattgttagaaagttagccatgatatctgaggaagttatgaaatggctgtaaatgatgtaagctctgcaatgggcaaacgtgttcacaacttttgacatctggggaagagagttaagagccacaggctcagccggctcccgctgaccagcacagcatgaagtccaattagggctgcttttaaagggggtgattgcgctcaggggtgtggatgctgctcccaggggagcagggctgttgggaggagctgtccagatggctgtctccctggctcctctgaactacggagacccctcctgtgaattggatgggggatttccctgcccctcaattgctattccagaccctcttcctgtaagtagggttgggctccaggccctgttagtgggtctgtggtctctaggcaaagctttcacagcttccccagagagcagtggtgtctgcaagatgtgcgtttggttaacatgctggaggggcctctcataaatttcatggcaacaggaactgagtggctttgaaactccagctgctggtgggctcgatatgaggtctgttccaaaacctggaacatttgcttttcctatcgtcagccccaagtgctactcagacttggtgtctggaggagatgggccagagtcctgggggccagtgccagtccttctctgccctcagctggcacatcttggggagactttctttggatattccctgctggcctttgccaccttccttttctaagtgattctttttttaaattttaagtctctaggcctttccttccctcactcgctattttcttgaatttccagaaaaaacaatagagtgggaaagggagagtgaagggagatagagaaaaaaatagggggagagagagaaaagcaggaagaaaagaaagaggcagactctgagagagaggctgagagaatcattcttaggaaagataccaggaatttggggggttccttgtaatgctcatttttataaaataactggaggcagttttgccccccaaggaggagatggtactctaagttactgagcaaacccttgcccattgacaaggttgtctaagcttcagtttagttttcttatctaaaaaatggagactacttaggttaaagcaggccgcctaccctgcctcgacttggcggatgatgtaaggaaagcccccagcacttagcaagcactcaataagtgacatccctgtccctgccctcccctaccttcaccaaagtgcctctcataggaatagccttgtctgcctgggctgaccctgccctggtatttggggtgttctttgctgagtctgggaggatctaagacaaacacctttaaaggccctcaaatgagaacagttactccgccctcacttgttggagatggctttagtaaagcacatcagctcacgaggctcgtacagcaccctaggggcgcacaagccccagtgctgcccctcctggagctggctcatcctaagggtgcacaggaagagcagagtggtcacagtgtggcttgcccttgggactgtggtttgacccactcctccctgtccacttaggtctcaagtgtgaatcacatcccctatcagaaaacctgtgacaagctacaaagctgccaaatatgccagtggaagaggaacccgttctgcacatggtgcacattgaacttcctgggtggtgggggcaggacagcaccctgcgcaaagaacctcgaacttgaattaaatgcttgtttttaagaagtttggttatatggtggggggggtgcggggaggagaatgcacgtaacagaatagaaagagtaagtttaggtgcatgttcgtgtgcagtgtatacttacatggttctctctacatagtggattacagatgggttttattctctaatatggtacttattatatattgatttattttaatttcctaaaaatatgtcacttttgtaatgagaaaatgtcttgaaacttttgaaaaagtttcaagagtgaatgtatcatggttgtagtcaggaaaagggttttttttaataaacaaccttctaatgataatccactagcatcaagctcccttcatcctctctgccctttgggctgaggcagacaggtggaattatggaggaccaggaacttgcactctaagcctcaggcttgtttccactctggtctctgaatacacagagcgagaccaccacatgtcatctgccatcactgttactgttgcatggagcttcttcacagcttggactcttctggcttcttagtgagctgtgtgaagtgaaagaactgatggtttacacgggcagatgcttctttgggaaattgttcaggatgtcatccaccacagcacatgaagtccccttcaaaaacacccgcagaagaagagaagttgctctctgaccgttgctctccaaccacagacttagggaaagctgagcctgtccagcttgtgcagaacaagtatatatattcctatctaatgaaccttatacatccttgctaagactgccaggaggcatagagttagatttgtccctcagctttggcatgtgcgtgtgattttctgatatccatctttgtgtattaacctggtgcctgttttgctcattgctgctccttacccttactttcctttgtcccaatctctccttccctctctcactgcccgcctgtctgtttcttcctgtttccctccctcccctcttcttctgttccttctctctcttatcgctctcataaccccaccccgtctctctctactctctgtctcccttcctgtctccttccctccttcttcctttttatgtccctctctcccgtctctctccttctcgctgtttctcccacacacacttgtttctcgtttgcattgcctttttatggtacctatttttataacaccacctcatgtcatttataaaaagaggcaaaggtatccatcaataggggttaaatgagaccatagcagagtccacccttcaccaatcagttttagagaagtgttccaaaacagattccaagttttctctttctttgtatttctactgacctaatactttaccacgaagaacctcagcagatttcaggctttagagtcacacaggagtttgaagagctggaagataatcagctccaaaaaggaccctggcctttccacttttgcaagagcccatttatcctttgcttctgtgtaacacaagcctgcgtctcaaacattagtgtgcatcaggatcacctgcagggggccagacgtggcggctcgcacctataatctcagcactttgggaggccgaggtaggcagatcacttgagcccaggagttcgaggccagcctgggcaatgtggtgacactctgtctctctactaagatacaaaaattagctgggtgcagtggaatgtacctgttaatcccagctactctggaggctgaggtgggaggattgcttgagcctaggaggtcaaggctgcagtgagccatgaacgtgccactgcactccagcctggatgatgaagtgagaccctgtctcaaaataaaaatataaattaattaattaattaattaattacctgcagggcaaacattacagtatagcaattctatttcaataggcctgactttaaaaaatcacctagcaagtttgtcccacagatttctgggcctcaccccagagatcctgattcagtaggtctgggctgggtaggggtggcaggcaaactcaggggaatgtgaagctgtctgtctgcagatcacacttggaggaacccagcccaaagccctgacaaagggacttcctctagccacttggaggtggtggtttaaacggccttttgtggagcctgtcaaaagcctttttgaacatgtacatcaaatgagatccactagcccagcagcccccaacctttttgacaccagggaccagttgcatggaacacaatttttccacagacttgggagaggtgctggtttcaggatgattccagcttgttacatttattgtgtactttatttctattattattacattgtaatatttaatgaaataattatacaactcaccataatgtagaatcgggaggagccctgggcttgtttctctgcaactagacagtccaatttgggggtgatgggagacagtgacagatcatcaagtattagattctcataagaagtacacagcctagatccctcacatgcacagttcacaataggtttcccgctcctatgagaatctaatgccactgctaaactgacaggaggcggagctaacgtgagcaatgggaagtggctgtaagtacagatgaagttttgctgccttgccggcctgcattggcctctagagtctagccccttcatctctctgtgtttgttccttgacaagttcagtgagcacagagaagccagttatgcaaactacagcagacccttcctgtctcaattcagcatccagcgtctactgttagccagtgactgggcctgttcctcaaccactcaagccaagcacatgcaggtgactgtaaccagcccaggcaactggacccagcagtcctgcagactcctgctcagaggagggtccagcagccccaggtcgatatctccacctggctttgggcttctctgcttgtcctcatgtgtgaaagacagtaactgtcattaagggctaaaggggacacttggacttttagttatacctcactgaatgtatggggggattacttactgtagtggttttatcacgtggatattcattcatatcttgggattgtcagtggtgacaacaggagagctaacagctgagtgtcataccagacaatctcttgagtacagaacttaacaagcattacctcattcaaccgcagaggaccaaggaggcagggggacccgctgtcttgtagctgcagaggcaggctaggagaggccagctgcttcaggtggcagaggcaggattcaaacccgtgcctctgactgcaaagcccatgtttttaaccactacacaatgtgtctccttcaatgtcaaggattctgttgtatttttagcctctgcttttcccccctggaattatgggatttctaaaatgatgacacttctagaagcagctcatgaatagaaagatagcaacaggagtttaatatttagtgatggtctaaaatctcccaagatattaaatgttctgtcctttctcagagagcaagagctccaggaacatggatttttttccccaaaaaaactaagtgggcaagactcactcctgaaatacccaaaatagaagcataagaggacctgttgaaagaagcagtggagactatatcgatggagctgtcttgaaatagctacataccatgcctcaaatttactttggacaaaatgggagtggaaaaaaataagcccaaagtgctgcctggtcagcaggtctgttgtgcatgacggtgctcctgaattggctggctatttttattcctgtctgaaagccagggatggaaaaccctgagaggtttggtgaccaccccaagctcgtgagagtcatggtactagggctctgagtaggacccatctcagcccctactctgctctttttcctctctccccattatgggaaagagaaaagaatttcccaacactgactgtgctgctctcatatgggtttcttgctttaagtaatcttttttttaaaattatttaatttttttaagttccagggtacatgtgcaggatgtgcaggttcgttacataggtaaacatgtgccatggtggtttgctgcacataacaatccatcacctaggtattaagcccagcatgcattagttcttttccctaatgttctcccccaacaccctcccccaaaagggtatggggggagaacactccccccacactctccctgtgtccacgtgttctctttgttcagctcccacttataagtgagaacatgcagtgtttggtttttctcttcctgcgttagtttgctgaggataatggcttccagcttcatccatgtccctgcaaaggacatgatctcattcctttttatggctgcatagtattccatggtgtatatgtattacattttctttacccagtctgtcattgatgggcatttgggttggttccatgtctttaccattgtgaataggcctgccacgaacagacgcatgtgtgtatctttatcatagaatgatttatattcctttgggtatatacccagtaatgggactctaagtaatctttatagccttatcactcctaatcctaccaagagaagccctgctaccatcttagtgtatgtccttcccagactccttcatgtctaatttctatttgtgttgggtttttttggtttttttgtttgtttgtttttttggttttttttgagacagagtcttgctgtcgcccaggctggagtgcagagtgcagtggcacaatctcggctcactgcaggctccgccccccggggttctcgccattctcctgcctcagcctcccaagtagctgggactacagtcgcccgtcacctcgcccggctaattttttgtatttttagtagagacgggtgtcaccgtgttagccaggatggtctcgatctcctgacctcatgatccgtctgcctcggcctcccagagtgctgggattacaggcgtgagccaccgctatacagacaatactggaaacccatttacttaacttactgtatatcataagcacctttttgcatcattaactcttctgcttctgcatcaatttaatggttacagaatattcttttgtacctttccattctcttgctttcaaaacagattcttatgacagctatctaaaaaaaaatcactgtcactttgcaaaagtgaaattaggtagctcttgtgttgaaatagtaaaattgctctgttgtctttgaattacgttagtttgaggggaaatttgttttgctgtctacaaaaacaaaaagctggaaagcacgctatacaggagctctaggcctgtcttaggctttagaaagtaagtgagagctgaggagggtgtgccccaggtgagaacccaaagtcccagccatcaggggctccaccttcttgactggtagggtgggaggtgtggggtttgcatgtcagctgttcctggatctgagccctgcatctttcctctccccagcagacccgcccgtggctgcagcagtggtgtcccattttaatgactgcccagattcccacactcagttctgcttccatggaacctgcaggtttttggtgcaggaggacaagccagcatgtgtgtaagtatcccctgttctcctggagatctggggctggggtcagtccaatatccaattagaagagcatttacctccataagacttgccagaggctccgagacccctggagccagatgtgtcagaggattggaacagtggggctgagggacacctttttcaaaaccagatgtctaaaaatccaggttccaaggcccccagcccacagccactgaggcagaaccccgggaagttcaagcctggggccctgcatttttaacaagcatctcaggtcactcatgggtttagcaaagtctgaaaattcttggattcaaatttaattcacaacttagaatttctggagcacaaggcactgggatggataactttgagtggccaaagtctctaagatgtggtctctgccctctagcatcttcacaatccagctcataaaacaagccagaagtgcaggcgaagggctagtgtacataaatggtaacagaaccagaagcgacttagaaataaagatgcaggacatgcatggtggtctccacacctggctgagcatcatcctccttggggggcttctcgaagtattactgaactctgctctgacctacggaatcagaatctccaggagtgggacctgggaatcacattagttcagagccacagcgactgccacagtcagccaggttggggaagaaattcactcgaagaaagcttcccagagcaggtgttagggttagaccagttagggggagtagagaggttgttccaggcctcacatgctcaggggatctgctactgcagatcagtgtggctacaccagggagacagagaggagaccagcttagagacaaagtggaggccagagcctgttgaaagctgtctttattctttaggcaatggaagccatgtgggtttcagaaagacatatttaaagacaatcagtctgtctataatagaatactattagggggacctatattgaaccttggcactattacatttggagctgggtcattctgttgtggaaactgacctgtatactgaaggaagtcagcggtatccctggcctctatctactagatgccaatagcactactatccctggccgtgccaatcaaaaatatctccagacattgtcaaatgtcctctgcagggcaaaattgccccccagttaagagtcatggatccatatgaaattgccatttttgtaggtaaaatatggttgaggattggcagtttcatactaatcattaataaaaactggcacctattaaggttttggcttcatgtcaagtactgtttgaagtacaatccgtgtgctaactcatttaatcatactgaccccatgaagaagaaagagaggctatacccagcccgcatagcagggcctggactcaagccagcctctttggctcctgaagctgagttcttagccatgatgcttaaggccatcagatgcatcagcccaggagcctggggaccaggagagcctgctgcagtaggcggtgtggtcagggctttcctctgtctgaggtgcagctgtgtgagtctgggcaggcccctcagggtgcctctgagccctcacctggagagaaagaaggagaggcacactggccaccctcctcctcggaacaccgcagggctaagaaactcctccagatgacaggcctccacaccctgttaatacaaagcacgatgatgatgatgatagacactgtcattattcatgattatcattcttattaataattaacatactaggggcccctgggggactgatggggttgttttcatgagtgccctggtcattgtggaaaaacactggccctgaaggaagtttgccctcttgacccagatatcagaaagcttccctgtacaacaggcagaaggtactctcccaccagccacgtccagggctcggcccagaatcaagcatacagggcctcttgtgcactgggctatgagtagagagaatcctctttggagaaaaagggcaggtctttaccaagttctgacccaaagtgagtcagaagctcagtttttcttcctcaggtgccctccccaccagatcagggctggtgtaaattttccaagagctggcagccaggcaagccaagccacagccacctgtgtggcagaagagccccctcttcagctgttagaagccttctgaacgctggggtgggtgactgctctcccattcccctcagtcccaagccttgctcttggcccaagggaactgtccatcacattcacacacccttacactttgctaatcagggtgattggccatctctccacattcacatcatacacgttactattaataataatagtaagtgctcaataaaagcttagttcatggcaggcatggtacccagcactctgcataccgcaaccatggatccctcacaactcccctctcaagtagggattattacccttgttgtataagtgagaaagctggggttcagagaagttgagcaacttgcccagagtcccagagctagtaaccggcagaggtggagttcagtcccatcattccagcaccagaacccatgctcccagctgctgcccagagggtgctgtgcctctgcttggcaaaattcacctcaaaccactcagctcttttgcttccaggcattttccccctgcaaattaaccctcctcctgagaaaggccagggtcatccccaagcccagttccctgaccacaaactcttaacaagtttttcctatgggccaagtgcggggctacagagacagctgagacacactcgcatttggaaaagctgaccatcttgggggaggcacggccatgcaagcaattacacctctttacctcagtttcccccctggatcttgatggcccagggacagtattcagtctgcagaaatgctttacatggcaacacatagtgagccacgctgttcttagatggctttaatcagttgtcagcattttagaagggagatttcacatttccatgcagacatccagctcctcttgaataagcagaatggcaacaccgggcctgaacttccaaacacagcccctcagctcggactcactcaggtgtgccgccccagatagggctcgcgctctccagcccttcattctccacctctccccaaaattcccgacagcaacatgacactggtccctggtcacctgttgccctgctgctctgcttacactaggccacttggctcactttgccatccgtgggaccccttggggcttgcatgtgttcagccctgggacagggtcctctgcagacccctctgacggcactccttaccccctgatggcttgtgagctctgggaagacagaaccacaccttatccctttttgtatttacagtacccaaaagaatgttctaattaatgaattcccactagaccagaaactcttgagtgcatgcagagaaagtagaacactctgtccctgctcctgtgacttgcccggccctgggaagctgacacacacatcctggtcaataagcctgacataccctgaggtcaggccccatctatcatggcctcatcaagcaaacccacagggagccaggattctagtctcgagagagggagcactttctaaaatatcgtaagtcttaaactccatcctccataagaacaacagtctttaggtttccagagaacctaaaatgacatctcacgctataaaatgaaggaaagaaaaaaaagtttaaacaaataactagtcacagactgccaaaggtggtgaaaactagccttacatatttatgcttcaagtgaaccctagatggtattttacagctccctttaataaatcccctagtcccaaccacatcagaaaactaatgggaagagaatttgcaaagacagtaaagctatagaaatgcaaggttaggactctcaccactttttccccgaggcagattccccacaccattggtctgctgcctgcagaagccttcaaacaaaggaaaaccgttgaaggaagacacccaggtgacaagtttacccctggcaaccagtttgaagtttctcacctgtcccaaatgctcctcggtgacccaactccctgacaactttcccacagcaaagtatgaaagcaaattcctgtcagccaagggaaacattccacctggccctggccacagacccttccagtggaatctgaacagagttaaacacccgaagagacctgaccaccatcagttcataactggctgcctgtgtgaccaaggtggcgcctccccagagattaggattgggggcagttttcttgttggtactcgagcccccttacatagatccatcagcaggtggtgggggtagggttaagaaggatgacatcactgccatccacaggtctggagaaagtgcaggtcctcccagagtgggggtcacacaccaggcaggaggacagcacagttaaaggcatggatgggaggtcaggcagaccgaggtaaagtccagctgagtctcccatacaagtgacttggcccctttaagcctctgtttctttgtgcacaaaatgaggatactaatacttcataggattgtaatggggacccagggatgataatatatagagagcaattgctgcctatgacaagagccactggactcttaagtagtgggactacttaaattaattgattaaaatttagtttctcagtctcactagccacattttaaggatgtaatacctcagggtagctagtggctactgtattcatctgcccagatatagactctgtcatgatcacgggaagttctattagacagcactggagaacattcaagcccagttcccagcacagcatatgagctcaagtgtttgctattgtggccgctgttggcaccatcaccacagccaagggatgttgtgaggtcctgctggaaggagtatgtaagtagggctgaccatactccagccctctccccaccagcccccagagcacagaggttataggacttggtgaatctggttcttgaaaggctgagaatgtgtgagcccaatacacgtgcccttggtcctagtgcacccactgtctcatagccctgtggaatgtgcagccaggtgagaaccaacgcctacctgaggcaaaggagagaacagcagctggatcaagtgtgattcatttgcagccaggtgaggtgactcttcccactccttctgtgacttgtgcctaaaataatcagcataattaagtctaatattagtagaagcttgggaagttttttttttaaaaaaagtatgtcaccaaacctttttctttttccgtcataaagagcagctgagaagcatttccattattacaactaggaagagaaaggatcgccctcccctgcccactggaatcagctaggagctttaaaaatcttgatgcccaggactgactcccagagattctgatttaattgatctaaaggtgtggcctggacatcaggatttttgaaagctctgcatgcaatttcaataggcagccacagttgagaaacgttggtttctctgttaaaaacttcatggtggctctcaactctggcagtgtcagaattaccttttggccctttctttaaaatgcccaggccccatttgcagagagattttgattggggaggtcccaactgtaggtgagacccactgggctgcttggggctaagacgcactgttcttggagctcttctaggtcatgacctggagtcccaatgatgaggcagttacccaggtgcctcccaccttggggaagtgttcgctcagaagcatgttgggttccctcactgtgtgggactgggagttgagcgtttgcagctattaacactagagtgataggcattcttgttggcatgaagactttcctaaggggctggggctcctgctggggcggttttaaagcagagctgatttgcaggggccagcatgcatgaatggcaaatgttcctctggtagaaaaagcatggaaagtcagcaaggtgtgtcccagcccagggggttatctcccttggtgcattaagacggcactgtctgggggcacctttgccccttgccacactgagcaaggagacctcgctccaggacaatcagtagcccatctcttgtgcctgatcagatttgtgtttgtcactaaatcactagcccagggtatcttccaaaccagtctgcattaacccagaaaggtagccttactgggtgagattgttagttcccaaacctctagaagcttttgtttcttcatctgtcaaacaaggtaaataatagtcgcaacctcacaggtcagttgtgattgctgggattaaaagagatgattcatgtaggagtttagcctaatgcttgcagtgaatgttatgtgttgtaattagcacttggctgccactattttatttaaatgaaatgtattggggtctccagtattgatgtgttaaatcgcagtgtttttagtgccaaataataggtgaggtgctagaatccctctttcccagggcctgctggttgaagtagaaacgtttcaagctgtgtgaaattgtcatgggttgctcaccttcctatacgctgagactttcacaaaagactctgcaaatcctcattatggtacctttccccgggagaaagaagcactaaccctaaccctaaccctttgcatagaagtctcattggcttgtccacaactcctggttacaaatctgataatccattccaaagcccaggctccccggccccattctgttcagtggttcaccggaggtttctgtagagctaagccctgccctgcaagagcaagaaggctgggaccagaagtgaagctggtcagagaagagcagtcagaaaggtgggcatagtcctggggggttcagggaggagaggttagggagatccaagtgagctatggaagaatggatggatggatgacaaaaatgaacgtaaacgagtctgtaaattacatccttctggagaatgtggtccttgggatggagcctgaggaggagagtgaggaatgatattccaggtggaaaaggtagccggagttgagatgcacaatggagggtagttgttcattcattctgcaggtgtgtcctgagtccccacatgctgggaactgtgctaggtgcagtgtgtggatttaacactgggctgggggtggggagtggcaacaacttggattggctggaacctaggtgggtgggagataaagtacaggggtggattagggccctgcaggagagagggctagatatcacagaggaagtgcacgattcagggaccccatctggaaggttggagagccatctgggtgcaggagaggaggagctagagggagggaccctttgcaggattttcttgagatatggatggcttagatttatgcactgcctaagcctgttgcttatcacctctcagcctggagtctagcccactcttcgcctccgcctcataggaaagggccagtgcctgcagggagagctgtttcttgacctttgcctttatgtaattttgttattaaaatcaaagcaagcaaacaaacaaaaaaaaccctgcccctgtcccatagcccctgagccgttgaaagtcagtgttcttattcagagttctgtgatcccctctcagtgtgcctagtcttcaagggccttttaatctaaaagcgaaggttagaggctagctaattaatcaaaagataaactctttagaaaagtttagctatcactgccatgtctgggggaaaaacaaaactaaacaaaactttaaatctagcatatgatatggggctgctctgttaagaagtcctcaccagcaggccgggcactgtgattcacgcctataatcccagcactttgggaggccgaggtgggtggatcacctgaggtcaagagctcgagaccagcgtggccaacatggtgaaaccccgtctctactaaaaatacaaaaattagccaggcatggtggcatgtgcctgtaatcccagctactcgggaggctgaggcaggagaaccacttgaactcaggagacggaggttgcagtgagccgagatcccgccactgcactccaggctgggcacaagagtgagactccatctcaaaaaaaaaaaaaagaagtcccgcctggcaaaggaagtggcgatcttagatttctattgacgataagaatgttactctatacaaagggagtaacgaagtaacaaagggaccagtgtctaagctaagtatcttttattaagaagaatcacatgcttgggggattagtggctcagggtgaggggatgcctgtaaaagaaaatgaccatcccatccttatggccagggcacatcccgaagcacttttgagacccatctgggcatagcagggggccgtgattgaaagattaataccaaagaacctctgaatgactcgccctcccctgcccactggaatcagctgggagctttaaaaatcttgatgcccaggactgactctgaatggtagcaataccaggaattacatcacctggtattagcaccacactgtacaggctacacgcacattcagacacgaccttgcttgtgcctttactaagcctgggtggaggtgggccaggtattgatggataggaggacaccagagttcacaggagagtagtgatttctccagtcctacaatgaccaggtagtcatgctgagtaacctggtaaatacttgaagaactaactaaacttgaagaagataaaaaggcaaaccacaagccaatgtctccactggtttcaggtgttttctttctcatcaccagaaagtctgaaaaccacatttggtttaaaactaacctggattttttatgaactgccaacatgaggcttatgtcatgaacacatgtgctgcctttattcctccaggatttggcacagtcacaatagtcatggattgcttcagccgtagcttgcctccgcagatgataaggatgattagattccccttcccttctccacataagcagcggtgcctgcgacagggaaacaggcattttgctgacacctttccctccaattgcaaaagctggcagggcccctttgggctttacctgcaggctctgggtccctccaggaaagccctccctggagagctagggtaacaagaccttttgtcaggagagtgcactgacgttcctttcttccccagctgccattctgggtacgttggtgcacgctgtgagcatgcggacctcctggccgtggtggctgccagccagaagaagcaggccatcaccgccttggtggtggtctccatcgtggccctggctgtccttatcatcacatgtgtgctgatacagtgagtacttgctgcccctaaggccaggtcccctgcccacctcccctaccagggacatccgcagtatatccagataacagggccacctcagcacagcttatttctgggatgtctgagtgctgtcaggaaagctaaatgctactttgatgactgttggcatggcgtggcagccaagctgcatgaaagcctcatgcatcctgggcggatccccagctggggggttggtgcactgtggaggccagtgcagaaccaaaggcatgctcgttctttccacggttgttggagtcttcagaatagtgatgacatgggcaggtgctccagagaggactagagacagctcctagcctccttccatcagcaccagaagtacttcctctctgcagaagtcactttgcaaatacatgtcgagggccattgttgctgttacaggctgatgaccatcattctgcacagcccttcctctttgtccacttctctgcccctcctcatcctccaaaactcagttgctgtgttgtatcttccaggaagcctccctggggcctagaccaggagagaccttttcaggtgtgtcctggccccatttgcttgcccacatctcctgactggactgctgtgcagggtcagagaccctgggaatacagtgcaatattcctagcatttggaactatgccagatttattccctggaaatatctaaagtctgagtcttaggggatttattaggttggtgcaaaagtaattgcagttttcaccattactttttaaggccaaaaccacaattacttttgcaccaacctaatatacctaattggatatgcacaaagaagtcacaggacagttaaaggctgccattcaattcagtgtaggttaactcatggtggagacagtcagtggatgggcccctctggcaaggttgtggtcagtagctacatgtcgatgcaagaagccagacttacaccctccaaggttgcctaagatttggacagataaacaaactgtccctttggtttgtggctattgagacatctgaaacacatggccctggttctggtaacagtgaggcacccgttagagccccagcttgttgacagtagccacaacctgctcacatccttctcctggaccaaggcagcactgagtggtgaggtttgaggtctgagctgggctggcctttccctccccaccaagcagtatccattctgcttccaggggccttggaaaaacatgtttgctgggagaagacaagtagctctggttcagactgggccacagcccaggctctgtcactcagaagggccctcctcgaggagcaggagcaagctagtgggctgccagccttgcttctcatggccagtagctgtgtgtgctgccccatccttccattgtcctgtgtctatggccaggagggtcacagggacttaggaacaagactggtggcccacacaggcctccccagagggacctaagagctaattttggcagattgtctggaaacaggaatgatctaggtgcctagacagcatctctcatttccagggaggcggccagtcccaactcctgtgtcccttcccagccttggtctccctgccagagaccaagttcagaatccatgagccagagactaagctctcactcctgccaggctgctggcttcctgggcttagggccctcctgagttgcagggtccaagttgggaccagcttgtcccatgctggagggatctagaggccttgatcccattgcccggggatgctcctatctgggaagtgacaaggacaagtccacctggctggctgactgtgagaaagtagtcattgatggctctggaaccaaggcctttagagccccctggcatgggatgtactgtttccagcccagactctgcaactcagaagggcctcgtgcccaggcacactgctctgggctcccggttttcacctgtaacataagcagcttgggcaggaaggtctcagagcctcctccttagccctgctgtccaaagattcaggggctccagtaacctttgcagcttctcactgcaggacagtgccaagacaggggctgggatgggaatcgtgaaatgcccaccagataccaagagagaagcccagcaacaggcttatttcttcatctctgccacctggctcaccttaggaaatttctcctaactccaaccctagcccagggatacataaattatatacgaattagggttagaatgagtggaaacaaagttctccacgatagcccaagggaaatggctggtagcgtctgtggggaactcatctctcactcagtgctttcttttctgttcttttggggctttttttttttcatgcaaagtctgaaaactctccattcctgcccacagagggaggcaggagcctttataaccctgatgcctcaggactccgggtcacacaggtttacagagagggtagatgttccaaaactagagaattttagtcctgaaagcaggattcaaagccattgagatccataactcattcttccatttttttccatgggtcaattcagccatccaagttccttgttctgctactggcaataccagatgaataacctcttcctaaaccctcacagccctgccagctggaggtggccactttatcccagtcctttgtcccaattctgaggccattacacttgtggaattacccacctggttctttatcaagaaagccgagtggaggaccagttctctctgacagctggggaagctggagccaggtcagcttgcagaaacagagcaaatactttagggtagccaacagatgcttttgttgttggccagcatctgccccaaaaaaccactgccctacaatgccctcagccccctatggtgcctgtccctctagaagcccccatggggagctggtttggagctggtttagagctggagctgcccagcaggcccctagggcagatgctgtaccaccctggccctcctaccaggctcctgcccagactgggtcctctgtgtctttgcagctgctgccaggtccgaaaacactgtgagtggtgccgggccctcatctgccggcacgagaagcccagcgccctcctgaagggaagaaccgcttgctgccactcagaaacaggtaaggagactcttctctggtgggagacactattgggtggagaaaacgaccaccttctccaagtcagggcagaagttcctggagtatgaagcaggaagagaggagaaaaggaagagactgtttcattctaccaagtcaggtttagtttattcataggtgccttttacttagtagggaccccttacatcctggctggtggctgtgggacctttgacaagttactcacctctcacagcctcagagtttttttgttttgttgttttgttttgttttttgagacggagtcttactctatcacccaggctggagtgcaatggcgtgatctcggctcactgcaatctccacctcccagtttcaagtgattctcctgcctcagcctctcgagtagctgggattacaggctgcccaccaccacgcccagaaaatttttgtatttttagtagagacggggtttcgcagtattggccaggctggtctcaaactcctgacctcaggtgatctgcctgcctcggcctcccaaagtgctgggattacaggcatgagccactgtgcccggcttaccctcggttttcttattcttaaaaagatgtgcaaattggaggagtactgatataaaatacctagtatagtgtatcacccaattgtaggcactcaagagatgttcattctctttcccttgagaaagtcacttcccctttttcatctgtaaaaggaggaatttggcctatgaaaggtctctaatgaccttaaaacccttagatcctatgatcttcattaagtttaccttgtttcctggatattttcgccaacatccatgaagacatcaggatgtggggcccagcttgcacctcaggagcctcctcggagcatcagtggctctgtgcttgtggaggtgaagagtccttcatccaaacagggctggaaaagtctcacaccggccagcttttcagggattcaattttgaccaagagagcccatcgtaaagttcttcttgaggacatagtgggtcaagagacagtcattaaagcgaatccacccagaggtgtccttccctagtaaacagttggcgttcagaagttccagggtccatggagagggtagggaggaaggcttctgggaggctggacacatgtgcattcattagagctcatggtcatctggagggagctgaagccccaagaacatatgtgtttgttctttatttcaataaccatagtcatcgtgcacagtaagggagcacacagagagtgcgggagcggcacttgagatttaggagccacagctcttgaggatgcaaatccattcagccttacagtggtcttaggaagaggatggctcatgagcgatgtgggtaaactgagtctgatgacagcctgcttgggtcccactgggaatcagtgggggagtgaggatgagaaccagggcctctaaagccccctctcaacatctcctttcagctaccttgggctaatctattgagctaatgaaggtaaatatttttattttttcttttagcaccaatagaaaaatgtttttaatcttttaagaaaatttgtaatagattctgtagcatttgtctgaacctaacagagtcatttggggtggagtaagtttcttgttaatgtcacttcttctctacccacatttaagaagttagctctaagcctggggatgggtctggcctttagagatggcaacctgggctgaagtccctctccctcagatggtgcatatcacaacctcatatagcacctgtcaggcctgctgggcctaaaggatgggtgaaccagtggtactcacctgtgagcacctctagaagaaccatggcaaggacctagagacatgtccaggctaagctgaactcaggaactgaggacggtccatgctgcctcaccacgacagacacagaggataccctcagggcccagccattgaaaaataaatgggtccattcttgtatggcctcaggggaagcctttctgccaccagagccctggactagggctgcccaccaagccaccccttacaggatctgactgcaggccagattaaaatgagaccctcacaacagggggcatccccccgctcccccccatctgccttccttctgctatcactcactcactcactcactttcaatcagtctctctagcttcctttggcactgaaagtactaggtcagaggttgcggtccctgagactgaaccagcagaatttggactcgggcctaactgcccgagagaacttggtgacattggctctgccatctccaagtctctttcctaagcttattttcccaacgtggccagggtgtggcccacagtgcttaacctgtttttccttcctgccagtggtctgaagagcccagaggaggagtttggccaggtggactgtggcagatcaataaagaaaggcttcttcaggacagcactgccagagatgcctgggtgtgccacagaccttcctacttggcctgtaatcacctgtgcagccttttgtgggccttcaaaactctgtcaagaactccgtctgcttggggttattcagtgtgacctagagaagaaatcagcggaccacgatttcaagacttgttaaaaaagaactgcaaagagacggactcctgttcacctaggtgaggtgtgtgcagcagttggtgtctgagtccacatgtgtgcagttgtcttctgccagccatggattccaggctatatatttctttttaatgggccacctccccacaacagaattctgcccaacacaggagatttctatagttattgttttctgtcatttgcctactggggaagaaagtgaaggaggggaaactgtttaatatcacatgaagaccctagctttaagagaagctgtatcctctaaccacaagaccctcaaccagcccaacatcttccatggacacatgacattgaagaccatcccaagctatcgccacccttggagatgatgtcttatttattagatggataatggttttatttttaatctcttaagtcaatgtaaaaagtataaaaccccttcagacttctacattaatgatgtatgtgttgctgactgaaaagctatactgattagaaatgtctggcctcttcaagacagctaaggcttgggaaaagtcttccagggtgcggagatggaaccagaggctgggttactggtaggaataaaggtaggggttcagaaatggtgccattgaagccacaaagccggtaaatgcctcaatacgttctgggagaaaacttagcaaatccatcagcagggatctgtcccctctgttggggagagaggaagagtgtgtgtgtctacacaggataaacccaatacatattgtactgctcagtgattaaatgggttcacttcctcgtgagccctcggtaagtatgtttagaaatagaacattagccacgagccataggcatttcaggccaaatccatgaaagggggaccagtcatttattttccattttgttgcttggttggtttgttgctttatttttaaaaggagaagtttaactttgctatttattttcgagcactaggaaaactattccagtaatttttttttcctcatttccattcaggatgccggctttattaacaaaaactctaacaagtcacctccactatgtgggtcttcctttcccctcaagagaaggagcaattgttcccctgagcatctgggtccatctgacccatggggcctgcctgtgagaaacagtgggtcccttcaaatacatagtggatagctcatccctaggaattttcattaaaatttggaaacagagtaatgaagaaataatatataaactccttatgtgaggaaatgctactaatatctgaaaagtgaaagatttctatgtattaactcttaagtgcacctagcttattacatcgtgaaaggtacatttaaaatatgttaaattggcttgaaattttcagagaattttgtcttcccctaattcttcttccttggtctggaagaacaatttctatgaattttctctttatttttttttataattcagacaattctatgacccgtgtcttcatttttggcactcttatttaacaatgccacacctgaagcacttggatctgttcagagctgaccccctagcaacgtagttgacacagctccaggtttttaaattactaaaataagttcaagtttacatcccttgggccagatatgtgggttgaggcttgactgtagcatcctgcttagagaccaatcaacggacactggtttttagacctctatcaatcagtagttagcatccaagagactttgcagaggcgtaggaatgaggctggacagatggcggaagcagaggttccctgcgaagacttgagatttagtgtctgtgaatgttctagttcctaggtccagcaagtcacacctgccagtgccctcatccttatgcctgtaacacacatgcagtgagaggcctcacatatacgcctccctagaagtgccttccaagtcagtcctttggaaaccagcaggtctgaaaaagaggctgcatcaatgcaagcctggttggaccattgtccatgcctcaggatagaacagcctggcttatttggggatttttcttctagaaatcaaatgactgataagcattggatccctctgccatttaatggcaatggtagtctttggttagctgcaaaaatactccatttcaagttaaaaatgcatcttctaatccatctctgcaagctccctgtgtttccttgccctttagaaaatgaattgttcactacaattagagaatcatttaacatcctgacctggtaagctgccacacacctggcagtggggagcatcgctgtttccaatggctcaggagacaatgaaaagcccccatttaaaaaaataacaaacattttttaaaaggcctccaatactcttatggagcctggatttttcccactgctctacaggctgtgactttttttaagcatcctgacaggaaatgttttcttctacatggaaagatagacagcagccaaccctgatctggaagacagggccccggctggacacacgtggaaccaagccagggatgggctggccattgtgtccccgcaggagagatgggcagaatggccctagagttcttttccctgagaaaggagaaaaagatgggattgccactcacccacccacactggtaagggaggagaatttgtgcttctggagcttctcaagggattgtgttttgcaggtacagaaaactgcctgttatcttcaagccaggttttcgagggcacatgggtcaccagttgctttttcagtcaatttggccgggatggactaatgaggctctaacactgctcaggagacccctgccctctagttggttctgggctttgatctcttccaacctgcccagtcacagaaggaggaatgactcaaatgcccaaaaccaagaacacattgcagaagtaagacaaacatgtatatttttaaatgttctaacataagacctgttctctctagccattgatttaccaggctttctgaaagatctagtggttcacacagagagagagagagtactgaaaaagcaactcctcttcttagtcttaataatttactaaaatggtcaacttttcattatctttattataataaacctgatgcttttttttagaactccttactctgatgtctgtatatgttgcactgaaaaggttaatatttaatgttttaatttattttgtgtggtaagttaattttgatttcagtaatgtgttaatgtgattagcagttattttccttaatatctgaattatacttaaagagtagtgagcaatataagacgcaattgtgtttttcagtaatgtgcattgttattgagttgtactgtaccttatttggaaggatgaaggaatgaatctttttttcctaaatcaagactggagtgtttctttaatgagattaggatattgctcaaggaaatgaagacttttctctgcaaatatgaatgatgaggaaaaattagatgatcttttgcaaaatgtggaaatcctataattaaccatagttgatccctgtctccttgaagaattcaagttctctgaagctcttcccagtgtataagtacttagtagactatgtgtccaataatgctaattgatgtggtagaaaatatatacaacctctgccactgcaggaattgaaatctggtcgagaagacagactgatacgctaagaataattcaggactatttctagacaatacaaataagagatgaaattataaggtagagcatatatgttaacagctgtggttctcaaagcatggttccagacctgcagcattggtataacctgtgaacttgttaggaatgcaaatctttgggctccagcccagacctactatactgtgggggtgctccatactctctctgccctctgggtgattctaatacatgctcaaaatttttatatattttttaattttgtagagaggcggggtctccctgtgttttccaggctggtttcaaactcctgggctcaagcaatcctccaccttggcctcagagttctgggattataggcgtggaccactgcgcttggctgatgctcaaatttaagaactactgtgctataggattcagtgaagggacaacttacttagtgttgagctacagttttatggaaaagctttgaaaaggctttgcagaagaagtgaaacagagtttacctcttggagttcaaatgtaatagccatcagaaagtgtagccttgaatgaagggctgcatttatctggatcttctctgctcagcctagttgaaggaaaaaaatagatctgtccatctcccaccatacccctgggctcacccacccctgttccctaccacccagtctctaattataaggaattgttctaaaactgtcaaccggatcttacaagcccatagtaaggcctctgcacttttttttttttttttttttttttttttgagatggcgtctcactctgtcacccaggctggagtgcagtggtgtgatctcggctcactgcaacctctgcctcccgggttcaagcaattctcctgcctcagcctccagagtagctggaactacaggtgtgcgccaccacgcccagctaatttttatatttttagtagagatgggatttcgccatgttgcccaggatggtctcaatctctagaccttgtgatccacccgcctcggcctcccaaagtgctaggattacaggcatgagccactgcacccagccaggcctctgcacttctaacctgtgggtgggtttcacatatgcaacataggaagcactcacagagaagtggagggtgaaatcgttgctgcacagtataaaatcctgggccccaaagaaggttctactctttgtagggagggacgagcatgtggagcttgctgtccagaccccagagggcttaggatcagccaaacttgcagaaagatggaaactcaaggaattcttcatcccaagctccctggcctggcatctggccctcagtaaagtctttccctacctcttaagagagagtggggagacttgctacccaaacctggtcttcctcctcatgaccctattcagtctttagagacatctccaggccttcttcctaaccagtgggatttttcactagtccccattttttctcctccttcccaatttctaaaccatctacctgccaaggctgcctgcctgccagaaccaaggtccagtgattgccccttgtcctggtcaggtgcactgaactgtctggggtggggaggacccattccaggaaaaagcaccgatcaactttgaatcaagccagacctttcctcatccagttgacttgcagttgacaacttgaaagccatgttctggatgctttgggtctagcctttttggatcctgttggcccaaacttcagacccctatctttcctagttgccctgacttatgcctggctgtttggggacatttgagtataatccttgccttgcttcctctctaactcagagcttcactacgagcacttttttccccctggctcctgaaacctctcttccgcaactgctttctgcaggacttgctacttccagcaggctctgagatttccaccacagcctttcacctccagaagtcaggagtgaattgcttgcagtcacagaagctgtgtctagcgatgcctgtttcatagcgtggtgtctgtcacccaagatcaataaggaatttgaatatatggggatggaccttaggcatcactttaaaaatctctccaggtgattctaatccatatcctactcccctctcgaatacacgaggccgcagggagcaggtggcataggagaagtgtgatgcctggagctaagagtacctggtgctcacccagcacaccccaccctggcccatcctcaaggagattccttaatatccaacagatgttcacctctggggagacagaagcttgggcctcctctcaagtgggatcacctaaggcagagaagtgagaaatctcctgtgggtactcctgtaaggagtgccttgtggctggtgcttgaggtcataggtcatgcacaagtgggaagtggcttttttttttcgagtcagggtctcactctgtcacccaggctggagcacaatagcatgatctcagctcactgcaacctctgtctcctgggttcaagcaaatctcctgcctcagcctcccaggtagctgggagtacaggcaccagccaccacgcctggctaacttttgtattttcagtagagacagggtttcatcatgttggccaggctggtctctaacttctgacctcaagtgatccactcgccttggcctccgaaggcagtggctttttaggagccaaattttacacttgggaataaaagaaagttgggcatttatgctgaaagggaaagagagaaagtgggaaggggagaccactttccaggaccatttgctccaatggaaacctcaggcttgtgcatctgcacaggtgcctgggacccagagtccttaaggacctccatcccaagacctgcagagcttcccctgcaggaagtaggtgaagttgagagctgggcaagaggacatctccactaacctggggctggggcttcagctgttagtcctgcacattgcaggaagggattctggacatgtgacatcccaggagaactgggctgtgaggagccagcatcacttaaagcatgtcctaccagatcagagcaaacagccacacccctccactgcagcataactctcccaccagcccttgtgaaagaagccccctaaccagagtgcagaggtccagagcccctgtggtgggaggaggcttggaggcaaaggcccagggtttcactacagcctgcttcttgctggctgtgtcaccctggaatgttactgtttccttctgagcctcctgtgcctgtctgtctaattcccaccgatttagcccagggttgtgagctgaatctcataagcacagcctgattcttggaataaaaaaatctgatgtgatcctaaatgctatcaatatattgtccagctctagggaggcccccctcgccttgtcccccactgaccttcaaggtaaaagaagctgtgaggtgggaggtgcccatgagaaatattttcatagagccagtagcaaatgggaccaaaccagggggtgatgatttcaggacatcacttttccaagtggttaatgacccagaggagtgaggacaactgtcttcagacataaggaggtttggtctgacctcaaggggcaaggccaggagacagtttagttttgtctcagtagaagcttctgtttcattgacagagctgcctgctggctctggctgtcctccaggcaagtgtgcctcctaattccaaagtgatcacacagaggtgggtaccaaccagggcccagagggtctcctggtgaactagagcataagccagaagacctggggcatctgaccaccgtctcctacctatgagtccatgggttacccctatttagctccaagcctccatctcccactgcacccttctggaataatctttgcgagttcagatttgatcctctgtcctcccagggcttcccagtgatggagggggatctcaggccctgctcaatccccttacctcccatctcctaacatcagagccatcctaaggatggcccccacacagggaccacatccccagcgactctcatcaggagagggctctctctggtgctttccactccttaggtgcctatttgtgccagtcatttgccactcccagatccattctccccatgtctgcgctgtgcccagaagctgacccctctgggccacctccttagggctctcttgtcctctggcttccagttcagccagtgggaggcactggcaggagatcggagtgcgtgtaggaggagagacatggggacttgtcatcctcgctccctccctgctccaatgctgcatatctggcagcaactgtgtccccaaggctaggctccctgggcccctactccccagccccactcccactgggcttcaggacaccacgtcctccacttgccccttcagtactggggtggtaatgccttcccacagttgccagttgaactctgccaatcttacccttcctctctctttagtatccaatgatgcttacccagaggctgaaaagtcaaacacctcctggagtgaagtgagtcatctgaattagtgcaactgcttgatgaaagcatgaatgacgatgaatgagtctgaatccagggttgtggtggacatagtgatgtactggcaggcactgaccaccgctgaaggaggagttcacttctcagtcccagtctaaagtggatctccagcagggaggtcagttttactatttttttttttcaagagaaacagaaaatctggcccttttcataaaatatctccatccttaagtgtggttccagttaagaaaccaccctgtggccccagcacaatctgtcagcaggccaccatccgttagcagccaccactctcaagctgtctgcttgtctctggctctgccaggcccctcacacctctctatcttcgtagttccctttgctgggaaagactttttctacatctttgcctgagcaaacttctgttccttcaagaacaggctcacaggcacctcactttcttctgaagccttcctggagcatgaaaagataacgcccccaatttcatccatgtccctacaaaggacatgaactcatcattttttatggctgcatagtattccacggtgtatatgtgccacattttcttaatccagtctatcattgttggacatttgggttggttccaagtctttgctattgtgaataatgccacaataaacatacgtgtgcatgtgtctttatagcagcatgatttatagtcctttgggtatatacccagtaatgggatggctgggtcaaatggtatttcatattctcactcataggtgggaattgaacaatgagatcacatggacacaggaaggggaatatcacactctggggactgtggtggcggggggaggggggagggatagcattggaagatatacctaatgctagatgacgagttagtgggtgtagcgcaccagcatggcacatgtatacatatgtaactaacctgcacaatgtgcacatgtaccctaaaacttaaagtataataaaaaaaaaaaagataacgcccccaccccaaggccccttgcatacttgcgtttgaatactcatctcacggtgctggacttttcgttcctcctccatgagctgtcttgtgcccctggccattctgtaccccaggtcttgaactcttcaaggtaaggcatctctgtgcatctttgtagcctggtcgtttagctcaatgcctgaggcatggtaggtaacatggtaacattctgtggaaaaaaatcgtcagagatatgaggctttgggtggaccaccgtatgtctctggaggtaagagaacagtgtcatatgggatccctgggtcttgtgggactgcattattggtatgttgtgttgggtgctataatcagaccccttgaaggtcaaataggtctttgcgaccctccctggttccccatctaccatgaggagctttgcttctaggcaaaaatacattgtatgttctgacccatgacttaccaagaattctgtcacagcctaggtggatttgacaaaaatttttaatcacatccattctaccctctgtgttagtctcacacagaagagttaactctttagagaatggttatgatttcatagctctttttatttgctgtctgacagtctacaccccagcaacctgccaacaggaagcagcctggcctgagccctgagctcagactagagtggaggaagttgcacacaaagacaaaggagaggagaaagatgggaggaggtttctcagaaagctttcctctacaagatttccttcttgtggttggtttctttgaagtctaatctgctcccttgagaggcctctgatccaaacaggcaatgatgtgaatataatctctatcagccaaaacagaacatctatttagtgttaggaataggcagaacaatgagtctaagagcgacccagcaactgagtttgctacaaaattctgtccctcctctacaatacaaaatttttaaatctgggttcccccaaagacagggcctcagataataatttggggcagatcttttattttagaggcaatctcaggaagcaggagtgagagactaagaagactgagacagagaatgaggaaaagtcagcaatgggaaattagcagtgagctgactaccaatatgcaaaattgggactcaatcctactggacactcactgaggaaatatgtagaatgccacctctgaattgagcctctgaacatcagaaggcattaactactgacttccatcacccaatggtgagagttgccatagggtcattaatcctccacccccaccacacacacacacacacacacacagcacaaatcttaggggcctgatacgtgacactgctactgagcacaggaagcttttccaaagctgcaactgaaattaggtggtctgagggcgtatgatgtggcgaaaatagcatctgctacaattattaatttttaacaataaaattgtaataatcagttttttcatgaaattcagattctcttctcataaccaaaagttcttttgaagatgcagatattctgattccgtagaataccgattcaagcaatggccattgggcgttctgccaaatgtggattctgtgtgcctctaacaccttccaagatgtcggccagagaccctcccttcttcccagatatcccgtccctttgttccagacgcagttactggactgtggcaggccctgaggaccctgaggggtcaatgtattggtcacacaagtcataggtctctggttagtccatgaattcctttgaagaagaaagtctgtgacagagaaaatggggctgagggaatggggccatcaatggtgggccatgagcaagcaggtggctaagctgaggaagccattttgcaaaaggaaacaatgaggcagattcacagagaaaaagaaacagcacgtctaataggaagagagaaagtcacacccattctcaagcactttttcgttcttgttcttgtggtacctggctcacagccacctctgctctattgagccctgagcctttacaagaatcctcttttcagcccagcgcagtggctcacgcctgtaatcccagcactttgggaggccaaggcaggcagatcacttgaggtcaggagttcaagaccagcctggccaatgtagcgaaaccccatctctactaaaaatataaaaattagccgggtgtggtggcacatacctgtaatccaggatactcaggaggctgaggcacgagaattgcctgaacccgggaggtggaggttgcaatgagccgagaccatgccactgcattccagcctgggtgacagagcaagactccatctcaaaaaaacaaacaaacaaacaaaaaaatcctcttttcacctgagccagcttgaatgcatttttatttcctaaaaccaaaagagcctggactagaacaaatgcctcttgggtatctcttaaggtaaatcatatgggctccccactattatttataaggtaacacattatatcaatattaaattatatcaaaattaaattgtattaacattaaaccttgcttttctgaaaaattctttctcacaccccaccccagcccttctatgactggctccttttccttcaggtctcagttaaatgtcacctcaagagactcctacatgtaagtccactccactaccctgaataccccttccactctagttattctccatccaatattatgttcatttccttcatagaacttaccacaatttatattatatgtatattttttactaggttaatatctgtcttctccactagatagtaagctccatgaaggtaggaattatatctgtcttcttcaccactaaatatttgacatcaagctcaatacttgacacatagtagacgaccaaattggatgggtggatggatagacggatggatggatggatggacagatggatggacgtctaaattcctggataaattggatggataaatttaccagatagtgtatcattttttagaaatattgtaggattctactcactggtattttcttaaggacttttgcacctaaattctatatccactgaaaatatcctaaattaatacagaatagggacactttgcagccaaacaaaaggggaaataattcagcagaaaaagctacacactacaagttatactaaatggtactcttcaggcaggaacatgatctcacatgggatgacaaaggaataaacagtatcagaaagaataactgtaaacaggccgggtgcgatggctcatgcctgtaatcccagcactttgggaggctgaggcaggtggatcacctgaagtcaggagttcaagaccagcctaatatagtgaaaccctgtctctactaaaaatataaaaagtagctgggcctggtggccggcgcctgtagtcccagctacttgggaggctgaaacaggagaattacttgcacctgggaggcagaggttgcagtgagccaagatcacaccactgcactccagcctggacaacagagcaagactccatctcaaaaaaaaaaaaaagaataaccataaacaaatataaaacaataaaaacaataatgtcttatgtggtataaaaatatttaaagaactaaaatacccaacagcaataacatatatactagggaaggggcatgggcaaatagaggtaaagtgttcaaagacctcttccattgcttagaaagtggtaagtctattcatttttattagaccttaataactcaagaatgcatgttgtaatctctaaagtaaccattaaaataaaagtaaaataatgtataaccaataatctaaaaggagggggaaatgggaaaataaaaagaacttaattgaaccaaaataaagcacaaaaggagagaaaaagaaacattaaaaaatgtgacaaatgagagatttcgacccaactaaattggtaactatattaaatgtaaataaactaaacattccaattaaaattcaaacactggattaaaaaataaacctgactatgtactgcttataagaaatgcacctgaaaaatatggacccagaaaaattaaaggtaaaaaggtagaaaaaaatagactataaaaatgccaactaaaagaaatctagtgtagctatactcacataagataaattcaccaggaagatataaaaatacataaaaatctgtatgtgtgtagctaatagcataaggtattcaaaaaatataaagcagaaatgaacagtttggaatctccctaacaggtaaggtactgtttagaaagcagaaaaacatttatacccatggacgcttaatttccaggaacaaaattggaagggagataaggggaaccaacttcttgggcacaccctgaaagtagacagaagtgtacctatgctcagagaaagtattagtatttacaataagtgaatggagcttccacggcttttctcctagcctttgaagcaaaagaacatgttaaagaccctatgacaaatctaacccagatattttcccagccctcctcccaaatgcagcctgaaatctccctgtttccttcttgataatctgtgtgagaaactcagggataccaaataacttctctgtgaagcccccaaagccagcagtctcctgaccactcctctgccactgatcttcactgcactgtagcttagtggtcagagcacagcttagaagtcagtccgcctaggctcaaatcccagctctgtcacttgttagctgtgtgaacttgagtgagttatttaatgtctatgcacctcactttcctccactgtaaaatgcagatactttaaagaatggtggtggagattaaacatgcacattttgtaaagattagaacagtatctagcacagagtgttgtctatcattttttatctccttcatcttttatgttttgatctaatgctgtcttcagctgggtcagaaatacgttccaaacattctgcgaccttcttccacccacctaaggatctatgaatatacagtaaagacccctcagctgaatatgactggctgctctatatggggcttaattatggccacacccaagccttattccctcaatatatattcatatgtataccaggttatctccattctgggaaagaaattacaaatgatgtaactctggcaaaggcatattaaacccccaatttcaatgctatggtttttgagttgagttttgagaggtcataaacatcctcaaaagcatttaatctgtaactttatgatgtttccttaaatgactatttaagatattgacgtaggataaaaggcatatctcaaactctagatgcagtctttttttcacaaaaccatgtacattgaaatagagaaaactctaaaggtgacccaccaaaagtgtacaatttacattctctaaagataatatgctgaaactagaagttaataatatgaatttagctagctacaacaataacaatagcaactcaatgtttttattaagcaaagacataaataattttggccaggagagataagtggtacatgtccaccctcaccacttctattcaacattgtactggaggttctaaccagggcagttaagaaagaaaaaataaataaaaggaatccatattggaaaggatctttattcatataatagattatagatcttatatataggaaaccctaaataatctacctaaatatatatatcagaactaataaatgagttcagcaaggttacagaatacaagtttaatacttttaaaaaaccatatttctatacacttgcaatgaacaatccaaacataaaattaagaaaacaactcacaacagtagcaaataaaatacttagaaataaacttaacaaaagaagtgcaaaacttatcctcagaaaaccacaaaaaaactgttgaaaacaactaaggaagacctaaatgaatgaaaaaatattccatgttcatggattggaagacttaatattgttaagatggcaatactccccaaattgatctacaaactcaggcaatccctatccgaatctcagctgacttctttgtggaaactaacaagctgattctaaaattcatatggaattgccaggaatccagaatagccaaatcttaaaaaaagtaaaaagtaagaagactcacagttcctgatttcaaaactactataaaacaatgagaatcaaagcagtatgaaattggtgcaagaacagacaaaacagacctaaaaaatagatggataggatagggtaggatagggtagggtagggtagggtagggtagggtaggataggatatagtataggataggataggatataggataggataggataggatataggataggataggataggatataggataggataggataggatacaggataggataggataggatataggataggataggataggatataggataggataggataggatataggataggataggataggataggataggataggataggataggatataggataggataggatataggataggataggataggataggatatggataggataggataggataggataggatataggataggataggataagataggataggatataggataggataggataggatataggataggataggataggataggataggataggatataggataggataggggataggatataggataggataggatagataggatataggataggataggataggatataggataggataggataggatataggataggataggatatgggataggatatgggataggatatcggataggatatgggataggatataggataggatataggataggatataggataggataggataggataggataggataggataggatagaatagaatagaatagaatagaatgtccagaaataaaatcatacctctgtggctaaccaatctttgacaaaggtaccaagacaagccaatggggaaggaatattctttcccaacaaatggtgctgagacaactagataataacatgtaaaaggatgaagttggacccctatctcaaatcacatacaactcaaaatagataatatacctaaatataaaaggtaaaaatataaaaatcttagaagaaaacaggcataaatctttgtgacattgggttaagcaatgattcttaaatacaacaccgaagaaaaaatagataagttgaatgtcattgaaattaaagtattttgtgctccaaggaataccatcaagaaagtgaaaagataatctacagaacgggagaaaatattttcaaattatgtatccaagagataagtatctaaaataaataaagaattcataacttaacaataaaaaggcaaataacccaatttaaaaatggacaaaggatttgaataaacatctgtccaaagatatatgaatggtcaacaagcatatgaaaagatgttcagcatcattagttaacagagaaaagcaaatcaaaaccacaatgagataccattttacatccactagggtggctagaatcaaaaagtcagataataacaagtgttgacaaggatgtggaggaattagaatcctcatacattgctggtgggaatgtcaaatgatgccgccactttggaaatagtttagtggttcctcaaatgattaaacatagagttactatatgactcagaaattctactcctgggtatatatatacacacacaaaaaaagaaaatatatgtccacacaaaaacttgcacataaatgttcacaggagcattatttttaatagctaaaaaatagaaacaatccacatgtctatcaattgaatggattttttaaatgtggcacagactgtgcaatattatttggccaaaaaaatgaaatactgttacatgctatattgtggatgaatctggaaaacattacactatgtgaaagaagccaatcacaatagaccacatattgtatgactctatttacatgaattatctaaaataggcaaatccatagattatttgttgctaggagctgggggagaaggacagagggtatctgctaatgagtagagtttcttttggggatgttgaacatgttctaaaattaagtagtagtgatggttatgcaacattgagttaactaaaaactgctgaatgtatacttaaagaattgtatacttgaagaattgcataaagaatgaattttttggtatgtaaactgtatctcaataaaactattcctaacacacaaaaaaggacaactatagatcccattatggaaaaaaggaaaaataataagttaaatgaaaatgaaaccatcactgaactgaagaaatggactgaaattttcattgtttttgtctcaacatgagtatgtatttgctggaaatgcagttgttcagcatgatgaagacaggattcaaaacgtacaggacaaagtaagaaaccattaggcaattgtgatttttttcttatcaccgatgagaccattgatataaataatatcatacagctactatacttatagctgttcgttggttttttggtttttttaacatgagcaaagaacttttggacatgtgcccatgtcagacacaacattagggaataaattattttgcatagagaacattcttgagaagttaaatgtagacaggtcaaaattagtcaatataaatataaacagtgctgctgtgatgttggtgctaacatgggacctcttatgaaacttttccatggtggcatcattcagcaagaaaataggatttaaattcattgtgtcattcaccaggaatctctttgtcggtaaaacattaaaaagataacgcatgatgactgtagtaattaactctgtacacaagattcccactccggcttgacccagagtcacgatgaattgtcttcacagtatggcaatctgctgccctacacagaggttatttggctaactagtgtcctcatacaaaagcaattgtttcaactatgggtaggaaaattgcatcattcatgtcatctgaggaaaagtccccacctcagctcaccaaataaaattggatcaattcttgttacttttctttgttaagacaacacctccaaaatgcctttgaagggcattcacaagtagttcctcaaacgtatgatttcatttgctcactcttgagaaattgtgtctttgggaaacttatttggcaagaaccaacctggttgaccttcctgcacaaaaatcagttttctagtaatgaaagtgatgatctgaagtttatttttaaattgaggaggtgaagattgaattccacaaatgggcccctgttattaaaattatgaaaatgaattaatgttgctcagttgtctttcccaattaatatattaatgatgtggatgaagaactatgaagagtttttaaaatccagtactgaaaactaaataaaaagacatgggtgtaccagaatcctataaatgttcgtgtgatggttactgtaattatatgtatttttttttaatttccttttctaccataggcctcaaagcactttaaatatccacttggaaattctaaaaaaagagtgtttcaaaactgctctatcgaaaggaaggttcaaccctatgagttgaatacacacatcacaaagaattttctgagaattctgtctagtttttttttttattattatactttaagttttagggtacatgagcacattgtgcaggttagttacatatgtatacatgtgccatgctggtgcgctgcacccactaactcgtaatctagcattaggtatatctcccagtgctatccctcacccctccccccaccccacaacagtccccagagtgtgatgttccccttcctgtgtccatgtgatctcattgttcaattcccacctatgagtgagaatatgcagacgacatgattgtatatctagaaaaccccattgtctcagcccaaaatctccttaagctgataagcaacttcagcaaagtctcaggatacaaaatcaatgtacaaaaatcacaagcattcttatacaccaacagcagacagagagccaaatcatgagtgaactcccattcacaattgcttcaaagagaataaaatacctaggaatccaacttacaagggacgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttacagattcaatgccatccccatcaagctaccaatgcctttcttcacagaattggaaaaaactactttaaagttcatatggaaccaaaaaagagcccgcattgccaagtcaatcctaagccaaaagaataaagctggaggcatcacactacctgacttcaaactatactacaaggctacagtaaccaaaacagcatggtattggtaccaaaacagagatatagatcaatggaacagaacagagccctcagaaataacgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcaataccattcaggacataggcatgggcaaggacttcatgtctaaaacaccaaaagcaatggcaacagaagacaaaattgacaaattggatctaattaaactaaagagcttctgtacagcaaaagaaactaccatcagagtgaacaggcaacctacaaaatgggagaaaatttttgcaacctactcatctgacaaagggctaatatccagaatctacaatgaactcaaagaaatttacaagaaaaaaacaaacaaccccatcaaaaagtgggcaaaggacatgaacagacacttctcaaaagaagacatttatgcagccaaaaaacacatgaaaaaatgctcatcatcactggccatcagagaaatgcaaatcaaaaccacaatgagataccatctcacaccagttagaatggcaatcattaaaaactcaggaaacaacaggtgctggagaggatgtggagaaatgggaacacttttacactgttggtgggactgtaaactagttcaaccattgtggaagtcagtgtggcgattcctcaaggatctagaactagaaataccatttgacccagccatcccattactgggtatatacccaaaggactataaatcatgctgctataaagacacatgcacacatatgtttattgcagcactattcacaatagcaaagacttggaaccaacccaaatgtccaacaatgatagactggattaagaaagtgtggcacatatacaccatggaatactatgcagccataaaaaatgatgagttcatgttctttgtagggacatgcatgaaattggaaatcatcattctcagtaaactatcacaaaaacaattatatgtactttttaaaacactgtgaaaacactatatctccgtttagaagtgccacacttttaattagagtttttttgtttgaaaactaagcattacctccaagtaaaggattcaaggctgaattccacctttgcatcattaaaaaggaaaataagacctgtctttgaattgtcagtacaaacagaaataatactggaatccatattctacaaagaagtaataaaaaattatgagaaagcaaaaacatattattatacaatttttcttttactcaactccatattgaaaatatgatcaacaatatcacgcatatttatatcatattggatgcttctcttcatggtctaataaaaataaagttttacaatacttagaacagcttatctttcctatcaggcttgtttcactcagttacattacttccctcatccctgcaggcattctgacccttttttctatgctggtggagacatatacaaacatctatacacatataaagatttttccagccgggtgcagtggctcatgcctgtaatcccagcactttgggaggccgaggcgggtggatcacctgaggtcgggagttcgagaccagcctggccaacgtggtgaaaccccatctctactaaaaatacaaaattagccaggggcatggtggcacatgcctgtaatcccagctactcaggaggctgaggcaggagaatcacttgaacccgggaggcagaggttgtggtgagccaaaatcgcgccattgcactccagcctgtgcaatgagcgagactccgtctaaaaaaaaaaaaaaaaaaaaaaaattccacaaataagggattaactataagtgttaactactcagatttctgtgggttttttttcacataataatacatcatgagcatccctccaggtcaatagacatcagtctaaatcattctttttaataactgtacaacattttattgtatgaatatatgacattttatttcaccacatggctattgatagatactccatttgtttttagttcttcacttccaaagtcaatgttatacataaattgtacataaatgtttacctactggtactttcatttcttaggatgaagtcacatgtaggaatggctgggttgagggtaaacatgtatctgattagaggcatatttggctaccattaacagaaaccctcctaacagaggcttaaattaaaaaataatgatttgttcgcccataacaagggcttagagggtagtagtggtgggtattagttcagaagcccaggcccttatacatttttctgctctgttatcctagcatgttgttctcatgcttgtttcctcacgattacatggctgccacagctccaggcatcaatcatgttcaaattcaaggtaaagttgaaaagtagcaacagcctcatttgtaccttacatcagcaaagcaaaggccttcctagagatcctgcaacagcagtctttcccttactttttttttttttttttttgacacggggtctctctctgtcacccaggctagagtgcagtgatgatctcagctgactcagctgactgcagccttgacctcccaggcccaagcgatcctcccacttcagcctccccaggagccaccacatctggctaattttgtattttttgtagagacaaggttttgccatgttgctcaggctggtctcaaattcctgagctcaagcaatccacccacctcagcctcccaaagtgctgggattacacatgtaggccatcatgcctggccccttacatttcattgaccagaactgggttacatggccactgatagttgcaagggagcctgggaaattgagtaactggaaattgtcatgatggcttaaatcaattgtggtaattcacatttctaccacagagatagtagccattttttgaatccttgtctaccctagatataataaaccttttttatttttactggtctgatatgttaaaagtatatcaatgttgttttaatttgcattttcctgctaattaatgaggttgagaatcttgtaatataataattggccatttggatttcctcttcttgagttgctgctattcacattctttattcatttttaattggcttatttttcttttccttataacttatagaatctttttgtgtcatattaactattcatctgtcatttgtattacaaatactttcccaatcttgttgtgtcatatatatatatatgtatatatatatataaaattttttaattttgtgggtatatagtaggtatatatacttatgggatacttgggatgttttgatacagacatgcaatgcataataatcacatcgtggaaaatagggtatccatcctctcaagcatttatcctttgtgttacaaacaatccaattatagtcttttagttatttttaaatgtaaaattattattgactattgtcaccttgttgtgctaccaaatactaggttttattcattcttcctaactccaatcttgttgtcttttgacttcatttatggaattttttgttatataggtagtcaattttgtctatttttttaattggttctgggtttcctgtcttgcttaagaaaatattcccctcctcccctaacaaattaaaattattccagtgctcagaaagctactcatttcaaatttgaagcaaatatgactagatgtctaaacattggggatagggggaactatatagttcaatctcatttataaatggagatttttaaaatcctaaataaaattttaggtttttaatttgaagtgtattataagaaaaggcattacaaccagcagggcttattccagacctacaaggataaggggcagataaaaaacacatcacagatataacaagtcatggtcacctgcataggcttgtgattaagtcctcactctaccaccatggaccttgggaaggttactcaacttctctgggccccagtttcctcatggtaaaatgagggtgttaatcatatctaacgcaaagaggttttgtgagacttacatgagttaatgctctcagcccaaagaccgacacatagcaaatgctcaataaatagctattgcattaactattattaacaacacaaacaacctgcattatttgtctgtttgctttgttggtttcagccttattgatccctgggaatcatgttacgtatacacaaagcaagatctcactcaacacaggtgtgttgtgaatgatctttgaagccagttcccactaccatgtcgagtgtctgttaagggaatacagtagagacgaggggagccaagtgtttgcaggggagctgggccagccaggtttcatcatgccagctgcctgagaaacacattcagatctgtgcccagcgactcggcagtcattgcacaaggcacaggaacacaccctcggggagacacacctagtcacaaagcaggtatagtgtgtctgccagggtcccccacccccaaaccaaagggcagtgagaggtgacagacacaaaaatggggctcagaaggcggtatgacaaccttactcctgagggactccagcaggccctcctcatgtcccttcctgctggcccctagggcaggcagctagagggcttcagccttggaaattgctgctcagctagccttttgagccaaccttacaggttggacttgcatttgcctggatccttcttccatgcctagccaggctacctgagagtgaaattagcagcaggagagtgaagaagcttcccactcactcccagaccccgtaagactccccagagcttgcatggcttacacctaggaagggctcaacacatttaattacactttcctaagaggaatcagactaagggcatggctggactgagggcttaagttccacttaaagatctgcgttattggtttggccttgttcttctcactagatttttctctccgctgggtttatttttttcctatcaccccctaccccaccctcagaatagaatacaggcattttaccacaggtgacatttcagcttaacatacaggcagcaaacagaacaaccagccaagattcaagaaggagttttattccaacagaattagaatatttagagttacatgagacatggcccttgtattggacttagatatcaccattcaaaagtaagttttcagagagccttttaacgatgagaagaaaaggttcacaatctaacatcaggagaggggaaaaaaaagactatatgggaaaatattaaaaattagtgctttttctgtatagcaggattgggaatggctttcattttcttcgtgttttttctgccttttttttttttttttttttgagacagagtctcactctgtcacccaggctggagtgcagtggtgcaatctcagctcactgcaacctctgcctcccaggttcaagcaattctcctgcctcagcctcttgagtagctggaattacaggcacctgccaccacacctggctcatttttgtattttttaatagagacggagtttccccatgttggccaggctggtctcgagctcctgacctcaagcgatccacccacctcagcctcccaaagtgcaggggttacaggtaggagcaaccacacccagcctttttctgcattttccttaaagtgtactcattaatgtcattatcatgtttgtcacccggaccagaattccacacctgtccatcaaaagccagttcccatctctatctccttgcattttcatccacctactctgcatctctaagcccaaatgcctctgtccctggattctgcttccagaggtgtatcccaatcaccagcacatgctcagcaaagggatttatcaaaaaattatttttaatcagatttcaagcttttcatgaaaaatcagaagacctatcatagtgctccaggaatcccacacggcaactaacagtctacacaaccataccttttagaggagccactctttttctgcctcccagcagccgttcccttcaagattttgttgcctaagctaatcactgcaaggggaatagccttaatttgtttgactcaatcaggattgaccccctcagctggagttgtaagctacttccctgagcatatgagagggtgaacaaaaagcatcactgagcaagaaagtggggaatgacagctggatggctgactcacatcattttccatattatctatgcacacttcaaggcccaccttaactccatctttctttggaactccaccttggatccctccaattcctttcaaccaagagggctgacttcctggatatcttctttataattaataacccacagtcttgtggcatttctcgagtgtgtttggcacaaagataaagtcaactctcctagaatgaacggatggatgaatgaatgaatgaacaaatagttatatgataaaatgtaccggaagaggacatgactggaggaagccagcaggccaatgcattcattcaagagaaggggaaaggatagattgaagcagggataatgaagatgaaaatggaaaatatttcggagatatttggtaagatctatctagcctactactgggatgtgggggtagggaggggtggggaggagttgaaaatgctatggttttctggcctagattctgtaattctattcgtagaagaagaaagctgcagggtccagggagcttggcagtaccttcttcttatggcattgctaactaatgcctcaggtatgagaagatacttttggggtaaaaggggcccagtaatcagcctggagtcaggattgttgtaagggaagagagtgcatgccaaaagggctgatatttccgttatgtcctataactgggaactccctaaatgcaagacacttaatcaggtcccatagagagagaggacctctgaaatgctgggctaggctgctgtcatattaactctagtgacagaatcaacatccaagcacagggcaaacctccataaatgagcaccacagaacactgggtctcatgctgctgggggaagagtcagggcagttccaaacactgcaacccaaaatcattggaaagagccccaatattgaattaaatgaaatcaatttgatttgaccattcactgtattttaaaattctctagcctaaaaaaggaacacaaaggtatttggaagattgtgctccatgatttaaagggcaggagtctgcaccaaaattatctccaattgagttgaaatgtctctaagaatggaaatgtagatcataactggaacttactttgaataaagcccacttatgggaatttacgttggtccatgttcctggcagaaagagcacacatcagccatccttctcaaaagactccatgctatggtttgaatgtgtcccccaaaattcatttgttggaaacttaatccccagtgcatcaatgttgggaggggtgcctaataagagatgattaggtcctgagggctctgtctcatgaatgaattaatgtcattattgcgggagtgggtttgttagctcaggagtaggttccttatgaaagggtgagttcagtccctgcctctctcttgccttctcttagctcttccacttatctgtcatgtgaggaacagtgctcctcccctccagaggatgcagcattcaaggtgccatcttagaagcagagaccaggccctcaccacacaccaaacctgccagcatcttgaccttggactttccagcctccagaactattagccaataaatttctctttattatattaataaatcacccagtctatagcattctgttatagccacacaaaccatgacactaatcattcagaattgtaaggtttaccttctttcccctcccccttagtcttctattctctggcctaaacaatctttattcatttcacttttctataccctcacctttaattactttggctcatttctgtggcttgttttgggttctcttctgtggcaccttcaaatttcttcagtagggtacagggacccaagccacgcctgacacaatgaggacattgccatgcatctttctgccattctggatgcctcttctctaaaaacaggcagtggatatgagcaggtatatcacctaagaagaaatattattataagtggtcaataacatatactcaacttcactaataattaaagacatgcaaattaaaataacaatataacatttttcgcccatcagatcagcatagatttaaaaaaaaaagattcttaatatccagtggtagttaggggtttttcaaactattggtaggaatattggaacaaactttatggggggagggagaacttgatagttctatacaattttacatgtatacatgtatacattatacattttacatgtagacatgtagacattatcacccatgtagacattatcacccatctattccacttttatgaatttatccttcagaaatattagcacaagcgtgtaagatataagcaaaagggttgcagcattgtttgtaatggggaaaaaaatggaaaaaatctaaacttccaacaatagagactggttaaataaatggtgcaaaaatacaatggaattctatgcagccattaaaaagaatgatagaaatccctaatctaggatatgatgtaggaaatcagcaaagaaatgttagctaggatattttgttaaatgaaaacaaatttcaaaattattagtaaagaatgggttcatttttaataatctgttgtgtatacgtgtagagatacagagatatacaagtctctgtaggtacacgaagaacactaaactgtgcttcttaagtgaggttcctataccagcaacatcagcatcacctggaaacttattagaaatgcaaattttccagctccaccctagacctgctgaatcagaatccctaggggtggggcccagcaatctgttttaacaagccctccaggtggttccaatgctcactaaaaatttgagaatcactgttctagaaaaagcatttatctaaaggtggggagagaagacatgtagcttacaagaaaatttctcattgtttattcccttttataatgttggaaaaaaagttaactcttttaatgagggatgtttctcaaagtcacgtacacatcttattaggttgtggcaacttatcagttaaattggcttttaaattttttttaattttttgtggctgcatgttaagtgtatatatttatgggatgcatgagttttttgtgtttattattttttaagttccagggtacatgtgcaggatgtgcaggtttgttacataggtaaatgtgtgccacggtggtttgctgtacctatcaacccatcacctaggtgttaagcccagcatgcattagctcttttccctaatgctcttcccaccgtcccccgccctccccacatacgatgctttgatacagacatgcaatgtgtaataatcacagagaatggggtatccttctcctgaattgacttcttatcagaagaactgacttttgcactctgcttgaggaaaatccaaccttcaaaacttccaacgtttgaagggagatacttacattacggaatgatttatgacatcaccagaataaaggaaaatgaacacacacacatcaggaattgaacctgggtcttctgtgtgagctgagggaagggagctcatggtccctgagccgtggttgcatcgtctatgactgaggatagcaacagtaccttgtctcctcagaggtcacacggaggagcaggtgacatacaggaaagcttactgctaattatcatattctgagtaccaaggtttcttaaaacagtgccctcaacaacatgatcaactgactctatttttcagaaacaccattattgcataacatcagcctagaatgatccttctaggagaaacagctctgccagagagcctttgacacacacctgccaagattgcttttactagtgaaacatgtaaaaccttgatgaagccagtgaataagtgcaaatgatttatttgcactcattcccaggccctcctgccagtcagcctcaagcctgctttgtgtggagtgtcccttttatgatctgtgaaagctctgcttcttacaacctcacctccttgtcttcagacaacaaagcaggcttttctatttgcacaaagtgcttgttgctttcttgatccatgagaaaacgcggagcaagagaacaataatgtgctgcttctttctgctccaataaaaaagagttatgaaacagaagcctggggccaaagcaggctctctgtcgtgtgttttgacaaagaaattgttccttaagcacagtcttcaggcagatggcagtaaacaagacggtgtggctcagatcatatcactgggaggctcttgctctgtcaatgccaccctgctctctggacccagctaggtgcccagagtagcaagcagaacctttgccttccatccagaatgcctcaaaccccctttccccagtggatagaggtgcaaagaccacccagctaggtgcccagagtagtaggcagaacccttcccttccatccagaaggcctcaaaccccccttccctagggtatagaggtgcaaagacacccagctaggtgcccagagtagctggcagaacccttgccttccatccagaaggcctcaaccccccttccataggaatagaggtgcaaagacacccagctaggtgcccagagtagctggcagaacccttgcctttcatccagaaggcctcaaacccccttccccagtggatagaggtgcaaagaccacccagttaggtgcccagagtagtaggcagaacccttcccttccatccagaaggcttcaaaccccccttccctaggagatagaggtgcaaagacacccagctaggtgcccagagtagcaggcagagaacgcttccctccctccagaaggcctcaaaccctgcttccctaggaaacagaggtgcaaagacacccagctaggtgcccagagtagcaggcagaatccttgccttccatcctgaaggcctcacatccccctaccctaggggatagaggtgcaaagataccacctagagctgtccctagctcccagacctatcccaccagccctctagcagtctccatctggcttcaggaaagctgttggaaaaaattcaggtggattctgttttcttcacaatactaatttgatagggtttgaggaggagcccaggaattagcctttgtttgtttgtttgtttttcgtttaacctctctggatgatgctgatgggcggctgaatttaggaacatgttttagaggcatctaaaacatttccctttctttgaaactctggctctccttagcagaactggtctagccacccaccttagccttccctgggctcttcacacaggccccctaaggggcccatacacatatgaaatctatcaccccctttacacatatctcttacccctcaaaaataagtagaggttggatcaactgggtccaactccaagctttgctacttaccagcccacgtccctgggaaactgacgagcatttgagcctccgtttcctcagctgtaagacgaaaataataattattgcctaggttaacgaggttgaaaggacccaggtgtgggaaagcactacgcatgtgtacagcatgggcaaaggctacaatcgttattcacaggtgttggttcagagctctcctcccagtgggtggtcctcaaactggttcctggccttttagagacaccacaatgaccagtgatatggttcggctctgtgttcccacccaaatctcatgtcaaattgtaatcctcattgctggaggagaggcctcgtgggaggtgattggatcatggggacggacttcctccttgctgttctggtgacagtgagtgagttctcgcgggatctggtggtttaaaagcgtgtagcacgtcccccttcacgctctgtagcctgctttgctgggtaaagatgtgtctgcttccccttcgctttcctccgtgattttaagtttcctgaggcctccccagccatgcttcctgtacagcctgtagaactgtgagtcaattaaacctcttttcttataaattatctagtctcaggcagtgctttatagcaatgcaagaacagactaatataaccagcatccttaattcatttccaaccattcctctaaatttaagggatggggagagaggagggtcgaagggccttgggtgtgggtgtgccctgcttgggttaggggaactccatttgaacagttgtcttcaccactcaagagttcctttaggaaaatcgtcctatgctgaaaaccaggctggggtaggggagggagaatgctgtgtgtgaaagaagtgatgagttaccacacttctaataagttgaaccaggctttaattttttttactaagctacattatttgggctttcactaaaaaattctattaatatttttaatgagaaatgtgcttgggtatgctttattacagtttgaaatcttgtttaattcattttgatgcagcatttccaagatttgttctaaagtgggcttttttcaatacttgtattgattggctattattgctggaaaagatacttcccaaagacacctgcagtacatccaaatgggagaagcgaattgtgatattcagtgttcaaactgacaccaattatacaaaggcttttgttgaaatgcagctggtgaatttatatattcctgacgccaattgttccacaaactaattggaaggtgtcacatttttacattaacaaggttcaaaactcactgaaactcttcatttaaagatttgtaaatactgagaaaagcatgttcctaagttttttaagaaggcagatctgggcattttttttaggaggcccactgcactttttactataaaattatatgactacattaccaaatactcatcctcaattctgtctccatagcacaagttcccgtcatcgcaaagcaactattttctccctcattgctagaggatcaccattacctcagaagaacaaaatacctgtgtttattgttttaaaaattgcttttagaaagcacacttctaagggtcacttgtcatcactgataaatgggcagcatattcatagcccttctctttataaaaggaaatttcttgtttttaagcattctgccacaagataatcagctaatctctatgtggtataaaagatgcttgtagtcactacccatctcattcagaatattaagattccactgtatttttatagtcttttttttcattattaccaaattgctgatctagcacctagggtacatatggcttcaacagcattattggaaagcttgctttttaataatatagtgaattaatttcatctaaggtgttacctctataaccttacttctgaatcctcttttgtatgttgttcaaagcaaacactcggttaatgattacacaattttttctaaaattaagtgtattacaaagccactcactgttgaaaaatatcctttgtatgatcttcctttagtaattaaaaattatgtcttttgggttcttgtttcctgctataattatgtatttgtctagtccttctcattccatcagtatttgttttatgttttttgaagctttttattgggtacatagatatttaggattgttatgtcttcttaatgtattgacccctttaacatatgtaacgtcccccttgttctgaagtctactttgtctcatatagccactcttttattattacttgcatggcatttttcatgtatgtttttatatttaaagtaggttttttgtagtcagcatacgatcagtcttgcttttttttccaatcttaccacctctgttttttatttggaatatttagatatttgcatttgatataaatatggttggactaaatcgaccacctgacaatttgtcctatctgttctttgttctttttctctcttcccgccttttttggattaacagagtgttttaataattatttatctctactactggcttaataattacacctctttgttctactttttggtgattgctctagtgtttataatacacagtctaccttcaatataatacctcttcaagtacactgacaaaaccttacaacagcacacttccacgtcctcactctcgtcctctgtgctattgttgttatacattttactctacatacattgtaacacccccaaacacaagtaggtttccttctcctcccccagcagcagttagcttttacttttactcctagcccagagattgtagctcttagcctaggacaggggatgagagagtttccttcccttcagtctccctctaaagtgtatggcttttgattcatatgaaagtagtatctggaaagtaagtagggtccatgcctgtgcaccatggagggaaaagctctctcaggtttcctatctcacccctaatcttcatgagtacctggtggcggctcatacaaaagggctggcaagttagcatgggttcctcttgggtctggggtttctagagattctaaatggagatactagaggcacacttggcccttaagaattcattaaaattttttcttacatgtttttttggcaaagtgctgatagttctgtgctctatcttatctcaggggcttctcaccccctggaatttagtaaacccggttgatttgagacctcagctctctaatgagctgaaaaacatttaatgacttatctttagccagctttttctcattacctagggtggatgcaatgagctcgtgtgactttctgtattatttaaaaaaaaaaaaaaggaatttttgtggtatttctttattgaaatagaatcttagaatgaccataagctgatacatctatacttccatccaacagtataatataaaacacctctcacgctgagcaatccattttaatgcttcttgctccaaattttaagcaatgttttctaagcatcattcaacagtttccaatgttgtttttctaacaaatgaatgcatcatagttttttgccatagtgtgttctatgtatttcagccaggaactcagaatattttccagtgtcagaaagtattcctctagtagtgtacaactttttgccttttgctattgcataagaaacctcaaaagagactttaagctgggagcagtggctcacacctgtaatccgaacattttgggaggacacacagggaggatcacttgagctcaggagttcaagaccagtctgggcaacataatgagacccccatctctacaaaaaaaaaaaaaaagaaaagaaaaaaaaaaactaaaaattagccactcatagtgacatgtgcctgtattccatgcttctcaggaggctgaggtgggaggattcgttgggcctgggaaggcaaggcaggctgcagtcagtgagctatgatcgcaccagtgcagtctagcctggggggtaagagagatcctgtctccaaaaaaaaaagacactttaaacatatattattatgtttaataaaattttctgcattcagagtccagagtgctcaccatggaaccatctgtgtttagtaaaattttctaacaagatttttttttcctgactttaaatattgctgaaaaactgtagagacatgtcttcatgtgttgggtgcttagtttttaaacacgctgctaagtgtgatgggggttttttgtttttgtttttttgtttgttttgagacagtgtcttgcactgttgcctgggctggagtgtaatggcactatctcggctcaccgcaacctccacctcctgggttcacacgattctcttgcctcagcctcccgagtagctaggattacaggtgcacaccaccacacctggctaattttttgtacttttagtagagacagggtttcactatgttggccagaccggtctcaaactcctgacctcgtgattcgcctgcctcagcctcccaaagtgtgaggattatgggcatgagccatcacgcccagccagtgtgatggttttatatcaccatttgctaatctcttgaagcatgatataaacttagagggaggctcaccttaaagattgtggatgtaaatccatattccaaattgccttccttaccagctttcttcaacttctcggatctgatcagattgtcattgtttttactttgtaacacaatgagcctgacacagctcactgtgggaatagaaatgtcccctactttttctctgtgtgttcatgagatttgcttggatttatgttttagtaggattttcaatccatgccttctttataagccgcttgtccacttgtgagcattattttagaatttataaatctaatgttcattgcagtttgtctcagtatgctaaaaaaataaacaaaagcccaagaatgccactgttagccttctgtgtgattgaaaccctcattctgccctcaagataccttacatgccaggcatgaaggtgctagcttccattaaatgtgagtaaacttcatctctttcttgtatcttggattggaaaataaatatgagtaggagtactggcatgttcttcctgctccccagtgggtcatccttggggatctcacagcccaccttagagagcattcatgtaagacacatagggggtgcttcacacacagtgggtttgaattcctgcaaatcctcttccctcgggggaacatgtgtagtaaaaaacactgggaatgtcatccagtcctcagctctctggggaatctcggaggtttatctctataggcaggagaattagggaagaacaagtaagggactaaaccaaggggtcttacctgaaaactcaagatgaggctggacaaggcttgtgttagatcagagcctggggaccaaaagatgagagtcattgggtatctcacaaggtcatagacatggggatgactgtcagcagaaatggctcacccagatgtttctgaagacagattctcccgaaaaggaggggagaggactctgatgagagagcccaggctcccccagcacaggcaacctgacccaaataataactacttttagctgacaggagccatacaggccccatgcaggcaggggcacctatatgattaccagcagcacccaatgtccttgactcagaaatacagcactcctttttcctaagtgttctcctaaaaccaaagtagatggtggccaggtgcagtggctcatgcctgtaatcccagcactttgggagactaaggagggaggattgcttgagcctaggagtttgtgaccagcctgggcaacatagcaaggccccatctgaattatttaaaaaaagaaaaaaagtagatggagacactgcaaccaaagccaccagtctgaggcttctgtatccctagatgtgattgcatgtcttgcctgctacttctgggatctggataaaccccacaggtgtccttctccccacctcctcctccatcctcctccctacagagaggatgaaaaccaaccctgtggttcctgcaaggggcagcctgacagagagcctctgtatccacacaggaacagttctgcgtgtccggctgccggcctgtggcctttgataaagccacacaggggaaacctctttcaagcaatgagcatcgctagcagagcatttattggcctgcagcagtcctgtgatgtgtaagccactgccttggccttcagcccacttcagaagcacaacttaaataacggctttcatgttagactctgaagtgagccaaggtttgggaagctcctagcttttaagatgtggctttcctcatgttttgaatggtctcctttgactaagcctaaaccaaggtatcagtcaacaaaaatttattgagtacttactattttatttcattgcaaaaaaaaatttttttttcacatgctcacttgtacccagacacaagcaaacttcaaatcaagagagagaagatagataagaggcatggactccagagttagagagactataattgaacttctgtttcaaaggtgacaaaactgaggcccaaaggttaactaacttttccaagggcttccagccagtcccagttaataaacagctttagaagttgaatcgtagactctcagagtagggagggacctcatagtatgttttctccggccagcttcaacataagtttgctgatacctgaatcttttcccaagatatgctgattgagaggtctgggtaaggtccagagatctgcattttaaccactcctccccactcaccaccccacttcccacacatatctgattctgatgcaggtggcacgctctttgagaagcattggtctagtccaaatttccagttaacgtcaaattttcaggaaactatgccacctgagcaaaagcaagtgcagtgataggacaatctgtacttcctaaggggctagcacattccactgttgcgtggctgttagcattagaaagttcttccttagaggtaacaatgtttcagggaggctcttctgggtcctgggaagtcatgcgctcatgaacctagatgatgagggagtagggtaaggtcacatgcagaagggaggaggcaggaattccaagacaggactctgcctggattgcaggggtcactcacagggaactgaaacaagagccaagtgtcattgaggtcctataagcattcccaaggaccgggtgagtcgtctatccttagcagcaggcatttgttcttcacaagggagcaaatctggttgggtcaatttgtcagcatgcaattcagaaccccgtggaaatgctctttccaagcttcccttctgggagggtgtagtcagtggacagcctctagcggctgcacctcaggatccaccacagccttcacaagccccacaccgaatgggctactcccagtcagtcactgaacacagcaagggaagcagagatagggcactgtttcctgacaaaggactcttccagcaggcaacctcatctgaagactccccacccatccagctgagatttttctcagatgccctgcagcctgaggctcttcctacacaatcctcctttccctctctcctttctctggtgtcagacgagcttcatggtctacaggatctttctgtctactcctgcttcctgtcccctgtatccttcccaaacatttccctccagtacatctgttgctcttttaattccatcttggcatctgcttcctgaagggcccaactcacatgccacctgatatgcaacagcttcttttatgttcttcctttatgtccatgcttgctttggcctgggcaccaaccttggtctaatcaggtgtcgggatcgcacaaccccagaaataactgctcttggaaaaattaattcctggggctctaccataggagagggctatagatatgacaatccagtaaggccagaatcaactttcttgaaattctcctgctggtactagctgtccccacaaaaccgtggtctccatatcagggtgtgcacattccaggggcagcacaagtcaccctccagagtggggggaaaatacaaagacggcttattttccatcttaaaaacaaaaaagaacttcaactctgctaacaattaatgtgcatataacttgtaaataaatatatacttgccggaagagtactgaaaatattttactgttatgggtgaacaattttttaaaagtggagagtagagctttagagtgataatgaatgaaactaatccctgtttgacataatgcttcctaacacttaaagacagcttgtatgtccttcctaaattatctcttcctcagaagaggtatcctcaggtactttagtcggcactcagctagctgaactccaagatccttcatcaaccctagttgttatttgttagttaccatgagaaagtatttggctaggacttagtaccactaacctccatctcagggttagtggcactaagtactagccaaatacacacacacattatatatatatatatacacacatatatgtaattgtaagagcacttaacagattactgtgttaaatgtttaagagtacaatacagtattgttaactataggaacagtgttgtacagatctctagaacttatttagcttgtgtaattaagactatacctgttgcaattagcaactcctcatttcctcctgataaccacaattctgattctataaacatgactattttagattccatatatatatgtaagatcatgcactatttgtctgtatgtgcctggcttatttcacttagcataatgttctccaggttcttctgcattgttgaaaattgaaagatttccttcttttttaaagctgaataatattccattgtatctataaaccatatttcctttctattcattcaacattgggcatttaggttgtttccacatcttggttattgtgaataatgctgcagtgaagttgggagtgcaaatacatttttgagatcctaatttgaattcctttgtgtgtatatatatccagaaatgggactgctgaatcatatggtggttctatttttaattttagggagagtcttcatactgctttccatagaggctgtaacgttttgcattcccaccaacagtgtcaagtactccaatttctccatgtattttccaacacttgttatcttttgtctttttcataatagccatcctaacagtgtggttttgatttgtttccctgataactagtgacgttcagcatcttttcatatagctattggccatttgtgtgttgtctttggagaaatgtctgttcaagtatttggcccatttttaaattggttattagctgttttccttatatattttggaaattaaccccttatttgatatatggtttacaaacattttctcccattctataggctgccttttcactctattaattacttcttttgatgtgcagaagctttttagtttgatgcagtctcattgttctatttttgcctttgttgcctgtgcttttggggatatatccagaaaatcatgacccagaccaatgcatgaagatttctcctatgttttcttataggagttttatagttcaggtcttacatttaagtctttcatctattttgagttgatttttgtgtgtggtgtaagataaaaatcaaatttttttattgcatgttgatacccagttttcccaacaccatttatgaaaaagactatcctttccccattctgtatttttagcacctttgttgaggatcagttgaccatgcgtgtgtggattaatttctgcgctctttattctgctccattgttctatatgtctatccttgtccagtactagactgttttaaattgttgtagtattctgaaatcaggaagtgtgatgcctccagctttgttcttctttctcaagtgtgttttggctatttggggtattttgtagttttatataaattttaacttttttttctatttatgtaaaaaatgccattgagacttttatagggattgcattgaatctgtagattgctttggatagaatggatattttaataagtctttcaattcatgaacatggggtgtccatttgtccttttttttttattttcccataggttattaggatacaggtggtggttagttatatgaataagttcaatagtggtgatttgtgagactttggtgcacccatcacccaagcagtataccctgcaccctatttataatgttttattcctcccccctacccttcccccaagtccccaaagtccattgtatcattcttatgcctttgcatcctcatagcttagctcccacatatcagtgagaacatacgatgtttggttttccattcctgagttactgtacttagaataatagtctccaatttcatccaagttgctgtgaatgctgttgattcattcctttttatggctaagtagtattccattgtatatatatataccacagtttctttatccactcattgatgggcatttgggttggttccacgattttgcagttgtgaattgcgctgctataaacatgcgtgtgcaagtatctttttcaaataatgacttcttgtcctctgggtagatacccagtagtaggattgctggatcaaatggtagttccacttttagctctttaaggaatctccacactgttttccgtagtggctgtactagtttgcattcctaccagcagtgaagaagtgttccctgattaccacatccttgccaacatctactgatttttttattttttgattatggccattcttgcaggagcaaggtggtgttgcattgtggttttgatttgcatgttcctgattattagtgatgttgagcatttttttatatgtttgtggaccatttgtatatcttcttttgagaattgtccattcatgtccttagcccactttctggggggatttttttttcttgctgatttgagttccttgtagagtctggatattagtcctttgtcggatgtatagattgtgaagattttctcccattctgtgtgttgtctgttcactgctgactgttcatttagtttagtttaactaaatctctttagtttaattaagtcccatctatttgtcttttttttttttcttttttgtgagagggagtctcgctcttgttgcccaggcaggagtgcagtggcgcgatcttggctcactacaacgtccgcctcccgggttcaagcgattctcgttactcagcctcccaagtagctgggattacaggagcctgcgaccacgcccagctgatatttttattatcagtagagacggggtttccccatgttggccaggctggtctcgaactccctacctcaggtgatccacccgccttggcctcccaaagtgctgggattacaggcatgagccaccgtgcccggcctgtctttgtttttattgcatttgcttttgggttcttggtcatgaaatccttgcctaagccaatgtctagaagggtttttccaatgttatcttctagaatttttagtttcaagtcttagatttaagttcttaatccgtcttgagttgatttttgtatgaggtgagagatgaggatccagtttcattcttctacgtgtagctagccaattatcccagcaccatttgttgaaaaggatgtcttttccccactttgtttttgtttgctttgtcgaagatcagttggctgtaagtatttgggtttatttctgggttctctattctgtcccattggtctttgtgcctatttttatatcagtaccatgctgttttggtgagtatggccttatagtttgaaatcaggtagtgtgatgcctccagatttgttctttttgcttagtcttgctttggctatgcgggctcttttttggttccatatgaattttagaattgttttttctaattctgtgaagaatgatggtggtattttgatgaagattgtgttgaatttatagattacttttggcagtatggtcattttcacaatattgattctatccatccatgagcatgggatgtgtttccatttgttatgtgcatctgtgatttctttcatcagtgttttgtagttttccttgtagaggtcttttgcctctttggttaggtatattcctaagtattattgttttttgcagctattttaaaaggggttgagtttcgttgttgttgttgtttgttttttgttgtttttttgttttgtttttgttttttgagacggagtctcgctttgtcgcccaggctagagcacagtggtgcgatctcggctcactgcaacctccgcctcccggattcaagctattctcctgcttcagcctcctgagtagctgggactacaggcatgcaccaccacgcgcccagctaatttttgtatttttagtagagacgaggcttcaccatgttggccaggatggtctcgatctcctgacctcgtgatccacctgcctcagcctcccaaagtgctgggattacaggcatgagccaccatacccagccagggttgaggtcttaatttgattctctgcttggtcactgttggtgtataggggagctactgatttgtgtgcattagtcttgtatccagaagctttgctgaattcttctatcagttctaggaactttctggaggagtccttagggttttcgaggtaaacaatcatatcattagcagacagtgacagtttgacttcctctttaccaatttggatggcctttatttctttctcttgtctgattaccctggctagcacttccaatactatgttgaagaggagtggtgacagtgggcatccttgtcttgttccagttctcagagggaatgctttcaacttttccccgttcagtattatgttggctgtgggtttgtcatagatggcttttattacattgatgtatggcctttgtatgctgattttgctgagagttttaataacaaagggatgctggattttgtcaaatgctttttctgcatctattgagatcatgtgatttttgtttttaatgctgtttatgtggtatatcacatttaatgacttacatatgttagtcatccctggtatgaaacccacttgatcatggtggattatctttttgatatattgttggatttggttagatggtattttgttaaggattgtagcatctatattcatcaagggtatcagtccgtagttttcttttttggttatgtcctttcctagttttggtattagggtgatgctggattcatagaatgaattagggagggttccctctttctctatcttgtggaatagtgtcaaataattggtatcaattcttctctgaatgtctggtagaattctgctgtgactccatctgatcctggacttttttgttggtaattttttaattaccattttaatcttgctgcttgttattgatctatttattgtatctaattcttgctgatttaagctaggagggttgtatttttccaggaatttatccatctcttctaggttttcaagtttatgtgacacaagacaagttaaaagtacatagggtgggtccaggggaccaatgctagtatggaggctgtgaagcctccgaattctgggaacccacactatttattggtgatcaaacaaagaagcaggtggtgaggatgtgaggatgtgggagtagcaagataatggtgcatcaagcgtagatgtgacagtttagcatatgctctgctacttgagataatggagaacaggttcttctaactcaaggtacaatcaatttttgatcctgggagagcaagaagcaaggcgccagcgagtctggacacattccagaggccacgaggggttttatgccctgagtcccggattctctccaagccacaaggagttttatgtttgggcttagattgtagtgtggtggggcagccttccacccttaggcacagagcttggtgttccatgggccatgaggggttttagaccctggaccctggatatgttccaagactctcttacattatgtcagacaagcaagccctgcctcagcccttctatcaacatatgtggttaggattgtgatattttcctgttggacaaggtcttttaccattatgtaatgtccctctttgtcttttttgactgctattgctttcaattttgttttgtctgatgtaagaatagctagccctgctcacttttggtgtccattggcatgaaatgcctttttccaccctttactaagtttatgtgagtccttatgtattaggtgagtctcttgaaggcagcagatagtttgttggtgaattcttatccattctgcaactctgtatgttttaagtatagcatttaggacatttagattcaatgttagtattgagatatgaggtgccattccattcattgtgctatttgttgcctgtgtaccttggttttctgtttttgctttttaacttgtatttttattttataggttctgtgagatttatgctttaaagatgttctgttttgatgtgtttccaggatttgtttcaaaatttagagctccttttagcagttcttgtagtggtggcttggtagtggtgagttctttcagcatttgtttgtctgaaaaagactgtatgtttccttcatatatgatgcttagtttctctggatacaaaattcttggctgataatcgttttgtttgaggaggctgaagatagggccccaattccttctggcttctagggtttctgctgagcaatctactgttaatctggtaggttttcctttataggttacctggtgctgttgtctcacagctcttaagattctttccttcatcttaactttagataacctgacaactctgtactctcccccttttcctatggatgtggcttcctgagagccaagctgtagagatcgttatctctcttctgggtctagccacccagcaagtctaccaggctctgggctggtactggggttgtctacacagagtcctgggatgtgaaccgtctatgggtctctcagccgtagatacagcacctgttcagtggaagtggcagggggatgaaatggactctgtaagggttcttagctttggtggtttaatgctctatttgtgctagttggcctcctgccaggaggtggtgctttccagagagtatcagctgtggtagtatggagagaaaccggcagtgggtggggccctagaactccaaagagtatatgccctttgtcttcagctaccagggtgggcaaagaaggacaatcaggtgggggcagggttaggcgtgtctgagctcagactctccttgggcaggtcttgctgcagctgctgtgcgggatgggggtgaagttcccaggtcaatcgagttgtgtccctaggaggattatggctgcctctgctgagtcatgcaggttgtcagggaagtgggggaaagccagcagtcacaggcctcacccagctcccatgcaatccaaagggccattctcactcccaccgtgccccctctctgcaacagcactgagtctgttttcagacagtggacaagcagggctgagaacttgccccatgttacccaccttccagctgcagaagaaaagggctttagttcttcctgcacctgtggagtctacatgccggatatgtgccctcccctaagttctggccaagaggcttctcaaccagttcaaattgttacaaagttcagctgaagacttccttctccctgtggcattttccccgaaggatccctgtggtgccaggcagaaatggcctgcttggggacccagagagctccaagggcctctcccactgcttcctctacccctgtatttcgcttggctctccaaactgactcagctccaggtaaggctggaatcttttcccgcaaactagaccttcaggttccccagtgggggtgtgtgtttgggggtggatgatctccctttcccacttccacagtttgggcactcacggtatttggggtgtctcccgggtcctgcaggagcaatccacttccttcagagggtctgtgggtcctctgggattcctgatttattcctgcagtcattctggagctaaaattcatgatgcgaccctccacacagtgttctgtccatccaagtcagagctgcaatctagtcctgcctcctgtctgccataatcttgagtatctctacttctacttctgtggcacagaagggctccccagctcctattccctgaatcctcctccttctcccctctttctctgtctctctccctcagtctgtcgtctttaattttttttaatcaatgttttgtggtttttagtgtacaagtctttcacctcctaagtattttatttttttcagtgcaattataaatgggagttttcctaattttctttccagatagttcattattacttcacaggtttttaaggtaactaaacaaagaaagaacaggacaaaaaaaaaaaaacgctttttaattctagttttcattcaaatgtgtttattgagtacctaccatgtaaagttactgttttagcactggaaatataatgttgaaaaagttaggaagggtttctgctctcatgagcttatattccagtagaggaagcagtcaataaacaataaatataagtgctatgaggaaaaaataaagcaggataaaaagttagccataggaatggatggctttttagataggatggtcagggaaggtctcactgattgttaactcttaagacccaaataaggtaagggaggagacatgagacaatatgggggaagtacattctagacagaaacaaacagcccatgcatagattctgaggcaggaacatacttggatttgaagagaataagaaggccagttggttagagtgcagagaagaaagagatgaggtcagagagactggtggggttggattagagacagaaagaggctagagggccctcaggtctttgactcttaccagtatggaccaccagacctgtgagtgagtaatgtttcaaattattctagccccagatctcaagctgctctatagagatgagcctgccccactgtgtcctgtctaaacttctggcccgcagaatctgcgagcacaataaatggttgtttaacaccactcggttttggagtaatttgttaagtgccaaaataaccagaatagaagggagggatagtctttgcatctcaaactataactagagcccactgttacaagggtgactttgcaaatatacgattgaatcatgtgtgttgatttgattggtccttctatcagagttatgggattatcaggagatgctggattcactagtaaagacttggttaccaacccgggtgggataggttcaattagtgggctatatgctcttcagctgaaaggggctctgggtttccccacttatttgtcactgagatttcaagtaaaataaactggagatggctaccctgccagagatgttggaagaaggcagtcctcttacaaagggacttctttataaaaagtctctttgctaaactacaattggattcatgtatttaaaattgttccttcagtcgatcaactaggaacccacgatgtgcccgatacgggattctgtgtagggcatctctttcctgacctctatatgaattttaatattttcagctgtaagaaatagaaaccccaatttaaaataactttaaacaataggggaatttagttcctataacaactccagaggaacacggctccagtgttggcttcctcagtggctcagcaatgtcagcaaggatccaggctgcttccactttccactcaaccatcctcagtgtgtcctgcccagaccagctcccctcgtactcccaacatggctgctgcaattccaggcatcaatacgcagacatcaacacatacacagggcaacatccagaaggagaaagggaccatgtcttatgtatctagtccttgatttaaacagttcatgattcaccctatggaactggacatggggcccaggcccctctgaagatagaggtggacagcaggaagcaggatgtgggcatcacccaacagtctgctccaaactctaagcctggttagagaagatctctcattactaccaaataatctctctctgtagttaaagtttctccttctacttcctaaggatgccaaaaggaatagttttgtttacaggtcttgctacagtgtcctcggctccttggagaaaatacatgagcttaaaaaaaaaaaaaaacctaagccttatattttctatcaatcacctgcccacgtgcacttgagcaccttttgctcaggatgaagttgacagataaataaataacattcctatcttgattggcactccttgtgggtgagagctggtttgtaggccattgtcaatggagaactgagagggtctggggaggggaacagatgaggaagcatttaccatctatcaagctgtgaggaatggctgccactcatctctcagagcagggatctgccaggtcaaatccagcttaatcacttgtacgatgcataagctaagaatggtttttaaatattttttaatggctgagaaaataagactattcatgacgtgaagattatttgaaattcaagtttccgtgtccataaatggaatattttggaacatagccatgctcattcatttacttcttgtctatggctgccttttacttacttacttacttacttatttatttatttatttatttatttcatttaatacagggtcttgctctgtggtccaggctagagtgcagtgacgcaatctcggctcactgcaacctctgcctcccaggctcaggtgatcctcccacctcagcttcccaagtagctgggactacagacacatgtcaccacatctggctaatttctgtattttttgtagagacagggtttcgccacgttgcccaggctggtcttaaactcccgggctcaagcgatttgccctcctcagcctcccaaaatgttgggattacaggcgtgagccaccgcacccaaccctatggctgctttcacacttgaacagctgcattaaatagttgtaacacagactgaatggcccatgaaccctaacatatttacaatttggccctccacagaaagcatgctgacccctgccttggaacaaagtccctgacagggtccccaggcattgagtagggctgtgcctggagcctccagagataccagccctcagcccatctgcagaccagcctcttcccaactgagtgggataggaacccccgatgctgtctcatccatttagcacaggggtccttagacctgagtgcacattagaatcacctagggagctttgaaaaaatcccatgcttggtttccacccagcacactttttctgtggagggccaaattgtaaatatgttagggttcatgggccattcaatctgtgtcacaactatttaatgcggctgttcaagtgtgaaagcagccatagggttgggtgcagtagctcatgcctgtaatcccaacattttgggaggctgaggagggcaaattgcttgagcacaggagttcaagaccagcctgcgcaatgtggcaaaaccaattaaaatctctggggatgggcccaggcatctgtctctttcagaagccccccaggtgatggcaaagtgcagtcaagcttgagaaccgctgctagatgcttgttgccaatgtcaagcctggtttctggagctttttctaagcaaacaccatcacccaccctcaggcaagtgttttggggacagcccatcagcaccacgctaaggtggagctgggcaagaagacatgggagaagcaagctgtggttaacccctacctttcatttgtacaggtgtgcagccaaatgacctcacctgtgtacagatgagttcctgaggtttcccaggctggggagtccttgccaccagggttctccttgtatctcttgccaattctcagcagagaaaacacagtgtctcaccctagctgccactcatgagtttattttccttcacctaagaggaggcaaacaaaagcctggtcattgtccaacccagggacagtttagttgcatatctttctcaatggcaccagaaacctctctcttccttggcatgtagttggagaagaagagccacatatagcaccctctttcctttattcactcgcacaacagatacctactgagcaccacctacttactaagccctgtagattttcagagtacaatagtgaataagagcccccaaaagctcatggactaggagaagccaacttagcccactcttctgcagtgctgaagggctgcatccaagggacatctgcagactgagtgaggaaatgactctccttgtcaggggaagaaaggcatttcatgccaaggatagagcatttgcaaaaatacagtggctggaagaagtagacatggatctgactggatctggggcagagggctatcgggtgggcaggagttgaggctggagatgaaaactggaggcagcatgagaacagcagtctggccaggaccagaggaaaccatgggagcttttctggagaggagtgagcgaggttcagaaggaaggaacccccggctggatgtgctggattctggagaacagaggaacagcccccatgtccaacactctgtccattgctcaggataagatgcaacaagctcccaaactactgccatgggagtggggagagagaggagccagatacaagaagtatctcagaaatacattcagtaggacgtagagatcaatttaaagggtggtgccagagagtccctgccacagctacccaagtccctccccagctgcccaaggttccaacctctcctgtcccctgctggctttgctctcatccccagccagagccagtgagagagaacaccaggaagggaaagaatgctattgggggattttcttctgtttctgtttgtgttcctttttaacacctgttgttaagcctcccaaaagttcccctggctattcttcaaaatggatttttttgaaacggctcagtgggcttcccttacagaccatgattacattgccaaagctcagtgttgctctctggttatgcccatgagctctggcatcagaaaggtctggatttgagccctaaaaaaaacactagctgaaaaacctgatcaagtcatataacctctctaacccccagactccccatctgtcaaatgggtaaagcagtacctgcctcttgagggtgtagtgaggattaaatgagatagtaaaataaagactttagcaccgaccctagcacataaactgcttggtagatagaggctgaggtgggaggatcacttgagcccagaaggtcaagtttgcagtggagccatgttcacgccactgtactgcagcctgggcaacagagtgagaccctgtctctaaaataaatattaataataaataatcatgagagcctaaggtcaatggatgggcagtctcaaggagaccagggtgttctacagtacgggctctaaagtgaggaagcaagaaaaagagtagctcattctcaaagaaggtgagagcagttgcttgtgataacacaatctgtggtgtaaccaagagagtggaaagctgagctggattgaaagagatttttggaggttcaaaggttaaggaacaacaaagccagggtgttggatggatcatgccattagattttgttgccaatgatgacaaaggcagagatggagaggaagacagtgctaaagttgttagtaagggaaggaaatctcagccatgaggaggggaaacagatgggatggcaagatagcccaaacctcagagaagttggttttagttgttcattgattaaaaggttgatttttgtctattcaaaggaggaatgaggagaaatggtttagaaacaggaaatgtaaggaaaatacctaccataattctttgcttatcaaaatttaagctgtcatctttgaaaagatttcccaaaacactgctaggagataccccaaaatgttaatagggttgtataaatgtatattttctggtcatctattgacgtataaccaaccaccctaaaacttagtagcctaagacattaatttttctcatgaatctgcaactttggccaagttcagcagggacaattcatctccgctccactctgtgtctgctggggtgatctgaaggctcgttcattcacatctgacggttgatgctggctgagcctttagctgaggctgtgaccaaaggacctaagtgcaacttcatcttgtggcaacttggcttcctcacagaatcgtggctgtgttcccggagtgagtgtctcaagagaaccag

SEQ ID NO: 12200 - DNA, 27056 bp, Human
gccagacctctcagaaagggtccaggaaggctggagtgagatggggtgggagcggcactcactctcaggaaagttcagttcagaggcaagccctgtgttgcggggtgcggggagccacgtgccctaccctcccttggctgctcgtgggaaaaggcctagaggttcgggccgagaagaggagcgaaagcacagagccgacttcccctcacccatctgggaaatgggctcgggccaactgctgacttcgcgctcgctggcgcagctccctgcggagacctcggcggggagggaggctgaacatctggatgacatttctgcgagagcggctccggagcggcggtcggggagggagaggtgcgctcgtgcgcacgtcgggccgggagggaggcgattcctcggggcctgggtcttgtttttctcgctctctaccgcagccccttctcccgcccctcagcccccaccccgcagcccccagcccccgagcctccccggctcccgaccagccgagctccttcactggcggcctcgcctcgccagagggcaccctcgatcttccggaaaacgccaccatttttcactgcccctggagcgtctccaggcttctgcccgcctcccgactccgatcttgtcaatgaagaatcgggccaggatcgccgcggagcggacgccgaccctccgacccggctcgcaggctgggagtcccctctgcgaggctggcatggccgcccctaccgggtcccgcgccctctgcggaccctgccccgggttgggcctggcccgcgggcggccccgggaccgggggaccaggagggagagtagacgcgggccgcggacggcgcggactgacagctggcgagagggcgccggggctgggggaaagggagggagggggctcatcggagtaactttccagaaaaacagccaacgtgtggcaggagtgattccaagaggggaaaaaaagttcagctaccacgtcgaacgagaggactcgcaaagtatttttcaaaagggctcggcttttcctgtgcctgtttaaaacattaacatcgtgcagcaaaagaggctgcgtgcgctggtccctccctcccccaccccaggccagagacgtcatgggagggaggtataaaatttcagcagagagaaatagagaaagcagtgtgtgtgcatgtgtgtgtgtgtgagagagagagggagaggagcgagagggagagggagagggagagagagaaagggagggaagcagagagtcaagtccaagggaatgagcgagagaggcagagacaggggaagaggcgtgcgagagaaggaataacagctttccggagcaggcgtgccgtgaactggcttctattttattttatttttttctcctttttattttttaaagagaagcaggggacagaagcaatggccgaggcagaagacaagccgaggtgctggtgaccctgggcgtctgagtggatgattggggctgctgcgctcagaggcctgcctccctgccttccaatgcatataaccccacaccccagccaatgaagacgagaggcagcgtgaacaaagtcatttagaaagcccccgaggaagtgtaaacaaaagagaaagcatgaatggagtgcctgagagacaagtgtgtcctgtactgcccccacctttagctgggccagcaactgcccggccctgcttctccccacctactcactggtgatctttttttttttacttttttttcccttttcttttccattctcttttcttattttctttcaaggcaaggcaaggattttgattttgggacccagccatggtccttctgcttcttctttaaaatacccactttctccccatcgccaagcggcgtttggcaatatcagatatccactctatttatttttacctaaggaaaaactccagctcccttcccactcccagctgccttgccacccctcccagccctctgcttgccctccacctggcctgctgggagtcagagcccagcaaaacctgtttagacacatggacaagaatcccagcgctacaaggcacacagtccgcttcttcgtcctcagggttgccagcgcttcctggaagtcctgaagctctcgcagtgcagtgagttcatgcaccttcttgccaagcctcagtctttgggatctggggaggccgcctggttttcctccctccttctgcacgtctgctggggtctcttcctctccaggccttgccgtccccctggcctctcttcccagctcacacatgaagatgcacttgcaaagggctctggtggtcctggccctgctgaactttgccacggtcagcctctctctgtccacttgcaccaccttggacttcggccacatcaagaagaagagggtggaagccattaggggacagatcttgagcaagctcaggctcaccagcccccctgagccaacggtgatgacccacgtcccctatcaggtcctggccctttacaacagcacccgggagctgctggaggagatgcatggggagagggaggaaggctgcacccaggaaaacaccgagtcggaatactatgccaaagaaatccataaattcgacatgatccaggggctggcggagcacagtaagtccaaattctcgctggggtgtctgctctggagggtctgaactggagctgggagctctgcagaggggggcctagtgctggccacacagcagggtgccccaggattcaccagcaccaaggctcaggatgtgcgatgctcctccgttggggctggggaggtgggtggggaaggagatagagccattctgttaagagccggcgcttctgggaggccaggagccctggagctgagtggcttgctgaattcacatcacatccttgactgattttaatttggaattacattgtgctgtccagggaaacatatgtattcttgcacatgcgatcgtatcagtaactgtaagcatctgggtgccataaaggggaaggccggctctgtcaggagcccttacggttctcagtgtggagacctcatcttctccctgcttttcacaactcattgtgacacgtctccgtttcagtttttccagttcttgggaagaagaatacctgccccaaattaatgtctgtcaagctttttgaagcccaggcaggagacagcttcttgctgcctgggccctttggtctaccccacccacgtgacccacgagacccacgtgagctgtgtgtgtggaaggaagagggtatgcacgaatgttcccagggccgtgtactttagggtgacatgcagtcttgtgcagtagacagattcatgtgctcaaaatgggcgccctccaggccggtgggcacggggagagcgggttttggctgtggatgcgtagaggaggctggcgccctttgtgtctgcgtgtcacgggagagcgggtggaggggtggcagtgggtgcatggtgggggggggggatatgtctgggagcctgccgtcccaggaggctctgtctgcatggaggagccgggcggcttctgggcgagatgtctgtgtgtgttggtacacgtgtggaagtcatatgtgtttactgaaggggattttaaaaacctcaatacaagagagagaaatttggcagatgttgagaaactgacagcccaggaaagaggaatgtgagccactcgtgggccgtagactccgggagcagctctgtttgcttttcctaccagcaggtgtcctcgccgccctgactacctcagcccaggcccacctgggaggtgggcagctcctggagtggggtggagggcatgggatggagctggcaggcaggggagggtggtcagcagagcacacagcaaggggtgaaaggaacctggctggagagaaggaacaggagtgggtaccgatgggtggaccagctctggctggaggtgcaaaggccccgttcacggctccacgccaggcagaggagcctgtggttactggcgaggggttcccgctccagcttcctgtggctgcctggagcgcctttcttcaggatgtggctgccatgtggggcggaggctggaggccgatgcagagctactactccctgcccagggtctctgggtggggctggctcagagacccacagttcccagaggcacctagcagctcgatggccaaggctccaactccctgggaacccaccaacgcgggagatagtgaccacaagcatcagaggaaggtcgaaatctgaggccggcaggagaggtgtgaggagagtccagggcaagagggcaggactcagaccttcatggtctgggtcagcaggaggagtccaagggaggaagcattctgagtcaccaggacccccccatcccggaatcctgagctgagaatgaatgagccacgtggaggcaaggccatgcaggtgcaagtggacactgattttgtgcagactcaaagcacaaatagcagatgtccttgggaaaagcccgggcagggccccatagatgctgggcagcttccaggctgcagtaccaagaccttacaactgcaacagatgggtggatgtggggttatggagcaatggtctggcctggggcaacccagcacagtgagcaggatgctgttcaggatgctggggaggagccaacgtgcgatgctatgaggctcacaggtacaaaccggaagcaggcagactctgcagctgttggaggtgacttggaggctgagcagacggacctgggcccgccctgcagctggtcaggtgctgagcccaccccagagaggcagacacacaaggcacactaactataaagaaggcagtgggcaggtgctgagcaggagcagagagccatcatcaggggcttgcaaggcggcggggcggggtgggggaaggaagcctgtctttaactcatgagggcagacaggggtgacaccaggtctgtggtggggcacagcagggtctcaatgccagagcctctgctgggaggtcatgagatcacgttctgttccatatttcctcacttctggccacttccctgacccagtgaacatgcattcgaaggaaagtgacagtaggagccagggcaaggagatagaggtccctggagaggaaaatgaaagaggaaatactttttagtagtgcaggagaaagggcaccaaggtgagagcagagaggaaggccttttcctaaataaccttttctccctgttttacagataaggaaactgagacctggattgcttaagtaatttgtccaaaaagagcagggaccctaacctagacattctgtgtgcaggacgcatgtagttaagcactcatttatatgtaaaatacacgttgtaagtgttacctttaacctcctttaacctttagggttcagtagaactttgatttataacataaatgaatcatgtgttggaccaagcaggagaggtcagagttattatcttagtaacccaggtggcagattgcacaatgataactggatttgttcttccttagctctgcatttttttttttttttttttgcccgggagattcatactgccacaaatgttctccctaatttaatgaaggagttttctttatttaatgaagagtctcaagcaggttaagcaaccgcagctacgtaaaagtgacctctctgagcctcagtttccccagctgtaaagttagagatgatttccaaactccttttcagctgaaagaattttataattccatctgggatgaatcagcagagcctctattggggagtatgggcaagactctgtaatcctttttctaattctccaggattttactgtcgggagggagtagagagtttctctgaccccatgtgatgggaaaggacacagcttttttacttccgttgtcatccctcttacaaaggtatcaccaatgtaggtgtcattttatcttctggcttgtaattatctgtctctgtttggagacttgttgttttcagccaagggcagcgctaagacaaccagcaaacccagagtttctcagcaaagagaaaactctatattttagtctttgttctctagctgctaagtgtagattttgtttattctgagaattattctgaaaatcatttgctccaagggccaatgccctctgcacagtagaggtcagcacttctccaagtgtggtccagaggaagctggaggtaaatgtagattccctggtcccacccacccttatagaatcagaatcttgagggggtggagtcttggggaacctgtattttcgacaagctccttatggattcttaagcacattgaagcttaagagtcagtgaactagggcgaaacttttcttagagggatggcaaacacaagtgcctacagagacccggcaggaaatgcaaatgatctggaagaaaagccacggcgtcatgataaactgcaccaggacacttggtcttggggtcaagaagaaagtagggtgtgtgagacagggagagggaggggacctggagcccacgtgcccagccaaagcagcagccagcctcagttcttgctgggttttgcattgaggactgtgggtccagcttgattagttcttcccgtgtcccagaaaagcagaaaatctggatctttctgtgaagtgttccaatttttaacatgggcttaaaatgtttatgggcttctaactcaaaatttttaaaggtgttccatcagcgaaacaacatgtctaattcatttaacggttaatcaatagaaagctcacaccattaaagcagtggtttctcaaacttccagaacatctagaagccatggtgccctttgcaacacattataatctgtggttctcaaccctggctgcacgttagaatcatctggagatcttgaaaaaaatatgccgtggaccccactcactccagtgtagtcagaactgctggggaatgggtccaggaatcatttgtttttaaagctttccaggtgattctaatgtgcagccagggtagagaagtacagccacactgataaatatagtcccttcactagaaccagcagaaatgatatatacaagcaaaggcacacctagccacccaggtgtctgaacacattttaaaaggcagttaactaaacatggtcagctatttcctggtttttccatgcatactgtacatgaatattctttgcttatgttttgccccgttaaacaaaatagagaaaatggcattcaccaatatatattttttctgtgcaatggaaaaagttgctcaagatttaatttgtaaaggtgggaccccctagtccagctctcaataatactagtgttctgtgaggcatggcttaagaaccacaaactcgtttgcagtgggtcattgtctgaggcataggttgacactctaggcccatttagtggaatcttgccatattttgttgatgaaaccatcttcaccagatgatctcccagatccctcccagcttgaagagtctctgcttcaataaatgaggtatgttcagaagacctgggttcaaaccccacctccaccaccttctagttatgtgaccttgggaaagacatttaactttttgaggctcagttttctcatttgtcaagtgataaattttacatgttttcattcttctcaggggttgttagaaggtcacatgaagtaataaaaactcgacaaaacaaggtggtgctattacattttgcttatttatgtatacgatgattcattccacagattacttaaaacatcattattcagtgaatttgattgtcaagaagattgtatgtacattttctttgatctcccaggcaattcttttttttaattaattttaattttaattttaatttttttgacagagtctcactctgtcacccagcctggagtgcactggtgcaatctcggctcactgtagcttctgccttctgggttcaagtgattctcatgcctcagcctcccgagtagctggggttacaggtgcccaccaccacacccagcaaatttttgtatttggagtagagatggggttttgccatgttggccaggctggtctcgaactcctgacctccagtgatccacctgcctcggcctcccgaagtgctgggattacaggcatgagccactgttctcggcctttaaaatttttaattttaaataatagggataggtcctccctatgttgtccaggctgatcttgaactcctgggctcaagcaatcctcccgcctcagcctcccgagtagctgaaataacagacatgtgctaccatgcccagctaattttcgtattttttatagagatggggtttcaccatgttggccaggctggtctcaaacacctgagctcaagcaatccacccacctcagcctcccaaggtgctggctgggattacaggcgtgagccaccatgcctggctgccaattcttcttcttcttcttcttttttttttttttttttgagatggagtctcactctgttgcccaggctggagtgcagtgacacaatctcagctcactgcaacctcgacctcccaggttcaagtgactctcctgcctcagcctcctgaatagctaggattacaagcatgcaccatcatgcctggctaatttttgtatttttagtagagacggggtttcaccttgttgcccaggtgccaattcttttttaatcactagcaattgtgtcctaagctttgcttgctagtgtcaagttgcttgtgtcagctaacttctgagtgactctggccaagaccctctagacagccatttcttcctctgaagagggttgcgccacatgactcctgatgtcccttctaatcatgggaaatctatatatcccagtaatagaaaaatgacctttcccacctctttcttgaaaccttaaaattctccccaggacgtgttcatcctggggagcagattatgattgataggctggaagaaaccaaagaggacggccactagggtgtcctgagaactctcttagctcataactttccccatctcctggcttcccactgccttgacccactctgactgtctcaccagcaagtgccattttccatctcccttcttttttttctgagatggagtctcactctgttgcccaggttggagtgcaatggcaccacctcagctcattgcaacctctgcctcctgggttcaagcgattctcctgcctcaacctcctcagtagctgggattacaggcacgcaccaccaggcctggctaattttcatatttttagtagagacagggtttcaccatgttggtcaggctggtctcaaactcctgatgtcgtgatctgcccacctcggcttcccgaagtgctgggattacaggcgtgagccaccgtgcccggccccatctcccttctttttacagcaaggtgcatgttgcactgacttaccctttattcctcttgtagtcactggagctgtgttatttatttactttattaatttatttatttacttgaaacagagtctccctctgttgcccaggctggagtgcagtggcacaatcctggctcactgcaatctggacctcccgagctcaagtgatcctcccaggaggtgctattgtaactgaagccatatcaataacagctccttcaaaacccagctctgttgtccttgatagggttgccaatgcaagtagcttatccacattcagagtattacaaacttgtaaacttacacattacttaactatcactgatttctctccttggttctatctgaaatggtttagggaatcgttggcagtatctgttctttcaaagccaattattaatcagggcttcattagacagcattcacacatttgttttcctaacatctgttccattaattttctaagaaccagcgtcaggcccaccagatggcaatttccagaaacactcactcatcctttcctgaagatcagtagcacatttgcttgtttccaggcctctgatccttcctgccttgtctgtgacttcctcaacaacccctcggggtgattataagctcattccagccatgtccattatgtgtggaatctgggtctatgagcttgaatttcaacttcgggctattgttaccatttgtgcagaaagtttttctctgggtgttaatactgctcagaccttgaggctgtcaagtgtacaggagcagagaaaagacaggctctttctctttctctggctcagaggggtgggaaagagcattcgctgcccagatcttgtggacagggatgaagaggccagcaggtgacagcgtctggcatagcacgtgctgtcaaggaaagagaaaggagccaatggtgacacaccagcttggtcagaggaagcatctgtgtttctgccaggctcatgatgtgggctctttgctatataagccctgctttattgggtctaaaacacaaggttgagatgtcactgcactgctcaaacactttcagtgactccctactgttaatgggttaaaatttaaccttttagtctgacaggtggaccccaatctatcatcttgccctttctcacctggctcccacctgctgtttcgggccgctcttactcatttgcatttcctcccctccctgcctttgcttccagcagtcactccatgtaacatttctttcctccccatcctcaaatcctctcaattttcaccccttccgtgaagtgctccttgccatttccctcctttgatttcctgcagcaactcctggacttctctgaaaaccactggtttcctgtcgctcccctcacctgtgctcctgcattgtgacatcttccggggcactctgtcctattatttctctctagtcctgttatttgggcccatgtattaatacccccccttagatattaacccataagcctgaggctgcacttttttgaattttgaaatcagaccttggccttgaccttgagcagcaggatataaataactcttacatgcttagcgttccaataatggaacaccaggcataaatgggttttaatccccttgaaggcaggggttgtgtctactcatgttttgcttcccaaggttagcactatgcttggcatatagtagctgctcaatacatctttgataaatgaatgaatgcccagatgaacaaacacacgaataaatcaactagctgtaagatatgtaaactactaggtgctgatatctttctagaatcagtattttctcaaaaagtaggaaaaacgggttggaaaacttaccagaactgagatgtcaaggcagtgggaggagggggcaattagatttgactggccagtctagtgccatgttgtggagctctgaggccacactgctccttgctcaggactgtgtgtgattctagggccaccaagaatcttcctcgtatctccaccttgcggtctgaggcctcaagcctctagggaggtggcaggcgggacggtggccacttggtgcctgtccgttggcagcacactgttcctgcatgtctcgctcatgctgtgccctctgctctgctttatctcctagacgaactggctgtctgccctaaaggaattacctccaaggttttccgcttcaatgtgtcctcagtggagaaaaatagaaccaacctattccgagcagaattccgggtcttgcgggtgcccaaccccagctctaagcggaatgagcagaggatcgagctcttccaggtaactcctctctcagagcagaaaccacaccgacgggaaagctggttcctttgccatatcagggcaccactgggtgcagcgtttggcagacctgggtttgaatcctggcttctctgagccttcgtttccgtatctgtgtctgtcattaaaacacttaagagttagctaaggtgctcgagggccatggcattcaggaaccactggtttcctatcgctccctcacctgtgctctgcattgtgacatcttctggggcactctgtcctggtctcgggtactcactcctttctctgccctgtagatccttcggccagatgagcacattgccaaacagcgctatatcggtggcaagaatctgcccacacggggcactgccgagtggctgtcctttgatgtcactgacactgtgcgtgagtggctgttgagaagaggtaggtggacccttcagataagcatttcagaatgaacctcaggtcccttagtcctccatgaaatggagggaagaggacagaattaagggagtcagagatctgggttcaaaccctagctttgccactgagtatcctccattcattcactcaactaatgtttattaaatgctcactgtaagacaggccctggggatgcagccacagggataggaactatgagaaatagaaagagggcaatgtgacaatgagtgggtggagtccaacagggaaggtctctatgatgaagaaattcatgcattgacatctgaatgataaggatttagcccatgaagatcagaatgagggatgtgctaagcaaaggcaacagggaggcccaggccctcaagtggaaataagcttgatttgttctagcagcagcagcaaacagatcggtgtggctggagcatggtgagctggggaggggaagaggaggggaagaggtcagggaggttgctggggccatataatttattattactattattactattattattattattattattattattattattatttcttgagactgagtctcgctctgttgcctaagctggagtgcagtggtgcgatctctgctcactgcacctccaccatctgggttcaagcgattctcacgtctcagtctcctgaatagctgggactacaggtgcacgctgccacacctggctaatttttttgtatttttagtaaagatggggtttcaccatgttggccaggctggtctcgaactcctgacctcaagtgatccgcccactttggcttccaaaagtgctgggattatagatgtgagccaccatgcccagccaatttaatttagaacatcatcaggtcatggcgaggtttcaggacttattccaggtgtgatgagaagtgtgggagtgctataaccagagctggggatactcaagatacccaggaattccttcctgtccctctactgggtgtgaagtcaagagcctaggagaacccacgtggatctgccaacagcagctctgttgggaattctgactcagacagctacagggaggaggggctgggtgaggtgatttgattgacatctttaaaagatccctctagtttccaggaggtcaagggaagaggcaggaaaatgagttaggagccacggcggcagcccagatgagagcaatatctaggccgagactagggcggtagcagtggatatgacgatcagatggatttgttctgtattttgaaggtagccagtagcacaggctgattaggtatgggatgtgaggacacaagagcattccagataacttctaaattttttcgacatccaggtggtatcacttattgaaatagggggcctaggagaagaacaggttctgttctgcccagttaagtttaaaaggccgggtcgtcatgcaagtagagctatcctggaggcatatcaaacttcacatgtcccaaatatcttacccacacactgccttcacctggaaaatcaggcaatggttcctcctctatgtatgcctcacagagctgttttaaggatcaaatgtatttgagagaacttcatggtttttaccatgttttacaagagtaagcttttcttattttagataaggaaacaggccgagagaagttaagtgacttgaccgaggtcgtccagtctggattagaactttggtgtctcatgacaccatcctctgtgtttctttcccttttcttggctggtactgcctggtctgatgctcagtgggttggggtcacagatggcagtcccatctgttccttctcttcctcttgggcaaggttttctcctgtcatcagctgctataaagccacagaccatccacatattgatgcccagagtccctgaggcaggtggatccttctaagtccttggtgttttaggcaactaagagttaaagctcaaaggcagagcttacaaactatttggcctgcacattgttttcgatttgactagtcatcaacagttttgggtgttttaagtcaggagatttcacataaaacctggacttcttgctgtttttgaaaaatcgaaagatttcctgataaccatccgtcagagatgagtaccggccaccccttgagatggggtatgcatcctcagtccccgcagcccccaccattccctattgttccccaagagtgaggctggcagttcctgtttagcatcatgtgctggctcgattttctcacttacgtgacctgcctgggctcggtagccatcgagtttgcattgcttgatgccacggagcccaggcaagtcacataaatgagaaaattccccatccaaggggaattatccagtggctgagttggcagatggtgggctgaagatcctgccccagtcccaagggtacccaggaatttcatcctgtccctcctactgagcatgaaggcaagagcctaggagaacccacgtggatctgccgacagcagctctgttgggaattctgactcagacggctacagaaaggaggggctggggaaattaatctcttaacttccctgtctgattttgatcagctccacctggatttctttgaagccctgggcacttgaaggagttcttattttcacagctgcagaactcaatgagaagtttgcattgagaatgatttccatcctcctgagacatcaaaaagataatttcgtaataaaacctatgggtcccccacccaccacccccacagctgccaattctgaggttagttcttcattggaaccttcagttcacacttaggcagatactgcccacctttcccacaggggaatcatcacacaggtttgtacttacagagagcccatgagtctcttcagagttcatggcttcaaaccaggcaacaaaggactccaaattggagcagttggcggtgtagattgatgagaaaactgagtcacacatgtggtcttggattcattcagcaaacatctgagagcccttgtgcaccaggtacccaggctgcattctgggtcgcagagtgggttggagtccacaagggccgctggggacccaggtctcatacccttgtgctattgctcatatagtctgcagcacctagctaggcagggccaggcctcccctagtaggctggggagggagcctctcagcatcatggctcaggaaaggtgggacactgggaaacaaccatcttgcatgttggtgaatgtgtgggcatcttccttggtggtctctgttgccccctctttacccctccttgtctctaacaagagtttgggatctggcatcaagctgtcagtgcttgaatcctggcactactatccactggttggatatcttgggcaagctgtttaatctccctaagcctcagtgttcttatctgtacaatgggggataatagttcttgctctatgggattattatagagatagaataagttagtgattgttgtcatcatctctaagtcctctatctggatacagcctgttggccaagccaggccaccctcttgtgcttacatcctggaccctcactctccccaacacagctgtctgcaccttgactttctaactcacagaatcatggaactcactcactccaggtctcttccagcctgccttgaaccagcttgaccaggaggtacactgtgttgttaggtagcccatttcagctactttggctcctccttccagctgccttaacccagggagagggcaatcctcatacctccctctccattcacttctcctccagctgggtctcagctgccttgttttattggtctgccttccctcactgagcgaacctgctggaacagagatcttcaagctcagcaggcgcagtgtgcctcagaggttgccctgacttagggtagagcagatctggttaggctctggagtttatggaagaaaggagctgggttttaaccagtaggactgggatgtccaagccaacctaatgttgatgggaatctccagtcttgtaggcttgtatccttctgtctatgagaaggttgctgggccaggttggactttttggggtttgccctgatggcacaatttcaggaagactccaggttgtctccaaggccagatgctcacacacatggtgtgtggcctcagggagcagcaaatcaatcaactcatcgagaggctgaccctgaatccagagaggtccatcccccatgacctctcctacacctggccacaactggctgctatcccaggatcaacagagcttcccaaattaagtcttacccaccagaattgacatgataccagatcctacctggttttctgtgtaaaactacttgtctcagtgcagacttttcattttctttctttttccttcacttcactcaacctcatttactgagttcctgcttccttgattttggttgccaaaacatgtgatcccacaactactaggcgaatgggctggagttgcccttcacgcaccagaatgtcaggcaccaaaccctggcacctccaggcttcatcatgctcactgtctccgtgctcaagtcatctggaccctcagccatagttctctatcatctcctctgtgctgttttctaagttcacaactgtcttcccaagctgttcatcttggtgagcaatccacattccaacttcccatcatggtgaacaaggattcccaaagaagaaatgtccaagtaatttttacctcgttgtgtccttgttccttaggaaaaatatggcccagtgtaaccgtgatcttcatcttatctcttctagaatctgccactttgtctaggcccacagtcatggccctggtagaaatgcttgcatcttccactgagacggattctgcttcctgtttgcaagtgaccttgcctctagcattggttcctgacttgaatctttttgccagcattacatcctgtggctttttgaatttgtggccttttgaatcacagtctctgtgctcggagactctttagttactccctgtccgtagtctcttccagtccctctgcctcttgccctgatccttctgcagtagattggctcaacgatcccctctcccaaaaaccatgtagatggcatgagtttttgctttccttactgtatctgtgtacttttgcctccaagtaggtaggtgacaattttctcttaataccatcctttcaaagggaatgattattccacttctgtttcatgatggccactagtgtatgcccccatttggtgattcataatacaacaggaatacctggaatgtggcaacgtgcgcttgaaggtccactctgagctctggaggcactttctgtctcctgtgaccctcaatagaactcagttcctatgagtccctgtaggagcagaggccctggctcacccttgcatgggtggtgggcacacttccccatcacacagaggtgcttttctcactaattctgtcttattttgcagagtccaacttaggtctagaaatcagcattcactgtccatgtcacacctttcagcccaatggagatatcctggaaaacattcacgaggtgatggaaatcaaattcaaaggtaacaaaatgaatgtgtatggtaggatgggtgagtgggggggaagttaatgggacaggatagtgcaggagacccttaccagacctcaagaaaagaaaccaagctccttcagagagatagccgactattttgtacttgagtaattctgctttgccccaaaagcaatgagtgtaactttcagtttatagcttagagaatgcattagcctctggaagacaacacgtactggtaagtggtgaaactgtgtaggcaagccgtctagcctctggtcctagtgaaatgggatgagagttcctctttcacagtgttgtcaggcaattaaatgagataatgaataaggaacacagtgccagaaatgctcaacagataggacttgtcttcctcctccctaaaagaaattaagtttggctgtcctgaacatgagtgcccagacaactgagctttccagatgtgcagggcctacctgaccttgcccaggggtcctctgggtttggatgattgcttcgagcctcagggtgtttgtccccggggtgtttgggtagagatggcgaagtcgttgagagtcatttctggttttccattatgtttgcaaggaactcagccttgatgatctctggagttcagggaagttctcttttcctttcatattcccattttgggtaactgcggaacgcctgaggtcagaggcttgtctgggaaaaggtgcaggcctcttttggctcagcgctggacagtgatcttaccccacatgggctctattttacagccttttcttaaagccaaagatttgacactgtaaccacagaaccttagagcccagaggacctttggagtccttacctacaggccagcttaggatgaaaccttcccatttcagtgaatacttatcttgttcataaagattttcagaaaaagggatttgtgatccaggtctctcatttatcttacagatctggtgccccttcctgagacccgagccactcctgtagctatgtaaattaattcctcatgttcctgtcctcagtgaggatggacaacagttggcagctgtccttcgcaaaatcgatctccatttagttgagactctttctaagtcagtctccagtcttttccttttttttcagatgaaacgggttgatgaatttagattttctttccagagcttatttgctatttatcatatgcttcattatctcatctgaattttatagtgaaaacacttcaaagactctaagtgcaatgtgaatgttaacaattatacagtcttgtttctttggctcccattcaggctatcttaagttgtgacaccttaaatttttggtaggacttctgcgttatcttggtccattcacattttaagaggaaactcacaccccaagattctaagtctagaatctaaagtgacaatccagggctgggtgcagtggctcacacctgtaatcttagcactctgggaggccgaggtgggcggatcacttgaggtcaggagttcgagaccagcctggccaacatggtgaaaccctgtctctactaaaaatacaaaaatagctgggcatggtggcatgcacctgtaatcccagctacttgggaggctgaggcaggagaatctcttgaaccccggaggcagaggttgcagtgagccaagatggggccactgcactccagcctggccaacagagcgagactctgtctcaaaacaaacaaacaaacaaataaacaagccgacaacccggagatatgtgttaggtacccacttagtaacagggatgcttcataggtccatgaagattcctaggaatctcagcaagggctttctgccccttggaagatttctatacaagggtatggggatctgaacacggggcatctttcagtgggcatccttacaataataatgagttcttttgatactggcttctccatctgctcttcccctttctgcacctggacatcagaattaagctgcacttgtcccccacacctccctcgcagactgcactgcccctcctcctgggcagtgatggggcgtgtggaggaggcagcctccaagggctctgctctcttcagacaggagattgtcactttccttcccttcttcaggcgtggacaatgaggatgaccatggccgtggagatctggggcgcctcaagaagcagaaggatcaccacaaccctcatctaatcctcatgatgattcccccacaccggctcgacaacccgggccaggggggtcagaggaagaagcgggctttggacaccaattactgcttccggtgagactgggcccacatgggaaccaacatctactgcctgcctactgcccaatggctaggtcaggccccagagccaagccacactcaacagagggtccctgatactattcacaaacatctccaggaagaagactgaaaatctctcacagagattttctctgtgaaatctctttctgttttcctgggagtcccactgtttttccataggctaactctggaaggagctggctgaagtaaatgaggaaaactctgtgaggaggagtgttgctaaaatagtttggattggagatgcttggtcaaagcctctccatgatttccatgttttaagcacttgtagagtgtatgtgtgagattaatgtaggagtttccattaaagaagtgctcagttagttccctatgaagggtccaaggatgctactggatggaggcaaatagaatggtctccatttgaacggaaagttggagctagagaaattaacaaatgaattcagaaattactgggtagccacaatagagagatagaaaagacccagcttctcttactcaggagcagtttcactgctcatttataaagggaggataaagtatgcatgccaactactaaaagggagaagatgatcacccccatgagagggtccgaaggattaagtgctttaactgggagcaatgagttcacctatggacacaggaaaggcttcagaagggtgtggaatttgagcagaggcttcaaggatgaggtttggggatgaagggatccaggaggggaagcactgcaggtaaaggaaggagcatgagtgagtgagtccatctggcctcagaggatgccgaaatgaagctggggagaacgaattgggaaatatttagatctggaaaccatgtcttatgaggatggttgggcttgggaaactagggatgttcagttgggggaacagctcaacagcaaggtataggagaggcaaggtagttgccacaaaggctggcatgtagatttatttattccatcagttaggaacaaatcagttaggaacgaatcagttatcagttaggaacgaatcagttaggaacgaatgatcttggccagtgactttaatcatagtgatttcttgttcacaagaggcctgtagcagcagggttagggtgggctggctgcttaatgatgccaccgaagactcaggctttctctctttccagtctgccatgcttagtatgttggcttttcatccttttccttatggtcacaagtgattgctagggcttcaggcaccttgtccacatttaagacaagaaggaatgagggaaggggaagagccagaagctttcttcttccatctgtcacttttataaataatcgaatatctttgccagaacttgcccttaccccctgcatacttctccttgtctgatgggtcattactgggtcacatgaccaccgctactctcaagggaggacaggaaaaggagcatctggtgttttcgactctgtaatgggatgtcacaagggagaagggagttaggaatggttattgaatagataaccaatggtgtctgccatggttcacccttggaacccacaagaagccagattttggctaatagctgcctttggaagtagcaagttctaagtctcagcagatattaaagcagaggctagctgtccacttggcaagcggtattattgccaaatgatctctgtaggcaacagaattgaaggggcctgataatcacatttgggtgatctgttgaaccacggttctaatagaaggatatgccttatttggctaaatggcctttggattgagtctcagcagtcacctactatagtagtcaagctgcataaacttagaattgatttctgtctgggtgcacattaggagggtaaaaataaaaccaacctcaacaaagctgagttggctaataacattcagtgcttggttttatgtggagcgcttcatagcactgctttgtattgtgatagaaaagggtgcagggccacctttgcctctttactcttcctcatgcagcatttatctctgtttcttacatccttgggatcctggtctttaacacatgaatgtgcctttctggtttcttctgccccatgcccttgaacctgggattccattgatcagagccacctatgatggcatgaaaggactccaagggagaatatgagagcattcatgaagtttcttttattggtggttttaagttgattttctataaatgttttttgttgtagcaacttggaggagaactgctgtgtgcgccccctctacattgacttccgacaggatctgggctggaagtgggtccatgaacctaagggctactatgccaacttctgctcaggcccttgcccatacctccgcagtgcagacacaacccacagcacggtatggagcaggctcatgccatctgaggcactggggctgaccgaccagaccacttgttaaaaagaatgagtgaaggattgaatgttgagtgagcaaatgatggtctggggtgagtaaaattcctctggtgaaggttctgatcttggcaccctgactcagttctactcagtcacattctgcccttttaaattcctaccatagtttcaaccagctttttaatttgctttgtccaaagctctctgtaccgtagaaattaattaactgccacgtgttaccctatgtcagagatatgtgcatgtggctggcaaggaacactgaagtagaaaggcttctatcagaactctgatcattccagcctctcgaatgtagaaaacttactctgaaagacaacaacaaggatggacaagaagctaatttgaaatgctaggaacagaaagtgagatagccgagagtccacaacccctgaaactagtctgtctttcccttgaggggaatcaaaaatagggcagtaatttgtgaagcatgtttccttctagctcattatttctgcatcctgtctggggccctgcacgctgcacttactaaatggctcaaggcaatgttttgtgagaacatttctcaccgaagtgatcagttccagctaggaagagcaatgtaagtgttttcttaaaagccaagataggccgggcacggtggctcacgcctgtaatcccagcactctgggaggccaaggcgggtggatcacaaggtcaggagttcgagaccagcctggccaacatggtgaaaccctgtctctaccaaaaatgtaaaaaattagccgggtgtggtggcacgcgcttgtaatcccagctacttgggaggctgaggcaggagaatcgcttgaacccaggaggcggaagttgcagtgagccaagattgcaccactgcacttcagcctgggtgaaagagtgagactctgactcaaaaaaaaaaaaaaaaaaaaaaaaaaaaaagccaagataattcgttatcagtgtagtaactgtcatatgcttcaactcatcaccccaaacaagtgcagttgttctgcttctgtcattgtggatgaacagcaactacacaactactcactcacccaaaccaggttccaacagtttttttttttttcttttttttgagacagactcactctgtggctcaggctggagtgcggtggcactatttctgcttactgcaacctctgcttcctggattcaggtgatcctcccacctcagcctcccaagtagctgggattacaggcgcctgccaccacagccagctaatttttttgtatttttagtagagatggggtttcaccatgctggccaggctggtctcaaactcctgacctgaagtgatctgcctgcctctgcctcccaagtcctgggactacagctgtgagccactgcacccggcccccaacagttcctcttaaagagcacccgtggccattctagcacttgctcagcttctgggactgcccctggaactgggcgacttcctgggttccaggcctgagacttggccttccaacctctcactgacatgtcccttcccaggtgctgggactgtacaacactctgaaccctgaagcatctgcctcgccttgctgcgtgccccaggacctggagcccctgaccatcctgtactatgttgggaggacccccaaagtggagcagctctccaacatggtggtgaagtcttgtaaatgtagctgagaccccacgtgcgacagagagaggggagagagaaccaccactgcctgactgcccgctcctcgggaaacacacaagcaacaaacctcactgagaggcctggagcccacaaccttcggctccgggcaaatggctgagatggaggtttccttttggaacatttctttcttgctggctctgagaatcacggtggtaaagaaagtgtgggtttggttagaggaaggctgaactcttcagaacacacagactttctgtgacgcagacagaggggatggggatagaggaaagggatggtaagttgagatgttgtgtggcaatgggatttgggctaccctaaagggagaaggaagggcagagaatggctgggtcagggccagactggaagacacttcagatctgaggttggatttgctcattgctgtaccacatctgctctagggaatctggattatgttatacaaggcaagcattttttttttttttttaaagacaggttacgaagacaaagtcccagaattgtatctcatactgtctgggattaagggcaaatctattacttttgcaaactgtcctctacatcaattaacatcgtgggtcactacagggagaaaatccaggtcatgcagttcctggcccatcaactgtattgggccttttggatatgctgaacgcagaagaaagggtggaaatcaaccctctcctgtctgccctctgggtccctcctctcacctctccctcgatcatatttccccttggacacttggttagacgccttccaggtcaggatgcacatttctggattgtggttccatgcagccttggggcattatgggttcttcccccacttcccctccaagaccctgtgttcatttggtgttcctggaagcaggtgctacaacatgtgaggcattcggggaagctgcacatgtgccacacagtgacttggccccagacgcatagactgaggtataaagacaagtatgaatattactctcaaaatctttgtataaataaatatttttggggcatcctggatgatttcatcttctggaatattgtttctagaacagtaaaagccttattctaaggtgtatgtctgactcgataaatatccttcaattacccttaattccatgtccgcatctactaatcagaggtaaccagaatctggggcagagaatctgtcaatcaccaaacacattgcttagcgcaactccccttacacagggggcacaccgtgctgacttccgcctgctaagaagactgcactattgcttgtgcgtctttccttcttgcagagtatattattctcagagacacagaggcagtggctcagattggcagaaagcacatacgaatttgacctccagatacctgtgggcaggatcccctggtgtgaatccttgcatatggaaacatggtttatttactaactataaattaccaacatcactgttttcgaaaatctccccccacccgtatcagttgagaatgagagaaaatgtgtatggcaaatggcctaaaaatatgaggctaattctgttctcaggctaagcctaaaagagctaaccaggaaccccttttcagattgtggccctcttgtcagggatctgggaaccatagctctcttttgagtgaggccgtggatcccactgtggtatggacatccacgtggggcagccgtccacagtgagcgggcacagagcgacaggccatctagcagctcctgagaaacacattcttctagtgagatcactttgcctctagtaaaagaaaagtctatctgaagctaaagtatgcaggctgaaggatgtgtctgatgtgttcatgcctgtgtgtgtgtgtacgtatgtgtgtcccttgttccttgagttctccaagactgaagtgagtttggtcagtacttttttccccgctttgtccacgcccagccaattctaagggtttccctctcagtcttcatcccatgtggcacccactgacttccaccatcgttcggagggctatgtccctgtcctaaaatcctggctggcgggattatactccatcttgctccagggagcccgggggcacagagaggggatgcagtaagctcagcacatcagccacgggctgctgctgtcccagcatcagtctattcacctgagggccattctcaaattcactgggcatgataacccccaagggtttatttaaaatgtacagtttcaggctgcagctctagaggtacctttaggactgcagtagggtccaggttgcctcaaaactattaacacattttgagaagtggtgcattacacccgacatcactcgtccttacttgaggcttcaatatagaaaagggaaataatttttttggccccagatgaaacccccttttatccaacttcacagcacattgctaaaacattggcctgtggttcatcctaatgaaccaaggcagctagatacatttcctggattattccaaagaaaacagaacgtggtgcaattccaaatggtctttttcttcagagctctacttgtaggttaggcagcagacacaaatacggacaggggtctgaagtcagcccccctattctacacatcactgacaggtgctacagaaacttgaatcactgtcttcaaaaatcgacgcttgttttgggggagggtaaagagtgacattggaaatatcacctctgttggaggagggctcatagcatctgtctggtttattgccaagtgaagtccagtcccaataaaaatgacttgaaagcacttggacacatgaagggagagatctggtgtcttagcacctgatcagcatatggtaagtgcagtaagaaattagctggaagacttcattctgattggttacctagggcaatttcaagcattatagtctaaaacttcttttactgggctcatacttttttcccttgtcacaagattcacgtggtgagtcctcccaaaccccttatttcccaattctacacctcatcaggggactatggaggaattctaatttgtcccctaatcaactcacaaccaattgagcaaatagttaaggtggtcctgaaactactctccagtcccggggacatttgga

SEQ ID NO: 12201 - DNA, 227390 bp, Human
  misc_feature (1)...(227390): n = A,T,C or G
ggttcaagcgattctcctgcctcagactcctgagtagctgggattacaggcaggtgccgccacacccaactaattttgtatttttagtagagatgggggtttctccatgttggttaggctggtctcaaactcctgacctcaggtgatccacccgtctcggcctcccaaagtgctgggattacaggtgagccaccgcacctggcacaaatgtatattttaatagagtcaagatggccatgctgaagtctttgtttttgggtaatccaacccaaactatctgctgtgggcatctatttttttttttttttttgagacggagtctcactctgtcacccaggctggagtgcaatggcgtgatctaggctcactgcaacctccacctcctgggttcaagcgattctccagcctcagcctcctgagtagctgggactacaggcatgtgccatcatacccggctaattttgtatttttagtagagacggggtttcaccatgttggtcagactggtctcaaactcccgtcctcaggtgatctgcccacctcagcttcctaaagtgctgggattacaggtgtgaaccactgtgcccagccgggcatctattgttttttctgcacactctaccatacctcttaaaaaattttttaaaaatttttattgtttgtgggtacatagtaggtatatatatttatggcatacatgagatattttgatacaggcatgtagtgtgtaattatcacatcatggtaaatgtggtatccatcgcctcaagcatttatcctttgtgttacaaacaatccaattatactctgttttttaaaaaaatgtacaatgaaattattattgactttagtcatactgttgtgctattagatactagatattattcgttctaactggaataatatattttttaaacagtaaagaatgagatataaaagtgaaagagaaagagaaaggtactgtattcctgggtaaatatacatgctccctttgctttccctgtttcattgacagccatgcacacttacgtttatattcctcattatttgataatcttccccattagagaaataggaaaggctctagaacacatgaacacacttatacagcctttatgatatccaaatttatccattttacgccaaaaaaaaaaagtactttcagtagtgcctcccatgtatctttcaaaaggtacatagctctgggtgcacaaaaaaattaacacaattccctatacaaaagggactgctcagagctaataacagctaaagaagagaggacgccaattgcaggtacaggcacatctcttcgaaccctcccctaaaacaaatgaaggacagaagaaaacagaaaactggttaattcaattattactctgcggaaacttagggatagtgcaaataaagctctgaaattagactttactgagccctgcctcttgggcatcccccaagaagtgtccgcgaccccccagaaacctcagggacaccctcctagacaccccgccccaccagcctcacagggatgaacctccctaccattctttgaacccccctaccattcctttttgtctggaatcagatcttgatttccttttggggaatcgcccctcccctggccatgtggttctcgcgagatgagcacagtgccccacctactctgaactaagaatcttgtttttttgagacggagtctcaccctgtcgcccgggctggagtgcagtggcgcgatcgcaacctccgcttcccgggttcaagggattctcctgcctcagcctcctgagtagctgggactacaggcgcacgccactacacccggccaatttttgtatttatttattttattttattttattttttagtagagacggggtttcaccatgttggccagaacagtctcgatctcctaacctcgtgatccacccgcctcgggctcccaaagtgttgagattacaggcgtgagccaccgcgcccgtccagaattatctttaaaatttatttctttaagatttgtagctactaagaaagaaaggagctttttttccttgggccttcaaactgaaagaaccgcatgagcctgaagctgcgcatggtcttaacatcaggctgtgcaggaagaagctatctgcagatggatgccagcacacacaaggaagcagagctctggcaacattgaggtcagtaccttcttttttgcttaagctaatattaattgaatttccatcatttgcaaccaaaagtgctttgatactgcttttcatctaggggtaagaatgatcaacttggtgcaagcaaaagtaactggttggccaggcgcggtggctcgcgcctgtaatcccagcactttgggaggccgaggcgggtggatcagcgaaaccccgtctctactaaaaatacaaaaaattagctttgcgtgctggtgggcgcctgtaatcccagccacttgggaggctgaggcacgagaatcgcttgaacctgggaggccgacgttgcagtgagccgaggtcgtgccactgcacttcagcctgggcaacagagtgagactcttacctcaaaaaaacaaaaacaaaaacaaaaagtaactggtcaacggttgtgagtaatagaaaacttatcacaatctcttttggataactggtaaatttttattggtttggcatgctaaatttagaaagctcaaataactagcatttttctgtaccctagagaaaagtgttaaataagccaactgatcctgaggattattcaaagatgtaattccaggttatgtcagagtgtcagtgtggattcaacttaatcacctacatttccaacattaataggattattctgtagaaactgatgccaagagaaatgatcctgagttctgtactaataatagctacaacatattgacatattttgtgccaagaagtgtgctaagcctatcattatttatatttaattcgcccagaaatcctaaaaggtaggtgtgattgttccttttttacaggtaaagaatctggccaggcatggtggctcatgcctgtaatcccagcattttgggagaccaaagcgggcggatcacaaggttaggagttcaagaccagcctggccaccatggtgaaactctatctctattaaaaatacaaaaattaggccgggcgcggtggctcatgcctatagtcccagcactttgggaggccgaggtgggcggatcacctgaggtcaggagttcgagaccagcctggccaacatgacaaaaccctgtctctactaaaaagtacaaatattagccaggcatggcagtgggggcctgtaatcccagctactcaggaggctgaggcaggagaattgcttgaactcaggaggcagaggatgcagtgagccgagattgcaccactgcactctagcctgggtgacaagagtgagactccacctcaaaaaaaaaaaaaaaaaatcagctgcatgtggtggcacgcgtctgtaatcccagctacctgggaggctgaggcaggagaattgcttgaacccgggaggcagaggttgcagtgagctgaaatcccaccattgcattccagtctgggcgacagagcaagaaaaaaaaaaaaagaattttaggtttagtaatgtgctcaagcatgggctttgaaattagaaagacaactgacaagtagtagaacccaaatctaagccctcatgttgatatttctaaaaaaaaaaaaaaaaaaaaaatccaagccctggatctttctaatttcaaacccatgcttttaaccactgtgctctctataagtttccaaagtaagtttttgagttagcagggttttactatagttttttgagacagtgttgctctgttgcccaggttggagtgcagtggcacgatctcggctcactgcagcctctgcctcctgggttcaagcgattcttgtgtctcagcctcccgagtagctgggattacagattataggaacgcgccaccaggcctggctaattttttttgtatttttagtagagatagggtttcactgtgttgcccaggctggtctcgaactcctgagctcaggcagtctgcccgcctaggcctcccaaagtgctaggattataggcgtgagccaccatgcctggccagttttactaagttttaatgttagatgtgttagattgattctttaaatttgccaaccatatgtagctagcagttcataagaattcattcaaatatcattttttcaacatattttgaatacatatgtagcttattcctgctatgagccaggaataagaatgtctaattgacatggagatcttatttcaaaactcttttttttagacaggctgactgcagcctcgaactcctaagctcaaacgatcctctcacctcagcctcccaagtacctgcagagactaccatgcccggctaatttttaaatttttttttagagagataggggtctcagtatgttgcctgggctggtcttgaacttctgggctcaagcaatcctcccactttgacttcccagtgctgagactataggtgtgagccaatacacctagcctgtcaaaattcttatagataatcagaatttgccatcaacaatcattatctgaatgataaattctttctcttatgagacagaggtccagactggcaattttttttttttttttttttttttttttttttttgaggcagaatctcactctgtctcccaggctgaagtgcagtggtgtgatcttggctcactgcaacctctgcctcccaggttcaagcaattctcatgcctcagcctcctgagtagctgggattacaggcacacactaccacgcctggctaatttttgtatttttagtagagacagggtttcgccatgttggtcaggccggtctcaaactcccaacctcaggtgatcaccacccccaccatctcggcctgccaaagtgctgggattacaggcttgagccaccatgcccggcctcaatttttttttttttttttttaagtgaggtgctagaagactgttaccagaacttgggagtcactcctttttcaaaaaatacacaaaacccagtggttttagaagatctggagggcatccctgcccatctcatgagatcctcagcatagcaggcagggaaaaggggttggagagcctggcactgcccctgtccacagctgtctcctttcctaaactaagtctctgatgcgaactctactcctgacctccatcatccgtgtgtgaaatgccttgttttcatgttgactcttcagtgctgggtgctgaattagcatcctgtgtttgttttagcttcttatacagggaccaagtctggaatgtaattaattgagcccttatttgaaataaatgtgttctgggtgttcagagacctaaaaagatgtgagaaaaaaaaaagaaagaaaagaaaaaaaaaataaactgcacttggctgggtgtggtggctcatgcctataatcccagcactttgggaggccgaggtaggaagatcacttgagcccaggagtttgagaccagcctgggcaaaatggcaagaccctgtctctacaaaaattaaaaaaaattagccaggtgtgtttgtgtttgtatgcgtctgtcatctcagctacggaggctaaggtgggaggattgcttgagtccgagagtttgaggctgcagtgagctatgatcatgccactgtactccagcctgagtgacagagtgagaccctgtcacacacacacacacacacacacacacaaaagaaaaggaaagaaactgcacgtcttcaaacagaactatgttctctaatggaggagtgaaaagaagtagggatttggaaagagagcacctaactttgaatttcagctaaccatttattaaacatatgtctttgggcagatgtttgtacctcagttttccaataatatttaacttataaggatgtaggggcaattaaatactgtgcatgctagtattatgtaagttttaaaacaaaaattattataaattaatggagcctactgattttgataggaaaatctataaattccttgagtatcagtgaacacataccgtttttttttttttcttttggtggggtgggggagggtcagggccttgctttgttgctctgttgcccaggctggagtggtgcagtggcgtgtttatagctcactgcagcctcaaactcctggactcaagtgatcctcccacctcagcctctggagtagctgggactagaggtatatgctaccatgtctggctaacttttttttttttttaagcaccaggtcttgctatgttgtccaggctggtctttaacccaggtctcaagctatcctcccacctctgtctcccaaagtgctgggattacaggcatgagcctggcccacaacgtttattctaatgtttatttccataaaatttcaagaacagttgaaaaagttagtttgatgtctttaaacatgttataatatataatagtatacaataacatttgtaatatgagaatgtacaatgctattatttaaacaaaaagctgaataaaaacagatgtaaatccttgtcagcttaatcacataaataatcagcctattgcatagagattgccttgtttcactataatctttggatgtagtttccattcattgcatattttcagatattacttctgactatccttttcttccatgctggagaagctacttctttttctttggatattatttgtatgtgttccaactaaccaagtatttggactgatgaagagttgttatatatttttcagaggataagacccaataaaaatacacctaacaaaaagtatatatgattattttaaaaacaaacaaaacccacagaaaataacaagtgttggtgaggatgaggacatggaggcactggaacccttgtaaagtgttagtgggaatgtaaaatggtgcagctgctatggaaaatggcatacagagctcttaaaaaatttaaaatagaattaccatatgagaagccacattcagtggtgtatgcctatagtcccaggtattccagaggctgaggcagaaggatcatccgagcccagaagtttgaggccagcctgagcaacatgacaagaccttatctcaaataaaacaaaaccaaacccaataactttttttcatgtctcttgaatttgctttttcaagataggcaccactggggaaatatccagagagtggggcaatcacagttttagtctttgatactttgagacactgtaaagtgatatgatgattcagctttgctgtcatcccaactattttccagagagtattaatgttggaccaccttgtggattatgcaagactgtcagtgttgcctttggcactaacagaaaagagtgagtcaagaatatatattgcaaggtagaaatggtcaagatgtggagtttcttgtatgtgatacttttctattttgttttataagaaaaaactagctatttcattaggaaattacagtttgcatatttagaattttcattagtagtgattttaagtgttactgttgttaaaacggtgagtttgttagtttagaaacggttcatctaacagctaacaacttagatttaaataattaagtttggctgggcgtggtgattcacacctgtaatcccagcactttgggaggctgaggcaggcagatcacctgaggtctggagtttgagacaagcctggccaacatggtgaaaccctgtctctgctaaaaatacaaaaattagccaggtgtggtggcacacgcctgtagtcccaggtactcgggaggctgaggtgggagaatctctaaacctgggaggtggaggttgcagtcagctgagattgcaccactgcactccaacctgggcaacagagtgagactccatctcaaaataaaataaaatgatgtaaaataagtaagtttaatatgaatggagagggatatctaggagtatatttcagaatcttttttttttaactactccaaatatctatgcacaaaattcaagtcaactgtgcaagaaaagtcaaagaagtttctttttgttttgttttgtttttagagacaggtctcactatgctgcccaggctggagtgcagtggttattcacaggtaccatcatagcacactatagtcttcaactcctggctaaagtggttctcctgcctcagcctcctgagtagctgtgactacaagtgcccactgtgcccagccaaagcagtttcttggtatttcaggagttcttgtataaatgttaattttcagccaaaaactcaagtttgctacaactatactcaattaatgttctttgttttatttgtagtcaaagcaaggacacaacatcagagggacggcagagaatccttgtgtgtagatctttggtggtgagtacctgggaaaagtcacctaagtcaagatgtcagcataaaaagcattttattttgagcctgaaaagtggaatgagccatctatctaagtgcttacatggcataatgtgattagtagaaaggtttttttgtgactctcttactctgttgcccaggctggagtgcagtggtgtgataacagatcactgcagcctcaacctcctcggctcaagtgatcctcccacctcagcctcctgagtaggtgggactaccagtgcacgccaccatacgtggctaatttttaaattttttgtagagacaggatctcactatgttgctgaattcctgggctcaagtgatccttccgcctaagctttccaaagtgcaggggttatagcataaaccatggcacccagctgacattttgatagatgtatacattgtggaataattaaatcaagctaattaatatatttgtcacctcacattcttattttgggggtaagaacatttgaaatttactctcaacaattttgaaattataatacattattaaccatagtcaccaagctgtacaatagatctgtctccattcttccctttacatttatgatttgctctgtctagaaactgaataagtatcacaaggaggaaaattgagtggttaacaaacatacatgaaaccacgttcaactttactttcccacctttaaggcaacttataaacaaaaattgtaatagtatagtaatgcaagggatatatagcagctaagagaaatgaactaaatctacatatacacaacacagatgggttttaaaatcattgtaattattacaggcatgagccacgatgcccggctgtaatattttatttcttataggaaagataacaaatttgtcaaaatgttaacaatgatcagccagacgtgttcgctcacacctgtaatcccagcactttgggaggccaaggcgggtggatcacgaggtcaggagatcgagaccatcctgctaacacggtgaaaccccgtctctactaaaaataaaaaaaaaattagctgggcgtggtggcgggcgcctgtggtcccagctactcaggaggctgaggcaggagaatggcgtgaacccgggaggcggagcttgcagtgagccgagatcgcgccactgcactccagcctcggtgacagagcgagactccatctcaaaaaaaacagaaaaaccaaaaaaaacatactgttgaatgaaaagcaagttacagattatgtactgcttatgtaacgtttttatttatttgttttgtttttctccttggtgggcattggaaaatggaacattcttaaatggacacattcatactaatagcatcttcatgttctgtctttttaaatgcacacacacagacacacacatatgcggaagaaagggacacactggaaggatacactctaaattcctgaaagtggttacctctgaagagactgggagggtaattgatttggactggggttgaggggagtgcaagggggcttcaattgtatctgtaattttttttctttttttcctgtactttctaggggtgactaatgtaatgttttatttcttttttttttttaaattgaaaacattttttaatggagactgaggtcttgctatattgcccaggctggtcttgaattcctgggctcaagcaatcttcctgcctcgggctcccaaagtcctgggattacagccatgagccatgatgcccggctgtaatattttatttcttataggaaagacaaaaaatttgtcaaaatgttaacaatgatcagttttggatgttgactcatgagtgtttgttatattctttgcatttttctgtcttttgaagatttcttataaataagatttgttctctcctgtgaagattaattttctactttgtgcctggatttggtatgttgtgcacatttcggcccacacaatagtaataaatgagtcttggaacaaaacgtaagcaatcctctgcaagcctgcatgatacattctcactaagccagcctaaaaataacagaagagtaaaagtattattagacagagggaccctcatttgacctttcggccatttggattgtccattcagttaatcttgtcacaatcatgtaattatgaggttggtttgagcttaatgaaccaatatatacaatgaaaatatgctgtcaccagaactgtgccacacaaaggccttgggacataatacttttcttgtgtttgtacatgagatttcccaaagataacaaaaccttttaccaaatatgcttttcagacctattaccctttctaacgaatattcctcttccccacgtcaagtcggcatctcccaaaatatgtcgatgctgtccctttgccacataaatacccaaatgctgcctgatacccccgcaggctacatttgacagtacaatacctgcaaaggcagtggagctgcagagtgctattgaaaagaccattataatctcctctgaaagagtctcaaactgaaatgccagttagtaaaacatataggaaagagaaaaacaaccaggcaagtatataagtgtactcagcagcactcaaaattccagctgagttgaacctggaggtatttttaaaaagttgaatgtctggagaactagtttaggaaacttactttgtcttttttaatttaaaaaaaagttaaaaaagatatatacacttcactccctaaaaaaaaaaaaaagaaaagaaaaagtgagtaggaagtaggggatgtgtacattaatgagggcttccttcctttctctcacttggggagttagtcaaagaccctttaagacttgtttacttttccttctctagaaggaaatagccagcgttttccagcaatgataatagcagtatggacatcatttttaaaaactctagcagtatactattataagaccaaaataagagcaatatagtaaagcattatacattatttctactcctgtatctgactctttctctttcagctagctttagtcagcaggcttatttgctccagcctagggggtttgatttatttactctatgtgaacaggtctgactatggaaaccccttcctcatgtcagaacctttggcttccaggtggagattcattcatgccgtttacaccacatacttgctccctgcctggacaaattggtcccagttccctcaggtcagatgtattctgatgactcccaagtcctgagctgcataacactcagaacctttgcatcagtctctcattgagccctagaggtgcatctctcttcatggttgttgcaaacattactaattgcctcaacctcttaactgtgggtacccatctctagaatgaaaccatcccttaatttgatgtttattgaatacctgtcagatgctgccattctgctaggagctaggaatatagtgctgattaagatagccatggcccctgccttcatggtgcttatagtgtactgtggagcttacacagggagcctgctttaaggaaggatcaggtttcttcactaatgagacctgtacatagatggtactggatgagtgtgtgtgtatatgtttgttagtgggtgggaagcaagacaggaagcaaggaaaccagaactatcaacattgtttaggttagagatgatggtattttgaccagggttgtagcagcaatggaaatagtgagaagtgatcatttgagggtaaacaggactgactggcagactggttgtggggttaaagagacagagataaatcaatgatgacccataatgtgtttgacctgagctactgggtgaacagcagggctatttacagagatgaggatagacagaatgtgtgtgcaagaatcaagagttgagtttttttcattgttacatttgattttccagttgaaaaatcaagtggcgatattgagaagtcacaaatacatgactttgaagttcaaggttagagataaaattttgagatcatcaatgtgtaatccatttaaagaaatgggtcttgtattagtccattctggactggccgtgtgtggtggctcacactttaatcccagcactttgggaggccaagatgggaggattcactcaaggccaggagtttgagactagcctggtcaatgtagtgagaccccatctctctaaaaaaataaagaaatacctgatactgggtaatttataagaaaagaggtttaattggctcatggttctataggctgtataggaagcataaagctggcatctacttctcggggaggcctcaggaagctgccaatcttggcagaaggtgaaggaggagcaggtgtttcacatggtggaagcaggagcaagagagtgaggggagagatgctgcacacttttagatgattagatctcgcaagaactcactatcttgaggacaataccaagggtatgatactaaaccattcatgagaaattcgccttcatgatccaatcacctcccactaggctccacttccaacattggggattacaattgaacatgagatttggatgaggacgcagattcaagctagatgagtctggatgataacaccttcagagagagtgtctcagctgggcgcggtggctcatgcctgtaatcccagcactttgggaggctgaggtgggcagatcacaaggtcaggagatcgagaccatcctggctaacatggtgaaaccccttctctactaaaaaaacaaaaaattagccaggtgtggtggtacatgcctgtagtcccagctactcgggaggctgaggcaggagaatctcttgaacccaggaggcggaagttgcagtgagccgagtttgtgccactgcactccagcctgggcgacagaacgagactccgtctcaaaggacagagagtgtctcaacagagaagaggaccaaggacattgccttgggacaagccaacatttagatcctgggagcagaaagaaaagccagcggaggtgacttagaaggaacagccagtgtgatgggagggaaaccattagtacatcttatccctgcagccaaatgcagtgtctcaaagaggatgaagtaatctcttgcgtaaactaagagcagttaggtaagatgaaaactgagtatcagtcactggtcttgccacaaggtgaccttgacaagtgatctgattggatctgattgaggaggagctgtggatgaagaagtgtgggcaacaaaggaagacatctcttttgaggagttagtgcaaagggagtagagaaataggggtaaggtggatagatggggtcaagtaagatttttaaagacaagaaatattctagtatgtttgtaagttgatgagaatgatccaggaaagaaagaaatctgaggctgcaattgcaagagggaattactacaggatgaaagtcattgagtcattgaaggaatgactccagggcacagatggaggaagcaaggccagttcatccagggtaacgagagaaagcagagcagagaagacgcatagataaaatcggcagatgtggtgggaagacaaagatactttcttctgagggctctgatattctcagtaaaataagaaacaaggtcatctgctgagttcaaagagggagaagaaggtattgaagacttgagaagaaataaaatcaacctcctgtagagtgatccacccactttggcctcccaaagtgctgggattacaggtgtgagccaccgcgcctggccaaaggaagtttttttttttttttaaggaagttttaattaaaaattttatattatttttctcaaatgttaacaatgtattataaaccaaaaataaaattttaaatcctccaactgactgaacgctttttgaagagaaacattcttagaaacctttgggaaaacatttcctactttgaaaaacatggactataagcaaataatgtcttttattatgagaaagtcttttggttcttaattatccttgtcaggaaaaaaaaaacaggataaaagattgctttttaagattgtcactaaaataaaaaatacaacataaaaacaaatttctatttaactcattcctgaatcttaaagaatgtgttacaagttgggctgggcacagtggctcacacctgtaatcccagcactttgaggccgagatgggcagatcacttgaggtcaggagttcaagaccagcctggccaacatggtgaaaccctgctctacagaaaatacaacaattaaccgggcatggtggtacgtgcctgtaatcccagccacttgagagctgaggcacaagaattgcttgaacccgggaggtgaaggttgtagtgggccgagatcacgccactgtactgtagcctggcgacagagcaaaactctgtctcaaaaaaaaaaatagttacaagttaagaaactcttctttctccttagacaacatgttaaaagaaactcaagaaatgttacagcaggtaattttatgacaaatatgtggatatgcccattttcaaaatatgttagaaaatacattttataaacccaaacttacaacacggccttccacaaaataagtgctcaataaagggtaataataacagacccaataataacagcaataatttttaaatttagatatttttagaagtagactttcagcatttcttctacttgttgaaatgaagtcaatgaggttgttttctttagtgtgttaactgagtatcaagaggcactaggaaggaaatgtttgatcagttggctttaggaataaagcatttccctgaagctaccttggttaatatttgcaagtattgtgaactttttggatgaaataccacacagatgcaactcaaaacgaatagtaatacacatatatagttatttcagctctaaactggtattactttcaagtaaactctgaaatctcgggaataaccatctcatggctcttggtaaaaatgatacatgttcattacgaaacaatcaagcacagataagatgatgatccgaggatgagatggtgccctcactaatttctgttcaatgttcaaggtataaccctgaagagagagggttcagggagaccctcatttgactaaaggactcacaatgcaacttcagttcagttttaaaaaataagaaagttatgtttctggcacactttcattttgggctgagattcaaaacatttacaggcattaatatatgttccgggtaccccttgtctttttttgtccccctgagcacaaaataacattacataattcatgattctttttttctcttctctagaccaaaacccagtaaacagaaaacagataaacaaaagaggtggggctagttctctgcagagtgttgtggaggtggggctgaggatggagttttccttctggaatcccagccctgctgttgggagagcaaggtcctgccacataccctaaggagctaagaccacagggatctcagggggttttactgtcactttgaaatggtgtgaggtttcctgcttcatcagaatccctgctgagggggaaattgaaggtgtactgtggaaacctccattgggggcttctgcacagtcacaggaaatggtgagtttgcaggaacttgcggttactgtgagaaaatttgctttggatttttatgtccaaaatctctgtggaattccccagatctgaagccagtgcctgctttggactctgctctgcatacaggttcatctgattgtattttttctcattaattgaaatttgccagctgcaattttatcagcgaaaaccaaattctaatctcgtagatagatatagaaaatgtggctttaaattatggccttaggttatgatgaaataaaacaccaacgagtatgaactgggtctttatgagcgaatctgaaaaataaagtagtaaatctgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccagggtgacagaatgagaccctgtctcgaaataaaacaaaatttctcattcttttcaaacacagcatatgttacatgtaatttcatctgacacgtgtcataatgcattgtctttttttccataatgcactgtcttgtaatttttttcaagttttatttctaacaaaaaacttaaatgtaggccaggtgcagcagctcatgcctgtaatcacagcactttggaaggccaaggcaggtggatcacctaaggtcaggagtttgagaccagcctggccaacatggtgaaaccccatctctactaaaaaatacaaaaattagccaggcgtggtggtaggcacctgtattcccagctacttaggaggtggaggcaggaaaatcgcttgaactcaggaggcagaggttgcagtgaaccaagactgcaccactgcactctagcctgggtgacagtgcaagactccgtttcaaaaaaaaaaaaggaaatatgagactctctttttatgagtagaaggtgtctttcacctgtagcacaaagtggaggttcagagcatgaacggattctgtagccaggccacctgactctgccacttgctggttgtgtgaccttgggcaagttacataacctctctgtgcatcatttcctaatctgtaaaatgaggataatagctgggcacagtagctcatgcctgtaatcccagcaccttgggaggctgaggcaggtggatcacgaggtcaggagtttgagaccagcctggccaatatggtgaaaccttgtctctactaaaaatacaaaaattagcagggcgtggtggcgtgtgcctttagtcccagctactcgggaagctgaggcagaagaatcacttgaacccaggaggtggaggttgcagtgagccaagatggcgccactgcactccggcctgggcaacaagacggaaactgtgtctcaaaaaaaaaaaaaaaaaaaaaaaaaaagattatagagaaacaaccaaatgatttttctaatgataaagtcttttagactttatctgattaaagaaagtctgattagcagactgtgaactgctaatcaacagaatctggagacatgccactaaatctgagtcactgtcaacatgtgagtccacacctacaggaggggtggttccttgtatgaaaaacagcctcagtaaatcactgaaactctgctggcaaacatttttaatgcaagtaatgcacctcaatttcacccccctgcttacaatcctgtttgaaacaattccaaacaaatgaccaagaaaccactttggaccaaaagaaagctggtatcttacagtaacaaatactgtagcttgaatgcagttctccatgagaaattagtgaaagggagcatccattcccttagaaatcagttaatattgccattaataagaggttgggcaactgggcacggcagctcacgcctgtaatcccaacactgtgggaggccaaggtgggtggatcacttgaggtcaggagttatggcaaaaccctgtctctactgaaaatacaaatatcaaccaggcatggtggtgggtgctggtaatcccagctacttgagaggctgaggcatgagaatcacttgaacctgggaggtgggggtgggggttgcagtgagctgagatcgcgctgctgcactctagtctgggcaacaagagggaaactccgtctcaaaaaagaaagaaagaaagaaaagaggtaggggaacccttttttatagagctttgctcaggaaccaaaaattcaagtttattttaaacctttcgtctatgcttgaggtatctggatttctgcttttaatatcacattgtaaagatttaaagagaaaacatctctgtagacattgttaattttgtaaatactgatgtaatttcttgtgtttttccatatcatctactgaaactaaatagctcagaattaaaaaaaagagcccttttattttgccagtctataaagcttctgatgacaggtagaagaacctggtggttaaggacttaggttttgaggtcggtggatgtgagattgaatcgtggacaggttttgaggtcggtggatgtgagattgaatcgtggacaagatctcagtttgtataaaggcatgtatatcggcctcatttatacatattcttagagggctgtgagaagtaaatgtgtttatatgtatagaatttagtacccatggccaggcgcagtggctcatgcctgtaatctcagcagtttgggaggccaaggcgggtggatcacttgaggtcaggagttcgagagcagcctggccaacatggtatgaaaccccgtctctactaaaaatacaaaaattagccaggcatggtggtgcgtgcttgtcaatcccagctactcaggaggctgaggcaggagaattgcttgagcccaggaggcagaggttgcagtgagctgagattgcgccactgcactccagcctcggcagcagagcgagactctgtctcaaaacaaaaacaaacaaacaaaaaagaattcagtacccacgctggctcagatgttgatggttactgttgtgaatctggctctacggggaccagtcacttcatcactctttaaagacaagacactcctaaattatctaccaggccattttatttagaaggccttaacatgattgatacatttaatttaattttatttttttgagacagagtgttgctcttgtccaggctagagtgcaatggcaccatctcagctcactgcaacctctgcctcctgggttcaaacgattctcttgcctcagcctcccaagtagctgggattacaggtgcccgccaccatgcctggctaatttttgtattttagttgagatggggtttcaccatgttggtcaggctggtctagaactcctgacctcaagtgatccacccacctcggcttcccaaattgctgagattataggcatgagccacctcacctggccgatgcatttaaatgtgggattaaatattcacacctagttcaagtgttcacatctgtacttgaaactaaaacttgttaacaaggcataaatactgtattagtctgttttcatgctgctgataaagacatacccgagactgggcaatttacaaaagaaaggtttattggacttacagttccacatggctggggagacctcacaatcatggcagaaggtaaggaggagcaagtcacatatcacgtggatggcagcaggcagagagagctggtacgcggagactcctgtttttaaagccatcagatctcgtgagacttattcactatcatgagaacagcacaggaaaaactcatccccaagattcaattacctcccattgggttcctcctaggacacatggggattgtgggacttacaattcgagatgagatttgggtggggacacagccaaaccatatcaaatactgtttaatttgagtctaggagaaatcttaaggccttaaacttagactttataaaagcagaggctagctccatctggactgtttattccttcagaatattatgcctacttgtattcccaatgcctgactcagggctctcccatagtcagtgctcaatgaatattggtaaggaaaaaaatggttcagtgaggagatttttgcagtaattcaggtgactgatgacatttgacctttgtgaatgaatctccaattctgcaattgggtggattctctgcctataggtacaagaggaagaggacgagaaatatttcctgttctctcaataactttccaaataacatgtcataagaagcctcctcattctactctccaacatattaaaagcctaggattgagccaggtgcagcggctaacgcctctaatcccagcactttgggaggccaaggcaggcgaatctcttgagctcaggagtttgagaccagcctgggcaactaagtgagacccccgccctgccaaccccctctacaaaaaatacaaaaagttagctgggcgtggtggcatttgtcagtaatcccagctactcaggaggctgaggtgggagaatcgcttgagcctgagaagcggaggttgtagcgagctgagattgagattgtgccactgcactccagcctgggcgacagggcgagactccatctcaaaaaaaaaaaaaaaaaaaaaaaaaaaggcataggtccatagccctttagaactggaagaagccttctaggccaagcccttcatttgaactgagccttgacgggtattagccgttagccatttgtggaaggtcgcacagtagtcaggactggaagtctggtctttgaaacctgtcagtccacggtcatttcacctgcctgtttgtaaaacaatgtcctgttacttaagtatactttttaataagaaaaactgggtgtaagcaagagtatcagagtggtgttctggtgccagcagttcaacttctgcagcgtgtacttcacaggcacaggtacttaggacgtcgcacaggcacaggtacttaggacgttgccccgccgagactgtcgttcatatcgcgcccacctccgggtaacgccggtaatgctgacctagctccattatttgtattaatttatttagctagcagggggaacggctgggtaatgcagtctcagctgctggaggggaagaggcaagactccgccggcgcccaccatcagagcgtgacaacaagcgggaccggaggttgggaaaaagcacagggacagaatgaatgtgtgcatgggggagctctgctggggagagggcaagaggctgtgatcagattatctgaggtttcagaacttttatataaagaccaaggaaccaaatgaaaatccaactcttccagggagccctggaaagttcaaaggacctcgtttgagggagcgagtccccgcagctcgtgcccacgtctccctcgcgcttcccccaggacaggggccgccccaacccgggcacgctgagcccggccgcgcccctagccccttctctctcggcctcctcgtcccgaagggaagcacaggctcgagcagcattcggggctcatccatcagccgcggaggcaaagggggaggagagaggaggcgggaggcgggaggcgggaggaggagtttctgggcggccgagagcccccggtggggccggcggaggagcgcccttccccccgcgcgctgattgctgtggcgtcctgcccgtccccgcccgcgtgtgtgcgagggagggcgagtgcgccgggtcggcctgatgggggtaatcgagggtttcggggacgccgagcggcactttcctcttcccagcgagtgaaggagggcagtcggcggctctcgcgccccggccactttccctgcgcgattcccggagctccctgcaggaggtgagagtccccagcgggtccggatggcgtagttttgccgcggcgcagcagctgccggagctcgccgccgccgagcgctgggcggggaaacttgccgccgctttcctccaacttgctgcgggtggatctccgctggacacaccgcctccgaggtacgtgccggcccagccccgcggcgctgcagcccgcccgggctgtgggctctgcaggctgcgcgggtgcccgtcggcgcggcgcgggctgccagtgcctacttaccggccagggtcgctccagccgccaggacctccggccttgggagggaggcgctggtggggcggtgtttaccctccggggagcaggcaccggtggccagcggtgcgtgggcagcggccgcacggggcaggcagtgcccccggcgatgcgcagtgctggggaggaattctccacgcccgccctcactcttcctctccgcgggtccttctgacccctgcggggcgcggcggccacttccctccgggcgcgtgacagcttcggtgggaatggtttgttgtgggttcgcagtcaattgccgtggcccaggctgtggctcccggactcgtgcacggacgcggtttgcgttccccgctggccgcgccctcagggtgccttgcgggctgagccgcaagctgcagctcggcccccccccgccccggtttattttgaaggctctcttcttgtattcatttggttaggacaaacttggaaatcttggactgtcgctagaagaatctgcttgcagacttgatcttattagggcatttgccccgctttgcagaatcgcatagtgtcaggagccgacgtgtcaagcatgaattaccttggcaaagtagaacttagtggatttggtgtcctcacgaaaagctggaagaagaaaaccgttccatttccctagctgtgaagtgaggatagtagtacttgccccgtaaagttgctgtgagcatctaatgatttaatgtgtgtgaggtgctacaacagtgcttggcaccgagtaagcaccgcacggaggttagcgctgcttgccgctagccctgcggtggcaggataggagcggcgagggcagaggatagtaggagtgacaggctgtgctggggaaccaggcgtattctgagttttatgtccttccgaagaagtgagcggtttgggagaagtctccacaggtagtaaaaacacacgtcaagaccgtttcttcttcctgaatgcagagtgcaaacagttacttcagtgtgaactcagttgtttcttttggataataataacagctaacgttttctaagcccatactgtgtgcacttaatcctcacagcatctctatgggaaaagcactattaataaccctattttacagataagacactagaggttaagttacttgtccaagatcatacataactttctgttagttctgactccaaagctaccttccttcctcagcggagagcggcaagtgcaggccgatttgtgtgtacatagatttgtgtgcatagtccatgcatcttctcccatctttcagctttctatttgagctgaacgcatatctcttgaaacacacataaggtatctgtgatgaatttaggcgattttacatacttatgagggtgcccaattaaagttcctctgaaactggccccaaataattataaatagaactctgacttgtattaattaacatggaaatttttttttttttttggtgacagagtctcgctctgtccccaggctgcagtgcagtggtgcgatctcggctcactgcaacctccacctcccgggttcaagagtttctcctgactcagcctccagagtagctgggactacaggcgcgcgctaccacgcccagctaacttttgtatttttagtagagacggcgtttcaccatgttggccaggatggtctcgatttcttgacctcgtgatccacctgcctcggcctcccaaagtgctgggattacaggtgtgagccaccacgcctggccaacatggatctttattcttaatttcttttattaattctccagacattgttgatcaccattacttggcttccttaggaaacagcttggggttggcacaggaggcagggaaataattcttacccccttaagggctattaacatgaaattgatttcatgccattgtgtcagttaaaggatgttgctctatttcttgctgttctttgcttttggctttatttctgcattgtttagtgtttcaaggcttgagcgttttttttttttggcccttcagtttgacatttgtcaactttaatttttcctgttttgatggaatctgaccgttacacggcagctttgcctaacaactgttgattcagctcatgtttttaaatataaaaatcaccaacatagttttgaatcccagcacttcaaaggcaacccgtggggagttcattgttattttgaatattagtcaatagggggagcataacacactgttgatatctataaggcgcataaacccgtttttagagtattaaacatatagtttgaaaggggagggcaaaatatctagcaaaataactaagttgcttttggagtttataatggaggactagatttaatttgaactgattaagaatgaccttgaggacagggcctgtatgttgaatatatgtcaagaactccatggtggctggacagatagataaacacacatatagttttttttcaatttgtttccttaagtggtgtgtaggccaggcacagtggctcacacctgtaattccaacactttgggaggctgaggtaggaggatcacttggccaaggagttcgagaccagcctgggtaacatagtgagacccccatctctttaaaaagtgaagtttgtatgtaaactaattttgtgtggtttgaataatatttcaacttacctgggagaaatggaaatccagaggaatttgttgtgaatccttttgtaatgatcctcatttgtcttttgtagaaaactgaatataatgaatttgttctcagggaggttggtgtgttcacaatcctgtcatcatctttcattaacatcttctaagtgcaagacaataggggatcagtaatcctaaataacagcagttctattactgtgcattcctcagaggcttacgttaatattcaagtatagtagtagttcagatgtatcatatttgatactagtataggtgtgatgtgtctatgaatactcatacttgtaaacataaacaataagaatatgcttgaaaaaatcacacttgacatttatctatttatttatttattttttgagatggagtctctcgctctgtcgcccgggcgggagtgcagtggtgcaatctcagctcactgcaagctccacctcccaggttcacgccattctcctgcctcagcctccccagcagctgtaactacaggcactcgccaccatgcccggctaatttttttgtatttttagtagagacgggggtttcaccgtgttagccaggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttcctttcttgtttcttgcgtattatgtagtatttttttattatttatttatttatttatttatttatttttgagacaaagtttcgctctgtcgcccaggctggagtgcagtggagtgatcttggctcactgcaacctccgcctcccaggttcaagagattctcctgcctcagcctcccgagtagcggggaccacaggtgcatgccaccacgcccgactaattttttatatttttcgtagagacggggcttcactgtgttagccccgatggtcttgatctcctgacctcatgatccacccgcctcggcctcccaaagtgctgggattataggcgtgagcgactgtgcccggccccatattatgtagtattgatttacctttatttcatttaccacgttagggtcccatggatcctattttaaaataactttcaaaattagttgagtcccttctttttaaatcttagcattgcgcttatactacagagtggcatttatttaggatctcatttagtcttctatgctttgctctagtttactcgagtaattcaacaaacacttataacctcctactccctactaggctatggtttctggtcttggagcttggcaaattaattgtccttattcagtgctctgatgactgggggccaaaatgccttcaggttgcttagggctttcttacagaaagcctttcgttggcttgaaggaaagtgttgttccattgtttttaagactcaaaagaattaatttttctctcttgcatgcaaacttggttgtgacttgtaaaagtcaggtgagtgcttgtttttctgagggcagaatctgagcctaagagcccagggaactcaactgtcctttgagttttaagaaggtgatcactgctgacttctttagtatataagtgaagaccaatttcctggcttcaaaaatctgtgaaaggtcctgactttacattttaagcttaacagacagaacagttagagtttagactgtgactgtgtaagtaataactttgctgtaatattttgcctggatgattctgctctgtggtcattttgaattacctcccttcttgatagttcattttgaaacgtctttttgtggtgctttcattgctgttggataaaaattgtaattgtcagatttattttttatttttatttatatacttattcatataaaatatgtaaatatatgtaaaatctcacatatatataatctataactatatattgtataatatataatatgtatatattttgagacagagtcttactatgttgcctcggctggtctcgaactcctgggctcaagtgatcctcctgcctcatcttctcaaattgttgggattacaggcatgagccactgctcctggctgtcagatttattagctactaaaggacagtcttctttttcagtcttaacagttacttaaaagtgattttattgccatttccatcagtctactggagcatttttcttatatttttatttttatttttattttttttgggacggagtctcgctctgtcacccagggtggagtgcagtggcgcgatctcggctcactgcaagctccgcctccctggttcacgccattctcttgcctcagtctcccgagtagctgagactacaggcgcccgccaccacgcccagctaatttttgtatttttagtagagacagggtttcaccgtgttagctaggatggtctcaatctcctgacctcgtgatccgccgtcttggcctcccaacgtgctgggattacaggtgtgagccatcgcgcccggccatatttttaaacttatttaaaacaattgtaaatttaaaaaatgttaacttttttgaaatttgcataacttgagttagataaatgtttttaggggcctttaatgtaaaagcagtcttgtattgccactaggaatataagcaatttggaatttaagagtgaatctaggttatatgaaaagctaaccttaaacacataatagtgagccttcagcagattgagtgagggcatttctgtaggaagaaaattaagtgtaccaagagccatagcagtaacttctctggttctgcatcttcagagtaacacttggaatgatagcattgtttctttgcagcatgtcataaaacacaagctgttgctaatttgttcagtgtctagtcaagctgaaataaatcaacacagcttggaagggccttacaagaaggatctgggttcatttcctgggctctgtccaggaaatatagaaatataataaataaatctaggaatataaaatttctagatttcttattttatatcttttgaaatagcacatttgtttgttaactgacattgagctttattttctctgcttgcaaagtccttgcttaagaatcagcacaaatttccaagcattcttcctccccacttgaataatgattttgatgtcttgctctctcaaccaaaatgtgtttttgaaacaacattgatataaattctgcatgaggctactgtcatttggaacttattcttcattttttattcttcagtttttcaggccaaagatgaagacttaataggctgacaactgcttatgagggatagagaccatatttaaaatggaaggtctagaacaagagccccagaaccatgccttcaggccatcctaatgtgccctgctgaagataattttttggtgtcggggggcagggcagggagcctaatgtctggtttttgtggtggtggttcttttatgttgaaatcttcttccatcctgggaagaggattcagttatatgtagagcctagcaaagttgatttttagaattagattttaatggttatttttttttttgagacagagtcttgctctgttgcttaggctggagtgcagtggtgtgatcttggctcactgcaacctctgcctcctgggttcaagcgattattgtgcctcagcctcccaagtaactgggattacaggcgggggccaccacatctggctaatttttgtatttttagtagagacagggttttgccatgttgtccaggctggtctcgaacttctggcctcaagtgatctttccccctcagcctcccaaagtgcagggattacaggcgtgagccaccatgcccgcaagcccactttaatgttaaactgttgccaagataatttagaattaagtctgaaatgttagctctatctttacttaaaaaatggttataaagaagcgtatactttctggacattggactcctagtgaagggggcctttggagttgggtgttgtttgcaggaggacgaaacacctgcttttctgtccttccaggcacataattcatttctctggtatatgccgaaggtcaggttttttgtgtaaaattgctgatggatcatttgtaaaaacacatttaagttgattagtccttgaaaaatgatctttagaaaatgatctttacagatactagtccttgagctttcctgtggatcagattgccttgggcgaaggtctgcagtttcacaagcatgactcactaccttttataggtgagaacatcaaatgggccaggtggagggtctagtagaactctggatttctttttaaatttgtatcatactattttgctaatggaaacttgatgaatacttaattccatctggcaagtgaaaagggtcccttttgggagtattcgttttgttagcatttttagtgatttattgttttgacagtgtgatattggtccttggatgcaaaaatactctggagactatttggaaatttcattttataattaactaactgtgtgataattgctggagcagaatgtgtgtttttttttttttcttttcattctggaaggttatttgaggtgaaaaacttagattctaatcacaaaggcttgtgttcatgtggtaccctgagtacttttgtaagatactcactgtgttgctgtgagttatctcttttatggttttttctttaaaacaaaactcttctgagtctccataaagaataagtatctcattttgttatattagattttgtgcagttggctggcaaattaaatttaactttgagggaaagcaccattgactcattacatacattttgcatcattgcagcgtaaggtcttccctatgtgtgtgggagaagtttctgatctaaatgggcatgtttcctattgctggtctatcttttagccaaagcatttctgaatagacattcctattcattttcttattttcgagactttagagagattgctacttgttatgtattcgtgataaatcatctgaatcctgaaaaaaatacttatgccaacagcccattttgtaaagacacttgtctttgagcttttaagctgtcatactcattattcgttacaatagctgtacagccattggatgtatcatgtttttgacacaggagctaggggaaggatgacctacttgttgcatttcacatttttccatatttatatcttttttcaatttgtggcatctttatttcattgttagagtggttgttctctaagacgttccaggttttaatttcattcactgtgtgggctaaataaggagctttcctgtagaaccaattctactaaattcctgaaaatgtcagttaaaaattagccaggcatggtggtgtgtgcctgtagtcccagcttctcaggaggctgaggcaggaggatggcttgagccaggaggtcgaggctgcagtgagtcatgatcataccactgcactccagcctgggtgacagagtgagaccttgtccctacccccaccacacacacaaaaaaagaaaatatgaagaaaaaagaaaatgcttccaaaaagtatcccatctagataccatgctggttagggcttttggtcatgtttgaatgggacatagctgaacacagagcaggatttcaatgggtaggctaggaaaaggagaggagtgtctaatttgttgggagaaaatccacttttgcataataataggggatttacgtgttttctttggagttaatatgtatttcaagtaggtagataggtaagaggtttgcaaaaaaattttgctaaggttgaggttctgtagttggcaactcttataaccctgaagatcctgttctctaaagccaggaaaaagcagtctgtttccaattatgtatcacaaaaaatagtgaaattaagccaagaaaaatgatcatttgggagttgggttgcttttttttttgcagagggtaaaggagaaaggactgtagacacacattttaaagaatctgctagtttttctgttggctttcagatttttctcaaatgctctgtattggaaattaagaataattttaggattaaaggccttttcctccttcggcttctttttgtttctcagagagcaaatagaagagcatttaggcagtttttgctgacatgaaagggtttgggtccagtgttccgggacccagcttgtgtttttggtaaagccttttcctgcctgaatggtcccaggttatgggctcacagcatcatacctggtagtggtgctatggtttttgttatatgaatttttttaccatgctttgaactgaaatgtagtccctgctgcctagcattattctgctggaggagaaaactagggatgttagtgtgggaaaggtatggaggtgcgaagcctagcatttggatgatgtgtgggtgaatatattgtcctcagcacttgtcagaagcaactagcctttcgggatgcctactgctagtttcaggattagtggtcctgtgagacctaggtgttaactaagaaatctcctttccactgccagaagatcagccccggcaggtcttagttcctgtttctcacaccttacacctccacagagtgttgaataagactttcctgatgctgcataatctttgataactcttagtcttgtcactgaggctaatgtgttttagctcttggtgcttttcttctcacctcccatttactcttctgcctgctgctggctcccacgcccaccacacccccaccacacccccatgaggtgctagaagaggtgtgaagtacggagtgcaaagttgcatttgctgctttactatcctttttcccccatttttttttcttggtttccctgaaacgagttctcctggttttcctcttatgttccggatgtctcttcagtcttccattttgtttctttttctttcttttttttttttttttttttgagacggagtctcactctgttgcccaggctggagtgcattggcacgacgttggctcactgcagtctccgcctcctgggttcaagcaattctcctccctcagctgcacactcccacccccccccccccgagtagctgggattacaggtgtgcgccaccatgcccagctaatttttctatttttagtagagacaaggttttgccatgttggccaggctggtcttgaactcctgacctcaggtgatctgcctgcctcagcctcccaaaatgctgggaatatagacgtgagccacagtgcccagcccagtcttccttttcaatgcttgatccctatgggttgacattttccaaggttgcattttcctttcctcctctcctctcccctcttcttttctttttcttgtcttttcagtctacattgagttgctcatatttctgtgcttcaatatcagcagctccctgttttttcacacccatatttccaacagcctatcggacagtgccatctggttgttctgtagatttttctgttacagtccaaaagccaccatattacttctctgtggtccacagcctccacagtgtcaccttctgtatttcccatgtccctccttctctatgggggttcctgcttactcttccaggctctcactgctgccagctcctccagtggggcttcatgtggctcctcctggcaggtgcttctcttgctgcctcgtgagaatgttgtttttccttcggcagattccccagagcaggattgagtcttaccatcttggtatcctaggtgtgtagcatgggcctggtttatagatatattgtcaaatggaattcttcatttcagcccacttcagttatggctttggggaaagatcaggcttacagttgatataaattatagctatagaaaagacacagaaaatcaactcagaatcatagagtttagggttacagtggggcttagaataatcttccttaagtttctctaaagatgagaacaaccagagagcagtgtttctcttcttgcccctctgcagcctagttcccacccaatagccagaatgattgtgataaaacctaagtcagattccttcattcccttgcttaaaacactctaggctgggcgcagtggctcacgcctgtaatcccagcactttgggaggctgaggcaggcggatcacaaagtcaggagtttgagaccagcctggccagcatggtgaaaccccgtctctactaaaaaaaaaattagcctggcatggtggtgggcgcctgtaatcccagctactcgggaggctaaggcaggagaatcgcttgaacccaggagacggaggttgcagtgagctgagattgcaccactgcactccagtctggtgacagagtgaccaaaaaaccaaaaaaccactctactgtttattcttgtctttctcagaataaaagccagaactcttacagtgatctgcaaagccctgcccaaccagcccaccactcttatgctggtgacccagttgacttccctcttgtgctctctaggctgctcaatctgctccagctgccgcacctgactgttggtccctgagcacgccagatacgctctgtctcagggcctttgcatgtgctgtttcctttgcttggaatgtttttccccaaatagctacagaattcgcttctgttaggtccttactcaaaacagacaaaccaaaccaaaaccccacacacatactttgtctctcccttttctgctttgttttcttagcattggtctctatataatatataattatgtatcttgtttatagtctgtctcctttagctagaatgaaagctccatcagggcagggatttttatgttttgttctctgttgaatacccacacctggaacagtcctggcatgaagcaggcacttgataaacattattaaatgaataagaagcattttatggatttcttttttttttttttgtggcagggtctcactctgtcacccaggctagagtgcagtggcacaatcttggctcactgcaacctctgcctcccgggttcaagccattctcctgcctcatcctcccaagtagctgggattacaggcacatgccatcaggcccagccaattttttttgtatttttggtagagacggagtttcaccatgttggccagcctggtcttgaatttctgatctcaagtgatccacccgccttggcctcccaaagtgctgggattacaggcgttagccacagcgctcagcccattttatggatttcttatagccccagttataggtgcactcagggcattaaaaagggaaaattgggccaggcgtgttggctcaggcctataatcccaacacttttggaggccgaggacaggagtctcgaggactcctgtcacttgaggacaggagtttgagagcagcctggccaacatggtaaagccccatctttactaaaaaaaaatacaaaaattagctgggcgtggtggcaggcacctgtaatcccagctacttgggaggcagaggcaggagaattgcttaaacctgggagggagaggttgcagtgatctgagatagtgccactgcactacagcctgggaaacagtgagactccatctcaaaaaaaaaaaaaaaaaaaagaagggaaaattggccaggtgtgatggcttacccctataatcccagtgctttaggaggctgaggcaggaggattatatgaggcaaagaattcaagattagcctggataacatagtgagaccccatctccataaaaaaatcttaaaaagtcagctgggtgtggtggggcacacctgtagtccctgcttaaagggactgtagttgaggtgggagaatagcttgagccaaggagttcgaggctgcagtgagctatgatcatgccactgcacaccagcctgagtgacagagtgaaaccctatccccccctcccaccaccccgtcaaaaaaagggaaaaccatcaatctcggggaaggagaatctgatttttaaaaagcctcatttaagactcgttggactagaacactgacctcgttttcatgtctgactcaaagcagcacctgtgggtccccccatccttacaagtggtttgggaagactcccattttacctctaacaggcatgggcttgctgcggtttctctctgcctgtggtttgccctttaacccagcaggctacaaagatgaaaagcaaacacaacgttaaagaaaagagctagggaagagggcagggggaaacagggcagaatttccttgcagccctgacatcttgccttgtttctgtgcccatccccttgtctggttacacagtcccttccagagctgccttgcttgggggctgtgctcagtcttgagacttttaggccagatgactcttgagttttgctttgatgttgtaatttctttgaagagaaatcttaattttaggcaaaaaggacattggagaacggattctttaaaattaaattaccatctttcgaagtgaagttttaacccttctcaagataaggggttgtccctgaaatttctgcttgcttctgctgatgatgctagtgggaagtcaggattggcaggaccccatcttgtgaaaccaataccgtaaatcctcagggcaataaattcagctctgaagaagtgtcagactcttatgggtagggattatgtggaatgaagtacataatttgtattagtgtaatagtaaagttagaggaatttgcctcctgctcttattgagataacatcggcatggttcctacagggataggaagcccagccaagaaaggcaaaggcttaggaggaagctattggccatgtacaaagcctgcagtgtcattcaccctgggattcaaaggtatcacattgaaaataaattgtctagaatggagctgagttatcagtgagtagttaaaaataatcaaagctaccatttcctgaattctaacaacatactaggaagtaagtgctttatttattaatttagttagtcatcataacaatcccatgaaggaggtagaatcattatctctactttatagatcaggcatggagctttaagtaagttgcccaaaattatattgcttagaaaaggcaggtgggggatttgaactcaggtaggctatgggggccccgcactttccactatgctgtactgtagtctgcttctaggacaaaccaagcatgctcttacctcaggacctttgcactcactattcccactgcctgggaggtttttcctttagatattgtcatagctttatctcttacctctgtgcttaaatgttaccttgtctgggaggccctctctgaccaccctgtctaaaatagcatccctcctgtcatcactctctctccttaacctgctttattttcctttcctaggtcttctcatgccttgacatattatttatttgttgtcttgtctgtccccacctttagaaggtaacctatgtgaaaacaggagtgtgtttaatttgctgctatgtgcccacctccctgaacagtgcccaggacagggtaggcgctaataaatgtttgttgagtgaatgaatgaagtaaactaaaactgctgatcaaggcctgccaccctggtttcagaacaaaataatttgtcccttgtgccagatctcatcagactacccaccaccagaaagtgagtgtccatgcagggcctggttgatgtctacagtggcttagtaataggcacagtccctatcttttttttgaaagtcagctgtttctggaggatctcttgtttgtagtagttaagagcatgggcgtggaattagacagacctaggtttaagtcctggtgccaggatttataagctggtgacttggggttgcttagcatcttttttttttttttggtgacagagcagagtcccactctgttgcccaggctggagtgcagtggtgccattgtagctcacttgcagccttgaacttctgggctcaagtgatccccctgcctcagccttccaagtagctaggactattggcatgcgccaccatgcctggctaatatttgtgtttgtatttatttatttatttattttcagaaactcctgatattcaaattatttttattttttctatgtttcccaggctggtcatgaactcctggcttcaagggagcctttggcctctgcctcccaaagtgctgggattataggtgtgaaccactgtacccagccttacttagcatcttgaagcctcacctttctcactacaaaatggagtaaagggcatctgtctccttgtattgttgagaagattaaatgggaaattgtgatatacatgataggtgttcagtagatgataacagacattttgtgggttcagaagaaagcagagatgtcagcttctgacaggaaggggaatcaggtatagacacttgatcaaccacagaataattacaaagcagcatgtggacaagtcttggctttgtaactaagtagctgtgtaaagctgggccagtcgttgagcctttctaatttttggtttgctaatctgtaaaattaaagggtcggagtagatactacctgttctagcattccaagttggctctgactagaagataacatggaacaaattatacacaaaatgataagtgacagaatgttcacagtaggatgggattaatcagaagtctcttttggaatgaggtgaggactattggtagagttcttggactttgaggaatagcataaagatggcagattgtgataaaatggttagatctgacaaaattcaggttttttgtgtgcttacattgttgggaagatactgcatttaaataatttttgtttacgtaagttatatattaaaatagctaatgtagtattaatattctatttattcttatgttgccaagttgaatatttttcttggataacacttttctgttttgtgaagttattcctgctagcctttacataattatgcatttcagatttccacaagtgtgtttgaagtctcattttctagaagggattcaggattattagtccatgtaatgacaattatagtatgatatagaataaaagattttcttgtttaatttcttcatattagaaatgagggaagtaggatgcagaaggtctgagctggtaaaacatgctgatggtcgcactcctgcctccttttcctttgaggatgcctgaggttcttatacataactcttgttattgagaaatgttctaatttatcatcctgctgtactattttttcttttttcttttgtttgagacggagtctcgctctgttgcctaggctggaatgcagtggcgtgatctcagctcactgtaacctctgcctgccgagttcaagcggttctcctgcctcagcctcccgagtagctgagattacaggcatgtgccactacacctggctaattctgtatttcttgtagagatgtgatttcaccatgttggccaggttggtctggaactcctgacctcaagtgatctgcccaccttggcctaccaaagtgctgtgattacaggtgtgagctaccactcccggcctgtactatttttattgtagtgtgcacagtagtatttatacctgtagtccactgtggtaccctcattagatgcccgctgtcagccaagtgtaggtagactgtgatccgccttgctggaattaagacagtgggaaagccatacttggaaggaaataattacataataattacaacctgaagggttgtactgcgttctaggtgtccaagtttaacttggtccaagggaatcagaggaggcttccttcaagaagtaaggcttttgctgagacctgaagatgttagaaagtgaccatcctagggaccatggagggatgttgagttccgatatagtgaacatcacttttggaaggtgaggacttggcccttttgtgggactgaattgacactagtgtggctggagtgtgcagaagatgagcttggactaactagacgatggttggtggccatgtgaagttttgctgtttatctggacggcagtgggcaaccattgaagagttttaattcttagtgtttcacatgcctgggctctaaaccaccacacctggtgcacttttaaattttttgtagagacagcgtttcactatgttgtccaggctatcaaaagcttttttcaatggccaggtgcttgctagggcctgagggaggatgactgttgtcctgagaatattctgatatgctgaattttgctcgaataattacagctttatgatttaaacctttttgatgacagctgattcctcattctaggtagcttggttggtttggtggcagtgccagaccaagttccacagcccccagctgaacccctgcagctaattgggaatcatcaaatagaatcgagaagggccctgcagccagatccctgtaacttataccagaaatgttgaggcaatggcttcaccaccatttggacagttttgctacattatgagtatctttagaacccataccttgtatggaatttggaatcatttttttgtgatggagggaatttttgaaattctagatgataaagtctaatctcaaaaataatacaaaatttgctataaacaactatttctgttgccttgctactagtagtttgcttattttctttttggaagtctaggtatattttaaccataaaaataccaatgactattatttatttaaaatagacagtgtggggccgagcacagtggttcacacctgtaatcccagcacattgtgaggctgaggtgggttgatcacctgaggtcaggagctcgagaccagctgggccaacatggcgaaaccctgtctctactaaaaatacaaaaattagccaggcgtggtggcacatgcctgtaatcctggctatttgggaggctgagacaagagaattgcttgaacccaaaggcagaggttgcagtgagctgacatcgtgccactgcactccagcctgggtggcagagtgagactccatctcaaaaaagaaagaataaaataaaatagactgtgtgggccaggtattgttttaggtaccatgcctatattctgtcttatattataatcaaaatattgctaccattttacagatgagggcgtggtaggggctaaatgacttttccaatgtaacacagctgggtaagccaggttttgaacccccaaatacagttctttattaattctagcttaaaagcagacacccttataaatgaaaaggtacagaaacctttggatgcaaaaatcttaaatgtgaaaaggtggttcttagagtattgcaagggtgggtgaaaaagccatcctagtttgtgagtttgaataaaacatggtcttttccaactttgtgaaatgtgtcaacacccaccctccctttttcctgtattttccttgggagtgaggtgtgttgtgcttgggatagatggaagggctcttaaggacggactgaagttcggccccaaggaaaccaaggctgctggggccagatttgttgatcatgctcccagccaggaatgagggtgggcctgctctggagggacagcccaccttgcctctgaaggcagccggcacagaacaggcagagtggagtcaggcttctctgctctcctcgtaccctctgtgcgtactgcttcccccgtgcctaccagtacaggtggttccagagtaatcttcctcctttcttttcctgccactggcagccacagaatgttgggactaattaatctgatacctcaggataataaatctctttggtagaaacagcttgctaatgataaatgatagttttaatactatacatgcacaatctcatttgattcttgcaacaactctgtgatgtagctaagttttgtctgttacactctttacaaaggaggaaactgaggctccattctgatctaaacctccatcctttcttgtctgacatgctgtgagaatctcaactgattgtccaggcagtctggcctcccttcagtctgttctctgtacagcgtgagggaaatctttagtaatcccatctgatcacgctattccctgtttaaacccctccttgaacttattcgtcttctctttccctttcagctctgcagctctcctccctcctgtaatgcttcctctgcctgcagtgtcattcatcacctgacttttaaaatcttcgcttatcctcaggttgcgtatacttttcctttagagctctgattatatcgtgtagttacatgtttgtgattattgtctgtttatctcaccagcttttaagcccacaagggcaaaaaacatgtctccttggccactgcttagcagagtaagcaataaagatttgttgaaaggagaaactcaggaaattaaatgtcttgtgagaagtagtaaatgatatttttactcggatataagctccctgagggcaggatttttggcgtctttttttcattgctatatccctggcatcttgaacagtgcctggcatatagcagtaatatttattgaatatcagttgtgcttggatgtgattccgaagatttcttatccaaatctaggactttttctctcattgtgccaaatctatctgaagatggggattagtttagttctgattctgaatcaactcatggatgtagccaggccatgttagccatctaaggggaagctactaattttttcttactggtttttagcctattgccagacatccattttgccacagtttttctcttagatagagcaagatttctctcctcaccttagggaatattgtacccaaccagatccttttgaatattggtttagaacgtgatggttttgaggattcatttggatgggattttttcagctaatcttggtctttacctgtgcactctgttgggtcatgagggcatgtggggcagtatgctcagtttaatggactcagaaataaacccaggggatctctgaaattagcagaattagcagcacatttgtttgctttttttttaaacccattaagttctaagaattttcttttttttttttttttgggagacgtagtctcgctctgtcacccaggctggagtgcagtggcgcgatctcagctcactgcaagctccgcctcctgggttcacgccattcttctgtctcagcctcccgagtagctgggactacaggtgcctgccaccgcgcccggctaattttttgtattttaagtagaaacggggtttcaccatgttagccaagatggtctcgatctcctgacctcgtgatccacccgcctcggcctcccaaagtgctgggattacaggcgtgagccaccgcgcccggccaagttctcagaattttcttatgttcattgatgaatactaagtgttcttcagttcatcaaagttcacctaccttttaaatggaacatgttgctttgaaatgtggggaaaatgactattattccaaattgctctttcatgatctcagagtaccctatttatatttctactttttttttaaataaatactttaagttctagggtacatgtgcacaatgtgcaggtttgttacataggtatacattaggtatacatgtgccatgttggtttgctgaaaccattaactcatcatttacattaggtatttctactttttttttttttttaagtgaaagcaagtttattaagaaagtaaaggaataaaggaatggctactccatagacagaacctatatttctttctttctttttttctttttttttttttttgagatggagtctcactctgttgtccaggctggagtgcagtggcataatctcggctcattgcaatttccctctcctgggttcaagtgattctcctgcctcagcctcccgagtagctgggattacaggcacgtaccaccacgcctggctaacttttgtatttttggttgagctggagtttcgccaggttggccaggctggtcttgaactcctgacctcaggtgttctgcccagctcggcctcccaaagtgctgggattacaggcatgagccactgtgcccagccagaacccatatttctaaagaaagcatttagttcataaagtccagagattctttgaggtcaaaaagtcaggattgggagtccctgatgtttgcagtcagtgtggtagaacctcacagaagaaagaggagtttgtattttgttagttttatcaaagctacaacttttcggaagccttcagtccatccagcattccagggaactgattcctaagtcgggtgttaaggcactgaggtgtacaagttgtggccaaaactggagttcagctgaatgagaatgacacacttcccttttgcttctcctctgccttgggagcctttcaccacactggggagattagacaaaaaccttctgcagtttattttctttttgaacagttacattatggagagacttttaagctaaaagaagaaaagctccctttttgttacaaacagcagtgtgtagtttcaacttgtccaggacttcctcagagatgttttaagatccggtgtaaacttgctgtggtttgcctttgggcatcaaactgtttagcttggctctattatatctgtaattgctgcattttaataattgcccaatattcttgtcagcaatttgcagcctatatttttaatggaaccatttgcctttcttttccacaggtttgttcagacctggcttaagcccctggattaacgcagcacagaccctcagacccactgcagctgtgggcagggtgacgcaagctcattaaatattcccacaagcctcgtgccgcttacagtttatgtgcttcataaaatcctctgggaagtcatcttcttctgagatctccttacagggatttgctttataaaagttgtctttaacatttgctgaaatagcatattgtttcagagaggtttttccttatcaaaattattatataggcaggaggcactatagttcttgtgaaccaattcactaatttagggaatctaatatttcgaagggaaaaaaatagagacagatcctctttgtggtggttgaatttttaagttaacggagaagatttccatatgatcagagttgatgtggaattatggtgacagaaatgttcgacttagagggataataagtcagtttaatggctcccaaattatctctataatttagtcagcttttgagacaagaccgttgtgtcattgatgacttatgcctcaacttgactggtaattttgttcttttagtgagtccactctttagcttatctccttttgactgttgtaatgtttatttttcagtaaacaaaagattgaactggatttacagtagctaagaattacataaatagctatatcttaatttctccactttattggtataaatagctcaaagagaatggacaagtagtgatacagtacagtaattgtagctaacatttatttggttggttgttacgtgctagggactgttctaagcattgtgtatgtatattaactaactgaatcctcacaacagcctaccatacatttcctaccacaggatatgttcattcaagaagagtaagctgcctaacattaccatttggtaaggggcagagtggattcacacccaggcagatttttaatctttatcataatccgtatgctattcatactaggattttaatcactatcgtatatcaagattgaaccatagtggcctcctgcctatataataatttagtttcaagacatatctaagaaattctttttgaaattggaactttactgttattatttctggataggtaatacttgcacatggtattaatacaaaacccagaagggaattcagtgaaaagcttctgctccctcccacccctgtcctgcagtcaccctatttcccccgttctcataggtaaagttacaattgcaaagagccattttaaatatctctctttgtcacttgatgcaataaattaagaccatttaattaaaaactcatttaaaataattttttttgtactgttatctacaagcgcccacattggctttgtctctgaaggtagctatgggcaactcctgttgcgtgatatttcctgagtgaggatgacaaggccacaacccccaggtgtgtgagatggctcccggaaatgccaccattctgccttttccagggcttagatcagggagggtctttgcacttttacccataacttttattcttgatgagaaggaaccatgcctggagcatagtaaatgctcagtacatgtttgttaattgaacttctgtgagttgtgccaggctcagggatagagggctggagaaatatactttggagtgtctaaatcagtgaccattagggccgtgtgaggaatattcaagttaggcaaaccaccacaaaactctcattgaagactctggataggaaaaggttagaaagaaccttctagatccttgagtccagtaaccagatagtctcagatgggctgagagacagggaagacttttttcctgttaaaatgttggcaaacagttgaaataagaaccttgcctttttatgtttctttatttttttcagattgattcctagcacaacttaatttgatccttgtgataaccctgttattataacattagattgagtctctaatcagtgctggttttgttttcttgctggcactagggttgcatgtatcaagtgtcattgattactttggtaccacaacttaactggtggtgttatatttcaggtgcaccttgattttcttctgtagttctgaaaattctctataaaaccaaagatttaaaatgtcaaaaacagggccgggcgtggtggctcacgcctgtaatcccagcactttgggaggctgaggtgggcagatcacgaggtcaggagttcaagaccagcctggccaacatggtgaaaccccatctctactaaaaatacaaaaattagccaggcgtagtggcgcatgtctgtaatcccagctacttgggaggctgaggcaggagaatcgcttgaacccaggaggcggaggttgcagtgagccaagactgcgccactgtgctccagcttggcgacagagagagactctatctcaaaaaaaaaaaaaaaaaagccaataacaaatatgtcatttgcaaaagtatttgctataaaaatctttattagatagtcactgccctcagtctagtttgcttgagtgctattttgcatcttttaagataaatttcttacattacgcttttcagaaattctctgtttaattttagtgtctgtttgtttatgaagtttcttcattaagttttcttattgaaatttgttttacaggcagtttgaaaattgcaaggagggactttaagactacttctgatttgcaaagattgtctgtgctctgagcaggctaaagtgactggacgagacgcactgttggagaaataaaaatgacttcccattatgtgattgccatctttgccctgatgagcttctgtttagccactgcaggtaagttgcataatataaattgcatatttgttatatatttttggatatattttgtcccagtctctttagttgagatgaagtttcactctgttacccaggctggagtgcagaggcataatcatggcttactgtaggctctacctcctgggcttaagcgatcctcccacctcagcctcctaactagttgggactacaggcgtgtgccaccatgcccagctaatgttttattttttgtagagatagggtttcctatgttgctcaggctggtttcaaactcctgacctcaagtgatcctctcttcttggcctcctagcatgctggtattacaggtatgtgccactgtgcccgacctgtatttacatttttgtccctgaataaggatttcaagaaagcatttttgtcctttattagcaaataaatagatcttctagattgaggtgacactcttgacataggctgcttgggaggtatttagttttgcctatttcacatatttcaatatgtaacctttttttttttttttttttttttttttttgtggagacagagtcttgctctgtcacccaggctggagtgcaatggcctgatctcggctcactgcaacctcctcctcttgggttcaagcaattctcgtgcctcagcctcccaagtagctgggactgcagatgcctgccactacacgtggataatatttgtatttttaatagagacagggtttcaccattttggccatgctggtcttgaactcctgacctcaggtgatccgcctaccttggtctcccaaagtgctgggattactaactttttaaaaagtagagaaatacactgagcttcctggaggccaaatgagattggagatgaaaagatgcaaatgacttggaacattgttgcttaactaagagtatcggatctcccacaccaccatcttagtgtgtttactgtgaggggttacttagtaaatttggaagcttaatttgctctattttattataatttccattgtgtctattctgtaatgagctacataaaactaatttgttggaccagttctggaaactggcaggtctcagcaagaaaagcattgactcgaaaagtgattagctgcttggttttggctgttgaattgcacatacagatgagagtgatagtaatgatcatctattgagtgggcactatatccaggcactgggctaaacaattaaagaatataaaaatgaataaggatattcttatttaatgagctcacttaatcacaacttggaggtagaattaatttggcattttataaatgatgaaatgagatatggagagattaggtaacttgcgtagtgtcatgtagctggaaagtggaagagccagattttacattcagattttacatctatgctcttcacctctgtgttatactgaagaaaccagatctcccttaagactccaatagactcagatctggggttgtgtgcagacgtagactaagcgagagtcagctggcagaaactggtttatggattggaaagtagaatgttcctctcattgcaagtatctttttttttttttttttttgagatggagtctccctctgttgcccaggctggagtgcactggtgtgatctcggctcactgcaacctctgtctcctgggttcaagcgattctcctgcctcagccttccgagtagctgggactacaggcgtgtgccaccatgcctggctaattttttgtatttttagtagagacaaggtttcaccatgttagccaggctggtctcgatctcctggcctcagcctcccaaagtgctgggattacaggcgtgagccacttcccctggctataaatatcttgaaagaaagttgctaggccttttttgttgttgttgttttttgaatgccagtttatgaatttcaactgcccattctctatttttgtctatcagcagtttcattttgtctcattattgaagtgctatttgccttttagcctgtgtattaaaatggaattgacttaaaatctcatcgaaaagtagtagaaatgcacccccccacccccacctcccaaaaaaaaagagagagagaaagagggagagaagcggcttgatggaaaacatgctgttttgatgacaagatgtctagtctcaccttgtgggtttgaggctgggctttctgccttcattgatgcctgggtcagactgaaaaacacaactgaagaaggcactttatgggaaaggagtgagttcaatggccctgtccagccttgatgaatttgatagtgaatcagttttgcttcagatcttcctttcctatttgaagcctttgggaaaatatacacacaagtatatatatatttgagttgaatacacactcaaggctttgctgaggtggaagggacagtagagttacagattttttttttttttttgatacagagtctcgctctgtgtgtcacccaggctggagtgcagtggtgccatctcggctcactgcaacctctgcctcctggttcaagcgattctcctgcctcagcctcctgagtagctgggattacaggcatgcaccaccatatccagctaatttttgtatttttggtagagatggggttttgtcatgttggccaggctggtctcgaactcctgacctcaagtgatccacccccttcagcctctgaaaacgctgggattacaggtgtgagccaccaccgctggatgaattacagattttataatagcatgaggcaactgataaatagcacagaggtatggatgcctttttggtgtagaagtttgttggttgtttcccttttgcacaacataatagatcaaatgaatgaagaagagggaaattttgtttttttttttttttttttttgagacagagtctcactcgccccggctacagtgcagtggcacaatcttggctcattgtaacctccatctcctgggttcaagcaattctcctgcctcaacctcccgagtagatgggagtacaggcacacgctgccacgcccagctaattttttgtattttagtagagatggggtttcatcgtgttgcccaggctggtcgtgaactcctgagctcaggcaatccgcctgcctcggcctcccaaagtgctgggattacaggtgtgagccactgtgcctggctgcaaaaaaaattttttatatgctaatatctgatatttttctctgtaggcccagcatactttacaaaatggttttttgggcgttctggatgagctgaatttagctcatctgggtagttataacaatgatgaatatttcaaataattactgtgtgtcaggccccaaatttctttacatgtattatctcatttcatcctcataaatactctaagaaatatagatactttaataatccatagtttataagtgaggaaatggaagcacagagaggtcaaataactttcttaaggtcacacagctaataaatggcaggtggaactataaacctacttagtccaggtctggagattgagcctttaggcctctctactatattgatttgaaggaaatcatttgtttggaaagaatggtaataggttttgagccatttatgtcctcctgaaacattaaatcatttattcactgatccctgctgagtacaaagcacagtagtagtcacttagggatatacatgcaaagaaatgtaagattcgttcccaccctattttttttatttttggagagatgggatcttgctgtgttgtccaggttgaccttgaactcttgacctcaagtgatcctcccacctcagcctctcaaagcactgggattaaaggcgtgagccactgtgcccagccatattcatcccttcttttgagttgcttgtactttatttaggcttataaaatataaccatataaccaaataatgaatgtgtagtgaaagccaagtaaaacccaaagacctcagaggggtcacgaggggaagccctgtgggtcagagtagccagggacagctatgtggaagctctagatcttgaactctgtcttgaagactgggcagaatctaggaagaaggaggcactgagttcaccaggtgggaaaacctggcctagcacggaatgtggcatttaggtgcttaatttttttttttttttaaataaatggatgacctggagagctggtgtggaaatgtagcaggaggtctatttggaaagaaggatggagtagattatgaaagttcttaaatatcataatgaggcttgtggattttattctgtggtttggatgctctcttcttccatcccttggagccaaaggcatgcactgtttaatcttggaattcaaacggtggcctcaaacagtgaggctgagtatgtggcctcattagcttcagacccagcagtgcttggctcacaggctgtcatttatcaagggcttgatctctgccagctaatttatttaagacaactctatgagatgggtattattattatcatcacctccattttacaaacaaggaaattgagactcagtttggttaataatttgtacaaagtcctggaactaataagtggcagagttgagacttgaacctggcagtttggctctagaatccagcccatcaaccactagatccttctctagggaggagaccctgtgtgtgggatgaataaacctcttcttgattgattaaataccaggtgagtagctaccagtgtgacatcctggaaccagattaagcccctttggcctcagaagagacagacacaggtcatcagagcagaaggaccctcaagtagtgggccttctttattcatattctgacttaaccaaagtggccttaaagctgtaaatcggtgggaaggtgtggaggtctggcagcagaggggtgaaggttgtcaaaggcctccttttggttatgtggccagaggaggggcagagcacaagggagcacgtaaattgagcccaagttagaataataggagcctgcttgttccagctccataggtttgtctgggccttcagtgaaaacctttctttccttctctgcttgtgatagagagtgaatgaaggcagtcggggccgggtgggtcgggggatatccatgtcccagtgttagtgttgttctgacaaaactcatgctttcggctgggcgtggtggctcacgcctgtaatcccagcactttgggaggccgaggcgggcagattacgaggtcaggagattgagaccatcctggctaacacggtgaaaccccgtctctactaaaagtacaaaaacaaaattagccacgcgcggtggcggacgcctgtagtcccagctactggggaggctgaggcagaagaatggtgtgaacccgggaggcggagcttgcagtgagctgagatcgcgccactgcactccagcctgggcgacagagccaaactccgtctcaaaaaacaaaaaactcatgctttccctcccctccctcgttccttcgttatcatatagcactgttgaggatggagggtggactgtgctcttggtgaacacgagctgtgtaaggaccataatgcctcttgattagaaattagcttaggtgatttacttgggttaaaaaaaaaagagagagaataaatacaagagatttattggggttaaaaacaaaaaagaaaaaaaaagaaattatctaaggttatttattggcctcttagatcctgtaagctacctaatgtaagaaaagtgggaagtttaaaaaataagtgcttgatactatgggcttaagtctaagttttgctttaaaaactcgtctatacttgtgttataacattactattattgaaaatatctgctttccaggctgaagtgattcatttattattctagttctgctttcctcctttgtaatttgtgataattgtgcttttctttttaatacaaaaaatggataaaaataaaaacttgaaaaggcaaaaacaaaaacaaaaacaaaacaacctcccaactgttctacacatctttaaaagatattagctgctgcctctgaggcttgccaacattaggcagggctatgtttccaggagttttagtaataagaaaaagaggcatgcatggagaattcagggaaatcagttttattggaagggctggagttatcactggccccttgtgccaggtgagaggggtgccgctgaggtgagctctggagcagggctgctggcattgatgccagtgggctcttggtggaatggctaacttcttcattccactgtctcaattcagtacccagatgtatccttttggaaactcgcctgcaaactgtgcacagatttctattgagaaacacatttcttttcctctctactggatgtacctggaattccaggtagagtccacaggaaaatcgagatgcttttagtctgagctattttcctgctcagaaagctctgaactctttgtgtctgtgggagagcaagctgagataccagctggttaatacttggtctggaatggtacaagctggcagccttgagtagaggctaataataccatattgtatttgtaatcttaaaaatgtttttataacaggtatttcatttgatcctcacagcagcctctgggggtaggcaggcactattttcttcatttctagaatgagaataatagggcttagagaaagtaagtgatttagaaagataattcaagtcttggttggaccagaacttagacatgcttttgcagacaaactgcaccaacaaatcctgtgacctttttggtatagtgcacccttagcacctcttgacaaataaaaattgtatatatttatggtgtacatcatgatgtttttatacatgtctacattgtggtgagtaaatcaagctttttaacatatgcataacctcacacacttatcattttttgtggtgagaacacttaaaatatactctcttaacaattttcatgtgtaaaatatattattttttttcacatttttatagggggctgtaggaagggggcctcctcactgtcgagtgaggtggtcacagtttctttggcagctccaagctgggcactgggggtcctggaggtggctctgtatgtcagcatgttcctaccaccttggaagggcactagatagtttcagggcgtcacctggttggtcatgatgttgtacttggtaggggctgagtattggcccccatggtgaaggacatgactggcaccagctccatggcccaggcatttttgaggaaggcatgagtcctagaggggtaggtgagtgggggtcacctctacaggggtcatggccatcttaggctcagtggtggcagtggctactataataccttgttattaactatagtcaccatggtgtacagtcaatctcttgaacttattcctcctgtctaattgaaattttgtatatttgaccaacatctcctcagtccttccacccccactccccagcctctggtaaccaccattttactgtttctatgagtttgactttttttttgggagggggtgggatggagtctcactgtgtcacccaggctggagtgcagtagcatgatctcagctcactgcaacctccgcctcccgggttcgagtgattctcctgccttggcctcctgactgggactacaggcatgcgccgccacacctggccaatttttgttatttttagtagagatggggtttcaccatattggccacgctggtctcgaactcctgaccttgtgatctgcccgccttggcctccaaaagttctgggattacaggcctgagccaccgctcccggccatgagtttggctttttaagattccgcatataagtttgatcatatatgatatttgtcgctctgtgcctggcttatttctctgagcataatgtcctccatgttcatctgtgttgttgcaaatgacaggatttccttcttttttaaggctgtatagtattccactgtgtatatataccacattttcattattcaatttattcatttatcctgtacttgaaagagaaatcttggatgtgagttaacggcctgtgaacctcagaggtggttctgccatagttatctcctgtctgccaaacgagtgatcaaaggctgtaatactcataagggcaggaaggctggagggtgctggcaggggactaccaccagggaatgtaaggatagaagatggataggctcaaaggttcaaagcaaactgaaaaaaagccccctcccctttttttcttcttcttcttttttttttttttttttttttgccaaccctcaggtcttagaacacagctagttgatttggtctgtgattattattgtttttagctgattattttatcttatttttattttatttgtttttttgagacagggtctcactctgttgcctgggctggagtgcagtggcgcgatcatggctcactgcagcctcgacctcccaggttcaagccattttccccccacagacccccaagtagctgggactacgggtgcacgccactatgcctggctaatttttgtgtttttttctgtagagatggggttccgccatgttgcccaggctggtttggaactcttgagctcaagtggtccacccatatcggcctcccaaagtgctaggattataggtgtgagccatcatgcctggcctttagctggttattttaaccagttttgtgtttaattctgctttttgatacacaaggaaaggatattgtcaaatgtgataccagttatcaccagagtgccaaactttattttaaagagcaaataactgctattaaaagacctagagtggcatggtggtggctgcctgtaatcccagctactcgagaggctgaggcaggagaaccacttgaacctgggaggcggaggttgcggtgagccgagatggcgccactgcactccagcctgggcaacaagagcgaaactaggtctcaaaaataaaagaaagacccagagtggatagggtagcctgcattttagagtgtattccctttgaggatattgtgcacagccaagtgtgatgaagcacctccccacctaccttctccattagatttttctacagaaacagcatgtgcgtgcatgcgtgtgcaaacacaacacacacatgcatgcgcacacacacacatacacacacacgggagttgaggcagtagttgagagaaaggtgagttcatttctcaaagattcccttgccctgtatggacctgtgtgtgtgtggaggtggggtggatagcctaatgcaaggccttttactttttttttttccctgagacagggtctcactctgttgcccaggctggagtgcagtggcacggtagctcactgcagccttggcctcctgggctcaaacgatcctcccacctcagcctcttgagtagctggaactacaggcacatgccaccacacctggctaagttttgtattttttgtagagacaaggtttcgccatgttttccaagctggtctcaaactcttgagctaagcaatccacctgccttggcctcccaaagtgctaggattacaggcgtgagccactgtacctggccctttttatcattttcaaggagagtttactaatagctagttgggcaactgaatgtgcatatagtggaggggaggatgtttaccaagaatgagtaagattattgctagatgtgatgttagccaagtcaagagaatcgaggtttctctttgctttgcatccttatcgtaggctgtataattgccacccagctttctggatttctgattgatttgggttattttaggacagcagtgatggtgtgttttacagtgatcaacacttccatcaagacacagctttatctgtatgtgcctacacagctctttaattgctaaaagcttacccttgcacacggttgtgtatataggaaattagactttctcagcttgtttgctttggtaattaatccaactctggaggtatctttatcaccccatagagcttcgagctctgagcacgctgattttggaagtgatgtaggagcagggagtgttctgggaagtgttccgggaagcgtgccagcaagaggccttcctttaggactgaccctgctcagcaccgaggcgcatgattggcccatcccgcaccacatccatggcagccactgactttcattttctttaaaacgatctctgccagaatggcctaaaaaacatttatcctgaacttcaatctagtcatatttttgttttctgagagggcactgtcaatcaggtggaattctagagggctgaaaaatgccatagctcttggaacgttccttccaaggagtaggcagcaggtgctctggggactgaagcccagctattcccctgccctcccttgccagctcttaaacatctttaaaaaaatctacagtgtaatgtggaaaattttactaccttcaaagggaaatgttgatttaaaaaattattttaaagttactctgtttgttggcaatgaggggaaccatatatggcaaaaggaaaaggtcttgataaaattgctctgtgttctttgttttgcttccttttgtcctcatatgcctgagtaactgcgtcctagtccagaagattgaccagggccatctgagtaacacctcccttccttcctactctcctactccacccatgaggatacacaggtagcataggcctcaaaggagggcagaggttcagcctctggagtcagcccctgctctgcattttttttttttttttttttttttttgagacagggtcttgctctgtcacccaggctggagtgcagtagtgcagtcttggctcactgcagcctcaacctcccaggctcaagagatcttcctgcctcagcctcctatgtaggtgggactacaggcacgtggcaccacacctggctaattttgtgatcttttatagagatgacatctcactgtgttgcctaggctggtctcaaacttctggcctcaagtgatctgcccaccttagcctcccaaagtgccaggattacaggcgtgagccaccacgcctggcctccctgctgtgttgttttcatcattgaccccgctggactgctacagcattttcctgtgatgaacttttccagtgggatgcacctgtgcatgacaattatgttgttaaattgctgaaagttaaagttataatactacatggtgaagcaaaatgctctatagctcctgcccgcccttatcttttccttttgagttaattagaggacagaaccacttattttgccttttctttatacttttaaataactactatgttttagatgaagacttgtagtctggtcaacgttaagtacctcctaagattcaggtactttgctagcttctgaggcacagaaaggggagagactttggggttagtgcaaataatgagttttttcatttttttctttttctttctttttttttttttttttttttttgagatggagtcttgctctgttgcccaggctggagtgcagtgacgcgatctcagctcactgcaagctctgcctcccaggttcatgcattctcctgcctcagcctcccgagtagctgggactacaggcacccgccaccatgcccggctaattttttgtatttttagcagagacggggtttcaccgtgttagccaggatggtctcaatctcctgacctcgtgatcggcccgcctcggcctcccaaagtgctgggattacaggcgtgagccacctcgctggccttttcatttttttctaatacagttaactttcctaaagtgttgattgattgatttaacaaggatttactgagtacctattgtatttcagacactattccaagtgttggagagatagtagtaaacaaaacagataaaaatccttgtccttatgaagcatgtctctagtggagagagaccagaaacaaacaaaatgcatatatcagcaggttcgtcgaataaaaagcaaagaggttggggattgttagcggggattgcaatttgaagtaaggtgattaggaagggcttcactaggaacattgagcaaaggtttggaggaggtgagctaagtggatatctggggaaagagcattccaggcagcaggaaaagcaagtgcagaggccctgtggtggaagtttgcttgcagtgctcaggcaatagcaggtgggccaggtgcctgctggaatgggaagtcagagagttaactgaggggtgggagacggtgcgggtgtgtatagcccaaggcattgcaggccatcataaggttctcactctgaatgacactgagccattggagagtttgagcagaagaatgatatgatctgaaggatgtcttaacaggaccactctggctgctgggctgagaataggctgttgggcaaaggtggatttggagatactggcaagagataatgatgaccaggactccttattagaaggaaggacccttgggagtcatatgcttaggaaattcagaatgatgcttttgtaatttttccccaacctattccttttgaggaggaaagtggataaagatgtatttctcacatcagtggaatactgtgccatagcctaatattaaagataattacatctatagaactgaaaaagctgagtcttaaaacacaaaacaacctccccaaaccatctaaagaaaatctctttgtgttgtgaatgaatgtccttgaaaaatcatcgtcttaatagcctaaaccctcttttccttgcttacttaccctcctgatttccaagtcttgttcttttcatttctcagggggcctggttttcaggatcatgagttttgagggtcttaccaccttttgcagaagtgcttcttacagtgttgtaaattacagtttcgaagaaatacagttgcatccagttttacatagtaaatgtttctgagttgtaggtcaacctatttttataagttaaactacatattaaatgtgagcaaggagcatgatacagcagatttttttctataaagaaaataatcacttttaaatatattttataataaggatattcatagtggttttgccagaggtgagtggttttgccagaggtggaatataccatcttgtttatggaataggaagttttgcttttggagtttgaggttataaacaaatattaggccagtgctttcttatatgcatgagaatcacccagggatcttgttaaaatgcagattctgttttagtaggccttgatgggtcaaagactgtagatttttaacaggctcataagatgctgataccgttagtctgaggaccacatttgacagcataggtcatctgttttctcaatgcacaaattgtaacacagaaactgcaaacacctagacaatttcttagtgccataaaagggagcttgattttagcatgcctttacaacagctaccttgaacacctttggtaaacttgtttgggtcagagggatccatgtgctggagaggaaattggtttgaggcagtgagttccacagatgcctttagctctctgactgtaagtgtggtgcacctgcagaaaccaggtgcatctttattagctggggctacaccttgacataatcctaacagttgttaaagaaggaattcttcccgcccccaccatttcttccttttatgtgcctcttttgccttgtctcatttcttgccttgtgacttagtagaccaaggtaggagattcgtgttgggtcactgagggcggggtcattggtcccggaacctgtggccaagggactcttcggtaatgagaggtgatatgggctgagtggataaaagggggactttaggtgggttagcgagggtggctctggagttagggactaaaagttaaaagttgggtatacctcatttctgctagcagggctctaattttctagctcaggtttccccattgacttcctactttattctttttttttttttttttttgagatggagttttgctcttgttgcccaggctggagtgcaatggcgtgatctcggctcactgcaacctccgcctactgggttcaagcgattctcctgcctcagcctcccgagtagctgggattacaggcatgcactaccacgcctggctaattttgtatttttagtaggaatggggtttctccatgttgctcaggctggtctcgaactcccaacctcaggtgatctgcctgcctcatcctcccaaagtgctgggattacaggcatgagccaccgcgcccggccctactttattcttataatcacactccagtctagagcttttaaaaaattaacattttttagaagggaaaaatttctgtaagttgtaattgatgtttattaagcaccctgacaccacatttattataagtggggataagactgagaatatttaagctctgtgcctgaaaagttgtgttttaaactaacttttatttgtttacactgccattgagtagtttataaggttttctgatttgctttctctggcctcatcactgtttttggagaggcagcgtacaacctatgtacagctctggagctcgccgcaagactcaggtggtggtcattctgcttttgaaattgaaccagaaaagtcctgaggaatgtaacaatattttttctttttgcccccctgctagcttttttctagccctcccaaaaatgtgtttatgttgctgtccatgcatgtggagcagtctggaattctgtgtgacattagatagtgaaaaaaatagatttcccacgtgactgaggttataggagtgagaaatcttggattatgcaaggactctttgattggaagaaggacattttgagatgagatttattttaagatatagtaaaaaaaaacctagtatacaactttttgtttttttctaaactaacccttttcgggggtgacaggatggggtgtggactagaagcaataccaaacttttaagtatcaaatcttcactcagaagaaaaaaaatgtcttcagggtgaaagaatagctcaaatgcgaaaagcctgatagttatataatttgagagtagggtctggcatattatagaggactccgagagcctgatccaagcagcctgccattttcatcaccccaggattatctgtaaggacaactttactgtctgtcacctgccaggtctcagcctggcccttgtgagtgccaggaagtttgtgtcctctgttttgccaagcttaattagctctagaaataccctatcaaaggctgtctggcagtgttccattaatggtatggggtgaattcaaaagcactaattaattgttagattatttgcaaagcccatgctgaaaaacctaatgcctgcaggagaaagttggcagagagacggtacagagattagcttggaccttacccggctcaattgcgttttggaattgggccaagaggggagttgcttttctttttggagaagtgcttgtggctatattgttttctaaactgccagtgtactgctctaggctctccgtgagggagctcatatggacacttgcagacctagagagcccagagaccatcttcaagaggttttgtttatttttgttttgtgagagaaacacaattgtttaactttcattaactaaataaattcttcgcaagggcctcttcttaaatagaggaaaaggaactctagtttgtagtgtaacaattcaggttttaagtgttaaatgttcaaaggagccaggatcagggctttaaatagttttttcttcttaaaataaaacaagtcaggttcctcatgtcctctgtttaggtggcccaggtcagcaaaaagtgaattttccaactgctactgcagttggaagatgctgtttaaaaaaatcttcatttgaaatcaagtgcatgccaatttaaggtcagggtatactacatgcaggaaaggaagaaacaggtaaacaggtttgcattattttgctacatttgacatatagaatgataacacctataattaactcagcttgacaaattgtagacaaataatagaagtccctgtcccttatagatgagagagatttgaggcttttggagccaagtgccagtttctgttgactctgaaggcaacggagacagctgaagatcaaagtatagaaggatatttcagacttatctaaaagccaattgagtgttatataagggagctgtgtgtagctctgtttgaaaacatccatccagtaatcttccagttcctgagcctggccctgcctcctgttgacaggcctcagcgtctttttcttgtccttttgggcttgagcaacatgtgagtaagtacttatgtacaaatcccagaccaaatcttactttattaacatgattcagaagaaaagaattctaatgaaaaatttcagaggactgtgccgaaacatttcgtgatgttgtcagatctccctgaactcaggaaaggcccccaaaaatctattatttctgtttattactcaacttggaaaaagcttacaagaatgcctcaggagagtatgcactggttgaggaatttattcctgggtgtacagcatcccctacgtttactctgtgtgaggcgggctatcctgaaaccctgggcaacctgcctgctcctcagccagcaggtctagagtagcagcttagtatttttaaccctttctgtcatatgactcccagccaactttttgagttgatagaaacacagatctgagagctatgaggaattatgaaagcctttgtactgacaaaagactatgatttttctttgctgctttattatggttaaaaggtctcattatgcttttattttggagaggtaattctgtataacaagacctacttgtatatcccagttaggttgtgagatatcatgaataacattacaactgatagttaaattgaagactttaaatgattttcctcaaaaagataaaactaaattcaaggttattctaaaataagtatggttatttgcatttaaaaatatttcaaagggagaaagagaagttaggattacaagtgatagaatgaaaagtgctcataatttgttgcctgtagtatctgttttgctattcatgaacatggtacacccattcatttgtttaggttttccttaatttctttcagcactgcttttgtagttttcactagtttcttttgaagactctagtgtgtccaaatgtgaacaagattcatcatgtctgtcttattagaattatgtttaagaacctctgttttagagctgtaatgctatcctcttcaatctactcttcattaataatgatgaaaactgatactccctctgactttcctggagagtgagctcaggggtgtgtaactaaggctattgctaaagtgagttatcggcctggctgcctttgctctaagttgtaggaactcaaagctcagtgtgtactgtgagatatgttctttaaggctgaaggctagtgttgctgagcaagagatgtagtaaaatgaatatccttgttcctttggactaaatgtcagagttagaggcagtcttggaacccaaagattggatgttgtgcctttccatcaggccgttgggctttcccagcagagtttcgctggaacagagtcactccagtgaactttcattttggacttgtaacaaaaggattttgtagagattttaccctctgaatgtgggtaatacctgagggctttatcaagatgaagagtaactttgttgggttgctgcacctttatttagggaaagtaattctccaccacagtgtcaagagtggtcttgacagagacatatgaaaggtcagagagtcaggatcgtgcactagttgtgaccttgggttttggattcaggcacacaggttcaggtccagatcataggctgtgtgaccacaggctcagtgtcctcatttgtaaaattgaagtatcagtagttcctgtctcagttgtgttcttgtgaggattataaatgagataatgcatataaaccagaggatcacgtttattatgaatgaaactactggaaatagtattctttgaaaatgttaccatagtacttacctagtttggactgctataacaaagtcacatataagtcacacatagattgtatgtcttataaacaacagaaatgtatttttctcacagtgctggaggctgtaagtctgtgatcaagatgccagcatggttaggttctggaaagggccttttccaaattgcagactgatgacttttcattgtatcctcacatggatacagtcctcaaaaagacaaactagagagttctctggagtctcttttaagacactcataccattcatgagagcgctgtcctcatgacctaattgctccacctgttagcgtgccccatctcccaataccatcacactggggttaggattttaacatacaaattttaggggggtacacattcagtccgtaacacatggtggacatatttaatcagtcttttaagttgcagttctattattcaggcatatttttggtacaaaaattagatctgatcctgaaatataatgttgctgttaaacagactttattgatgcccagtttctttattttccgtaagttttacttagagcagtacagtggaaataccacagtggtacaatgggagtgatggagttgggagagggtgtggataagaagtgctctccctgccccccaactttttgttttgttttgttttggagatttgagtcccagttttgtggtttgcagagcttttgttgccttatctatacaatactgctaattatacctattcctttgatttgatgaggataaaatacttgtaaagcagccagaagtttatggcacatagtagttaggtcttcaaaaagttaatctttatttagacaatatatatgtgtaggaaaagagggggagagagagctagaacaaccttatgatgggcagaatgcatttgctgtttagctttgtgctcccaatggagaaaaagcaggttggggaatgtccttgggagatggctgaggagctgttggctgagccaggtggatttgaactgagcacctggatggaaaagaccttgttttcttttgaggcagtgacttggtctttaactggaagttacagggtaaagatgaatgctcaagaacggtggcggtgctgaggatcaggaccagtgggggacaggagaacccaagtgaagtggattgaggctgtgtattggtagttttcctcatctatatggtacctctaggctcagtcccagtctaaccaccctacttaaaattgtaatccctctctaaccacagaaactcctattccttcttatcttgctctgtttttcctcgtagcacttctcacctcaaaagctgcttgtaatttacttatgtttattatttatcttcccccactaaaatgtaagctccgtgagagtcaagttagttttgcttttgctctggtgcagctttttcttttttcttttctttctttctttctttttttttttggcagagtcttgctctgtcacccaggctggagtgcaggggcacatttcttggctgactgcaaccttcggctcccagtctcaagtgatcctcttaccttagcctctcaagtagctggggccacaggtgcacaccaccatgcttggctaattttttgtattttttggtagagacggggttttgctctgttgcccaggctggtctcgaactcctgaactcaagcaatccacctgcctcccaaagtgttgtgattacaggtgtgagccactccacccggcctaaaactactttttttttttttttttttgagatggagtcttgctctgttgcccaggctggagtgcagtggcgtgatctcagctcacagcaaccttcgcctcccaggttcaagtgattctcctgcctcaacctcctgagtagctgggattacaggcccacaccaccactcctggctaattttttgtatttttagcagagatggggtttcaccatgttggtcaggctggtcttgaactcctgacctcgtgatctgcccgccttggcctcccaaagtgctgggattacaggtgtaagccactgcgcctggccaactatttttacaataattccaagattgggttaacactgctctaattgtataagagcaatattggataaaactgctggtgactcagcaggaatgaaggcagtacttcactggcacacacttgcagtaaaacatctgccactttcctttaagagtgttgttaccctcagatacatgttttttccttattctatatggtaaaatgggaggtacgtatgttgcatttctgcattccaaagtacaatgattttcttgaggaaaagcactgtgcagttgtttgagttgtgagctgatctggtctgtttttcatggaacaccatttgatgtgaaagagtgactgacagacaactgatggttatccagacttcagtatttggcagacatttttgaaaatgaacaaagtgagccgggcgcgggggctcacacctgtaatcccagcactttgggaggccaaggtgggccgatcacctgaggtccggagttcaagaccagcctggccaacatggtgaaacccagtctctactaaaaatacaaaaattagctgggtgtggtggcatgcacctgtagtctcagctactcaggaggctgaggcaggagaattgcttgaaccctggaggtggaggttgcagtgaactgagatggtgccattgcactccagcctgggcaacaagagtgaaactccatttcaaaaaaaaaaagaaaatgaacaaagtgaacctgttagttcaaggaaaacaacagtatttgttgccaataataaaatttcgtttttcacacaagttaaaattttggaaaacttacatccattaccatgattatgacagtttctcaatggttaaatacttttctgatgaaatcagttgagatattaacaaatgtgatttttaaaatattatataatgaaatatgtcttatttggcagtaaaccattattttccagatgaccaatgcatgatattacaaaatcatgcatgatattacaaaatcatgcatgatattacaaaatcatgcatgatattacaaaatcatgcatgatattacaaaatcatgcatgatattacaaaatcatgcatgatattacaaaatcatgcatgatattacaaaatcatgcatgatattacaaaatcatgcattggtaaaatattccacatcttgagagtacaagatagaacaattgattttttttttttttttgacagagtcttgctctgttgcccaggctggaatgcagtggcatggtctcggctcactgcaaactctgcctcccaggctcaagtgattctcctgcctcaggctcccaggaagctgggacttcaggtgcacgccaccatacccagttaatttttgtatttttttttttttttaaagtagagatgggatttcatcatgttggccaggctggtctggaactcttgacctcaggtgatccacctgcctgagcctcccaaagtgctgggattacaggcgtgagccaccgtgcctggccagagcaagtgatttttaaaaactttttattttgagataatttttgactgacagaagggttgcataagtagtacagcgtttctttaggcttatcactcagctttaccttatgaggacatcttacataaccaaagtacaatgatcaaaactaagaaattaatcttgttacaatattattaactaaagtataatatttattaggatttcaccagtttttctactaatgttctttttctggtccagaatccaacccaggatctcacattgcatttagtcgccttgtctccttagcctcctccaggctgacagttccctggtctttcaatgaccttgacgctttgggaactactggagaatgtccctcaattaatttttttcctgacattctctcaggattacattgaggttatgtgtcatttggaagaataccatagaggtgatgtcctcttttcagggcatcaaatcgaggatatgttatgttgataggaattattactagtgacgttaatcttggtcacttggctagagtgatgtctgccagaattctctggtgtaaaggtactatttttcactttgaaattacgcagtattttggggaaagcaaaggattttaatgttacggagtatgaaaaatttattatgtaattcagatgctaccttgcaactaaacttaagaaatgattatttgttgagtttaggtgtaatagtaaagaagaaataaccacaagtatataaaaagacttaagatttggctgggtgtggtggctcacacttgtaaattccagtactttcacggggtgaggtgggaagattgtttgagcccaggagtttgagaccaggctggtcaacacagcgagaccgtgtctctacgaaaaactaaaacattagccaggaatggtggtgtgtgcctgtggtcccagctgctcaggaggctgaggtgagaggatctcttgagcccggaaggtcaggactgcagtgagccatgttcatgccactgcactctagcctgggtgacagagtgagaccctgtctcaaaaacaaacaaacaaacataaaaaaacttaagatttgaaacttccaactgcatatactgtatctgtgtgaggccagatttcttcatatccttcaaccagaacaatgtattgcaaaaaattgaatgcaaaagtagatgggaaaacccagtggtcttgtattaagccagacatttaaagagatttgctgtgcatgtgtctttgaaatttaacaagaaaagagatttgcggccgggcgcggtggctcacgcctgtaatcccagcactttgggaggcagaggcgggtggatcatgaggtcaggagatcaagaccatcctggctaacgcggtgaaaccctgtctctactaaaaaatacaaaaaaaaaaaaaaaattagtcgggcgtgatgacgggtgcctgtagtcccagctacttgggaggctgaggcaggagaatggtgtgaacccgggaggcagagcttgcagtgcgccgagttcgccccactgcactccagcctgggcgacagggcgagactccgtctcaaaaaaaaaaaaaaaaaagagatttccaaaaatgtaaaacagtgctgctcatctcaccttacattttgttttagaaagtagttgtttttcatgaaagatactgtttatgttacagtttattatagttggtttttagtgaattaataaatatttaaaaatttcctcagttttaatttctattgcagaaaatgttaatagacttatattaacaaaatctctttggagtcctcagtaattttaaagcaataaagggatcctaacaacaaaaagtttcagaattgctttttttctgaataatacagaagagatatcttagtaggggaatcttttcttctggaccaaataaagatttaatgaaggactccaccaaggactcttggtccttgcagggaagtcactcaattatcagtgtactcagctggcagatgagggggattgccttgtactatctccaagtttctttaaaccccaaactacatgatttcaaatcactatcattgtcagcatgggcattatgcagcaatctcccgagtatgctatttgctaggttaaagatgaaggttatatgtaaggatataatgcagtagtatttgtgaagcagggactccagggacttttctttttgggcctgtaaaattatttctttcactgctcctttaaaagaatagaagttttcatgattattagattttactgtaatgagcaagggaaagatttttaattattgctgaaaatttttgtcaatttatgtatatcacaaatttaaaaatgcatgatttctgagaatttttctgctctaatgtatatgtgtaaacttatgtgaatatttgtaagtatttacataaatcatttaaatttgttaatgggttctaaatataccactgatgtctctgttgaagtagactcgggttgcatatccattatatccttacttaccagccgggcatggtggctcacacatgtaatcccagcactttgagaggctgaagtggatcatgaggtcaggagtttgagaccagcctggccaacatggtgaaaccccgtctctactgaaaatacaaaaattagccaggcgtgatggtgcatgcctgtaatcccagctacttgggaggctgaggcaggagaattgcttgaacccacgaggtggaggctgcagtgagccgagatcatgccactgcactccagcctgggcgacagacagagcaagactctatcttggaaaattaaataaataaataaataaataaataaataatatccttacttatagtcttcatgaagttaatttgttattttggttctttggttttaaaaaaaattattaggtctgtatttacaaatacagacttaaaaatgtaccagctagaatctattaagaatccccaactttggaactaacatttttcttttttagtttaaatgaaaggcaatttgatggcttagttttttaaaatggggaaacaaaagggaggggaagccagtagtatcttgttgtgttaagtatcagtttaaatcaaatgttaaacaggatcctgcattcttgtaaagtgaatttagtaatggaaactgccacagtggagggccagctctgtcataatcaccaacttgagcatctctgatatttagcagaaatataaatatctaatgcagcgtgtatgtgttatactgtcatggcaaaatgttgtaactgattttgagccagattcttccagtgttttgaagctactgcttggaaataagatttggaagctgaactaacttctacaatttggtaaactatagtaaagttaactcagcatatattataaatacaatagaaatatataattatatataaaaaagtttcatcaaatttcaaaggtttaagtactattttaggatattcatagaacccaatctaagaggaaaatgctcctcactgccagcaggagaacttaatggagcgcagcgttttagagcatagacgttaagagccagctgcctgggtgcatatcccacggctgccactgagtagctgtgtaacctcggtttgcttcagtgtactcctctgtaaaatggagataatatccatctccctgggttgttttgaagatctaacgagatactgtgtttcaagtgctctgttgttccattattgtttagttagcaattgttaagttttaggttatttcttcatgacatctgaattttttttaaaatttatttatttgtttattttccttgagatggagttttgctcttgttgcccaggctggagtgcaatggtgcaatctcggctcaccgcaacctctgcctcccaggttcaaacgattctccagcctcagcctcctgagtagctgggattacaggcatgcaccaccacgcctggctaattttgtatttttagtagagatagggtttctccaagttagtcaggctggtctcgaactcccgacctcaggtgatccgcccaccttggcctcccagagtgctgggattacgggcatgaaccacggccgacatctgaatttttatctcattaacaacatatatcctcaagtaatgttttagggtaagttacatctgggaagatttggtattcatagggcatggtagagttctagtggtatgttggctttttttttttttttttttttttttttgaggtggagtctcgctctgtcacccagactggagtacagtggcacaatctcggctcactgcaagctccgccttccgggttcacgtcattgtcctgcctcagcctccccagtagctgggactacaggcatccgccaccacgcccggctaattttttgtatttttagtagagacggggtttcaccgtgttagccaggatggtctcgatctcctgacctcatgatctgcccacctcagcctcccaaagtgctgggattagaggtgtgagcaccacgcctggcctgtgttggcattttaagaatccttggagattatctggtcaaactcagcctgatatgtaaactacctttctaatatcctgttgactaagcccccaacctttacttgaatttaaaacatccctgactcttgggaaattcttccttgtgttgtgctacagttcatctggctgtaacctcctctcccagcccttacttcttccttgtagagctacatagaatttttgtctaacaaataacccatctgaatggtgacagtgaagcaaatgaattctggacaatttaagtgttgtataaaagtggccggatggtgtgtgtcaaagttgagggagctcagaggactttgctccctgttggtaaaagaagcaaggctcagatttgtggttagagctatcctgatctagttgggaacacttttgcctcattgagcctatgatggggctgtgagccagacaggggataggcagtggctgggtctctgggccccccacttgcataaagcacccccatccattgctatacttgtcctttcctggaggaggagcttctttgtgccttaaaaattatctcaccgccaggcacagtgactcacacctgtaatcccagcactttgggaggctgaggcaggtggatcaccggaggtcaggagtttgagaccagcctggccaacatggcaaaaccctgactctactaaaaatgcaaaaaattagctgggtgtggtggcaggcgcctgtaatctcaactactagggaggctgaggcaggagaatggcttgaacccaggaggcggaggctgcagtgagccaagattgcgccattgcactgcagcctgggcaacagagcaagactctgtcttaaaaaccaaaccaaaccaaaacaaactccatctcacgtatttgttcattgtctatttctcctcctgcatagaatggaagctccatgaaagcagaggagaaactgcttatcttgttcgctgctgtttctcgagtagccacaagaacttggcactttaggtagtaggtgttcggtattcaaatgatggaattaaagatcaactctgaactctcaaaggcagatagattttcactttagtgcaggaaaataaacactcatatgtcatgcccattcttcaggcctgaaccaaaggggaacctgtcagaggataggaaatgagatctcagcagcgtctgttactatttgcaattttcaaatacataaagagaaaagtatcttttgtctttttgatatgtgaagattttctagaaaggagaggtttcaactcttattgaaggcgggagacaccatgctatcagaattggattttaaaatcagcccagctggatagtagcttcaaactgcagccagcatgatgtgttacatgagtttagctttgagtgttaaaagaacaagtttgccagaaacatgaattgttaaaaaaccatgaaaacattacaatgtaggaaaaaaatgtagtgaaaattccagtatataatgtccaaatagttcctttttctggaggctttaaacattttcttaggtaatttgcaaagaatattggacaatgtagaaaatatgtgtagagttaaaatgatattgagaattctgagcagatgattaaggaaatctggacctccttttttctttgtttctttctttctttaatatgttagtacttgagttttccatagaattaggacatatatttaggtcagatctcactgggatattccttgggatatcttgattcagggttttcttccttttttttttttgagatgaagtctcactctgtcacccaggctggactgcagtagcaccatcttggctcactgaaacctccgcctcctgggctcaagcaattctcctgcctcaaggcctcccaagtagctggaattacaggtgtgtgccaccgcacccagccaattttttttttaatttttatttttagtagatgtggggtttcaccatattggccaggctggtcttgaacccctgatctcaaatgatccacctgtctcagcctcccaaagtgctgggattataggcgtaagccaccgtgcctggcctttttttttttttttttttttttgagacagagctttgctctgtcgcccagggtggagtgcagtggtgtgatcttggctcactgcaacctccgcctcctgggttcaagtgattcttctgcctcagtctccctagtagctggtattacaggcgtgggttaccaggcctgttttttttttttttttttttttttgagtcggagtctcctactgtcgcctgggctggagtgcaatggagtgatctcggctcactgcaacctccgcctcctgggttcaagcgattcttctgcctcagccttccaagtagctgggattacaggctcccgccaccaagactggttaattttttgtatttttagtagagacggggtttcgctatgttggccaggtcagtctcaaactcctgaccctgtgatccacctgccttggcctcccaaagtgctgggattataggccactgcacctggcttttttttttttttgagacagattcttgctctgtggcccagggtggagtgtagtggtgtgatctgggctcactgcaacctccacctcccgggttcaagtgattctcctgcatcagtctcctgagtagctggaattacaggcatgtaccatttttatatttttatataatttttgtatttttaatagagacagggtttcgccatgttggccaggctggtcttgaactcctggcctcatgtgatccgcctgcctcggcctcccaaagtgctgggattacaggtgtgagccaccatgcgtgaccccgattcagagttttctctgagaagaaactcccttcgattttggaacccaggaggctggactgccttctagtctaggttctaccttccccctgctgtctggtttggcttaatcacttgattcaataattttatgactttgagtgagttacttaatatcactctaccttagttctttcatctgtaaagtgcggccaataatagtgtatctcaaggttgttgtgaggaataaacatgttaatacatgtcaaatgcttagaagagacccttgcacaatagtaaacactccatagataataatgttattattagccaaatgtggttattttgagggtcatataatggggaaaaaaatgcaaatttaaaattcctgtacaaattcaaaggaatatcgattgtctctgtatatcaaagatgaccttagtatttgcaaagctctctctcatttagggccactagctgtttttccatttacacttccctatacaggatatagagttaatttctaggaaattagccattaattattggttaatgatggactaggaatgctctcaggagagctgactagttagaacatgacataactttgaattatctaagctttacctttacgtggaattttaactttgttgaatttttaagtaaagggatataaaagccagtctgctctattattagattcactgtgttcataaggcaacatggaaaaaaatagataatacagaaagaaaaatgacaattttaaggagaaaagtttttgtttttaaataattttctatgttaattaaattccatggatgttttgttattactttgtctctacagagaatgcagcagattttgaacatgcttttttccctctgcttaaaatgtgttggctattatatttcacaggacttacgtcgttttcaaaaatagaggtaattaattgttacgtgttttgatgttcagcaggcaaaggaaacacattactttgtgtaaacagaggttaatatggagtctttgaagtctaaattattgaactatttgcctaaggacaaacttcttaactgtttaggtttcttctggcctgtaataaactacagtggtggaaataacacaaaaaatcctgtgtataaaacatttgggtcctggttgcgtgtttgacccaaatctgcaggtttacctttgagttacactgcgaattagggacctttcatttccattttcctttccttgtagtggtttagttggttcatggttgataaagacagaagcatatgtttctgggaatggtaaaccttaattttgcttaagttttaaatgatcacttatttctggaactggcactggggtcgaagaatgtttattattccatgttaacatgggaatgagtctaaagactaagtgacgtttatgctcacttctattttacagcttccttgggctctagccaaggtgacttggttttgcaagagcgaagaggacctgccttatagtgcagtttttttttttaaattgtttttgtctgaaatgatctaccttgaggacagaagctgtactttgcagagtaaaagacaaactattactggttttaacaaatgaacaacccaggcaggtgggcatggtgcaggttgtgccccagcttgtgaggtctagcagatcttgtggcctttggacaggcttgccttggggaggtggaaacacaatggtgatgatttctaacttgaagagacctttgggactccagtccagaagtttttacctgtgtgtactgggtgggaggcgtgttgtgcttcctgctatgggggtggtgagagccgtttcccacctaagtgggacagggagaaagcgtctgatcggcacacagggtgcagaagcagcactggcccaactccacactcacttttccaggatcattccttttgcaccaagctctgaccctgtgccctctcactgctctggggactgttgaagccacaaggaggaagttgctactccttatgcccttcattcttcctgtgccccagaccgagatctgtcaggggtggggtattggaccccacctgaaatcacttgtgtatctggcagctttcttgggagtttctcctcagggggcagactcccatataaagtactggctggtatgactgcagctcccgttgacccactcactgttcacagaagcctaggaacagactgtagaacccagagaaagctctgggtgacctctgttatttagcagctgcttgcagcaccagtcactgtggcaactgggctttgtttatgaaaatgaatgaggacctcaagcctggggcatccataccgtggacagagctccccctggaaatcgactgcctgccagattgccagggctaaaccaaaacaaagacataccaaacacaagtagccaggaagtattctgcccttggggacgagcaccaagtcccgattgcctgtatccctcttcaccaagcataaccctgccaggctgagctgatcttggttatgccagagaaagacagaggcaaagaacatggtactagtattggcagtttttggaacacagccttgtattgctcaggtctggcctctagttctggttttagatggaaagagtgttgagtaccaaagatctagctttttgaaaattttatttcaggccctgcctttatgtaaactgtaacgatcatttgggtctgtactcaagaggcaggagaatcacttgagcccaggagttctgggctgttgtagtgcactatgccaatcaggtgtctgcactaagttcagcgtcagtgtggtgacttccctggggactcccaggggactgccagattgcctaaggagagatgaactggccaggtcagaaatggagcaggtcgaaactcccatcctgatcagtagtgggattgtgcctatgaatagacactgtattccagcctgggcaatatagcaagatcctgtctctaaacaaaataaaacaaaacaaaaaaaaaccccttgtctggaacaactgagtttggagtttgttgtccccttagagtccttgctttcatagtgattgttttcttgtgtccaaagcatccttggtagttttaactctccatgggaattggtgagccatggacatcatcttggagcacactttgaatctcagagcttcctttgaggggactgctatgttctgggtgcttctggtattcacaggttctatgattctatggctggacccttctagcatatgtgccctttggtgtcactttgtcagaaccacagccagtgcatgggtcttctgatgccatcctgtggctctcttccccacaccatgccttgtttttttttttttgtttgtttgtttttttgaagaccttcgagtctcgctctgttgctcaggctagagtgcagtggggcaatctcagctcactgcaacctctgcctcctgggttcaagtgattcttgtgcctcagccttatgagtagctgggattacaggtgcgtgccaccacacctggctaatatttgtatttttagaagagacggggtttcaccatgctctccaggctggtcttgaactcctgacctcaagtgatctgcccacctcaccctcccacagtgctgggattacaggtgtgagccatcgtgcccagccacactgtgccttgttactgcatgtctgcttgggtcatggcccaggtgtcatggtggagggggcggggttgggaggtagagagtgctggcattggtgatttgccagcaggacacatgcccaggaagatggtcagaaaaagagggactccttcacgtacgtataagtcagctttagccttaaagcttcaaacacccactcactgcattgaggagtccttgaggtccctcacctgctcttcctggtctgactagatgccagggaattgggagagagggacctgcagtgggagggtcctggaactgcagtgacagtaatacgggcttaaactagaattccttcctggaagaatttcggtcttcctctaccccagcagcctttcactccttaactttagtagtgtgccttggggcttgagcagctgctgcttctgtggaggtgaccatccagagggaccctttcacagctaagttcacttgcacctccgtttctgcttaaggcaactacagtttcgggggtggctgcccctgtttgctcatgataattccttatgaactctcctgttgataaactgaactggatcagctttagtttccctttaactaaggatttaagtcaaagcgtaaccacaagtgtcctgttcgttttcattcatttcagtgctgaacatttatacactgggctatggatttgatgtttccttcctgtcttggctgagatacctgtgtgaaatatgagtttgccatttggcaaactctttttcctttgactagttaatgaagccaaaatattgacgggggtgtggagttaggggaagaggaggtgtgcatggttacatttgaaagttcttcatggtgcaggagaatccagtgcttcaccctgagtaattgtaattagggtagtaagtaaaccctttcaggtttattctatagcgatcatgacgagttatcttggggaagggataaagaagactgtgagaggttgtacagttctgatcctgtcaggctttgagaagcagacctcagcgtgatctgaagagccggtaccctggagtagatgattaaccaagataatgttccggacagtctgcagctgaactgaactggtgtctctgcatccattcatagttacccagtgtggttaataacaagtccgttgggagttatgcctgtgctggccataactaccttgtattctggatgggggtcagagaaactgaatggatcgattcattcactgagcagtgagtgactgcagccttactgaagccagctcctttccagctctttgatgacatgcactattattgttgttaacaggttggctaaaaaagtaaacctgggagagttgaggctttgttcctctgtccagcactcagatatttcctgtagtcattcagtaaacatttaccaagtgcttactgtgtgccagggactgtgttatcataaccagtaactttttcttcgttaatgaattatctcatgcggcgtgcatacaaagaagccttaagaagtggaggataatgggggcctgtctctccctgctcatcctttggggctgtcacatcacggaaaggaagtaacagtcaacttaaatcagtttactttggtaatagcagtttttgaaaaggtttggagcaggaaattgaaactcttgagaaacaggaggtttggggattactgctggatttttcttattcctgctatcccaaggacttgatcccagttaccactgataatggaccccttttatgtttaactgtcttgtcagtaagtcagtgacacatgctgagaatagaaaccagtaccattccatgtcgtaaccgccagcctgtacacgccccgctggttctgttgttgtgatcgttgctacagcgcttaacatcaaacgccagcctcatgcctggcactttacatcacacctacggcgtccccaccccgggagcttaccttccctagaagtccaggacattttctatgttggcaccacaggaataggtagagggcaagggacagaaagttttcgtcagtaaaatgtggtcttttcttgaatcaataaaggcaactatgttcatctgttttaataggaaaggcctgtaggtaattttttttctccgttaaaatctgcttttaaaaatgtttggggttgagtgtaacaacagattgataactctctgttcatcgcttttccgttcttgcaaaatatgtgacttgcagtggttgactaagtgctaggctctgacgggaagaaatgagacccgtggaactcctggccccctgctctgtaggtgcctccagaccagggaggggagacaggcatcaggtggcatggccaggccttttttttttttttttaatagtggatgggagaaaatgggaatatgactaattttatttaatacttaggttgttttgtctgtttgctttactggcatagggtcatcttcagctgaagaaggatgtgctggtgcttaggaatggctgtcaggagccatcggtttgctccttcaaacaggaagggcaatgctggcttcagctaagagcgagagagcttctttccccagacacccagtatgtctctctttgcaatcattggctgaattgactcagcttttcctcccatccttgaatcagtccctggtagagtaatggagttacagtgattggcttaggacagtcagctggagaatcagtcacaccactcaccacagcggcctcctactaaatataaatgtgagcgggacttaaaatagaagaaatgcacatctaacaggaccataacttagggataaggtactggacaaggtaatgaagaggcgatcatggcccttgtttgtgtttcctccgttccctcggcagccttctaggggaccctctaatgtgctacctcactgtgtacctgtctctctatcctgactccacctgtcactctctctcgactctgggagtatagctgcttaaggccaaggcactctgtcttactatttgtggccactgtagctggcacatagcagggacttaatatgggtttcagcaaattgaacgaaaaaggatacttcgtattcctttgtgtttaacttttatcaaacattgcttgaatcaagtggattttttttttttttgagacggggtctcactctcacccaggctagagtgcaatggcactatctgggctcactgcaacctctgcctcctgggttcaagggattgttctgcctcagcctcccgaagagctgggactgcaggcacccaccaccacgcctggctaatttttgtatttctagtagagatggggtttcaccatgttggccaggctggtttcaaactcctgacctcaggtgatccacccgccttggcctcccaaagtgctaggattacaggcgtgagccactgaacctaaccacaagtggactattgatagtatattcattgcacattttataacaagtttattgagatataatacacataccatgcaattcacctctttaaagtgtacaatcatttttaatatgttatcagagtcgtgcagctgccaccacagtcaattttagaacattttaatcatcctccaaaaaacctctttatccattggcaatctctccctattcttccctttccccaggccctagtaactactaatctattttctgtttctatggatttgcctattctggacattctgtagaaatggagtcatgccatatgtggccttttgtgaccaatttctttcacttagcatgttttcaaggttcatccatgttgcagcatgtatttggtatttcattcctttttatggccaagtaatattttgttttatgtatataccacattaaaaaattcatcatcagttaatgaacgtttgcattgtttcctgtctggggatatgaggaataatgttgttatgggcattcatatacatgcaagtttttgtgtgggcttatgttttttcccttttttctgggaagtatggctttggccaaggccagagtcaagcacatccttatgtttttatttctcttgtatttatatgtgtctgagagtagaatcgctgggtcatatggttactctgtgtttaaccctttgaagaactgccaaactctttttcaaagtggttgcattattattgttattattttttgagacggagtcttgctctgtcacccaggcaggagtgcagtagtgcgatcttggctcactgcagcctccgcctcccatgttcaagcgattctcctacctcagcctcccaagtagctgggattacaggtgcctgccaccatgctcggctaatatttgtatttttagtagagatggggtttcatcatcttggccaggctggtctcgaactcgtgacctcgtgatccacctgcctcggcctctcaaagtgctgggattacaggtgtgagctactgcgcctggcctgttgtattattttatactcccagcaacaatatatgagggttctagtttctccacatgcttgcaaaccttattattatctgtcattttgaattagtcatcctagtgggtgtgtaatggtatctcaatggatgttcatcaatgaaaataaacatttgaatgggcacccatggcatgtcagatgctctttcttaggtgtgggggcaaagagatttgcaaccttcggctgtctgtctctctggcctcatctgttttcacatctttcctcttgatttatgttccctaaataccaaactgtttgtagtcctcatactatcatgtcatttcttacttccagatctttgcctataatctaaatattaatgcagtgtgaatattaatgccattactagttaactcttaaacagccaataaattatagagctggcagtctggctccagagtctgtgttctgtactacatactctttttttcttttaaaatcaactttatatcgaagtataatttatatagattaaaatgtacactttatttatttatatatttatttttgagacagggtgttgctctgttacacaggctggagtgcagtggtacagtctcggctcactgcaccctcaacctcccaggctcaggtgatcctcctacctcagccttctgagtcactggtactacaggtgtgcaccactaaacttggctatttcttgtattttttgtagagacggggtcttgctatgttgcctaggctggtcccaaactcctgggtttaagcaaccctcccaccttggcctcccaaagttttgggattacaggcgtgagccactgcacccagcaaattgcacacatttaaaggtacattttgatgagtattaatgaatacatatgcctgtgcaatcaccactgcaatcaagatacagagaatttttctattatccatctccacccctttcattctcttcagcctccctgtagtccatatccccagtcccaggcaattactaatctgctttctgttgctatagattagttttgcctgttctagaagttcatgtgctctttggtgtctgacttctatttgctcagcaaaatgtttttgagaatcaacagccaagttgttgcatgtattagtaatttgttcctttttgatgctgaatgttttccgcggtatggatataccccaatttgtttattcattcacctgctgatggatgtttaggttgtttccttttagtattatgcagttaagtagctatgaacctctataaacatgtctttttctggacatatgtcctcagttttcttgagtaaatacctaggactgtaattgctgagttgtatgtaactttataagaacttgccacgcagttcttcaaagtatgtgtacctatgttggttttaatacagattcatcatttcctatccatgttgcttgggtagattatattaattcttaagaatcacctcagatatcacctgccctaggaagcctttttttgacccttctcatcttccccttctttgaggtgaattagggaggctccccctccaggctcccttaacaccttgatgattgagtgttcactggcctatctttcccattagactgtgagctccttgaagaaggaaaatgcgttattatttctgtatccccaggaccttatatagtatttaccatctagataggtgctcaataaggcttgtgaatgggcgactaaataggacattattcatctttatttttattttatttttgagacagggtctatctagttctgtcacccaggctggagtgcagtggtgtgatcttggctcgctgcaacctctggctcctgggctcaagcagtcctcccacctcagcctcccaagtagctaggactacaagcacgtgccaccacgctggccaatttttgtatttttgtgtagagatggggttttgccatgttcccaggctggtctcgaactcctagactcaagtgattcccttgctttggtctctcaaagtgctaggattacaggcgtgtaccaccatacccggcccttattcagctttgtaagggagtttatggccctgtaagggagataaaataggcatgcaaataactaatgtgaagcagaaattaatagagttgaagaacaaagtctgtgagaagtgaaagagagtgatagcttttagtgaggaggatttgggaaggctaataaaggagatggggtttcaactgagcccccaaaatagattagatgtgctgagatattattacccattgattctaaagggatttgacttgatcttctgttctaaaagattggtgaggctggaaaatgaagtttacgtttgggaaggtcacactaagattcatcttttttttttttttttttttttttttaatgctttgctcttctcagcctacagcgggcactaggagatactggaaatgttttctgtttggcagtagaagaatataaatgtggcggtttgtctatcatctctccagattctaaaggcttctaggtgggattgaaaagacttctcttatcctctttgcctcttaccccatatggtaataggtcacataagtcacactattgccaaagctctgcttagccatttgtctggtctctttggtctcagccacctggcttcactatttagcacatatttgtccattgtcttctatagcacatgttcatagactattagagctgggaactttcaaaataatcaaatgataggccctccctttacagaggagaattgatactgaaatctagagactaacctggttaataatagtaaagataaaagctgccatttattgaccatttaatatgtatcgtatatttgcatgcattatgtaatcctcacaaagtgtagatgtcttcattttacaaatgagaaaactaaggcaaagtttcagatggtatagacagaaccaggattcaaagccaggtcttttctctacagcatcctacccaggcaaggccccaggtccgtagagttgctgaccacagaggaggaggaagttgggccacagctctcaggtctatgagagggcgttgtcactgaagtggaggaaaccaggattctctgcttcctagagagacactgagattgttcctttaaaccacatatgatttttaaaataagatatgtagagcagaaaccaatcaactagcattggctttggtcagaattatttttatgataaagtagagcatatttttaaatttttaattatctaagtaatattcaaaaacacatttgcacagtaaaagcattaagaatgtattaggttgatgcaaaagtaattgtgttttttgccattacttttttttttttttttttttttgagacagtcttatctctgtcacccagtctggagtgcagtggcatgatctcggctcactccaacttctgtctcccaggttcaagtgattctcatgcctcagcctcccaagtagctgggattataggcgtgtgccaccatacccggctaatgtttgtatttttagtagaggcagggtttcaccatgttggccaggttgctctcgaacccctgaccttgggtgatctgcctgcctcagtctcccaagtgctgggattacagtcatgagccactgtgcccggccattactattacttttaatggaaaaaactgcaattacttttgtgtcaacctcatagaaggatggagagcaaagtcagagttcctctcgtgtctccaacccgtctctagcatcacccctaccttaggtaagaaccatttatagttagagttatccatttaatcctttttctatgcatgtatgtgcatgcatatggacaaatacacatagttttagaaggttaataaattgtatcattctttacatacaaaaagaacatgtcataagatatttctgtctgtacaaataacagtgttttaaatgcagcatatgtatttcatgatatagatacaccctttttgatgaacatttaggttattattattttagacggagtctcgctgtgtcacccaggctggagtgcagtggtgcaatctctgctcactgcaagctccgcctcctgggttcacgccattctcctgcctcagcctcccgagtagctgggactacaggcgcccgccaccccgcccagctaatttttttgtatttttttagtacagacggggtttcaacgtgttagccaggatggtctcgatctcctgacctcatgatccgcccgcctcggcctcccaaagtgctgggattacaggtgtgagccaccgtgcccggctggttattttaaagtatttgtttattataaatactgtggcagttaacatctatgcctgtaatactttatagtaccataacagtgatgttgttatggtgtagtacagtaggtgtatttacactgatatcagttacagcctggtgtaattacagttatgatgtaatgcctttagagagaggttggacagttcagttgctgtcccaaacctggctgagaagattacaaaagatttaaaatatttctactggtctttattattgaatgactacaccctctgaaaagtatgaattgagcattatgattgctcataggtaaaaggttagcaggcatttaatatgtgctaggtattttcttgtgtattctctcatttgagtcttataataatctcataaagaatgtgctgctattcactgtttatctggaactaagactgagaaagactgtggcttgcataaagtgacacagcttctaagaagccagttcaagatttgaaccctcatctgatgatcagtttgttttttctttccccattttctgaagctggttcattctcttaagaactgtaaggagaaaaatgatagaaggcagaatatctttgaactaatgaaatcatcgcatgagcagagaagcagagtgggcatcctgtggatttaggggagggagggggtggtaaagcctctgaacctgtcactggacttggaggtgtgattcatgacttcaggatagtggctatgctgagagaccttggtgtctgacagcaacgtcctgctattgtaagctatggatttactgtcatgctaagaaataaatcatgaccaggaaaggctgtatgtttaggtgctgctgatgcctgtaggccctctccaaacaggagaatggctctcagtggatgaattgtctcagcttcctctgagttgtaatttctatgtgggtcaaagggttatttttagcctgtgggatccctagctctttgaggagtggcctcgcttacaaggtcagtggagtgggatgatggtcgggattttttttttttcccagacggagtcttgctctgtcacccaggctggaatacagtggcgcgatctcagctcactgcaacccctgcctctcgagttcaagtgattctcctgcctcagcctcctaggtagctgggattacaggcgcatgccaccatgcctgggtaatttttgtattcttagtagagacacggtttcaccatgttggccaggctggtcttgaactcttaacctcatgatccacctgcctcggcctcccaaagtgttgggattacaggcatgagccaccacacctggcgatgatcaggatttaaggattgtttctgagctcttcctggaccctgtgttttaggtcccccaaagaaggtgtgaacagccttttggaatctgttttactctggcaaaataatctgtgtccatagattgcaggaggatgctgttggtgttataataatgctctcacatttaaaaataagttatcaagtgtatttgaggaagaaaactaagaaaatctggaaaaaaccccaccatcaacaaaagacacgcaaaactctaaaacttgtaataggataaatgatgttcttgtaatgaatgtgtcagcattttaacacatgtgtgctcagtgtgtggtgatgcaggatgtgtataacagaaagcacaaacgtggtctgtgtttacattaaatctcccacctccaagacacacacacaaaaggtcccacttgagtatgtgtaattacatctctgaatactcccttgatcctatttttttccttttccctaaacacatattttggttacttctccaaagatacatgatatatattagcctcactcagaaccacagggaacatactcaattgaatcacacctctatgagtagtgtataaagtgtaacattttaaaacaccagggaccagggctggcaaggtccacggggaatcctgaaggctggtttccagccacaactgtgctggaatgaaaatagaaaacaatgaggcatgtgcagagtcagcttttctttgtgtcacagctcagcagttttcctgctgtcctaaactttcctaaaaaaaaaaaaaaaaaaaaagctggggctaaggggaaatggtgcagttgcagttgaaatttttttttaatagtaaagactgaaaatataaactaacagctggtgctgtaggaacatgtgaaatgaagagtgaattaatggtgagaaatctcactgctctttgcttggctgtgaggacacgcgtaggaaggacttgtggaaacttgtttggtaaaatagaaaaaaaaggaaaagaaaaagctaagtaaccatcaagcctttttcaggagtgggggaaaaataaaaatttatatactctaaacttaaagctttatttatgatcattattttaaatatctgtaaatgcatctgtaaaaaactccagccaagacagagggagatgtgaattatcaagtatattgacttttttttttttttctgttatcagtagcatccttcagaaagtactgattaaaaaggaaggccattcccagttcttggtttatttgcctcatagcgcaccaagtcaaggttgagctggggccttattccagaaagcacaggcttcctttctgattggaaataatatgtattttgtttgaccttcagaatactcatggctttactggaatacatgggccaacatttgtcctggcaaggccagggcagtttaagataggtatccacagggattgctttatagagcaattaaaagcagtgggagggaggtgactgcagaaattcagacgtttgcatcctttctggcctaaaaatcaagtgagtaatttcaaaaagcagaatttgaaaacaaacaaacaagcacttctagaagtttctgtctgaacacttgagaattttgccaaggtcatagtgttctttattttttctttttccttacatgttactttctgaaatatgatcatagtgttcttttgcaactgatcttggtgtgaagagggggttacatcttatatattacacagtgctaatatgtgtaatattaacatttttttgaaagattgtcaaatatggaccgtggaaaacagtttccatgccgtttgaacgttatgttctttatgatgctttgtttataaaaatattgttagatagctagggatgtttactactgccagctggagttaggcctcatggtagctttttaaagtcaggctggaggtgaattcaaagcctaacacagagtttcaagttattgttcttatttgaagtaaatgcataattggagactgtattctgatttcttgaattcttagctatgccagtaattcttgtttcttagggccacagtttggttctgtcaaatgtgtagttgtagagatgataaatgagtactcagagattagatgaattcatatatggtgacattaagatgttttctttaataagaatacctattatatgggagtaagtgaaaataatcatgtcttaatgttgttgaaatcctgtattcatttgggggaaaaaaagtaagtactttgtattctgcttatgtaaagggatatgaaagaatgtatataactaaatttcttaatgcttcattttgcttttgatgtgcaaaatataactttactgctaggtaaaattatacttgaatattaacagttattgcatgagtttaaagtttcagttgagcccaatatatgggaaccacgcagtttctagtgattttcaaaatatagtcccataaagatgaaagagactcaatagctgaaataggtggtacacttgatttaagtgaacatttgctaacccaggaagaatcaggagccattccaacactgtagctgtgtaccatagatacaaaataatatgttatccaacttagtatgtatttgcttactgcagttgagaacgcaggagtggtcagtgaagtgtagggattagggaaaataattgagaaaaatgaggagaaagaaagaaaaatagatgttttggtaatctttgtcaaatgttttctcaaagaccaggctcagatttaaaatattatgcagatgtagtctttggcctctggtagtttctgataggaattcagccttgagttgaactttgagatgggttgttttcttttcgtttttttcttttttaattactaagtgaccaatctgttgtagtttgttgatctattttttcctcttgccatccttctgttgctttctccatgagctgctgtttattctggaatgttgaacatccacatttagaattaggatttgtgtggctctatcttaaccaggaatggaaaaaatccaacccagtctttcaattcatgggtttaagtggattcagagaggttctcatccacagtgacaggttcagaattcccacttctaaagcccccgtttcattaggtaatgaatatacaagctgagcccttccaggttcacactgtggaggcttctccactcctctgtcttggttggctttcttccttggggtgtttgggaagagtctgattacagccaacttctttccttgtcagttgattttataacacaaaccattaaagttcaaactttttgttcagcagattgatttcatttgtctcttctatagggatctcacttagagtttatagaattctttgctatcctttactttaattcattttggcaaggtatgtagtattaactccaggtgaggcaaccaagagaggggccctaagtcaaggaacttgttaatggcagagatgagcctggaacccaggccttctaggtccaaatgtagtgttctttcctctgtgctcccaaggttcccattgtatcctgtgggcttcttttttgtaacgtaaagtgggtagtgaggagaaaggaggttcttttctgttgatctttcatatacttattgatgttatctttatatttttatagaacttcctgatttaattaaacacttctcaaatgccatgatctcatttgttttcatgatgaccttgaggattagctaggacaggactatccctattttattttattttattttattttattttattttattttattttattttaagtttagtttagtttagtttagtttagtttagtttagtttagtttagtttaagatggagtcttgctctgtcacccaggctggagtgcagtggtgcgatcccagctcactgcaacctccgcctcccgggtccaagtgattctcctgcctcagcctcccaagtagccgggattacaggcccccacaaccatgctcggctaatttttgtatttttagtagagttggggttccaccatgttggccaggctagtcttgaactcctggcctcaagtgatccacctgccttggcctcccaaagtgttgggattacaggcgtgagccactgtgcctggcctcaaaaatgcctgcttttataaattgctcacagtatagtagagatttttacagtttggagggtgttggaggttaattttgttgaaggaagtaatttctctaatgtggaggaggtggtaatttagaagactatgttgtagaactgcagccgggtatatgtttacttttgtgagcgcctgttttatttgcccgtttatttatacctatgcattttgatagaaaaataaatatagttctgttttggctccctgaaatagtttttatattttctggaatttcctcacttattgtctttaatattcctaagttttattatgactcattttggtcatacaatagtagaagaagtaggtgtcggcctgtttgaaggggtttattaagtaatttggggaagtatatttttgaagcctataaatattaatttgtccctggtgttgagatttgtcttgtggttgtcagttgtgcatgttcttatatgttttggataggggagagtaaaaaggggttgagcatagtttatttttttctttggctcaaatatgtagttttaccataaaccacggaaagtttcctgttcttgtttgattaaaaaaaagtacacttccattcattgtttccatgtaacttcctatactttttactaaaaaaggttgaaatctaggataaattatgagctatctctcgggcaaagaaacgatttcatttcaggaaggagcttaggaagcgaaccttcttgagtatgagaaacagtaatagcccttggcatgtatgtgtgtgtgtgtatatatacatacatatacatatacatatgcctttccttacataataatgatttgcaaagagtgaatttggaccccgacttctaatcaacatggaaaggcagggaagattccatgtcatggctggattttagaaagctgcaaatggtattgtaccatagagcaggggtccccacccccaggccacggacctgttaggaactggggcacacagcaggaggtgagcagcgggtgagtgagcattactgcctaagctccacctcgtgtgagatcagcagtggcattagatttttataggagtgtgaaccctgttgtgaactgcgcatatgaaggatctaggttgcctgctccttatgagaatctcacgaatgcctgatgacctgaggtggaacagttccatcccaaaaccatcctctcctcctcggtctgtggaaaaactgtcttccatgaaaccagtccctggtgccaaaaaggttggggactgctgccatagaggggcctttgggtggccccgttaggtgttttctttgtgaggtggtgctttccagcctgccctggactctgtggttcatggtagatcattcgtactgacctggaccagggagcactggtaggagtatctgatttctatgaacagtgcttgctggcactgactcaagaaagaagacaggaaggaatggtgaatacaacttccattgagaaactagagtggaaaaaatgtgcaaattatgctaaaattgtaattaatctgggctgtacaggttgaatatctcttcatcctgaaagaaaaggggaggtcaccatgagaaaatgggattgagggaccataagaactttgtcatacctagttatacatttgtttttttctcttagaacttctgaaaagcttgaagccccagaagcaatagaatagagcttttagcatggttttgttgtgaactaaattcccaacagttcacctttagtgcataagcttaactttctttgatggtttgccattcaaattagattactgtggacagtgtccctaatattgtcactaatattatgatacagtatcagttttacagcaggtttgtgcatcatgaaggaagtcagaacgttttagtgagttacaaggaaaatagccatcaaaagtccatataggttactctgtggatgggttggggagccatcttctggtcttcatccagacttgattgacttaaaattgagtatataagagtgtaaaagatggtaagtgataggcttgaggcagagacacaggcctgcagccagaactggaaaaaaacccacaagtatgaaaagtataggcaaaactataaagcagccaggcacggtagctcacacctgtaatcccagaactttgggaagcagagatggacaaatcacctgaggtcaggagtttgagaccagcctggccaacatggtgaaaccccatctctactaaaactacaaaaattagctgggcatggtggtgagtacctgtaatcccagctactcaggaggctgaggtagggagaattgcttgaacccgggaggcggaggttgcagtgagctgggacggtgccattgcactccagcctgggcgactgagcgagactccacctcaaaaacgaaaccgaaaaaactataaagcacagaaatatgggaccatttggtagatatagtaactgaaatcacatcaagttttaataaactaattagtattcataatggcagccctacatcttcaagaaaaatatacaataagcgagtttcaggatgctcaaaatatttaagatggccaagaagaaattatgcatgtagtacattttaggcagattttccttaaaactgactaaagacacttacttttttgaaacaagaaaagacttagttatttggataatttgcttatgtggaatatctcattgccagtcaatgttgaataagtgaggcatttattgtgtggcggaaaggtggttctttgggccagatgaagtaaggtgggaagaaaggaatatgaaatactgagagaaggaattactactttaaataatagatgtagctttggtatgtttttctgtgcaaatcttgagacaaagccctttttgttggaggaaatggcatgcaagggattttattttcagtttgaccatttgcaagtattagagctgtctccatgggagaaaggtgagttccctctggcagtgtggtttacgaaggtttgcttgggaggaaaagagaggagctagttgatccagagtggaaaaacaccaaagcaaagttttctccaaaataacacacacggatttctgaaaaacagcagttactttcactgaatgtgacaaacttcaaaaaaaaaaaaaaagggaaatcagctttgaaacatcatatgacacatctgttttggaaggttgctttgtcagatacagatgtatgttttacagtatgttactatgtaaagtttcgtcttgagcaagctcaatagatgtttttctgaacaggtatctcatttatcccagttttaaatttttgggggagagtttattaaacaataatagtacagtactttatcttatttttaggttaaatacaatttgattgaattatacccttctctcttagccttttattgaactgatatctctgcttagattttatcctttcagaaattgcttattgacccgacacagcaaaatccaaactttttgatatatgtcatggcatatatcatgccaagatcacaaactccatcacatgcttttagcaaataaatgccagtttgcttcttgctttcatacctacaataatgcaaattattggtttaaaaagttaaaaatcactgattcttgctttattacaggcctcttaaattgagaccttggaaaagtattttcttgcaagagctgatgtttcctattattattattattaatttattttttaagacaaggtctcactgtgtcacccagactggagtgcagtggcactatcttggctcattgcagtcttgacctccctgggctcaagggattctcccacctcagcctcctgagtagatgggactacaggtgtgcaccaccatgcctggctaattttttaatcttttgtagagatgaggtctcactctcttgcccaggctggtctcaaacttatgggctcaaacaatcctcccaccctggcctcccaaagtgctgggattacaggtgtgagccactgcacctgcctgtgatttgtttcctttttatgatatctatgtgagcatcatattttcttttcatcctgcctgctagaaagcgcagagctaggtttggcactcaaatgatgtagtttcctttagctaagtgctttgatgaagtttctcttttgcatttttttttccagaacacatctcatagttgaagagatggtaataattacagtaatacaataataaaaatgagttgatcctaagaacagtcttatggggcagatcctgttattatccccattgtatagataaagaaacagaggcagggaatggctaagtagctgccccaggttaaaaggctaaaatgtggcagcgctgggattaaacgtaggagactggctccatagtccttagagaattagcagcttgggagtttggttgtttggcacatgaattcatcactcaacaaatgtttatgaacacgtgccgcatgccaggcactgtgtcaagcactgggagagaggaagtaaaagaaacacagtccttgccctcatggagtttctggtaagtagaggacacacaaacatatgcccaaataaatgaagcaatagatttataaaagcttatatttgctataaaggagtaacaggtgtaacagtttaagggacctctgaattttatcaggtgcaatacaaaagtgtagttctgggccaggcacggtggctcatgcctgtaatctcagcactttgggaggccaaggcaggtggattgcttgagctcatgagtttgagaccagcctgggcaacatgacaaaaccccgtctctacaaaaaatataagacatgagctggtgtggtggcacacacctgtagtctcagctattcgggaggccgaggtgggaggatggcttgagcctggaaggtagaggttgcagtgagcccagatcgcaccatggtactccagcctgggcaacaaagccagaccttgtccccgtccacttacccccaaaaaactgtggttctgaaccacagcaactgagccgagcacaatccttctgtctctctaagacccagtctacactgagtagttctgttgatggcactgcttgatgggcctgtaactgccacaagctctggaaaaaccaggtccacagcttctcagagccttttagcttcactgtgaaaggagcaagagcacaccagtgaccaggtgttcataatttctctgcaaatgtcagctctcagtttccctcctaacagaagcacctgaagcagcaggctagctagcctgaagaggaaggaatagagtttagtcttataattgggacctatatattaagctgaataatttggcattcagtgttaagcatttgactcattcctgtaaccaattgtgagtgccctgattatgtataaactccttaaagtaaatgtgttttagttcgtggcccagtgtgtacacatggctgtaattaacaatattttgcacagccaaaccaaaagtttgcagattttccttttttaatccatggtctcctatctgcaatcaggaccagtggttataggcgatgattcaactccccagcagttgtggtttcccccttctgcccttcctgaccctcttacagtttctcatcttgccacttgtctctgcttcagactctgcaccccagaccctggccaccagccctaacagaatgctcaccaggcccagagcatgccacatgcaatgcatgttattcctccgtgcttttgcacacattcttacctctctttctcccatctttttctttcttgctagacaccagtttgcaaatgataaaaaagagaaaattagtgatcatcttaggtacaaatcaaggtctgagagatgaacagatttggtaatgtcatccctcagggttaatgaggtgtagctttgtagctctgcaagtcttactttgccatcagatattgcattagtaggaattaagttgtaatttttttatgggataaagttcagtttaatattttgaatctaagtcgataaagcatttgcattttaataaagaagtgtactatccttcagttattttgtatctgccaaattcatagggtaggagaaaaaagatcttattttctcccatccttcaaaccttcagatttgttcttggtctctgttctgagccaattaggcagtaacatcccataaattcttatcccctccaaaatgaatgctgtagccagtgtctccttctgtttaagcttccttcttgtgagaagaatagggacaggtgcaccatattattggtcaaaagtaaatcagtgctcggtgtggtgactcacttccagtactctgggaggctgaggcagaggcaggtggatcacctgaggccaagggtttgagaccagcctggccaacatggtgaaaccccatctctactaaaaatacaaaaattagccgggtgtggtggtgcatgcctgtaattccagctacttgggaggctgagggaggagaatcactcgaacccaggaggcggaatttgcagtgagttgagattgcgccactgtgctccagcctgggcgacagagtgagactgtgtctccaaaaacaaaacaaaacaaaataccaaacaaagtaaatcagaagaactgttggccaagatgatgccaactgattgtctttatggattgatggaattccctggaggcagaaacatggcctgttctcgcctttgggagttgtacttccagaatgtgctcagagaacaggaatttttactctaatactgtgcatagtttaatttaattaaaaaaatttttttaaagagatgggggtctggttattttgcccaggctggtcttgaactcctggcctcaagcactcctgctttggcctcccatagtgctgggattacaggcatgattacagggagtacatgcccagctgtagttttattttaagtctttccagtgcaattcatagaaataatttctggggagtaatgctagggagtagtataagaacatcttatcttagatattttattaatcattctaaaagtttttagagaaaacagtttttgattggagaaaatgttctcattcatttatttctcttcccctcaagggactttatgtctctaatagtatttgaagtttgtaaagcgttttcacatatagtgcatcatttgatctataagtcaagcctgtcatagaataagagatcatggaatgcttaaaacccagctcctgtatctcctggttcactatttcccggtgcttctgtaatacaaggacacctcttgctatgtccagtggtgacttctgagacatgccactgcttcacttcaggtcataaaaaccatgaaacataacagcaccacttcctcacagggctgcagaaatccccctctgttggcacgtccagattgtatagtggtatcttgtttagatggaagagtatgtgccttttatagcttggcacttcccaacactttgagaatttggattcctaaagaacctgtgccctttgtttccttttgaacatttgaaaacacaattgaatacaggaaattctccaacatggttgctccatgatttcaacacaacaatacacaaatatgcactggcttttggcccaaaaagttggtggttgacttcttggaagagggttagtttgttaggaggaaggtttggatgtagattttgcttggagggtgaaagaaaccatgataagatatgcctaagagttgtgctgtagaaaaatctagtttttttccccctgagaaatccaaattacaagttttaggacttgtctacctttttcctactagggataagcttcagcctgaagccaggttttattgttgaaaaacccaggtaggagctgtggtagaagcgccctctttggagtttaatggtggtacattccaccgctccatccccaaggcgctgtagttccaatgaattgtaatttgagatggtacaaacatgagcatatgttatgtacacgtcaggcgtgtttgtgagctcagggcattccaggtgtttttttcttggagctttgtttttgcgtcatatcctgtgttggtaacattccttctcatgaagctcgattgaagtgaggcagtgctattggctgagaaatcatcctgggtgccctttcttacagattcttgcatcccatgggggtagaaaggattttcagcccaagggcagaatagatcctgtagtacccagtcccacaatctgtgggagtttgtccctctttgcagctgacagcatttcagaattccctgtgggacaataacaaaaaccttattagccaatggtgtcattagaataaaatctccccactgcgatgtcttggtcccagcctataatgttaccccttaattccctctgcatctttaccacttttattacagctgaacacacgctcctcattagaaccctgggtgatatggggaatcagagtgctgaaaattatgtggaataggtaccagatgtttgtgtcaacttggtatgcattggtatttagaatgcttgaggatcacatttattaaatgtgaaaattacttactatgtcttctccaaaacattaccccccccgccagtatttttgtccatgttgcatgaggtgtgatattagtaatttcttttggcactgattaaatttaaagtctgtgcagcaaatgcatctgttcccaaatgctttgtctgcgttctgtcgagttttggagctggcccaccgccagcagggatgtgggggttctgtaactgagattggaatgctgtgttgcagctaaaggacataatgaaagggtgagtccatttgatttttttctttaagtggaactgggaatttagacattgatgttatagcgagatcttaggaacgtttcccatgtgtccagataagcaagcattagtgaaaaggatggaggagggcatttggtaaaatgagaaacgagtttcattaagttcatgaagtcttttaagtcaaccaaaggtgatacgtgtgaaccgagcagtttattttattttagtagatatgaatgaatgtttacatttggcctatgcatctgttcacccagtcctgaggcgaggaactggaaagtacaaggcagaggcaggtggtgctctgccaggggaaaagtctggagctggagtctcagagacccaggttcaaatcccctattgccacttcctgctgatgtgtttcttagcctctcatgagctccagtttcccatcactctaaaatgagggcattaacactgtcttcacagtggcattgtgagaatcagaaacatgtacaagatgtgtggcccctagtggtgtggtaaccatacatatgaagagttaacccccagcttctcacacaaggcagcggcccagggagccaccatgtgcttcacagtgtggcctcaggtggcccagctgctgagcacccgagcggtgggggcctgctttgtgaaggaggctggtttggcagtggccttggcagtgtggccgtggtctgggccacctggggagtttctcaccagagtttatttgaatttgtgctgtcttcaggtcagtaaatatttttgtcagtagaagtagcatcttgtgggtgaagggggctgtgcctctgtgctggtggccgaggagagtgtaccaaacagaagagcagagcctgacttcagttcaaacaagacacgacacccggcaagattttgagatcagatttctcgagtaagccagcaggggaggattaaactcagctcacactttgagtccaaggaaaagttagatttctttgggagctacccttaaggaatcttgtactcgtcacataccagatgcccagaatgaactgaaatatccagattgggaggcaccagtgaggattgtctctggaggtgaatccatatggacattactgccaggaagcacttttctgaaatacacattctacctctgtgtggctcacaacagtttacttatagtgggttatagagtttctgtgaggctttggatgaagtatctgcaacatgccttttcatgatagagtatggtgtgaagtgagcacgcgtgtgtgcttatgagcattgttgctttcaggtgtgttctttcgtcatcgtccacgccctggttgatccttacgtggtaacacagcttttgctgtgctgctgataaggagcatcatcagagcatgtcactcacttggctcttgactgcagggaagagattgcgtagggaagacgggatgtgggttttcagccgtggccacaggagacactcccagccttttgaggctgccggtgagggcctacagtagcagctccagagctcacaggtcaccacaaaagtgagcagatgagtcagatggggtttcggagcatgttttcctggtttccaagccttcgtggctgggaggtgctatactcgggccccatggtggtcaagtgagaatctgagccactgtgttaactcaggcacttgtgctagagcctgtggggtggatcatgctgttcccaggtggaagccttcctgaatggagctggccctggcattgtgcagacagattgcggaaggaaccactatgaggccaagggggaaggatgggagacaggttcatgagctggctgtggcagagggaaagggacaggaaggctagggcctgacccagaagtggcaggatgaggctggggctgtggtgtgccaacggagagatagaggattgtcctgccacctggagagaggggattggccagaagagtgtccgggaagagaagacaaaaacagatttgtgtttcctgctttctgtgacagttgaaggtggggaagccccaactgggacttgattcttagcaaccaaaaatgccacctccttcatttcatggttggtgttttttttttctgccccttttagtataagagtgaggctttggctctcaggtaaagagtgaaagcaggaagtctgagacagacagtcccttattggcacaaagcccatgcagcatgcatcaccccatggttcttccccatttctcagcgataattgagtgtctgttttgtgccagatactgtgctggggtgaggcaggcagcagcagacagagtggttgggttctgttctttcgtggtgtttgcagtctttgggagcatgtagatgtgaaaccaataattgcacaaataattatgtacatctcatcacaggaagtgctgtggagagaaacggagagtaccatgagagtatgaaaaaatacagatctaacacagtgagggaggtttggggagcttccttgagagatcagtagaatgagcaggagtttgtcaggccatggtggtgggaaggaacagaaacggtggggaatgtgttcctggaggaaaccttgctattcagaggctcctttgggacaaaggttggcacttctgatgaaataaaagaaggcaagtacattaattagggtaggttaagctacaaatgtcagaaaacccaaaataacattggcttatataaaaaaaagagtttacatttgtttcctattaaaaaaaaaaaagcagttcagagctgatcccgtggctccatgttcatcaagtacccaggtggcttctcagttgctgtgccctcctcagcatgctgcttctgtctcatggccccaaaggcttgctctagtgctgcctgttacatccacgttccaaccagcagtcagaaggaaatggcagaagaactgacctccttcccttcatacaggaagctgccagctgctagcgggattgggaaacatagctttcgttctgggtggctgtgtgtccagctggcacttgaagaaaggagaatgatggctatagggagacagtgagcacttctgtgcttcaccagaatggccaaaacacgggagcaagtgtccgaggaatgagagacggggccgtggcaggaagcagggccagatcttggagggccttgtaagtcacgttgaggttttggggcttcatctggacagcagagatggagtgataagtcttttaaagcagagaaaagcaggatcagacttgggtttttcagatcagtttggctgctctatagaagacattttggtggagataagaattaagagcatcttgcagtaatcagggaacgagagacgatggtgcccatggagatggagaggaggggtcagagttgagtggccagagagagaatccattgggtgaggagagggaaggggtgatgttggggcacctcccccaggttggtgccaggtgtacgtaggaagaggctggtgccatttacttagggagggaatgaaggaggaacaacaggcacgaggggtaaagatcctgagttctgcatgttgagattgggtgtccatgagacaaaagtagatggtgaaggagctgttgaatattcaggcctggagcttagaaaaagaagtatgggccaggcatggtggctcacgcctgtaatcccagcacttcaggaggccaacgcaggtggatcacatgaggccaggagttcgagaccagcctggccaatatgatgaaaccccatctctattgaaaatacaaaaattagctgggtgtgatggcgggcgcctgtaatcctagctacctgggaggctgaggcacgagaatcgcttgaacctggggagtggaggctgcagtgagctgagagcgcgtcactgccctctcgcctggacgacagagcgagactgtctcaaaaaaaaaaagaaaaagaaaaaaaaggagaaataagtaagtctgagatggcctggagtcatttctgtaaagagatgagagttgaacccatggatgtgtttgagaaaatctatggaaaaaggatagtgcactccaggaaggcctggcaggcattttacctggaaggcggcgatggaacagctggtggcagaagagcgtctctccaagatattcaaaggaaaacttcatacaatcacactgcctctttcctttcttggccagagaggcttgttttttacccaaaggaaaccctctcccctgattcctacactgtgtctgttctcttaggagaggactactctaccccatacttagagtttaacctacgtcctttagcctgggtgttttcacagggactttttgtcccctcccttaagtcttaatttttttcacttgtacattctgtaccccttgcaaacttatccagttatgtttttcaggataaaattcctagcgggaagttgctgggtcaaaggatgtgtaccttttgtggggccttggataccactgaaaaattataccaatttgctctctcagcagcagtgtgatgctggcacactttttgaggaaggtttcttaaggcatttctgggcttaattttttttataagcattgcctccctctcccaacttttctttaatgaaaagtttcaacatgtagagatgttgaaaccattgtacagggaacatttagattccacaattagcattttgcaatagttgctttatcaaatatctctccatctgtcaatccatcttattttttgggaggtatttcaaagtaagttacaaaacggtagatctcacccctaaatctatgaccacttttttattttcacagaaagtgttggcacagtagcccaggcattgggctggatgttcaccgtacaatgcttggtcaccctttccctctcctcacccagtggattctctccctggccacttaactctgtccccttctctccatctccacgggcaccatcatctctcttgccctgattactgcaaggccgggcacttcaggaccctgcctcctgagagagagagccgcaaggagggccaagtctgaagctttgggtgactggggcaaccttgaaacagttacttaagcacattgagcttactttgctttctttaaaatggggttagtgctgcttccttgcaatgtgtcagaaggatatgcagcacctagcattgcatagtgggcacttaataaatgggagcagtctctctctctctctctttttttttttttttttgagacagagttttgctcttgtcgcccaggctggagtgcaatggcgcgatcttggctcactgcaacctccgcctcccgggttcaagcgattcttctgcctcagcctcctgagtactaggattacaggtacacgccaccaagcccagctaatttttgtatttttagtagacacggggtttaccatgttggctaggctggtcttgaactcctgacctcaggtgatccacccgcttcggcctcccgaagtgctgggattaccggcatgagccaccgcactgggccgagcagtgtctcttattacgttgtatgctgaactgttaaagataccatttcttatatgaccctggggatggtggtagataattcctgattttttttttttgtctttttggtgtaaggatagtttaatcatatgttgtagctttttttctttttcaatcttggagggaaaaaaattctatgaggaacttcgaaaaccaaatactactctattgtgtcagatggtcaggaacacactgttgagtgtatttaaacgtcaagccaagtaagtctctgtatttttatttttattttctgagatagggtctcactctgtcacccaggctggagtacaatagtgtgatcacggcttactgcagcctggacttccctgggcttaggtgattctcccacctttgcctcccaagtagctgggactacaggtgtgcaccaccacaactgcttttatacacacacacacacacacacacacacatatatacacatatatatatatatatgcatgcatatatgtatatatatgcgtgagtgtgtgtgtgtgtgtgtgtgtatatatatatatattttttttttgtagagatggggtttcatcatattgcacaggttgcttttgtactcctgggctcaagcgatccacctgccttggccttccaaagtgttggtgttacaggcatgagccattgcacctggcctccagtgggtctctgtaaagagtcgctgtcctgtcacttcatcagggtgtgccccatgcattgctttctcttttctttgaccttggactgactcatataaccaacccgtggctagagctctagcccttaaagagggtgtttgccctgttctggactctggcaaaacagagagcatagactctaaggcaagaagtgcacatcttcagcactgaaggcttcctggcactagttccctccctctttgggagtaccttattatttgatttgtttccattgagtttttgcccctgccccagtgtggaggtgagcagtatggtgatttaaggaagatcttaatgggtgatggtggcatcatgcagaggagggcagatcaaatagattgcaggcctttttgcagatgtgttttcagcctgttcagagctttgcacacatacaagaatggaactgaaaggcatttttatttgtgcttaatttgtgataattgtaaattcatggcaggaggctctgcaaccagttcagaagggtttcccagtgtgggtagctgtagccagtgtgtgtccccagaattgagtaggagtaggataatttcttgaagctctgggtgtgaagtataccagacatcccactgcggctgggaaagccggaggccaggagggcaggatgagggcagcagagggagcacctgcccatatggtttccccgcaccccgccaggggctccagggaatttacagtcagtacctcctgttgttgctctcgggacatcttccttcaccaccttatgctttctcagaaagcagctggccacagtccagagagtggcagtgactatttgagaaggcacatacttcatttcagaccagatagctattatcagcctagataatttctgtaagtcctgaaatagacttggcccaccaggcagggtgtctgcttctgggtgcagactggctggttctgaactttgtttgcaaccctggagggtacctttattatttagaagtcaggaagaacaaactggagtacattcaggcctttttcgtgggttctatctgggaggttgtggtgtagtgggcactgtttcagcccagtttcctgggtgattgaatggagacaatagcaccaagctcacagaagtgtgtgaggagtaagcatccagttccttcttcccctgggtatgtctctatcaatccagccaatgtgaaaggaggctgcagtgatgtcagggctgtagcagcctatttcccttattccctacagccaaatccaagtccctggaatggtgccctactcactgatctgagagggggcaattttttttaagctcaatgattcatttatacatttaacaaacgttttttgagcatctcatatatgccaggcactgcagatgaatgctgaggatacaaagatgagtacccacagccctcagagaggtcacattcgaccaataaagatggatgtgtacaccagtggctatcatgtaaatgcagtagtggagacaggcagatggattgcgggagggcagagaaagagagccttcctcagcttgagatgtttgttgtgggggcggagtgagagtggaagaggaatttgggtaaaggaagcaggcttgaatgaggacatggagttgggaaacatcctggtgtgtctggagacctttaaataagttgacgtggagtggggagggatgagacataggaaggggctagatcaagaagggcctcctgtgctctgtggtggagctcaggctttatttggtagggcagctattctgaagggacaggaacttcccacagagatgccaacggcaggcatttgctttgggaacacccgtaacattgagtgcctctaggttaggtggacagtgcctgtgtggaaggtggcatgcagagcttgagtcctcagactccgttcaggaaggtttgtaattgtctagggttggtaaagaagtagagatggagaggagtggatggatttaggatttaaggcttgactgattagaggaagagggaatgaagaagcaggaaccaagtatgaccagcactctactttttctatttgaggctctgctcagatcctacttcttttgggaggatttttctgacctctggcccaaattttgctgtacagctctggccctgatcgcctctacatgttacatcttgctctgtattgttcttaagtttgttttgctttccctaataaagggaagctctgaaaagataggatctgtatcttatacttttgttaagtgcaattttaggtatttaatattatttatgtatagtattattgggactttaagcaatttattttatctctgattttctaccaagagggaagaaggaattaaacacaaatgttaaatgggaagtgtcttctacccagaggaatgcattcatgacttgtgagtccaaaagggaatttaaaaaatcaaatacataccaaattatccaaaagaaatttaagagattgggattttagaagataggctagctttttggccacttagtcttggaacagtttacctggaaaggcatctctggtgggttggcagtggtttgatcacccttgcccctttggggcagaattaattgctgtttctgagtggcttgtgtttgtgattcccttggcaggtccagagcctggtgcactgtgtgaactgtcacctgtcagtgcctcccatcctgtccaggccttgatggagagcttcactgttttgtcaggctgtgccagcagaggcacaactgggctgccacaggaggtgcatgtcctgaatctccgcactgcaggccaggggcctggccagctacagagagaggtaggtgcaggtgtcagctctcagcccactgccactgagtctgcagagatgattttctggacagaagtccttttcttctcttctggggttcaacaaaagaagctcatgtatgaacataagagaacagatttaaaataccagctgctgtctggattgggcaactttaggatttctctgtctagagattggttggctctccccatttcctggccctccgtattggaaaaaaacgttcataagaatttcaacttttaggccaggcatggtgatggtgcacacctgtaatctcagcactttgagaggccaaggtgggaggatcgcatgagctcaggagttcaagaccagcctgggaaacatagcaagacctcatctctactaaaaataaaactaaaaaaaaaaaaaattagcagggtgtggtagttagcacatgtagtcccagctacttgggaggctgaagcaagaggattgcttgagcctgggaaatcgaggctggagtgagccgtgattgccattgcactccagcctgggagatagagcagaaccctgtttcaaaaataataataataatttcatcttttaaacatgattgtgagaaaccaaataaggtaccgttttctctgttgttgtgaaatgtctttcccatttcctcctgtgtcctctgtcttctttctttactttgtcatatgaacttattgcttctgcaggatgagtgaggggaaatgggaacactctggaataaagatggcggtactttgtacttgcctgaaaatccctgagcatagctccttatcactatctaggcagcttcccaaaggtggcggtgacattagcggagatggtgatgataaagatatatgctcatagttactcagcatttactctgccaaacactgttcgaagcactcatacagtaactccatgaatcctacaattatactcattttacaggtgacaaaacaggtgcagaaaacttatttgcgcaaggtcatcatcttcagagagaaatggcgtcctctttcctgtggctcaaaaatggcctagattgtgggtgaatggtcatcatttaagagtacagatttcccaacaagataacacagagtattctgtttttaagcttctgtgtgtcagaaatgttatcactcaggtattcgctctccagggagagagaaaccacaaaaaatcctgatcatagtgaagtataggaaaagtaatgcagaatggaatttatctttgagctttcttctggtcaagaaagttaatttccagagccacttgtttatgtgcctcagccaccccatccttttggggtggtaggaagaggagaagcacgagatgttaaggaaaagcaagctgattttaatctcatgaacgtgtgcagagttggctcatttcaaagacagatcatctaacctttccagcaacattggaaattattgttaatactcttggttgcttgccattgttgctgcaactcatatttcaggtcagatttctttatcccagtaatgtgcctttaattctgaactgatgggggagagtttgtggtgagagggaaaggaggagaggaggaaatgcagctcctatgaagcgttgctgactccagcaattctttagcagcgacaattactcattttatatatgcttctctcagaggaactcagagggaaaagaaagtccaagctgttacagaagcagcaacagcagaaaattcttgacgttaaattgtgcagtactgttgttgactctgaaaacaaattcgagtaagactactgaaacaagagaaaaatacctcgaggagtgacagcagagctctcctgcacttggttactatgttattcaaaatgggattcattttaggacctggcagtactgaggatacataacattagctggcatcagggacatagtgtgttcagtgaggaagaaaagaaagagggcctacaaagggtagtctcaaacttgtttaaaaacctgaacattattctctttcgatattagtatagtatatgtatgattttgggccagtgatttgaagatgtttctgagaatagacaacagacggacctttaagaattagatggttgtagttcaatactgtttgaaaacaagattttgggataactgatttttggagattccatctggctctgcgttgctcacatacggcagatctcagagtagtttgcatatacaaagtgagcatagaggataacatcagaatgagggtcaggacgagagaatgaaagattgtttgtggttggtaagatgggtgtgtataaggattaaatatcgctcactcttttgacatatgactatggagaacattcccgcagctatgcaaacagtttttaaaaatcatttgaaccacatgacccagcaattccactcttaggtatatacccgagagaagtgaaaacacatgtccacacaaagacttgtctgtgactgttcatggcagcattagtccaaaagtggaaaaacccaaattttcatcttctgatgaatgggtaaataaaatatggtatatccatacaatggagtgttactgagcagtaaaaaggatggcatactgataggtgctacagcatggatgaaccttgaaaatccactaaatgaaaaaagacagacacaaagaccacatatcatatgattccatgtatgtgaaatgttcaggatacagaaatttatagagacaaagtaaattagtcattgcttagggctagaggggaaagaaggaaatggaggttgactgctaaacgttacatgtttttttaaaaaagtggaggccgggcgaggtggctcacacctgtaatcccaacactttgggaggccgaggcaggtggatcacctgaggtcaggagtttgagactagcctagccaacatggtgaaaccccttctctactaaaaatacaaaaattagctggcatggtggcgggtgcctgtagtcgtagctacttgggaggctgaggcaggagaatgacttgaacccaggaggtggaggttgcagtgagccaagattgcgctgctgcactccagcctgagcaacagagtgagactccatctcaacaacaaaaaaaaaaggtggaggagatgacaaaaatgttctaaaattttaatggttgcacaattctgtgaatatactaaaaactgttgaattgtaatttaagtgggtgaattttatggtatgggaattgtatctcaatgaaactatttaaaaaaaccgtttgacctgctgacatgctaattagtctataaagtttacgttggctcaattcacttttaccaagattgcttactccttcaacttaaactcacctaatgctttttgttattttcaatggataacttggtttttgtagatatgtcatgatatggtctatgctaaaaataacagctgatctgttttgagggtaatagtaggagggccagaggcagcctttgtgcagtctctaccaattttttttttttttttttttttttgagacagagtcttgctgtgtcacccaggctggagcacagttgtgtgatcttggctcactgcaacctccacctcccgggttcaagcaattctcatgcctcagccacctgagtagctgggattacaggcatatgccaccgtgcccggctaattttttatatttttagtagaaatggagtttcatcatgttggccagtctggtctcaaactcctggcctcaagtgatccgtccgcctcagactcccagagtgctgggattacaggtgtgagccacctcacctggcctctaccaaatattaaaggcaaatatttttcaaaatgaaataagtgccgttacttacaaattagcaaaacaattaccgtgctggctccaagctgtaattgactatgactgaagactggagtagttggttttcatgatgtcatccttaaatgtgagggaattactaaatcagccccatttccccttggcttgttattggtgcaagatcagtatcaagatctattataaatcaccccatatctaatattttactattaataaattcctacctcccaggtgccttaaagttcttcagctggggagagatttttaattttcctgtgtagaggcggtgacagagcctacacccaaaagtagtaactgcagcaggttgacaagatttagggagacagtaacgcttaagttggatgaacagttttataggccagcagagaatttgtatcagaaacacacttgttacaacagtacataaaaagccctcagtaccaaagcaatgttttgtcatcggcctccctgctgggttctcctcgggtcagagtagacctattgtatttttcatctgagaacacacctctcatttgtaatcattggtttcggaaacaacagccttggaagcgaacaggaaactggaaaatgactttctggcaacagaggacagcagaagagcataaacaatgctgagagatcagatttatcttttagagcaagtgaggaccagtgtcatggtttccatccccatgaaaaccagctcctagtaccctctgactttgaagtaaaatgcagccgcccccttgtgtcggactcccgagtttaattgctcagggcgtttcctgattcctgagaggggttacagcaccattagaggcttgtttacagtaacatactttcattagttgctggaatggcaacaattttgtttcctatcatctaatttttacttgtgacctgcttttatgtggtggtgtgtcttttctatttctgacctatctaattgcttgcttattatgaaaagctgctgaggataagtcccaagttagccattacatatgtgtagaaaagatatggacatttaaatttatgcatttgttttgacattaaaggagcaatgggcgtgccagtgcctggctgtaggggtggagtggggatcaggaggctccattaccatgggaaaggggccaggtttaataacttcacccgtcaaaaagctcataaccctatgagcttctctgcctcattccaaaagaggatttgggatgagcctccagcaacaggcataccaacagtgtaagcagaaatacagaatgaggaccaagggaaaaagaagggtgcagcttgcgagccatttgggtttatgtggttggtatgattgtgtttgaaatttggctccaggctttttggcaggcacagacaaatgggatgtgtggttaatcacacatgtggctccaagtcacttttactttgtaccttctctgaggattggcataaagctgtcccttttttggttctttttgagggcaggaaagaccacagtggggagaaagagaaggaagtaaacactgtcaagtgctaactgctcgacttgcctcttaacagctctcacatcccccaaatgacaatactagcagccgtagtggtgaagactgcgtgtctcctgtgggccagccacctgccaggcacttgtttggttctgccagtcttgtcgtcagcctgaaagggaggcttggtggtcactgtttttgcagaagaggatgcttgggcttagggaggttatacaaccagatggtgagttgtggagccagcccccgagttgtgtctgttggattctacagtgcaagctgcaagcttttcccatactccagctagttgtcctttccttttagctcttacttggttctgggctacagaacctgctagtctgctgagtctgctttgttagacagccagcaagtaggtctgttagtgagggtttgggttctgtgcataggtttgtaataactctttgcagtgcttggagtcctttttgattcccttccttgcagctttggggcagtattaagttggtctgtgtgtggcagtgtctctttttttccctttcatggtttaggattatcacaccacatgtcagtaattataaaatgcagggctgagctcaggagccattgtgctctatgtggctgctaatccccatgctaaatggcaccaccaaggggccttttatgttcttgtctgttttcatagttaaacattccccccacccccaggccttcagctgtgttcacacaaatagctcacctgtcctctgcttataatttactacgtcttgtatccaaacttgttttaactgtgtggtaagagagaactagcatattaactgactcttcttgctaagaatgatatgcaagagcttcagtattcagacttcgccatctgatttgacatctttttgcttacattgaggaatttggcaattcaaagattgaccattttggagatctttatctacctacctacctatctatatgtaatccttccccatttccacaatattaatacacgaacaccttttctctttttccccctcgattatcgagattcagataatacagtgcttggggaggagtgggtgtgccttgcccaacaccactaaaagaactgatacaaaatctcaaggctgggttttgggagagtacatatgtgagagcaaaaacattaaactagctacattcttttctctatctggggcattttttaccctgctgctattcataaatgacttcctaatgcagtcctgtgcatatgcagaaaaaacaaaaaacccagggctatttatgtttgagataccttttatgtggtatgtactaagcaagtgtcaaaggaaacccctcacacacagacactgtatatcagtgaaatttggtttctaaacaaatacattccgcatataagcactgcctggtgtttgtttaaaaggaagctgttctggaaatcacccagcttgacagggaagattacctctgaaatggtcatttagttttccaccagtccttaacagatactgtcatgcattgcttcatgacagagacacattcagagaaatgtgttgttaggggattgtgttgtgcaaacatcatagtgtaggtacacaaacctagatggtatgtcctactacgcacctcggccatatggtatatatagcccatggctactaggctacaaatgtgcacagcatgttactatgctgaatattgtaggcaattgtaacacaatggtaagaatttgtgtacctaaacatgcctaaatgtcaaaaaggtacaggaaaattatggtactataatcttatgagaccaccgttgtatatgtggtcccttgttgattgaaacattgttatgtggcccatgcctgtactatttctctctctctctcttttttctctgtctctccccacctgcccatttcctctctcctttcttcccttccccatttatttgagtattactatagaaatcatttcattacctacaaaggcaactgaatctgtctgtccacataggattggagggcctgaatgaataggacactcatattatataaaaagagttactcctttacttgaagacactcaatgcaatttaaacaatgacaccctgctaggtcgtgtgaaggtgccagtccaggcctggaaaggggagcagggttagggacagcaaggcaatgcatctgctagctgtcacaacagaggacaatgcaagcgagagctggcactggtcacactagtcaaggatgatgtctaacactttggggcaagatgttcaatctaaaattccagctaactctccaataggaactctccaaaaatgcagtcttggacttttagaaaaagtgaaagcagaaatcagagaggtaatagcaaacaccggggtttaggaaacaaaccaggacacaaggctaagctaagaagttaaaacgttcctaccaagatgcaggttggtcacgtcacttaaatcctgtcattcgtcacagtaatatccagatgctgtaaagttgccccaggaaagtacagcccctgccccggcagagggactgagcctggttggactcggcctttttagaatgaggtaatgccgatttatgttctatgctggctggacagattgtaaaaacctgtcattattgcctcttcccccagatagagactgccttgacaccccctttttttttcgagacgagtctcactctgtcgcctaggctggagtgcagtggcacgatcttggctcactgcaacctccgcctcttgggttcaagagattctcctgccttagcctcctgagtagctgggactacaggcatacgccaccatgcccagctaatttttgtatttttagtagagttttagtagagacggggtttcaccatgttggccaggatggcctcgatctcttgaccttgtgatccgtcagcctcggcttcccaaagtgctgggattacaggcgtgagccaccgtgcccagctgaccccttttaaaatttgtccagcagcagcattttccaaccagtatggtgttttgtctttatggaggttagggttagaaccctgacctgtactactgttgccatggtaactgcccttggctttaaaaaaagaattatataatttcctgaaagtgttgttagacaatgtttttacaagagcactctctgcatttaaaaatgtgacattttgctcttagaacttttgggagagtattaaaaaaaagcaatagacccaagtcaggagcagctctgcaaatctgagatgcagatgtgctgattgggcaaaggcccagtgcatgcgtgtgcagcgtctccagttttccagcttgagccttctccttgccattgcttatctgcttcttgacattctgtttgagagtaaaaggaaacttaactgctaatcgctgatttaaatacttaaactctgcagaagtatttattgcattgacttcaatcactccttccacggtattttctaaatatttctgtgtaagtttagacacgtttaattatttcacttttctttcttccacgatgaagaggccatgtatgacttggcccctctgatgcctcaggtcagcttatttctcttttccttcccctgctccactggaatgagtgaacatctgtacgtccttctttcccttcttccctctctgtggcctgagctaatctctggggagaccctgatgatgcccctttgaacaactcaagggctgctaggactagagggtccctggggtccacctagccctaataccttaggggaaccaggccagagggtgtagcggtgacatgttcactattaaccaagaacttggtgctagcactggactagcccctcggggcaccaacttctgttgcagagctgcctctacacatctgcctgccccactcttgctcctccccagcttatgaagcctccagtgctgtcaagcactccctttctggcacctccctcttggtttcctggttctcattctaccattccatctgtttttctgtttctttctcagctgctcactctttcttcttggggtttttttttttttccccgtgagacagggtctggctctgtcgcccaggctggagtatagtggtgcgatctcagcttactgcaacctcaagcgattctcccatctcagcctcttgagtagctgggactataggcgcacaccaccacgcccggctaatttttgtatttttttcaccatgttggtctcaaactcctgagctcaagtgatccactcgccttggactcccaaagtgctgagcttacaggcgtgagccagtgtgcctaacctcgggggttcttgactgaggcatagcccttggctttctgttttcctctgtctcctctccctgaggtggcttgtctggtcttaggattttgcttgtcacttccttgcttacaactccaaaaactctgcctgggcttctccagtggaactacagtcagatggctgaagcatcccggctcttgggtcccatcttgagctgccaggtgcctcagatatggactggaggagtggctgtcactgtggttcgctcccatgttagatacagggctagtctcagctctgccactccccatgtgtgaccctgggtgagttacttaattccctaagccctgtttcctcatctgtaaaatggagatgttaatagcacttttttttttttaattattactttttgtgagatggcgtctcgctctgtcaccaggctggagtgcagtggcgtgacctcggctcactgcaacctccgcctcctgggttcaagcgattctcttgcctcagcctcctgagtagctgggaccataggcatgtgccaccacgcccagctaatttttgtatttttagtagagacggagtttcaccatgttggccaggatggtctcaatctcttgacctcgtgatctgcctgtctcagcctcccaaagtgcggggattataggcgtgagccactgtgcccagctagtagcacttctttagagggttcactgaccattgagaaatgtctctgtggcacttagggccggtataggtacagtcaactgctagctaacagtaatttttattctctctaaaatagaatttaagaaccctcccaggccagttctcctgaccctagtgctggcttttcaatctggcttccctgacccatcaatgtcaccagtaccatccatcttggaacttttgaaccatcttgtatttactcatcctctttttttttgtctttttttttggagacacagtcttgctctgtcacccaggctggagtgcattggcgcgatcttggttgactgcaacctccgcctcccgagttcaagcaattctcctgcctcagcctcccaggtagctgggattacaggcacccgccactacacctggctaatttttgtatttttagtagagatggggtttcaccatgttggccaggctggtcttgaactcctggcctcaagtgatccatccatctcagcctcccaaagtgctgggattagaggtgtgagccaccacacctggcctgcccattctctttaaaccctatatttggccaatcaccacattttattgacatttcctctgcaattgcccttgaatttctctgtttttctccacttaccctggagcctccttaactggtctcctgggactggcctcttcagctttagaccctgattctttctgtctagcttgtgaacctcttcataaaaccaaacttctctaaataatgctctcataatgaatttgtttattcattcacaggcctgttcaatgaatcactattaagaacccactgtgtgctaggtaggtgctctgccagattcttactcatttttatgtctttagcacctattagagttgagagagaatgaatttaatgaaacatgacaaataatatgactaatatattttaaaaatttgcagaaggccagctgtggtggctcacgcctgtaatctcagcactttgggaggctgaggcgggcagatcgcttgagcttaggagttcaagaccagcctgggcaatatggcaaaaccctgtttctatcaaaaatacaaacagccaggcatagtagtgtgcacctgtggtcccagctatttgggaggctgaggcaggaggatcacttgagcccgaaggttgaggctgcagtgaaccacgatcgcgccactgcactccaacctgggagacagagcgagacgctgtctaaaaaaaaaaaaaaaaaagtacagaagcccaacaaagggtgtgttcattctctctggaagtgagggaaggattcccagaagaaagaacatttgacggagggcttaaaagtcaaattagtgttgttgagccaagggatgggaggactcaatatacacagagtgggcgccaggtgtggaggaaagttcttcacctacacggtgtggctggtggacagatcaagggtgctaggcaggactgaattctgcctgctgcctgtttgtgtttttaaaatagctttaatgagatataatttacgtaccataaagtttacctgtttaaagtgtacaagtcagtggtttttagtatatttatagaaatgtgcaaccagtggcccataatctaattttacaacatttccatcaccctaagaagaaaccttgtatctattaacagtcactctcccattccctgtgtgtgccccccacgacccggcactagcccaaggtagccactaatctactttctagatttatctgttctgcacattcatatgaatgggatcatgcaatatgtatcttttgtgtctagcttctttcacttagcgtaaagcacttgaggttcctcgatgttgtagcatgtatcagttgtttcattcctttttattcctgggtagttttcattgtgtggctataccatgttttgttaatgcattcatcagtccgatgcctgtttttaaagttttattagttttaaagccacacccatttgataatatgttgtctatggctgccttctcactactgtggcagagttgagtattgtgtcagagacctgcatggcctgcaaagctttaaatagttactattcagccctttgcaggaagagcttggcaattcctgtaatagaggatgaagacaatgaagggggtaggctggggctgagtggaagatgagactggaaaggccacgtaaggatttggacttaatcctgtggatcggcttctcaaagtgtgtgtgctgtgtgaagcccctgcatcggatcccttgatgtatagattcctgagcctccccctgggcttaccagctaaaccccttgccccacgcccttattcttaattccacctggacttctttcttcagtctctcaattcttgccactttggaagcccatgcttaggtcttagctcttcaccaaacccttgcctgattgctttaccctcctccatttctttcttttctaaacatcgctctgaatcttcttccccctaccacaacctgtgccttcccacagtatggaattatatgttttattgtattacttgctgctgaatcgtgtgtgttaattctgcacactcagctggtgagtggactgctttcgggcaggaactaggtcttgggtctttttttgcattatgcaaattgggttattgcatggcaccaaggatgttatttagagtataactgaaagtcttcttaaatgactttccttttgcatagtgcatctttatttgctttgcattctattagtggacttagtgtttggtccctaggcccctcaacattggagctaagcaggtgtcctccattttgtatgactgctttgatttacttttttaattaaatctcttttaattaatcttattttttactctaaactgcagatctttgttcagtcttttccctagcccatttctaaatctttgttacattcttctttactctgaggggttttagtcatctgctagtaaactagttagtcctttccgtcagctgggtaaaaagctataaatggttttcaactctatgcagctcccttgggttgctcatttgatctgagccaggtttgaagttgggccattgagaatgatctgtcctcatgatgtagggggtgactccagccaattcttaatattgctggaattaattaactttgattcctctaactgaaagagggcattttactctaccgtgtattattaaataccttataacttgatttttttgattttgttttcttgctcagtgagtacttaaaatatccctgccgatatagtaatttgttccctgtttaatatggctttttcctttgtttactctggactcaagtctttgtagcttgttttctaagtcagctcaaaagttgctggtcattggatttggcagccttttcaagctttacccaccagaatcctacaggaagttgtgtgtcggccagaagagtctgtttatttagagcgtggtgtccagcagaagcaatccatttatgagggtctggtcttaaagacacaggcatctgagtctgtgtttggaagacctgctgctttggcttccattgcagccatgttctccatgctttcctgtccagcccgccggggcacctcagtggcactgctggctgattgaaggagtccttgtctctgagctccttggccttgtctgaaaggctgaaatatcaaggcccagatattagacagggttctagtccaaagcaccctacaataatgctttgtatttatggctttttttttcacctgaaccacagagtccttcagctgaacctgaaatttgtacaactcttggaggatgaggggcaaattacaggtatgacttggatacttttgaagataagagagctaatgagatgaggtgttactgattctcactgtgaagcaaggacagagcccagctttaggatccaaggtcactaccatagcctaactcttgcccggagctgaagtgtccccttgtgcccattatggcttaacttctatttgttgatacatgtgtacacacatctgatccattttgaatttgctccagcaagtcggtgatgtggctgtcggttctctgtgcctagcactgggcttgccacaggttagggactgcatgcctgtggacccgtttacgtggaagctgcatcgatgtcttcttaaaaggtgagtccccctcccagagtgaggtgtggcctcactaccagtgatgtgagcacataccgaggtgccttgggggagaggggcagagaggtatagcaactgctgagaggcctgagcaacaaaaggtcgaaagtgagctgtcgtacctctcagccctcgccatgcccctggggtcttttaatgacctacagttggattttttcatgaggtggaagttatattgaaatttctgcctcagaatagttcctgaagagcattgactctctgggagtcttaggtaaatttaacacttaatgaaggtaaaaacaatcctttccacattcctctgctcctcctctcaacctcaggtcagtcgatgtgcaagcagtgctttccttgggaggcagcagtttctgaaggtaaaggagaaagccctggtccaagggagccaaaggtccgttgggacacacatgattccgtgttgggcacatgggcatgtaggtgtctcctagccttgccaagctgtcttaaattcgggcatcttccaaaatcaaaggcaactgaagagcttaatttccaatgatgatacattttgcctcagtcatctggccccaaaagacttctgggggccgatcaccctcccttctattctgaacgccctcatcccctagattgtcacttggtgcttttggccagggggctctgcttcttccttgctgcgagttcttcctgctgagcccagcatccccgtgagggctttcacgcaggcccttcattgctctcggtatgttgtcagcccatgtgttgcagtttatttttgattcctgctttcataaggtttgaagattccactcatttttccagtggttgttaagatagtgagaatctaaatgaaatggtaatattaccattgtgaacaattatttttctaaaagaatcttttgtgttcatttttaatgctgttaagatctaattcccagtattttatttggaagctcttcaaatttcccaaatcataaaatctttcaaagcctactccaagttactttttcttgattcagctctcctatttgcatttaaaataaaaaggccagcctatttccaaatatggaaatgatctatgtttattagagatcagcaaagtgatatgggcccttgacttgctgtgaggttttttttttaaatgtgttttagagcaatgtacaagggcaatttttcgtcctgttttgtcatgtgttcttaaatacatttcctaaacactttctctggcttggtgctattactgtgtatacgtcctacatatgtttcctattttttatgactcatacttacggtactcataaagatttatcctttatcttggctctgagtaatgagcccacttgcacatttccagcagaactgtgggttagggattttacatttcattctgctggagaggcctctggaaggcatagcacaggcagcgcagcatgttccttgtaggcagtactcacttctccctgagggaacagttagctcagtttttgtgaatttactaatttttgttctctagcttttcctttccctttgccctttttagccattttgctgtttgagtgaggccacacaagagcatgaacagatgaaacaaatgctctactcctttttgctgctgagtaactgtggtggaggaagaaatggaaataatgaactgaaacgatattattacatgtggcaacaaactcaggcaaggagtcttcttgggtccaaataaacattcagacccatgagactatcataggccatgggtggctccattatacttaaaagggtataggacaaggaccacagcttacggcatggcagcaaggcattcctccttgttgtgtgccttgtgactgttcacacatcagttcatcagttcacatagccatccagagctctccagctgatggctcaaatgccaggagatgagatctctgtgtgtgtgtgtgtgtgtgtgtgtgtgtgtgtgtgtgtgtgtgtgtgtagttctctagtttaaaagccttaggaaggccgggtgcagtggctcacacctgtaatcccagcactttgggaggctgaggcgggtgggttacctgaggtcaggagttcgagaccagcctaaccaaaatggtgaaacccgtctctactaaaaatacaaaattagccaggcatggtgacgcatgcctgtattctcagctacttgggaggctgaggcaggagaatcgcttgagcccgggaggcagaggttgcagtgagccaatatcatgccattgcactccagcctgggcaacaagagtgaaactccatgtcagaaaaaaaaaaaaaaaaaaaaaaagccttagacccttgcgggaactagtaggcaactatgtaggaatagttttcatggtactctgtctcataaatatgccccatttacaagaatcactgctctcagggaagcccccagatgtcacttcttatcagatgtcttaaaattttccagtcccaatagcaagctgccttgtgttataattgacatattgtcttaccagattaccagggttacagaattgagagagttaacagaagatcaaattctcatgtaaaagggaaaagctttgctcactgtttatccacacctgtacgttttattgtttttatttgtggtattcctgactgtgataggctaaataatggcccccaaagatatatccacgttctaacccctaaacctgggaatgttgcctttatatagaaaaagccttagcaggtgtgattaaattaagaattgtgagatggaggattatcctggattatctggtggcccctaaatacagtcacatgtatccttataagacagggatttgatgacacagacaaaagggaagactgtgtgaccatgcaggcagagattggtggtctggaacccacaagccaaagaatgccagcagccacgagaacctgaaagaggctgggaacaggttctctcctggagcctctggagggcatgtggctctgctgacaccttggttttggcctagcaatgctgattttggacttctggcctccagaactgtgagagaatagccttctgttgttctaagccacccagtttatggtaatttgttacagcagtatgggaaatgagcacacactcacattagtttgagttccatgctccctcctgtctccagtttgtttactcctgtgttccccagctctgtaaaggacgctaccacacagttgccagggccacagtccttggcattattatccatgacttcctgtgtttgctcagatgtcatatccaatcctatttgttctaccctaagaccatattctgaatctgcccacttctgaccaccaccttcggtctgacccaccatcacatttttacttgagaggcagtgggcctctggcccatccctcttaggagtgcaagatctggggtagagcgccagtgttggaagcctggctacactgctcatgagctgtggggctttgggcaagtcagttaacttctttatgcttcattttcctcatgtgggcataatcatagtatctacttcatagagttgctgtgacgattaaataattaaagcatgactggtgcttagaacagtgcgtggaatatcatcagcactccataaatgtcagctgctatcattgttagcaattaagatctattctctaagtggcagccagcatgatcttttgaaagacttccgtccagtcacgaagttcaccagttcagcttcctgccatggttttttacatttcaatgaaaatgcgcaatccccaccagagccctgaatgatcttttcccccttctcccagcactctcaccattgctcactgtgctgcagtgggccctgacatcttgcctcctgtccttggcatgggctctttgttttgcctgaagtacttctcccagttactcatgtggctgccttcacccagtccctgctttgccattacctccactgagaggccttcattgaccaccccatttaaaatagtcatagcaccccacaacagacacactctcttttactgttttactttaaaatgtaacttatattaccacctgatatttatttttaaatatgttcactgtctatctcttctgctagtatatcatcagtatagatgttttatctttagttggtattgccaggaattagaacagtgcccactacatagtaagcagtcaagaaacatttgtgaaataaacatttgcatgaataaataagtatgttgatgtagcagtttagcaaataggttaagtctagaaattctatatatggaagtttctcattaattatattttttgaagatctagttattgatattggtatgtatggcttgggcataaagtaatgtttcttaaaccaaggcttcaaggtatagaagacagcactggattgtgagtcttaataaaagacttccctcttttttggtcttccctctgttgtgatcttttttgtttaaacttgagggcaaatgtgtagacccatttggatctcagtttctttttttattttctgtcaatataaagacattgagaaaattaatatttcaaaataccaattgagaattagagtcaaaagcatttctggagttgttaaactacaaaatatccttaaagaaaccctcagcattcagtgaataaggaaccacctaagagctgaaatgtaaactaagggtgtctcatgtcttcttatgtgtgttttttttttttttttaacctagattaagtaggatttacagatctgggggcagatctggtctctgaatacttgggaaaatgcttttgagtttcattgcttatatcttactgccttgcacagtaaaaatttcatgattttccaaagagctctactgtttcgtcaggacagagtacatgtgaatctttccctgtctttcttttatttattgaaatgcagaagattagaagaactaattatttcagtttgttgagtggaggcctctctccacataaattagaaccaggcagttggacagtcagctgcagctgcctttgtgaactgggcaccggtgcaaagcattgcaggagtgaggagacaggcagccctcggagctcacggtcaccgtgcatccagggacaaagagcaacacctgtaacagaaagtacggagacgtagaaacatctcatcgccctaaatacacgagatagaaacttaaccaaatagatgtaatcaactacagctgggctgagataaacacgttaagtgctaagtaatcaggcatgttagggggatgtggggctggggctagggctggggctagagctggggttggggctggggctgggggaaggcattgctggaataattggagccaggtgtgcttgcctggtgctgctttttggaggtgagaaattggaaaggtttgaaatggggatgtggtttggcagagggctgaaaggagaattttccaagactaggggaggagactggtaaataaaatagagccgagttgagtatgaaatatgttgaggacagcaagtaccttggcagctgtgaaagcttcatctgatggttttgcctgttggtgttgatgctgggagaatggtcttcagctgaacaccacaggtcttcaaagccaggtgaattgtgacagcctgtgacactggaaggggcagtgtagacaggcctctgaagataaatgtttgtccccagatttccccactacagattgggagaaacctctagctttacctcacaatccagtgatgtcagctgccttggaagcagttccttgctttggcacttcctatgttcctatttttttggaaggtacctgccagggaggaaaggcagcgagcacaggtgattgagtttttgttcagagatttggggtaacctcagagtagatgtggtgttggggtcaggtgtggaatgaatgtggtcttcccaggacctttgtttgttagattcagaagtctccagaactacggtgagatttggggagcaaaacctgagcttgtccaggttagtggtgcctgaacaggaacaactagcaaagatgttgatgtttgtgctacctttcggccctcgtctttaatgagctccaaatcccaaaggtgaaggaaaagcagacaaatgacagaacaaccattagttcctcatgaggaagccaagtgtttggagggtcatgtatgcagctgccaccaatttgtcaccctgcttgaaaatccagggacctgtaggcaggaggtaatggcactacactgatcagagccaaagtcaaacgctggtaggcttctttccagagaattacaaaacctggcattttatttgtttttttcaacacccctggaagggagattctgttagctctgttttacaggtgtggaaattgaggctaagagaggttaagtattctacccaaggtcatgagctgggaaataattggtagaacctaaccttgaattcacaacacacttcctatagatggagttgacatgcactctgagtggctctgggcaaggtgggctttcccaaggcttaggcatttattcaataatgaaatcattatttattaagcacctgtttgtaatgtgtcaggcacagtgccaggcactggcagtcctgaccccctacccttgagaatttgccaaaggtaacaaaaacacagtggatagtgagttctcccttgctcccgctcccatttagatgatctcaagctctttactttgcttaaatgtgggcttagatgttgcacccagtgttgcgtgttgacttaatcatatgcaggtaagtctttgagctgcaatgaaacagccatcaggtaagagttaaatgtgaatagctgggctgtcatctataggtgaagagcttagaaagaggggcaggttagggcaccctgttattaacatcagctctgttctatacaaacaattctcttactggattacctgtgccaaaatattgctgaatagcttggaaacaggttagtattttgccctttagcaaaacagacaaaagaaagaccatggagttgaatttggaaaggaatcttggaaaatgaatgtttcagtacaacaatgtatcattcacatgcccagaaattcagcactgcagggctcctgctggcagaatcaggtgaactctgggatgcattctgatttggtcttgaattcttgcatgtcttgagtaggttgaaagttggttatttttgttttgctggcagtggcctttacttagaagtgcccaggagatattcttgggatagatgccaacaggctttgtgtcttttcccttcaattttataaaaatgtaaatgaaaggatttcccagcaccaagttgtggagctacctgggtattcaagtgacaggaagagttggttgttagggtggttaggaagggcttcttagaggaagcgtgcttgaactgagacctgaacggtgaaaaggcgtgaactatgccgagatctgggtgaagaagaggccaaataaagggcccaggccctcagcttggaagcagcttgttggagatgagagaggggccagtatggctggagtggagttagcaagggggagagtggtgggaggtgcgattggtcattgagggttggatcacgtggggccctgcggagtaagaagttgtttcttggcatttctttacatttctgtgttcttatctagtgattaaaagagctgaccctaaattctgaagacttggggagtccgtgtttgctaacaacggagaattggttctataaggagaaatgcgaatagttccactggcaagggaagtagaaactagattactagagtggatatttgggctctagtcccaaccatgccataaccagctacagaacttgggcaactcatgacctctttgggcttcaatttccttatctataacaaacatttggagtagaatgtctgtaaaatctcctttctcactagaagtcaatgattttattatatataaatttcatttttggttttatccttttgtttctttcagacttttaccagtgatcttacagtaaccaagtccactcactagttctgatttcactcttttctctattcctttgcttctggagtagccagtgaagtacttggaaaaaaaaatgtcaggagggaaagagagaatttcataactttgcacagtgtactcaacagtgcatatttaacacattgcctgttgccctgaaagaattcccaatcaccgcatgagtcgattgtgatgaccgagacttgttctcagactagtgatgtagggtttaaccaaaaaatgccattgtccttactgaggaggatttatcccatcaaaacggcatttgagaacctgacagtgggatactgttgtttgcatttactcttttttttaaatcatattttgatttattggaaacttatatttcaataaaaaaaacctgctcatctttcagtatcaattatacaactctctcattgaaaagtatatctaggccgggcgcagtggcttacgcctataatcctagcactttgggaggccgaggtgggtggatcacttgaggccaggagtttgggaccagcttgagaacatagtgaaaccccatctctactaaaaatacaaaaattagcctggctggtggcgcacgtctgtactcccagctatttgggaggttgaggcgggagaatcacttgcacctgggaagcagaggttgcagtgagccgagatcgtgccactgcattccagcctgggtgacagagtgagactctcaaaaaaaaaaaagaaaagtatatctaaaagaaattagcaagaccaagtatattaacttgtttttagactactaccatgtcaacacttcctattttaaaatgcactgtaaatcatggtttacccttaggattagctttgagtatttcattatttgttttgcttctgccaaatgtaaaagactaagtgggcacactgacccagaattaaagttaaggaaagcaaagaaactctctaaaacaaacattatttaatttttcaagccagcatttcaagacattttcacttgttgaaaggagaaagcacttctattttgttctctagtattcactttggcaggctaaactaaactttttaaaattgttccttttaattgagtacacagatcattttagtgtgacatggcatttatgaaattgataattcagtcacatcaactcatttattgagatacattcatttctagagatcttttgttttttgagatggagtcttgctctgttgcccagactggagtgcagtggcgcgatctcggctcaccgcaacctctgcctcctgcattcatgcaattctccctgcctcagcctcctgattagctgagattacaggcgcctgccaccaagcctaactaatttttgtattttttagtagagacggggtttcaccatattggccaggctggtcttgaactcctgacttcaggtgatctgcccgccttggcctcccaaattgctgggataatgctcatgagccactgtgcctggcctagagatctgtcttgaagacttttactgactctattagttgctgaaagaaccataggctctagatttataggtggccatagagatagagtctaaccttttcatttatggggagactgaagcccaaagtaagatacttaagccaaaaaaaaaaatcatttatttatttatttttattatttttagagacaaagtttcactatgttggccaggctggtctcaaactcttgtcctcaagtgatctgtccgcctcagcctcccagagtgctgggattacaggcctgagctactgtgcctaaccccctttttaaaatgaatgatatgtcaggatcttacattaggaggaaggcaaaattggggagcaccggggtttgtggtttatagtgaaagttaatttcctctgtttctcagacaattaactttttttctccttgagggcaaacaacaaatgattattttctagaaatcagacaatcctatttttgttctaaaatttcatgccaacaatttacttactttcttctttgaaaagaatgagagagattctgacctaaaattgtctgaaatgtgtactgaagatgctaatattgtattggtaggtcttgccaagatttaagagggcatctcagaaagacattgtacaccattctacaatggtaacttgttttcaccttagagatgataaagtagagggatagataagaggcttaattcagctcatttcttacacagtagagaattatggatagaacttacagacttttacataaaataatgtaaccaggacaagaattaccaggccctataagttgttccttatagaaatgctcaaggctcctagctcagttgcttaattcattgatagtttatggttataccccaaactcaacaagtgtttattgagggactatgacctggggacaaagccaaggaacaaactcctcaagtctaggagatttagggttgagggctagagtttgatttttctcaccatgcaagatattccttggtaattcagcaacaatctaaaggtaccctttagatcctaaacaaaaatgggatcctaaacaaaaatgggatttaaaattgttattagatttatgaatgatatgttttcttttgggcaagtaagtcaggtaatggaagttcatttagtgaatcagtgcagtaatgtggttaactaagtgacacttactaagccagaagttaatgtactcattatctatcaggaagcaaatcagggtctatgtctctgaaaagcaaatgatcgtctttcattaactggttaagcttggctttcaaggctcattgtgatctggctccagtaccctttcaacgacattcttctttattcttttttgtatttccttagctccgtctgaattaagtattcttcacacccactcatgctgcctccactgccctcctccttgtctggaccccttagatccacctttccccattcaccctctggcccagctgaagtgcccccttcctgctgcccacagatgtgtttgtatctgcctgtccctctgcccccatcaaactgtgaacttcttgagggcaggtattgtgtctgactcacatttgaagtcctttcattacttagtggtgcttcccaaatataagtttatatgtgctattagtcttcacagtttgtgtagtattcatatattatttgcattatttaccttttttttttttttttttttgagacagagtcttgctctgtcacccaggctggagtgcagtggcacgatctcggctcactgcaagctccgcctcccatgttcatgccattctcctgcctcagcctcctgagtagctgggactacaggtgcccgccaccacgcctggctaatttttttgtattttttagtagagacggggtttcaccgtgttagccaagatggtcttgacctcctgacctcaggatctatccacctcggccttccaaagtgctgggattacagatgtgagccaccgtgtccggcccataatattttttcttaaatctactcacttaaaaaatgactttagcttcatcctcaacttcctaaacatgaaatcatgtttttaattcctgtaaaaatatatatacataaagtatatcttaaaacattcttattatctccacactttgggaaggattgactgagtaaagtgctttacacatagtagccattcagtttctgaggaatgaatagtaaatgcgcaaaacataacatgagaacctcttttccctgttagtttagtaacttcacgcttattaacctagagataaaaggaggagggtgcagctagaaaagactgagcaagcccgtaagccaagccattcattcctgtctgtgaagcatttaggtgttagatattactaattacctcttatgcattgcaaactgctgggctagaggggcctatggaacaataaattttgtggattgcagagtccctgctgacttactgagtgagcctctgctgaaactccagaaattgtgtaagtggaccccttccccacaaaagattcagaaagcagcgcactatacatgggacacatcctagagaaaaggggtgtggtaagtatgtgtacacatcacatggttgttgttgtatttctcagtgttcctgtttggggcagtttaagttacagatttctcactaccactaagtgttttttaggaatgcattgtgtactgccaacataacagaggtctgaaggatttttctataaatttgctaatgggaattgtatattttttaacctaatttttgaggatattgtaagattactcaggtagaccaatttgagtttctttaaaaagaacaagttcctatatattcaagctatagttaacatagttaataattaaattaatcatactaataaatattgaaggctcttataaatccatgaagagatttctgtcttagttactatactctatatttgctgcttctatagagtgtagaaatagtatgctgtagtttcttatttattatgtaaactgcagtatagatttagggtggcagatcagagactagaacaggtgatttttttcatttggtgtttaataaagtttaggtaattttttcttaaatctgtaggaatcagtctatgtaagttcagcatgggataaagtctatttagggttttatgagaaaaatcacccactcttttttttttttttaatccagggttgggatcaacagttgttctagcatgggcagggtaacttgatataatggcatacatttttaccctggtctgctcttagagcaaatttgaaatggttgttttggaaaatgtgctatgagtttctctccagacctttgcaccagggcaggcagtccagcctagcaaatctttggcacttgatgcgcatctttcataacagaactttgatgctgagactcagtgtcttgaaatcagcacaacaaaatggtgcctgaggagcagtgtttactttgatcattcttcaacttctgtgccccagcctttcacagagcacaaattgctttaccagagttacggtgctgaagcccacgactgtttttgtagtctggttgctgtggtgatccttagccttccatgaaactcccatctctagggaaatagaaacctttgcagctgtctcggcctttttggttttgtatctggtggaggtcttcaccgagcttgttcaagcctgagagtgatcggtttgtgtcagagtaaaatacacacatggaaacagggcatccccttcaggatgtgttgtattaaaaaaaaaaacaaaaaaaacaaaaacacagctcccttatccttctctccaatcatgtggggcctttgaagtatctccaagtctggctagagtgaagtgagccttggagatgttgttggtcatgatagtgctgtgagtaagctttgggagcgtgactcaggaagtggggtggccaggtggggaagaaagagagtgggggcaaaggggaaggttaacagggcccgtgtgtgcccagagagaagttggtttaggaggagaatgtgggccgagtccaaggatgccagcagcttgatgtttagaggactatgaggaaacccgttttgacttgaagcctcaatggaggatggtatagacaagagcttccttccataggaaccaagggaatggagaatagcagctgtggttttagtgggtagaagtaataatagctaacacttagagagtgcttaccagatgccagtcactgttctaagtgctttcgacaaatgacagatttaaccctttgacatctgatagaatagatacaattattatccccatgttacaattgatgaaactgatgtgagtagagtcttaacatcctcgaggccctagggtgggtaggtggagagctgagattccaacctaatgcctggctctgagtcactgttcttaaccaccaggtcaaactgcctgtaatttagaaaggaaggcagagtgacccaaaggattgggttacgggagatgtggccaacttagaagaaaatgtagatcttggaagagatgaaattatgctttaaaatgtgtgtgttgattcatgtattagtccattcccacattgccataaagaaatacctgagactgggtaatttataaagaaaagaggtttaattggctcacaattctccaggcagtacaggaaacatagcagcttctggggaggcctcaggaaactttcaatcgtggcagaaggcgaagggaaagcagacacatcttacatggatggagcaggaggaagagagagtgaagggcaaggtgctacacatttttaaacagccagatcttgtgagaactctctcatgagaacagcactagggggatggtgctaaaccattcacgagaaactacccctataatgcagtcacctcccattaggccccacctccaacattggggattacagttcaacatgagatttgggtggggacacagatccaaaacctatcaatttcttcattcagtcattcattcgttaccaaatattaatgtaattcctgtaagtgctagatactggacaaggttctaaggtgataaaaatacaagtcccaccccatgctctgagatagtttatatgtacaaagttaatacaaggcagcagattctggatgctgtaagagatgggtcaacaggacataggtcagtaatatcctctggacacaaagtcttctattttttttttttttttgagatggagtttcgctcttgttgcccaggctggagtgcaatggcatgatctcggctcaactcaacttccgcctcctgggtttaagggattctcctgcctcagcctcctgagtagctggaattacaggcatgcgccaccacacccggctaattttgtatttttaatagagacggggtttctccatgttggccaggctggtcttgaactcccgacctcaggtgatcctcctgccttggcctcccaaagtgctgggattacaggcatgagtcactgcacccggccaacacaaagtcatcttaaagagcatggctttttttttttttttctgtgatccaatgtgaaaatacaaaacagtaattaatgcatttatccctccttccagaaagaattgagaagttactttgctgagtttgtatatagtttccaggagtaaaatagttcctgcctcttactgctatagagcagcttcccattctcctctatgtcccaagactaacacccaagattaaagatgggggtgggtaggtagggggagagacagacagacagacagggagagacattcattctacttccagcactgtcattttctagccatatgactttggcaagaacaccaatttctttacctttaagatgggagtaattagatattacgcagagcacttccttttgatgagagcagcaaatctcaacaggagccatggatctacctattgtctttccttaggagatgatgatgatgatggttattactactgctgccaccatgatttttaacaataatccaagtgcggtgtttttgaatgttcatgtcttagtaattactcctctctggatttctgatttctgctagcaaggtaacactgtactcctaaagaattccttaccagcttcaggttaatatactttctaagattgtactttagcccaggggaatccaaatgccatcctttgctgctgagagcatcttaaatcgctacctgactacaactgcattttgtggggttttgtttgtttgtttttgctattacaaattaactaactttaagatgctgcttaaacagaaatccttattgagatcttacagccataataggttcattgtccaacgtgcgtggcaagtcaatacactgagataccaggttgcagcagagacagaggtttaattgtacagctgctgaactgggggaaaactcaaatccatctcccacaggagtttggggttggagtttttaagggttttgggtgggctgaaatatggagattgttgatgggtcgaagagtgcagggtaaagtcgtgggacagggggatgaagaaactgtgttctcatgctgatttggtggttcctttgtgggagtctttaaactggttggtgtcagctgtcccgttggaattcaggatctgctcatgcaactctcaaacaaaacccttaggattctaacatcagacatcctatctatctataggagcaatggggatgcaaatggtgagaatctagtgctatgtgacttggttacaagaaactaggtcaaagagcagcatgttaatgcttaattatattttctgtccggaattcttgttaacccagtgaggacagcttcaatctctgactgcacgtagcaggtggaatgattactccagtactcagattttgtgggaattgagttcctgctatgcttattttgtaaatcagcttctaatgatcactctagtgattctctttattatgcagtttgatacatcacagtactgatgcacaggccattctaacattctgttgttggtaaagacatatacatgtgagcatactggcttactaaacaggtatgtagcaaagctaatttgaagcccattataaaatgtagaaattaggctaggtactgtgtggctcacacctgtaatcccagcattttgagaggctgaggtgggaggattgcttgagaccaggatttgagatcagcttggacaacatagcaagaccctgtctctacaaaaaaaaaaaaaaaaaaagaaaacaaaattagctggttatggtggtttatgcctgtggccatagctacttgggaggccaagacaggagattacttgaggagttgaaggttacggtgagctctgattgtgcaactgcactccagcctgggcgacagagtgagatcttgtctcaaaaaaaggagaacttgagaggaaatacgtttgtatagcacatagttatatggggctttggttacatattagtgttaaaaacaaaaagtgatctgaatggatgtatttattaaatgtgacagggaatatatatatataaaaagcaaactttccctccattttaatcaatttgcaaatattgagtttcttcagtttgtctaaaattttaatttctaatcattctaacacacttaattgcctacatgcaaacccgtgtaaaattctatgcctctaaaagatagtggaatatttgctcaaaatattttatctttgttatctatccctaaggaagaaaacacgctccaaaggttttttacattttatgtgtttttatttgcgtaactgtttaagataacaaacattttctattttcttttctttgccttttatggttcccatggatggcccaagtgccattctacgctgtcttacacacagagaggatgatgatcagggtggcttgtcctacaaagcctgggagtggccttggcatgctgtccagcataccttccaggaagcatctccgtcatttgtttcagtagctggaatctgcttatcttgactgtgtgttaatgttctgtttactatatacaccccaacccccttgttctggccagaaaaacaggtcaatatgactctgtaattattatcctagtcacatttcattaataacttttgttcgttccttcttttattccttctttcagagaacttgtggactgcctactagatgtcctgccctgtgctaggcctaaggatgcagaaatgagtgtgactcagtttctgcccttgaagaatgacctgaggaatttatactgtgacaggggggacaaacatccaaaccagggcgtccgatcttttggcttccctgggccacattggaagaattgtctcgggccacacataaagtacatgaatgctaatgaaaactcatgaacgaaaaagaaaaaaaaattgcaaaagaaatctcataatgttttgagaaagtttacgaatttgtgttgggcctcattcaaagccatcctgggcagcatgtggccgtgggttggacaagcttgatctaagcagttcattatagtgccaggcagaggcagaggtagaaacaccagtgctgtctgagagagctctggctctgtctgagggagggggaaagattttactggagatggcattgtgagctggacccacaagtccatccggagcactgtggtgcactttaggccagaatcctgcaaggctgcggtgtgttagtgatgtacacagtaccccattcacacaacctatcttaatgccaaagaatgatagaaaagtgcctgtctgtgtcctcagacttgcatcagtagtggcctgctgagggcactagcagcgttcctccacccgaaccacccacacatcagggtctccgctttgcctgcctctcttctccgcagccgggggagctgtggctgctctgggaaggaagggcctgggtctctggaatctccttgcaacggctcccaggacccctttagaaggtcatgacctgtagtttcataaatactcctctgtttatatgagctcttgcccctcaacccccaacccaaatttagttcccagtatttttccagggcatacaaaatatggagcagagcttatttctgcatcccgtttcagactttcattttaggttttttttttttttttttttttgtctcttttgtggttatattagatgattttcagaggctctcagggaatcctgaatcatgtccttgttggggggaagggagattagttttgaaatagactgacagtgcccctctcagcactttaagtggtttcaagacaaaaccattgggaaagagcttgataccatttgaccaaggagaatggttagttgagtgccccaggtcaggatggggaccctgggtgtgtgtgggggggaatgtgtgtgtatgtcaagatttcttgaattcagcaccaactgattaatattcttctagaaattcagagaaatataaaaataaaaaggaaaaattttaaagctccacacccagttctctaaaaatattttgagggaatctttttatgccaattcccaaatggtgaaggacaagcaatggtgaataaaatatcagctgtaggggttccttagatcagaatatactttaaatactgcagcagcaactaagtaaatactgttcccacccctagcagtcagttgcacattttagatccatctggggtcaggtttgagttcctaaaagtcatattgcccaaatgtcagtgaaatttgagttcagtgggaccctagtgtcctgaaataggtttgtgcctttccatttgtgggtgcaaagtgtgggtgctgggagacccagattcaggatgttttcagttactactaacattgttgccaagtgggatgtctccttacccctgaagaggggacagatgatggctatatacagaccagcatgtgattttatgggtcttggttgtaggcacgctgttggagttcttttcttatcttagtgtaaactgattattgaatcatccatttcagagaattatttggtctggttttagataataagagtttccctggtagtgttttggatgacttcattgcttcatgaacagcccacaggggctgttctaagaatcagaaatgttgaaatggacctcactgacacgttagcaaaattggacagctgttagactagcatatcagttgccttgctcactttgctttttcgttcgttttaatgaaccccagaagtagggggtctaactaattcatattctgaaatctctatggtagaaatgccttgcatctatattatgaatcttgggaaattcaaaacaattttcataaggaatctttccataaagcaagtagggtttccccctcttcctgtaattcattttcataaagtaatctacagagtttgagacaatagatagtttttgcttatcaaagataacctttggagaacccagaagccttcactataacaaggtccagaaaagattgtccttgttattttctgctgataatgtgagcaaagacgttcttcccaagtgagagatagggaggtagtgtttccactcagaggctttgtgctccttagagttgtccttgactttgggcaaagttgtgttcagattccccagaaaaacactcagaagatctgctttgaatttctttataaaattgtatgtttgttgcattgcacaggtaactgcagaagacctagtatgaatagatgttgtagaacaggttagaccaattaactcttttccatttaggggaagaatcagcaatgtatgagggatggtgttacataagggatgtggcagatcagatttgcttgcattttctcacaccatcaggaataccgaatatccagcactgtttgaaaccagcatggttagaacaggaactcttggattaggcttcatggaccagtttgtggtcaaagtacgggtttcacgagaaactgcatgtgaaagtttttttagttctgagtcttcatctattaagttcttctgctgaaaggatgacatcttaagaccagcggtgtaatttgtagtttaattagatggatccattttgttaccattgttgctcttagaactttcttactcttttacgatggggttcttaatctgggttaatgggtgcctaacggggagttcatgggccctgcaatgaatgtaattccctgacattgtctgcaaaagtttgtgtgatatggatgttttttgtttggtttggtttggtaaggagagggtgcacacatgcattcagttctcaaatgttccatgactcccaaagatttacaaagaagccagtggtttcgagactggtcattgctgctcctttgagctgcatcccctttggttctaccagccttcacagcttgcatggtcccagtgttcaattccttattacttatcagcccatagacaaagctgttaacctgtatttttatgtgtaaatttgacataggattgatggtcaactctttaaactactgtttggatttccaagctggagatttctggatactctttgtatcatttcttcatgggatatttatttgctgtagtctgcctcagctcggcctttagaccatgagcactggagagtgtaaccacaaaaagcttcaggatattcttatatttgtaactgtagtctaccctgagctataattgatcctaaggaggattttctttttcttttcttttgtctttttttttttcccccaagcctgggagaaattgagcaacttagccaggaattctttgagatattgctgtgtgttctctctacatttctggaagcttttataccatggttcttttgttagctgttttggttgtcctttatcttcccttcagcaagatttactcaagcgggggaagcatagaaaagacaggttgctgagggattaggtgagcaggcacttgcaggactcattgtccctgccaaatgatcttttaaagaaactattgggtatttttctttgaatttcccaattgtagtgtgaattcttctttgccaaatggcttttggggctctgcctggaccctgtgtgccagagtcagagattcatcttggccagacactgccacatattgaagagggagctgtttccaggaaagctcagagagctgtggctcctagaaatcttcccttgattgtatgagccaggcctcagcacttttgaccatctggaaaattttggacctgagcaccaatatctgtctcatagatctttttcttctcatttcatgagcttttataaaaaattcttgttcatttgaaatacatacttactagtattttgtagtatatattttgaccgaaacttctgcatatctatgagctctaagaagaattgtatgcctgaggactgcaaagaaaatcttcagaagaagggttgatgcagcccctgcagatatacattactagtctttgcatcattatggtactcagtaaatagtcttgaataaataaatagagaaaccttttactgatacatgctattagtgaaagagtgttgctttgcagttttcaggtacactggaacaaatgatgatttcatccctccttcattctccatagtgtgtgtgtgtctctttgttcagtacagtttgaatctttgcttctgctatttctatagcatctcttcttctcagtggctatcaatctgtttatttctagatgcggacagcatctccaaagtgtgctgtgaggtagagtctttacaaccaaggagcacattactttgctgtagctgtacttgacatcactgttcatctagtactttgatttagtgctatgcttatgccagatataaaaatgatcctagctgtgtgcagaaatagctcatgacagttggagtattgcttatttttgtatttttttgcaaattagccagctaaattcctttgaacctttttttcccctttaggtaacatataaatatatgaatttgctgtgataagtcaatatttattgtgtgtgtttacttcccggccttttggctaagatcaagtgtattatcgtgtctatgttaagcacagttttttgtttgcttgtttttgaaacagagtctcactctgtagcccaggctggagtgcagtggcacgatctgggctcactgcaacctccacttcctgggttcaagcgattcttgtgtctcagccacctgagtatcaggtgcctgctactatgcccggctaatttatttttgtatttttagtagagacggggtttttccatgttggccaggctggtctcaaactcctggcctacagtccattttggaaattaagacatgcattctcaagctagtgaacaagatgatgcaagttattcatagaatatttttgtggcattgaaaagcagagaattaaaacattattttgacatttgctgagtgcttaccatgtgctaaagcctgggttttgaaagataatgaaagtttactgttttatttatcaatgacctgagagcatactatgataagtgacattggtcataagtggtccctacaaaaaaaggtagaagtatgttgagatcacagtgggctggcagccattgggaaaatgtgaaatagtccagcatttagtgctgtatccctgatggttgtatagacacagatcgtggatctagaccatgtcatcctcatgaggattctagctgagatgtactattattcccagtgcatcattcagtctgtgtctttctagcctaagtccttttttgtcctgtccctcccttattactttatggttatgtttgatgagttcactctgtttaaatatgtgattcttgggtcttgcctccccgctctgtatggaaagccagtatgagacagactgtatgaaagtatctagtcaatatttccttatatatccctttgttctcctatgttcatgttgccctgggctcatgtgtgccaagaggactttgttgagtccatggtttgcagctccattcacaggtgctttttggtgatgttaatgacaacagtgatgacctgcaatagtccttgatctgctgtcaaaattggttacagtttttgtatccatcccatggttttcttccctgttttttttttttttttttttttgacaggggctgtatacaatcactctttattctgtgtgtcctctgtgcttcatttctttggaaaagcccttcaagctaaaagctgagacaatgaaagccctggcagcctcccttggcagccgctttttctcagctttcggcacttttctttggcagaacccatttcactttatagaggttggagcttacctggaggagaagaaagtcatttctctggagatccagagggatgaccccaccccagggggattttgttttccaagtttcaccttagtcatttgacctaaagcttaaagcaggcctaagggaaggtaacttttgttccacctttgctgacttttagaaagaaaaaatgtgttctgtttatttgttctttggcagggagctaaatcatgctttggttgagattagtgtggttgactaatatgaaatagccattttgtagtaaaaaatggtcaaatattggcaatatcatctggttcaacttaatgtatcttattcatagaatctgagctacattatagcttgtttctgttgatagtgagttgcaaaaaaagtattccagaggctgctctgagtgattttcatggaaagccagggctaagatttctgccctctttctgttgcttcctaggtcacacttcacctgaatcccatctcctcagtccacatccaccacaagtctgttgtgttcctgctcaactccccacaccccctggtgtggcatctgaagacagagagacttgccactggggtctccagactgtttttggtaagtgcttaaacctcccccaaactgatccttagcacaaggacataatggtccttaaactttgccaaacttttcataaaggcttactttcactgaaataatgccagagtccaaagagtgttaaatttggaggatgcacttagtgatatttggatgatgacatagataagcattcacagaaagcagacacacccgcccatcttctgtgggcagaggctggggtctagtgcgcacattagagcaggacctgtcgtcatactctgtgtggcctgagctttggtttcagctctgaaaccccccttgtggcatcaggagccctgtaaatattgtaactggctaccgggtgtgtggtccctgaccacaaaatgaatatgcacggacccatactatttgtatataacacaggcctaattcctgatatgaggatctgtttgttgagaaagtgacacagtgagctccaaaatgaagtcatttgtattttattaaaaaaacaagctggaactcagctcttgtcgaaagatccaaatattacctactatttgtaaatcatgtccctttgagtttgccagaacattcaagtgtgctagttgtggagaaatcgatgggttgtttggatggaatttttttggtgtgatatcatgtctgatgatgagcagcactgcaacttggtagttgtaactcacattgtctattacgagagctgcaggctaatgtcctaactgcggtgcctgaggccttaaacctctcttgcccacaagcatccaaaacaagtggagtccccagttaatagttttcctcttgcctcatgaataaactttgcccagttaatgtctctcaatccagatctgtagtttctttcccctgtgtttgaagagtacttctaaaaactcaaaggttcttgttgaataatgtaagaatccatagtcaatacaattattataataagtacataaatgaataaaagggagaaaaggaaaagctcatctttatagtaaaatgccaactagaaaatctagaaggagcaaaggagttagaaaatgatcattttgcaaccatcataataaaagttgaccaggcaagaattatcaacagatgctaaatctagcagagatggagggagttcaggaagtagtatatttagatattcttaaaatatctttcatacaaattacttattaattacacataaaaaatagtgactatataccttggggatatcccatgataccttaaccaggtgattaaaattcatatcagcaatgtggggcagatggacgctgtgtgcctataaatgagagagaacacagcatcacttttgtggtatttttgccagaaatgcatataacctgaatctaatcatgaagaaacgctgacaaaaccaaattgaacgacattctataagataactggcctataatcttcaaaagtatcagtcatgaaagacagagaaaggctggggagccattccagattagaggagacaaaaagacaagacacatgtgatcctgagctggatcctgttgggtagggagtggggcagctgctataaaagacattagggggacagtggattgtattttatataaataaattataattgagcctatagattaaaatattatatcaatgttatattccttgaatttgataattatgttgtttttatgtaagagaatatccttaggaaacatacttaatactctttaagattaagggctaaaaggtcagatcattcaggaaaaaaacatgttgtatagagaagaataaagcaaatgtggcaaggttttaaaaactgatgaatctagttaaaagggtatagtagagtcctttgtactagcaactttgctgtaaatttaaattaatttcaaaagaaaacatttaaactcaaaaggtatatttacaaggtgggcattacaataactttattgtagccttttctgggaattgcaactcttattctatattaaaaaggccaaaaatcaaaaatcagtaattatttagttgttattactagcacatttatttagcacttaggatatttcaggtcactaaatgctctaatactttaattctcacgatagccttctacagtaccatagtgtagatcctttcttatagatgaagaactaagatttagagaagttaagtagtgggccaaatcacatggctagttacttgcagagttggtactcaaacctagatgggacccattctacaagctgttatgctaaactgtctgccttcgtactcataatcactgtcagtctcctctaattaaagttacttgtgatagtaatactaatggctctgatcataaagtcatatgcacatttagccctcatactgtagagctatactgtccaatactataggaaatagctgtgcgtggctacttaaattacagttcttcagtcctgcttagccacatttcaggtgcttagtagctatgtgaggctagtggctaccacagtgggcaggttatggaggcattatgagcaaaggcagtgcatgtcctggtttagatccaagcagtgaccttgggcaaattaatttctctaagccggatttttctcaggccctgcatcatagggctgttatcttgagtaagtgagatcacatataaaatgtttatagacatcacctgctgttgctgctcttatttatttctagtcacagtaaagagcatgtgggacgggtgttgaatttgcatctgtatttatgaaatatctagtttggctggccccagatcaaaaggggttctgtttctctgggctataggtccagatgaaagtgtgggctacgtatgtcatagttgtacttatcgctgcctggattctttcttcagtctgccagttcatgggttttgacggaaagtgtcttactcttagttattaatttgctttaattttgcttaaaatctgtaaaaactgcttcttggtcatcagtttagacactaacaatgaaagaaggtggccgctttagtaaacaattgaacgtcagccccatttggatcaatcccatgtaaggagattgcagatcaagtaatgagcctaaaattaccaacacgtgggaggcagcatcaggagaagtcaaggatttaaattccaggacacctgaactctgctttgttgtccagcaggcttcctttagggaaaacggtttttttcccgtctgcacatttcttcttggcctggaagagacgatggaacatctgttgttcattcacgttctcacatcagcagacaacgagtgatgcaagtccttgcacaagctgggccactctccttgggcaggcttttcccttcctctctgtggcctgaaatgaattttagtttctcctcatctccttgatagcctttgccacagagggtctggtgatcaatagaaatccagtagtgtgttctctttatccatttgtatagttaagagttaaagtttggggataagataactaaattattttatataaagtgttcatcaaacacttcagagggcccacgggatctctggaaattcaggcttcaccgttttcatcactgtcttctccgaggttacccagggagcctaaaggagctgtggaaagcgaatgggtctcttgactctcagtccacgatgcatgtatccttgcctgtttcctgatatgctgctggatggtttgcatttctgtctcagagctgtctactgtgtacgtagagttacagaacttttaactgtttttttttaaatagggcaatgagaaaagttcaagtaatagcatctactcatttatcagggtgacctttttatttaaatggacatgtctgtgttgttatgactgcccaaattaaaaaaggaaaactttcataattagttaggagggccttatgttacccaggacatcgcagccacccttgagggtgactgaaaacatactttaatactagtaataaaggcatctgtctttttctgtcaaatcatttcagtccttctcaccccctcacagcacaggcaagaagggaacgtgtcaggcagggagaaagtgggatttggttttctctgcaggtgcagctcctttatctggttattctggttacctaggaaatatgagtgggatgaagagtgatgctttcaggctgagtttcaagtagtgaatctttgagtgtgagtcacacacacacgtgatgaagttgtaataatcttatagttttccttttgcagggtgtatgggtggcccagagaacaatcagaaataaaaatcatcttaccctctcagtgtgccatgttgaaactgcaaataatctcttagaaggatcacataagcctgtttttatttatgcattcatttctacactgaaaaaaaaagtaagataacttaactgggtgatgatgcctgaaccttcaacctgaatttgctaaaatgagagccacagtatgaagttgtctttaaggacatactacaatttaaatacacggtttctagagaaaagacacaaatggccaaaaaacacatgaaaagatgctcaatatcatgagtcattagggacatgctaatgaaaaccacagtgagatgccacttcacactaggatggctttaataaaaaaggcgataacaagggttgtgaaagctgtagggaaattggaacacgcatacattgctggtgggaatgtaaaatggttctgtggaaaactgagcaaaacacatgtccccaagaacttgtccacaaatgtccaaagcatcattattcacagtaaccaaaaagtggaaacaacccaaatgtctaccaacagatgagtggatgaaaacagtgctatatccatataatggaatattagccataaaaaggattgaagttctgatacataccacaacatagatgggtcttgaaaacattatactaagtgaaagaagccagatgctaattgtcacaagttgtatgattccaatttatataaaatgtccagaatgggcaaatctatagaaacagaaagtagattagtaattgccaggggctgatgggaggggaaaatggggaatgactactaatgatacgagatttcttttgggaggtgacaaaaatgttctataattacatagtggtgaatataccacaccttgtgaatacacacagaaacactgaattgtacagtttaaaaggctgaatattatggtatgtggactgtatttcataaaactagtaaaaacttgctgcagcacttttttttttttttttttttttttttttgaggacagagtctcactcccttactcaggctggagtgcagtggtgcaaacatgcctcactgtagcctcaaccttctgggctcaagcgatcctcctgcctcagcctcccgagtagctgggactacaggtgcatgccaacatgaccagctgattttttttggtattttttgtagagatagggttttgccatattgtccaggctaatctcaaactcctggtctcaagtgatgcacccactttggcctcccaaagtgctgggtttataggcgcgagccacagtgctgggcagggactaggtttttaaatgtatctttttactttattccatgtacctgatttttttttctttttttctttttttttttgagagagggtctggctctgtagcccaagctagagttcagtggcatgatctcggctcactgtaacctctgctgcctgggctcaaaccatcctctcacctcagcctcccgagtagctgggattacaggcatgtacccccacacccagctaatttttgacttttttttttgtaaagatggggtttcactttgttgcccaggctggtcttaaactcttgggctgaagccgtccacctgccttggcctcccaaagtactgggattacaggtgtgagccactatgcccggcctctaattttttttttttaatcttgctttatttgtattccaaacttgagcattctctcctgcaaggtctgtagacttggagccctaggacaagcagacgttttcaagatgagaccctagtgcctggcttttaataacctaaaatacctagtccagaggccttggccagcttacttatgtcaggcttagtcactttgcatgctcataaggaaaaaagggtatctaagattagaagtttcaagaaataagcagcttcttccaacctcattcactctcgatattactgtgctgtgatctatttttttctagccatttatcattaaaatcagagagcaaatgtatgtgaatgtgtgtatgtttgagtgggggatggggcatagaaggggattttggtctttgaggtacaattgctggagctggcatataaaaatagaggatgcccaattaaagttgaatttcagataaataacaaatcattttgttagtgtgcccatgtagtatatgggacataacatatactgaaaaagtattcattgtttacctgaaattcaactttaactgggtgtcctgtactttattgggcagctctactcggaggtaattcaggtttttgtttccagttaacaccctggcctgggtgttaggaggcctgagtactagtcttggctctgccactaactagttatatacatcatcgggaaaaaaaatcacttaactactcagacctcgtttcctcatttctaaaatgaggggatcgtactagctcatctctaaagttcctcccagcttttaaactctgtgattctttgatagtacgactgctagatgttatatcccaatttaatttggaacagaaactggcaaattgagcattgcctcttcagcaaatccaagtaaatatcaaggcagggcagttgcaataaatgacagaaactaaactctatgctattagctttggattaaaaacaaatcaaaacttaatcctaatgaaaaatgtaaattaataaatttaaaaccagttttgtattttcaagaagcggggagggatgggtgaagaagctggagctgccaacatctagtttattccttttacttaaactagaggcattaaaaaaaaaaaggtccaaatattttgggcctctgccaccaaaccacaggcagttctctggtctgcactggagtttggatgactgacaagactcagtgaaaaacaagtgctatttgttttcctgtgcctagtatttaactggaaatcagaaggctaaatttccaatcagttgctaaatagccccagatgtgtgctcagtgcagcactaggaagggacacgcacagcccataccaccgtgcatgtccagctgttaccttttcatgaagccaagtgatgtgtaactgagggttgtagtgtctgtccaaaaacgccctaagaataactcagacattcaagtttgcttgtggagaagggaactttttttaaaaaaaattctgtattctattgtgttacatttaaaaatctggaaataatttttttctttgctaatttccttctttcccttctttggcagttcccccacccccatgtttagaaaaaaacacagaattagcataccgggtatgatggtttatgtatgtgcttgttcattcatccaacacacagtttttagtgcctgactgtgaactgtgctagctgtggaggatctagggaaaactggggtgaattgcctgtcgtcagggagcttcccattgtgtgggagagctgattgaaaaattgggaattgcagtttagtgtgctaagtactattacgctaaataatagtgaaaattggagaagatgagaatagtagaaattggagaaaatgagaattctcttcttccaaatgcaatcaaggcagcttcctgcatgaggttggctctggagaacagcatgtggcaaatgggtcaaggttgcagacacaaacacagctcttggctcggccagaagcattacccctgtattccagggacccggatataccagtttgtgttttgcagtgaggtctttccccagataaattctctcttgaagggagattaaataactaaatgtttcaagattgctggtggttcttcttctttttttaaatgtctcttgtggaatgactcattgtgtcctgtgggatattccaagtggttgtgtaccatgcatttttattccggagtctgctcatctgttggttttgtggcttgtccttaagggccttaattatatgggtcttgatcctctcatgaactagggtcagtcaactaccctagttcaaacaagtcattcctgtttcctaggaataggagtttttggccctattgtggccattgagctcttcctaaatgtcactatggcaattagaacattggaaagagcccagtttcaactggtaaacctggtccagaaggggtttttgaaagactccctgggatttattctaacttgctaggttaaggctggtgaatgttgtgagtgagtgaatggcccgtggcccctgggagatttgcctgggtgtatttttcctgaggaagacctactgtccaggagggttcacgcaagtgtagacttttcctggctctggctggacttgcgtcatgtctgtgtgcaggcatgggttgcagccctgtgaaggctttgctttcattcaacaaattgaggtcaaataaactcactttcactgaggaggcaaggttggtgtttcttcgtgtggagtcccataacgtcttttaaggctttattgtctaaggctaatctggtaatcagatgcatctgcccttcccaagtgttgggcaattgtatcaaatgtcacatctctggtgccctttgttgacgtggtggccagcctccagagagctgttcggtagaaaaagtgactgttttgttaaggaaggttgcagaatattttatttccatgtaataggaggggaaagaaaccccaactgtctaccaggagactctgggaggctgacttgaaggctgtggctgtgccttgttccgctcataaattatagacagtgatgcctttggtaagggttctccacaggtgacctacactctccatctcagaaagcaactccaggatggtccaactccttcctggacacaggttgttgggtttatttgaggcaaattggttcttgcacctcgagtccacattatctaactctagcttggaagctacttctgatttcgcaggggaggaaggagtccctttagccttctaatttctgtgtctaggatagaatttgcttttctcaagatctgcttttgccttttgttcctaacactgtatccttagatgacccagggtctttgttgcaactgtgggtccttaatgccactgtgctagggagtcaccattggtttgcctctgccttgtcccactgaggtggtgaatgacacagtgtatacctggaagtcagggggtcatccgtctgccacctctagcaaaagtctcacagtccatttgatctctggcctttccatctttatcacagagagcctgttcttgagattctattggttctgggtgatacagatggcagagtgatgttcagagctgctgtttggagccaagcctgccccaatccattaaaacagggtttttatatccttttcttgcagtttgtataagaaggctatggtcctgccgtagtgaggaatgactcgtggcctgtcaacctcagcatctgtcagacaaatctcatggcccaatgtgaggatacatacacacatatgtgtatgtttaacaagcacttctagtgtgtgccgtgtgtgaggtactcttctgagtacttacatgtatgagcttagtcttcataataagcctgtgaagtaggtgcttttgttgtctttgttttaagatgaggaaactgagacaaagaggttaacatgtacctggtcccatagctagtaaacgggggctctaacccagggacagtgcttagtaagtactcagtaaatgttagcaataataataataataataataataatactttccagaatggtaaatggggacctcattgggaacagtcacactgctgactcgagggcatgactatgattttatctctaactctggcctccagtctggagccactcatgactgttccaagaacagggcttcagaattgaacctatagagccaaatcagggcatcgcatcaggtgagcaaacttcttgtttcagcaaagtgttttatgcatgacttatttcagtactgggatctagatcatatcagtatttcacttgaataaagattttaaaactgtttcttgacccctttcccaagagctttccctctggggtcccagttggagcgtttctggatcagctccaccaggatgccctaatatctacatctatcctgaaccctgtggggaccgtttgttaattgatgctaaatatgtgcagttcaaccttctttgctttgacctaggagaccaccttgatcatcttcagagacttcaatgtagactgcaaaatgggtgtggcctgcttaagagggctctgcctttgcttcagagctaattttaggaagctcaaggaggctccaaccacagttatttcgggctagaggcctcacctccattcttgccctccaaggaaataccctttagaactttttttcccaaactgttgttaggtctgtggttcctgggccagaatatgcagctctgtttctcctagggcttgcaccagccattcccaggagctatcagtcagcatttatctagagaaacagaaccagtcggggatatatatatgaagagatttattacaaagaattggcttatgccattgtggggacaggcagggcaatcaaagtccgcagggaggccttcaggaagggcagctcaggcatgagcggaagccgctgtccacaggtggaattttttcttcctcagggaagccttgggtgtgctcttaatggctttcaatggattgaatcaggcccacccagattatctgatacaatctcccttccttagtgccacctgattatggagtttaattgcgtctacaaaatacctcacagtaacgtgtagatgagtgtttgattgcatagctggggaagatggcctagatacgttgacatataaaactgaccatcacagaaatttttaagatccttgagcaatttgttgttgtttactctaacttgacttctagccaagtaattatttcgttgctttaactgtttcatttctatttctgtctgtcccttccattccgttcctctccactctgaccagcacagctcctgagattgctggggaagaggggacagagagggaaataacccaccaggagaatctctgcaagcagcagtgaagggtgggagccccctgctttgcctcactgcttttccttttcactctcctctaagcctggagaatgttcctctgtatttgcctacccagacttggtagaaagcttgccctaagacacccaggtctttgctgacctgtgagccagtcagttccctcaccaacgggagatgacctttccaggcagagtgtccaccttcccacagtggaaagagcatcatttttggagtccagcagacagtttgaatctgcactcatttcttgctaaaggtgtgtaatctggcactttatctaattgctcagagccccagttgtttccactatcagatatgaggattcagaatccatgtgacatgcacttaggaagtgtgcagcctgagcttttgtgattaatatcatatttcctagtgttttattaacatgaggctgagggatgtgcgtgtctaccctacactactgatttctgagcctggtagctgactcttccacagcgatggaatagaaagagctctagagtgagaaaccaggtctttggttctattgtcaaccctgttgtctgccagctgtgtgccttgggtagatcctttagcttctgtcagcttcaatttccttctctgtaaaatggagttgagattatcagccttgatgaaaaaaaaaactctataaagagaattctaggaacatgtttggagccaggcatttgtaaaaatcagtttttgctcttgaacttgacttggctgattggatgtaacttagaagaaaaaaaaagagagtcttccctcctgtggggttctccaggagcacatttggaggacaaaattagataaaggaatatggcaagtaatagtaatgataccaacattttattttttttcgtgaaaaacatcatttagattgaaatgcactttgaatttgggggtaagctcttccatcaggctaacattggcagatgaggaagggtaaagttaggagtctgaagaattttttgtaaagctggacaggattcctgtgtggcctgggactctactttggaaaactatattagaaagcagcttgtgcttcatcagtttggtaacttgtggggacttagtttgttttttagatggaaagacatcttttgcttctctttgtgtatatacacactcacatgtactgttgttctgataacgtttccatgggagatgagagtattgcttttgtactggctcatgttcaagtttgtgcatgtttgtgtttggagggcagcatctcagagctttcctcttggacgtgtgtaaacatgcagggtgttaagaacatggggcggtttcagtcatttaggttttttttatatttcagcaaaaattaagaacaggatgatcatcatgaatgttttgagaaaaagtaatagtcaaatatgttttaagtcattttattggaagaaagtaatctggtttggggtactaaataaaatcacccaagaatttttaaatggctgcatggatttgtgtttcatgaatgcatgattggcagataccatcatcacatggctcatgaatatgtagctttgcaaattatgaacctaggttcacaggcatggaagttattatttctttgaaatgaagcttttttaaaaggcattgagtcatgatatatgttaatagaaaacatgtttcggattgcatttcacatcacatggcttcagaggaaataggcaagtggggtcctcccaggaattgggtagggagaacgtgtgattttcctcttttaaaatgcagggttcagtcttcatttggaaggtaaatatttcagtgctgttccagtatgtttgtttttgctggactttgtgtgtccaaaatacataaaagcataatctttgtaatgcctttctgtgtgggggctgtgatgagttctagggccaatctgtagatcccacttaaacctcaactgagattcttgaggaatacctattctcctttaccgtgtgtcttttccccctggaactgagccagcaagttcttggcatggcaggtgtttctgaaatatcagtgtgtttttctttgctttctttgttttccttgttttgctctttctattttcctaagcaggcaactccaaaaagagatttgtttgtgcaggagtcaggaaaagggaagaggaatactgaaagctgggagtagggcaggacagaagagggggaggagtctattttcattgtgtaagtgttgaacttccaccaatgccaaagtcacggacatgtgtgcagttggatgtgcgagttagagcagccccaagggcctgtaacctgaatagcaggcactcacccagctgataactcaagttccaaatggaccacagctgagttgtaggggatgtgtgtgtgtgtgtgtacgcgtgcgtttgagattcctggaacagatttcctctgagatctcaacaggctttttcattatcattggggagctatggtttctcttatttcacaaggcccatttcttccttttgagatgtgcaaggagatgactccatccatgacttggctttacactctccctcttggctttttatcatcagtgcagaggagagattcttgctcgttcttcaaacaatctcattcgagctttataaagattattggagtttaaataatattcatatctatggcctagaacaatgttcctcaagtatgcgtcagaatcatgagtggtagagggaggattataatgtagtttcctacatttctacctcccaccaccctggagtctgcattttaacgtacttctgtctgaggatcagactttgggaagcgttgggcttgagatgttttcttgacattgatttatgttgagaccagaccaagaagcagatggatggacatgatcagttcataaacatgttcctttcttagggtcaaattggaggaggctctagagaagcactgtccaatagaaatataatgccaacaatatatgtaattttaagtcttctattggtgcatttaaaaagtaaaagaaggctgagtggctgggcatggctcctcgtgcctgtaatcccagcactttgggaggccggggtgggcagatcacctgaggtcaggagttcgagaccagcctgcccaacatggtgaaaccccatatctactaaaaatacaaaaaattaaccgggcatggtggcaggtgcctgtaatcccagctactcgggaggctgaggcaggagaatcgcttgaacctgggaggcagagactgcagtgagctgagatcgtgccactacactccagcctgggtgatgagcgaaactccgtctcaaaaaaaaaaaaaaaaagtaagtaaaattaatattaatgacactttgtttaacccagtagatccaaaataatatcacttaaacttgtaatcagtcaataaaaattaatgagatagggatttttcttgtgctaagtggtatgcattttacatttatataacacaggtcaatttaaccagcaacatttcaggttcaggtacttgatggtgccatgtggccagtggacactacattggataacagctgtagagcaatgatgccttcgctaaccccctggcagacacgtggttgctcatggcatttgttcccatttctccactgctcctgaatatgacctcagaatccttctcggcacagaaccttaggcaggcactgccagttaattggacatcaagatttgttttatttatcaaacaaatacttaacaagtatcttttttgtacccaacacttggggtatacccatggacaatgcacactaagatcccagcctctgaaggaaccttctagtggaaggagttgggcaataagcatattatatggcattttagaaggtgacaagtactgtagaaataaaatgtaaagtgagtttgggaaaatcagaattcctagagtggggctgggtggtggggttgtaaatttaaatgggcccattgagaaggtaacatttgaatagacttgaaggaggttgaggtgaaacttaagatgagacttaatatccacttttgatctagggtggcctgaagtttcctcaagacttcatctgggagcattctttttggggtaggggtcaaggaggcaggaggatggggatgtgtggcactatccacagcaagttcctctcctcaccactgaagactaaaccaacgttggggaggcccagagagaggctacaatgcaacctgccaggtggtgagtcagctgatgtgctaagtgctaaagcaaagaacctcagtgccaggaaaatggtgtctgtgctcattagctgggacttgtacacttcactcaggcttgggagatcaaccttgaggcttccgtggatccgctgaggactttaagagttaaagcttaaagacaggtgtggaaacaaagggctggttgcctctttggcttttttcatgtagttttggatgaggttgttgaacctgatccagaaaaaataataaacttggctgtggttgcctagccgtaagttcttataataaaactcccagcaattggcagatagagtaatgttctgctctttaaaaaagtctggtagcataacctgaatttcaaatacaaatgttgtgcatggttcaagtagggaggagcattcaggagagtccagggtgcacctcagcatcccaggatttgtttgactgtaaagtgcttcatggttccccttcaacaaacgtttactaggaattgggacccttggagcccagtgctctgttcattcccacaggaagacatttgtcatgtcagggaatgttagaggattgggttttaattagcaagcaggaggaaagttcattgggttgtggggaagacatggaattactaaatatgctttaataattggtttttaggtggagttattaggtgaaaaatcaaatcattagctttaaagcttggccaaaagctcatttcctgggcagtaagggaagcaatgagtttgggtaatgggaatgaatcaattatggtgtatcttttcctgtaggtaacaacattgagctttcattcaacaagcaattattgggtccttgcttcatgcccagcactatgccaggcccaagggattcagaatgaacaaggttttttcttggccctcgaggtgttgctctttgtcaaatgagggtggcaggtatgctgataaatagttgcagtccatgtgagagagggatggactaaaggtctgtacagtcacttgtgtgcagctcattgtgaggagagtagggagcctgggaggcttcacagagcaggtgatactcctgggaggacacagaacggtttgccatgggagcaaggtaggatagacgggttcaggcagggtgcagggtgtaaaaagacccaggagtgtgtggcagcatgatgtgttctacaactgtgagtagttcttgggtatgtgggagggtggcatgagatgagggcgggcagaggcacttcagtcatgcgccatgttaagatgcttaggtgccattccgctttatcatgtgtttactttttagaaggattacccaggtgacagtgtggaggaggggtagaaggaacaggaatagcggctgggagggtagaaagttactgcaacagtttggttgagattataaggacccaaaatgggacagtgttgtggcaagcctccagggataaggtggaagatggggcatggaataaatagtctcctcctctggcacacagctcctccaaccctcatcatctctgaagtgttaagtacctttttgtatgctggtgagatgactggtggctggggctcctggatagcctctggatgggggctggttgccaagggaaccaaccatgtgattagaggttagaactttcagcccacccctctgaaggaggggagaagggctggagattgacttaatcatacatgaccaatggttttatcagtcatgcctgtggaatgaaggctccctagaaatccctgatctgtggggtagggtttggagagctgctggttggtgagcatgtggaggtgccggggcgtgggggagtggcgctctccgagagggcacagaagctcctcaccccttccccgtaccttgccctgtgcatctcttccatctggctgctgttcttgagttgtatcctttatcataaatgaataaacttaaaagtatttccttgagttctgtgagccattctagaaaataattgaacctcagggtcatgggaacctatgatttatagccccactatcagaagcatctgaagaggggcagtcttgtgggactgagcccttaatctgtgcggtctgacctatctccaggtagatggtatcagaattacatcgaaatacacagcatcaattggtgttctgagttggagaattagttggtgtgggaaaaacacccagacatgcgatgtcagaagtaaactattgagagtggtgtgagcatagagaaaaataggttgtttttctcctatacactcttgcagttatcttccttgcagtgatgattgcaaccctttctcatattagacaaaattattttccctacatttcttatgtgttttgctattctctttatatcctatgttcttctacaagccagactctgataagggtgctatgccatgaaaattaatgcagtgtctggagcatggactggtagactagaggaatgacctggaaatatcttgtcttcatttcagcaaatgatatgatttgggtctatgtccctgcccaaatctcatgttaaatagtaatcctgtgaccgggcacagtggctcaggcctataatcccagcactttggaaggctgaggcaggtggatcacctgaggtcaggagttcaagaccagcctggacaacctggtgaaaccctgtctctactaaaaatacaaaaattagccgggcctgatggtggacgcctgtaatcccagctacttgggaggctgaggcaggagaatcaattgaacccgtgaggtggaggttgcaatgagccaagatcatgccattgcactccagcctgggcgacagagcgagactccatctaaaaaaaaaaaaaaattgtaatcccagctgggtgtggtggcttacacctgtaatcccagcactttgggaggccgaggtgggtggatcacctgaggtcaggagtttgagaccagccttgccaacatggtgaaacccgtctttactaataatacaaaaattagccggatgtggtggcacacgcctgtaatcccagctactcgggaggctaaggcagaataatctcttgaacctgggaggtggaggttgcagtgagccgagatcgcaccattgcacttcagcctgggtgacaagagcaagactccatctcaaaaaataataaataaaataaaataaattgtaatccccagtgttggaagtggggcctggtagtaggaggtgattagatcatggggatgggaagatttcctcttttgtgctgttctcgtcatagtgagtgatttaccacgagatctggttatttaaaagtatgtagcacctacccactccctctcttcctcctgctcctgccatataagtcacgcctgcttcctcttcaccttccaccatgattgtaagtttcctgaggcctcccagccatgcttcctgtacagcctgtggaaccatgagccaattaaacctcttttctttgtaaattacccagtcccaggtatttttttatagcagtgtgagaatggactaatgcagcagggttcttggcgggttgtagcatgatgcccttacaaagatgaggaaggttctgtgaggtcccttggtagttggctgaacaacctggaaccccagcaaggactgctaatgtgctcaggttagtgtgggagtgtacgtatgagtcacagacttcagccttgtcttggtcaacctctcagggatttagatgaaagtgcagaaggtgtgctataaaatttaattatttatagctaataaaataaggatttttacatggtctcttcagacttgaaatatgggtctgaagaataactataagactttgcatttattttgggagaattatgggtataaggataggatagaaaagcctcgaactggtgaaaagaccttggggggttaggtaccatcatctctaccatccttcctggtgtgagtgaccactgtttctcacctgaattattccggaagtctactaatgatctcctgctttttgtctccccttagactcaacatagcagccagagccatcctgcgaaaacatttggtagatgtttcaatagtccttacaacggtctacaaggtcctgttgggcctactggtctcctctgggacctgtgtcctaccaaccttgcctcagccctgtgtcctaccaacctcctctcagccctgtgtccagccacactgacctccttggtcttccttcaccatgtcagaccttacacttgctgcgtctcaactgtgaatgctccttgccctgatgtttgtgtggtttgttctttcgtctcctttaggtctttaacttctcagtgaccttattgtgctcctctggctgtcttattagactttaatctccataagggcagggaattttttctgtcatattctccactgtgtctctccactgtgtctccagcatggagaacaatggagtaggcaggcactccataaatctttgttggctctatgtttaaagcatagattagtttattaggctgttcttgcattgctaaaaagaaatacttgagactgggcaatttataagaaaagaggtttaattggctcatggttctgcaagctgtacaggaagcatagcaccaacatctgcttctggggagacctcaggatgcttttacttatggaggaagatgaagcaggtgcaggcacttacacatggcaaaagcaggagcaagagagagaacgtgtgtcgggggaggtgccacacacttttaaatgagcagatctcacgtgaactcaagacgagagttcacttattaccaaggggatggcctaagccattcatggggggatctgcccccatgatccaaacacctcccaccaggccccatgtgaaacgttgggggttaccattcaacatgagatttaggtggggacaaatatgcaaactatatcaattagtaaatatgagatcatagcagggttcagctgatgccaaagctaatgtggatgcttcatgcagtgttcacatatatagagaaagagatttattataggaattgtctcatgcaattatagaggctaagaagtccaaaatctgcagagccagtgccccagttccagttcgaaggcctgtaggctgctgtagcaccgggaagagctgatgttccagtttgaaagccatcaggtagaattcttacttgtgagagagtcagctttttgttctattcaggccttcaactgattggatgaacccatacatgtcagggagagaaatctgccctactcaatgtactaacatttaaatctcatccaaatgcatcctcaccaaaatacccagaataatgtttggccaaatatctgggcacctgtggcccagtcaagttgacacataaaatgaaccatcacagtatgcttctcagaccatacctggagaccttgaatcttgtcccgacaccgtctttcagagactatcctgttgacgctctgacaaccagggtatctggggcagaactgaagaagctaggggtgttgccctgaaaaagcaaacatgtgattgaggtcagatgacacctttaaacacctgaagtcttgtctcatggaagaaagacgaaggaattctttgttctagtaggcatggctcagactagtgtataaaaaatgaatctaacagaacagaaatctgctgtcttgggagctagtgaggtcttctttctggaagggtgcaagcagaggccagctgtgaccaggagtcagaagtcttaagttctggtctgggcctggtgcatgactctctggccttgggtaggccattagactctctgaggtttccgcttttctgctgtagaggtcaccgtagcctgcctcacagttccgcaaatcagatggaaataacatctgaacaataccttctaaaacaacaccttctaaaactcagctgtagccttgtcagggtcaggagagctggcagtcaggaggggagtgctagctcactccttgctgaagctgaaaatttccactgacctgcagtcagggacacctcactgcagctttgctttcttcttattggaatgtgcctgaggagtggcagttaactccagttccaaattcctcagccctgagtgtatgaagcttattgctgctggcccgtgaggacaacaatgcctggagggagcagagggagttgttcctcctccacgaatcagccccatcaccagcttcatcacggcatcgctctttaattacttcaggacacaattcggagttgccgttgatatcttctgtatttgtgctgtttgctttcttgcctctggaatgcaccagtgtgacatcccgctttccgctctgaaaaatgtactctgtgtataatgtatatagggttgctctagtttatggccacaacatgaatgagaaacaagaagcagaacatccagggtttctcgtctaaacattcagaactgtgctggcagtgggacaaaggcctctggactgttgtgggttttggtgacagccttgataaaaatgcctttttagtacaagtgaaaggaagattttactacagtgcaaaagtcaaaaaattagataaacattgttggaagttcagtgttgatgagtagctaagcctcagagaagttacacttaggtgggcatggttattttttggcaggaaaatgacctaggatttttttcttattcaggcgacgtcaaaacaaggttagagctacatgttcccctctggttttgtttataactggcatcaggacattcagaaatgatcgtgactacacttgacagcactgatacgtagtaagtgtgcagtcagtggtagctgttgtgagtagaaatggtttacaccgagtttattannnnnnnnnnnnnnnnnnnngtttacaccgagtttattagtgattaattcagggcttccacagagccctgtgtagttctacacagctaccactgactgcacacttactacgtatcagtgctgtcaagtgtagtcacgatcatttctgaatgtcctgatgccagttataaacaaaaccagagtggaacatgtagctctgtaccatctgtgtggcccgggcatcaggatatctagaaacttttcaggtgattctagttttcagcttgcaacattagtaggtcatggaatcaattaattgaagtacttttttttgccagcgtttttagaagatacgtttatataattgtatagaaaatattaatgcctagcacagtagctgggaaaatataattttgtgtgtgttaaaaatgctgctgtgatagaaccactaataaaatccctgccctcgacttgcttcttagtcttacttcagaaactgcatgcttttcgttatgaataaatggttcatgtgaaatttaatacaagacatttatagttctatgacctgagaatttgtgagccttcttgcccacattttgaggtttcactctgacattgaaaaaatcagttattttataaatgctagccaacaaaaatggcatgcatattttcaccagcaactaaatttgattatagcacagcaacaagatgatgattttcctcctttggatgtgttaattacacatataccatgatatgctaggtcagcagtggtctaaatacattcagcaagaatgaggtacttgcatacgtcatcctgaaagttttattagatcagtttaacagcctcttgacttcattatctatgggaatttgggggtcttacacaataaactgttacaaacattcatctcactcttatgaaatagagcaatgtgatagaaaggctggcaacctttggccatttttatctcagtgctgaggtgaacataaaccaagaggactctcgctgtttccctattgtgatgactctgttggcagatgctgcaactgtggaagacctgaaagtcgtgatcagttgctagcaggactttgggatcacttgtcttgatcctgaagctttttataagcccacgagaacattcatcaaggcttcccacttgacttgaaatacattcattgtaagattggtcttcaatttagatttcttggaaatagcagtgataattcttacgattactcaatgtgcaatgcagtccgtcctcacaaggttctttcagagttcagagggacatcctgcattggtagttttgcctttgtctgggaggactaggcttgggattattccttgaatccgctgcttaaaaacgctgatctgcttgtataacaaagggaagaggttcgatttacaagcacttcgatttgagaagtactttctctaattatgattcagctccggtgactgcaccatgttaaatacgcaattctctttcctctaggtgtctgagggttctgtggtccagttttcatcagcaaacttctccttgacagcagaaacagaagaaaggaacttcccccatggaaatgaacatctgttaaattgggcccgaaaagagtatggagcagttacttcattcaccgaactcaagatagcaagaaacatttatattaaagtgggggaaggtaaattttatgtggcttcagttaatgactgatttatgacaggcaattgttttcttttctgaaaccaggtggttagggcaaggaatcacagaattacagaatgttggacctggaagggacctgaggggtcatttggccccaggcctctccaccgccccccatattccctcccttcttttttcctcctggggaagcaggcctggttatggccaagtgaaacacagggaggagcagggggagagaggagaaggttgttgtgtgggatttagaagacacccatgcacagaagtcaaaaaaagtaagtggaggtgagaagctgagggtgtgggaaggaggtgatgactgatggagtggaagagctggcagaatgaatgggtcagcaggtggcttcctcttacctgtgttctgcaaacgtttgaagcctgtgtcagtttgtggtgctgagacataggttacattttggacaatagcaaaggaaaagtatttaaatatatttttagtacaaatgactattacaaggacaaattattggagaaaagaagtgtagggtcttgataagagattgcctatttaaatttccttgcattgcaaagggatagaaatatccagaaacccagttttgaaagccttttttaaaacaaaaacaaaaacaaaaaaccttctctttctttctcattctttcattctttcattcttttcctccctccctccctccctccctctctccctcccttccttccttcaacagggtcttgctctgttgcccaggctggagtgcagtggtgcgatcagtgctcactgcagcctcaacctgcagggctcaagtgattctcctgcttcagtctcccaagaagctgggactacaggcatatgccatcatacctggctaatttttacaattttttgtagacacaggtcttgctgtgttgcccaggctggttttgaactgctggttaagagatcctcctcccttgttctctcaaagtgctgggattacaggcatgagccaccgcacctggccagacctttttttaaaagtcattattttcagttgagtatatttggaacccccataagttactaggaaataactcttgtgaatgggtccttgttatagctggctgattgtgtgaacactgcgtttaaggtcttcagcatccagctgctttctgttaaattctacagcagctgtcacctcctcatagacaagacagggaagggtgggttagtgaacacttgatcccaactcttatttggatctgggctgctttaaagtgtgtgagagacagaggcaggaaaggtggacgtggacgtcggagaggatgctacgtgcagaagccatttcaggggccttcacgtgcatcccacttaaccccacagtaaccccaggaggaagatgtcatttccaccattttacagagggcttagtggagggctaagtgaacctgctcacatccaagttactaacaagtgacaaagccagaacacaaacccaggcttcctgactcttgagtttaatgcttgttgcctgagctgtactttaagtcctagccaaataagcataactcaaaaagggaagtggtccacctggatgaacatccttgtttagttgaggcagagagaaggggacttagaggagggctgggctcaaaaagtctaagtttgtttctgtactctcatgataggtagctaataacagaggtcaaatcccattgagacaaaatgaaaaatttcttttaataaagactctaagccctggccagcgggccgcgtttctgaagcagaattctagtagcatgaaagaatgttgattaccccttggaatttgttagaataagaaaatttgttataataacatttagaatgttggactgtgttctctcggcagtgcatgagcttctttctaagcacagtagtcacttaccctgagagccacgggttgtcacttaactggttcagcctgtgcacactgggtaggggaagccaacttaaaggaccttgtgtctggtgcagtaaaaactgttaactccttggtaacaccttcggaacccctgaaacttgactccagccaccagttgagtatgagtcaccgggccatgccgtggagagaggagcagtagggaaaggaggttccttggtgaggtcagtggaccataaagtgatatgtttatcaccacggctcagactgcactgagcaagcttcatcccccacttcccagaatccgacctggctctacctttcttgtacccagcgatcgcaggccatgaggcctggttgctctaacccgagcagttctcagagtgtggtttttgccccagcagcatccgcatcacttggggacttgatggaaatgccagttctcaggcccaacccagaccaactgaatcaggaactctgggggtgggacccagcagtcagtgtttcaatcagccctttaggagatctgatgcttgctgacgtttgggaactgctctcatctatatacccagaatgaaagaatttaagagttttgctcttatcccagctggtcttgctgcgaggcttcaagcaacattgacttaccaccagagcctcagtttccacagcaggaaaatgaggtgtttgcattaccccccaggttcattcctgctctcagagtatatccttctgtgtctcaaagtcatttgtcaatctttccctaaaatacaaataagcatgtgactccccctgcccccaaacttgccaggtttctacccgggaattcccctttgtggtttcctttctacttggcactcggtataagttttgatgccaggcattcggaaagtcattggggagcgggggagaaaccacacacaacaaaagtggtcagcttattcaacttagtgacaatggcttctgggactagagcccttaataacatcaacttttgaacaattagacctttcctagtggcttcacatgagtgaatattttgttatttgtctcaaatctcacatcattgtttgttaattcaggaaacctataccatatgcccactatgtgccagatacaagccaggcacacctatgaactggatatgccggccacaatcccaggagggccctagtctcttgagttccagactgtcctgtccctggcccatagacgctctttcttaattaaatttcaaccttgccgttccaatatcattttccatcctgtgatgtgggggaggcatccgcagggctgcagctgcacggtgtgcatacctcatttgctcatctggcaaaaccctcagcagatgtggagggaggctgctctagcagcctgagtcagtggagccttgagcttttctctctgagggggaggggaattagaggagactgcagagtgcaaacccaatgctctctcgcaacgagccgacaaacagaggctttggtcccctttgttctggggtggtgctgggggtgctgtggtggccagagccatgatgccccagtgtgtgctgcggacctcagcacaagggaggttgcacaagtggggagggggagggacagtatcaacccagtcttgggaccccctggttggattccttactccaaagtgagacttccatgtggacttgaaccctggcatcctgtcctcaaaatggaaaaggcagaagtctgttttatagtagtgccaggcctctgattaattatcccttctgaaaaaagcatgctacacctagaacttccttgacactggtcccagctgtcacactgccagcagtttctttcaagttctgttgaaatatttaagcccgtggatggaaatcccatcagccgccgtgctgtgtaaatggcatgtgccgttgtgggagtgtcttcagattctggtacttgcatcactttcccgggtggaggtggtgagcaactctcagcacagtgagataatgtttgcgaaagcactttgtaaactgtaaagtgccatataaacttgagttgtctgtgttcagattgtgagaaagagtgaaagtctgccttctttatttcccccaaattcctacctttcatcttcagagtataaagtgctgtgaggaatacatatgagggaaagattaattctacatggggtgtcggaggattaattaggtggttgcttctcctgatagttgaaataacaaatatccaaggaggagtgcatttggggatagaatggattgaatgttaaatacgctgaccatgaaatacataagtattggatttttagataggagatgcttggtagacagatgacagtataagtcaactgctcagaaaaggagtcatgatctaggtacaggttgaaaccatgggagtgattgagatcacctagaaaaagaatgagatagaaaggggattgaggaaggagctgagaagttcttagccttggtttatattggaatctactacgagcttttcaaaaaagaaagctccctaggccccgcctgggtgttctgaatcagattctctgggttggggtctatacagattctgagcagaggaggaaccagtggaagagatgtgaaagataggtcagaggaaacagacgaggacaggaagtatcacagagaacatgcaaggagaagatttagccaaaagaggcccctagttgggggctagtcaataggcggtcactggtgaccataacaggatgcatttcagggcagtggttgcggacttcacagacgaagaaccatcctttgagctcgtggttccctgtgtctgccatttgctcagtttcactgtcaccctccttcctttgaatctggttaccgagtacctcagtggtttgacagattgtcctgtgcctctttcagatcaagtgttccctccaaagtgcaacatagggaagaattttctctcactcaattaccttgctgagtaccttcaacccaaagcagcagaagggtgtgtgatgtccagccagccccagaatgaggaagtacacatcatcgagctaatcacccccaactctaacccctacaggtaagtgagtctaagtgtgtgagtgtgacaagagatgaaagtaaagatcttccttgacttgaggcagggagaggtgtagcccgtcctacaccctcccctacgcaggagggaagggagccattgatgcttcacgcaggagggaaggtagccattgatgcttcaggtgtgcttcatcagatgtgtttcacagaagctttgaagaacagagtaaaggcaccagtggtatattttatattctgcatctgtccctagatcccagatatttcagatgaattcctgaagcctgttccaaacttctgggtgttaattacaggacacagtcactcttccttcatctttatcacctctgactaaggttatccctgataggaaaattacaaaatatgccctattaatataattatcatcttagtaaccttctgtttttaataaagctctgtttgtggtgtccttagagcgcttaggcactcagagctgtttgcgttaaatctgtgtgtgtgtgtgtgtgtgtgtgtgtgtgtatgcgcatgcacgtgtgtggtggagtggctcttcatggtgccataccaaagagccattcgatagaacttgcctctcccttgtgtgcttggtgtgtgtgtgtgtgtgtgtgtgtgtgtgtgtgtgtgtgtgtgtgtatgctggagtggccctccatggtgacatacgaaagagccattcgatagcgcttgcctctcccttgtgtgcttggtgtgtgtgtgtgtgtgtgtgtgtgtgtgtgtgtgtgtatgctggagtggcccttcatggtgacataccaaaaagccattcgatagaacttgcctctcccttgtgcgcttgttctccctctcagcttcctacccctggattggaaattcgaccctccctatcaagaataattagggaattaaagaaaaaggagaaaaagtaggttcttttcccacatgagcctgcatttcaccctccttcctttgcatctggactagtgacttgaaaatttaaatgtatattgtagagggatttcgaggtgaaaatgctaatcggggtttgactttcaaagcgtgtaagctacagatcgttttgataagattccactctggccacttgaagaattttgtagaaagtgaaaagggaatgggaataggagcagtctggtgaatgtgcttcgacgtcaggcctgaggcttcattggagtataccatgcattttatgctttacaagtgtgtaaagctgagatggaaagaaagactgttcccttaaattcagaatgacagggatgttattgtttagtaaaaaattctcttttttacgaattcttagaagtttgggttgtgttcatcaattttccagtaatcacttggttgaccatctgttttctttattttaataaccttatatccagaagtttgggaaagtaaatgcagatacgattctgtagcaattgttaatgacttaagcaaaccttatataaatcaagaaattctttagccttttgtctcttattttactctgaagtttcctaatttttttttttaccaccatgcttcccttatcccaacaccccgcccccaactcaccaaactgccacctacttcagttttgaaggaatttgagcatattagccaaatgggaatcctgtacgtcgaaggtgttgaaggttgaaaaagcaacaatactgcttcaaaagtaaactcttctggttcgttcaagtccacttcaaacagtggctgcattaagtaaccacctcttttccatcaaagaagagaaaaactttagtgactaattatcagcaagcatatgtttctattgttatgtaaaacaattttgttatgtgtgcagtaacaatctgttttgcacatgtcattggcctgggatcaactccagctttttaatcaactggccagacactagaaacatgaagacttggaagaggggagatagttgcaactttctggcatgtaggtcttaactttgcctttgtcttccattcacagtgctttccaggtggatataacaattgatataagaccttctcaagaggatcttgaagtggtcaaaaatctcatcctgatcttgaagtgcaaaaagtctgtcaactgggtgatcaaatcttttgatgttaagggaagcctgaaaattattgtaagttggtggagcatgtcttttgttttgtttagataaatgacaacaatttaagctgtactttataagtgttatttttaaagttcctgcctctttggactctctaagctctgtcaattatttttcactttgcaaaatagcatgctcctataaaataggtgcggttgttcaaacatggccttggattaagacggacccaggtctgagtccaggtaatcccactgtgacctttggcaagtcccctaacctctctgaaccccagctccctcatttgtgaaattcctgaaatacattagtatgctttccactaatagtaagtgtaaagtaatgaacacaattaagccttcatattgagcatcccacaaggacctcagtgtcatagtaccgaatatcagcttttattttggagttaggtacttagagaaagtatggactattaggctgaccccagctcacatcattgacttttctttttgagttaaatacgaaatattggcatgtctttttgcttgcttccaactcctaagtgtgaaacactgatagaagaatcacagtaagtgcgaagtcagtgaaatgatgctggacaagtctactccagcttgttcccaaggccctctatttaatagagatgtacgcacaaggcttagcccattggcatgatgggcaaacagcagctggtttcctcaaaagttgaatgttgaaacttggtaaagtaaatcttatctcaaatatgcttaggcaataactatttgactgaattatattgaaagttaaagaaaaatcctcctccctattttttaagaagataattatctctttagtatctcttctatgggctcaaattttttttttttttttttttttttttggccaatctctcttttagttcctgcactgagtaagctgaagtgggttttatgttttcagtattttgggagagggatgcccttggttttggtattattcattcattcatggcaccttccatgtgataccacagtgagcaaagccaacagttcccttggcaacgtcatgtaaaagcactcaccagaggcagcaggcaaaaccactagcacacatattttaattttaaagtaatcgtttctggttcccgtgggttttttttttttttataactttgctaggatcccagtgagccatcatatgtaatggtgatacattaatttgttgtcaagcccaaagcctagccatgatctgaagtcagagatgttttgattgccttctctggcatggcatgaggggtgttggtgacctaggctgtctgctgcttttgctgcctggcacaccggccaaatgtttttaatttcagaataacaaaaacaggaaagggaatcatgctttgaaaggcaaaaacatacggtacattttaattccctgctggagttcttgtgtaaatattctttcagccttgacccttcgatggctctttccctgagtatgtgtgcctggtccatggcagtcctggagttcactttgaatgtccccatctctcatatgaatcagaaaggctagaaatgagattgctcatcccagtgcaagatctgtttatgttcctctccttggctgtacgcttgttccaggccaattttggacaatgcatgacaacattactaaacaattaggtaatgtttcatgatgttcttttttattctcccaaccagtttatgctttgtgattttctaattccctgtttcagatgtgaattctgactgtgctgtgagggaaaggtacctgctcccacaaaagtttaaattactatttagaaagggggcaatggtttatagaaaccttgtttctagtatttcctttagagacagcatagtgaaattgaaagaatcttgactttgtgccagacagggctagatttaaatcccatttccaattactactcctagtagatgttgtgcagtctgactgatgaacacggagtctgtttggtcacctgtgaaatgggtatgatgatagtactcaccttgagtttgtggttcattagctgagttcatttgtttgttcatttatttgccaaatacttgttaagggcctataggatatttcacctaaagcactggacacagggcctgcacatgtaagttctcagctacatgtgttgcttctgtgagtcttaggttctccttctctaacaggaatggtaatgcctatctccttatattttggaagagaaataagataatatatgcctagcagagtgcctgccataaaaagggggttcatcttccttccataaataactctttcagagtgtctataggaacaattagggcacttctctatacaaggtgaaaagaaagaaagatgtctactaagggaattgtaaggagtctgatggagtaatttaaagaagagcaccattaaatatggatgtcttatgcatgtgtgtgtcgggggtggggcatgggcagaatgtgtcctccagatggcaaaatggtcaaaagaggtgcaaagagccaggcagtgggcaagaatgggaacattggaggtgtctacattgccttgtccagctctggctcttttctcaggtcctgtgtggaccatgcataatcacttttatggtaggaagaacctctaaaacataaaaaaatagatggaggaaacctgttagaggtttcctcttatattatttcatgtggcctcaggacttcagggttgatgatgggcagcttgttcttagagaatacatttttaaaaatctcagtgggcatatgcactatgctctctggccattcccttccttagtcctccctcccctataccatcagtccagatgtaaatatgggggagtgtggaggcacttagacttaactccttatctttcatgaagatatggctgggaaagatggtggtggtttttggagacctccttgtacacctgcatttggcgtagctccactaaagctggaaaaagcctagggacttccagaagtacagtgtgagaatttgctcaaagctgggaaccaacttgtctgccattgtcccaagccttgctgctttacaaatgtgtagatagatgttgagtcttttaagttcccagacataatcaaaatgagatgtattgacagctcctagatttaatgtggaaaggtgcaaacagctcattccacattggtgcaaaaggacaggtggcagttatgatgatagtgttctggaaatacgatattttctcagctgtccaacaacatgaaagagactagggcagatgagggcaagcagtgttgtttaggccaattgttgtgattccagccaatcaaaatgacatgtagctctaaaaggctggaagaagctgtacctaagaaactactgttgactgaatgcataaaaagttctaagaataaattggatctttcatgatctcattttagctctttccttccttccttcctctttgtttctttcctccctagcccttctttaccctaaggagtttttttctgaattggagtaagagctaaaatattctgaatctattaaactgagtttacaaatggccgcagaagttggttaaagttctgtctggttcctttgcatatagaatttgtgactggtgagtctggcagtattcccacacataagcactttaggtaatagaaaaatatactgaatgagatcctttaagatttgagttgaaatatatgtggcttcagccaatatcccacaaccacataggccaagagaacttagagcctgtgaatcttttagggttttacagtgggaaaggattaatatttagtcatgttaggggcaaacagaatgggaaacaaatgaggaatttaggaaaaatgctgcatgcatgcaggagaaaatcactgggcatggaaattaaagtgatttttatacagcacgaaaatggtgtaatctgcatgctggaagggctttccagccctgttggtgcagttgttgaaaatatggtaccttccctttggggtcccctctgcagcatttagctctctcaccctctgagaagagcactgccacaggagtcagcaactgatgtataaatttaccttccatgtccttgttgaataacctggttgagtagagtccatttatatcctttcccaaaaatatttctgtcattttaattttgtaattgattatccagtgaaagctagtcttttttttttttttttttttttttttttaaggcagggtctccctctgtcacccaggctagagtgcagtggcatgactatagcttactgcaacctctaactcacgggctcaggtgatcctcccacctcagcctcctgagtagctgggactgcaggcaaatgccaccatgcctggctaattttaaaatttttgtagagatgggatcttcctgtgttacccaagctcgtctcaaactcttgggctcaagcagtccttccgcctcagcctccccaaatgctagtattataggtgtgaagtattgcacccatccctgaaagctaatcttaagacctacttgtattactggataaaacagtgatacttaaggggagagtaacctaaattaattaattaatatttagaatagaagatacaagtatattcagttagtagaattggcaaatgaatacagttatagaattactaattgatcatacattttagatgaaatataaacattggttgttttaccatgtggaatttaatagtttatatagatgggatagtctccacactgaagtacagtcttgagcatataatatggttcagtcagtgagggaccacatatacgacagtggtcttatcagattgtaataccatatttttactgtaccttttctatgtttagatgcacaaataccgaccatcatgttactactgcctacagtattcagtgcagtaacatgctgtgcaggtttgtagcctaggagcagtaggctgtaccatatagcctaggtgtgtagtaggctctaccatgtaggtttgtgtaagtgcactctatgatgctcacacaatgactaaatcacctaatgatgcatttctcaggacatatctccattgttaagtggctgtaagtgattgtgctatctttcattgaaatctaggggaataggaagtggaagcatgggaatttgagggcaatataacatgtctgtttgtatactttatatgtcattttaagtaaaaaaagggaaagtttattatacatatgtactgtgtgtgttaataatttaaacattagactaactgtacagttatagactaggcatacttagtatgtaactacttacatgtcattggatgattttttttatcagcataggcaatacaaatagtatgatcaagcagcatacgtagatgtcttttagtcggctattaaaggtttttcacatcatcgttcttagcccaaggaaaacaggggtcaaaagaataaataattccctcatatacaatatagaatctacttatttaagatatttaatttttattatctaaagtactgtttaattttagactcatgagtgatttttttgctatatcttcaggctcctaacagtattggctttggaaaagagagtgaaagatctatgacaatgaccaaatcaataagagatgacattccttcaacccaagggaatctggtgaagtgggctttggacaatggctatagtccaataacttcatacacaatggctcctgtggctaatagatttcatcttcggcttgaaaataatggtaagttagaagttttttaagttatgtaaaaaataccccccaaatgaagcttttccagtgaggaactgtcatttcagcttatatgttgctgtttttctcttgtacattttaataatttgactactttttatcagaaggcttaaaattacctagacagagattttgaggaaactgtaatacagattttcagtgacatagagttgaatgcatattcagagaactttgttataggttatctttagtgtgattacattaggttcttctctccgagacacctaatgaccacttatggctgagaatacagaagagttaagactgcaggaaagaagttcatggtaaaaggctgtatcttttaggaaaatagtcacgaggactcatacttgagtgttcatacccagaggatggcaggagttactaccccagctgaatggggtggaaagcagagggtcaacaaattcttgaggttttctggagtcttctagctagcatgacttgaaaccctagttttctgatccctagacctgttcctcagctcatggtaccaccactgagtgaaatgccaatagaataaggattaggagtacaggttcaagccccagctctaccatttagtcactgtttggggagaagttgcttcacctctgagccacagatttttcttcagtaataaggggaaaataataggacagaccttacagggttgttgtgaaggttttcgtgaaagtacaaattaaaaaccctacaaagctatgacttattttggacccttacagctctagcgtcctttccaaagaatattattaaaggagagataatgtccaactatcatcttcacttccagcttccactgagatggatttgacctcaagtgtacatcagttggccttagatagtagatataaagaatactggggaaattattatttttttagttgttagaaatacgacaaaatattgagtattgattgtatggaaatacgtctctccctttgaaggaataaatgtatctatgcagctatttcttatctttcaagggaatatgttccaaaaggccaaggtgcccagatacctgttaaaatttagctgtcaaaaagaaggtggtgaagtaattttaacataccaatattgtttcaagacatcattagagaaattattcaaaagactctcttgattcaaggaaagtattttagtggcatttcaatggaatattattgcatcatgtaacttaaatcacagatttttctagcttggacagccttagaaactgtctattccattggttctcagtcttaggtgcacattgcagttacacatggagagactaaaacatattaatgattgggtaccaccccagagagtctgagtttaaattgtttggggtacaacctgggcgtaggaatattttttaaagctcccaagtgattttcatgtgtagccaaagttaagaaccactgatcatttccaaccacttaatttaaaaaattggaaaagcaaatttgaggcacagagaagcaagccgcttgcctaaagccactgagctagttagagagaacaccaggactagaattcaggcttctagacttctaatgacctttatgcactgcttattaaaagtcattttacacctgcccattctatgctaattcctcctgttctgcctgtaatgatgttggttgtggcctggcatcaaacactgctgatgttttgccttcttctttcaccagcagaggagatgggagatgaggaagtccacactattcctcctgagctacggatcctgctggaccctggtgccctgcctgccctgcagaacccgcccatccggggaggggaaggccaaaatggaggccttccgtttcctttcccagatatttccaggagagtctggaatgaagagggagaagatgggctccctcggccaaaggaccctgtcattcccagcatacaactgtttcctggtctcagagagccagaagaggtgcaagggagcgtggatattgccctgtctgtcaaatgtgacaatgagaagatgatcgtggctgtagaaaaagattcttttcaggtcggtgcagctgattacaggagggaagagaggctacctcctttcccatctggccctagtctgcatctgtaatttctccctatctctttcatttttgaactccggaggcttgatactgttttctcagttggatgggcctacttccccttggctgtgattctcacctggttcctgttgttctcagtgacagggggtgggggttccagatccttgtgtgtcaatattttgctattgaatttccaaggccaacagatactacccttgagctgttgagaggtgggcagctgggaagagatacttggggaaggggcacgatgcaggcctctcatcgcctgtccttggaagaccaggcaattgtcaattgtgtcaattatacaacagaactgcctgtgggcctccaaccatgtctttggtggttgttgttttaggccagtggctactcggggatggacgtcaccctgttggatcctacctgcaaggccaagatgaatggcacacactttgttttggagtctcctctgaatggctgcggtactcggccccggtggtcagcccttgatggtgtggtctactataactccgtgagtgttttccagaacaaagctttgccctttgccagagcctggctgtgtgctcccttaaagttagtcttaacatttctttgaagatgaagagggttttcaccccaggcctgaagaaagccaagtgtcagttctcaacaaaatggatgtactttgaccctgagctctttggttttatttgttttattggtgagtctttgggaattggaaggcctgttttctcaccccccgtttccgtctcctgatgacaaaggctgcactgtcaaggtgattatgacttctctcagtgcccaagctcaactggcccttataaggataaaattttaaggccctgggctatatgaacgagcagcacctctgcacagccgggttaaccagatgtgtggtctctctggcctcatttgagtctcgtccagaagtaggagaacttctccctccttcatgaataaaaatccaaaaagagaatttaaaactcaaaaaggacctttaaggaattattaagtctctctccacctctaagaaagaccatacattgaagaaactctcctacttttgaagttacttggagaaagattccacagatttcccccaatgataaaccgttgcaatagctaagctgcattttccagaaatctttcttctcagttggtcaaaatcttttcagattaaacccattctcttgggtgcagagactaggcagtgaatattaaaagaatttaaaatgtgaagttccaaaagaactttaaagtgctgattttgcattttgggttttacttttaatggtaaaaataaggctcagagatccctgtgtccacctttgacacagggtgggttggggtgggagggggggtgtcttcttagtgccatatccagctttgacatggggtggctgagctgtggctgctagttcgaccccatccagagaagagaggctagcaatcaggtgctctggtcagcgtggttcctgtgggaagtgactctcccatgaacccaagcatattgttcctcagagaatattagactgttggagcagcaaataaccctaagatgagcttattcagcttcttcatttcacaggtgaggaaactgaactccaagaagttaaaaagacttgcttttttaaactccagggatgggctaatggcagagccaggacgactgaatccaacttcctgacctcttgtccactaatctttcctagacaccaggctaggccctgctaatctccttttgttactcaaataattaatttattaacctttgacctcctgataattgcagcatgaattttcgttcagttatccagtgtctacagatataatgaatgtcatatattactgaaatacttgattatggcattttaaaactggggtccaagttaacaccaaaagtggctacagtaatatgtctgttaagaaaaaataaaaaaaaaaaaaagtcagttgcttcaggagagaaaggcatgtaatgatcccttaaagttcctttttttctcacatatttttcttttctttattatgatctttgagtttagcaatatcctagatgcttcctttaattggcgtcagtactttctttggaggacctggtacagagagaaaggcagtttgttttttttttttaattttcttcccatcctactccctttggagactgttttagctgttctcaccaattataattgtttgtagtaattttcagacttactatatatttctattttgcatcatgttcagaatccaagcatgtgaagcaaaagaaattaggatttcatttatggcgtcatgacccttgggtgaattttctcatcctatttagaaataatccaggaatcataatttcaacctatgtcaagatagattccgggaatatatctgcaggtggatagcgaaaaaggtggaaaaaaaagattcctggaataaaacgtattcttttccacatccatacaccatagagaaagatttcttagggaagaaatgagcaaaagttagaggggtacaagagcggcaatgaagagatgtgctccatagtaaacattaggtccttcgctgctgactccaaccaaactttctacaactcttaaaggatatatataaccaaacattaggtccttcgctgctgactccaaccaaactttctacaactcttaaaggatatatataaccaaagcttcttgtattcgccaactgctagtagttcttagagtttataatataaagactcttaaggggaagccccttctcacggtataggcaagtctcttgacaactccattcaactccattctagtatctagtgttttcccaccatttgaaatcatttgtaattattcaatatggttacaacataaatatttatttttcacaagagaagatacaaatattagtttagcttttaacttgaacctgcattgggtttctccttattcttcatcactttgaagatataattcgaaaaagcctggatgttattttattattttgtcttaaagtcagattttcaatttgcatcagaatgattacatgagtgtttgtgtgaggcagaaccaaacacacatggtttggtgtttttataacattggctgtgctttctttgccttttagattgtgatacaggttccagcccttggggacagtagtggttggccagatggttatgaagatctggagtcaggtgataatggatttccgggagatatggatgaaggagatgcttccctgttcacccgacctgaaatcgtggtggtatgtgtttgttatcagtagggggtttgtggaaaatgctgtctattttgttggctttagttagggactatctgaaaataaaatcagatgttaaaagccaaagctcatgaagctacagggccttcatccttcatatgactgtcattaatcttcctgtgggttgttatttccagtttaattgcagccttcagcaggtgaggaaccccagcagcttccaggaacagccccacggaaacatcaccttcaacatggagctatacaacactgacctctttttggtgccctcccagggcgtcttctctgtgccagagaatggacacgtttatgttgaggtgagacctgaaagttagccttgaccttttaggttagtgctgggctatagttccttagacatcagctaaaataccctgtacagacctcttcctgtcctacctcacagaccttcaacaggtctgatgagggattggctcagagaacgcttccagactgacttctgaccaaagcaggaaatttcaagatttaatacattatgctaagtgaagacagtattttgtagatgaatgttaacaaaaaaaaaaattggcaagtgtgaattctactggtaaagccctgtcctttgcttttggaacagtagttcagtagttgcagtgttagagttaaccatggaatatttcaaaaccacctcatatgttatcttttatttctttttttttccctgcacagtccccttagcccccagcagggcagccaaatccctgtgggtccatgccgccactgaaactgacttgttatcttttaaattgcactcacttttaagtgaaatgctatgtgctattataactcatgacatttttttttctagatcatgatctgagtatctgtataaacttatttaaactatttcctatatataatgttaataatcatgtgcaacctaaatctggaatctggagtgactacacaatattaggcagtggcggtaataatgaaataacaacatctaacatttgctgcagatttattatgtgccaaacagagttgtaagtattgcagcagttagttaactctttagagccatcctataagggaggctaataatatcttcattttatggatgagaaaattgaggcacaaatttgtctgaggccacacagctggtactagtggagttcagattcagtgctcataggccgtgtgactccagagctctgactgatcttcgctggatacgactatcacttatctccaaagtgccatttgaaaggggagaaaacataacgtcttatcaatgcaaacatccaggttcagagagtggattctagaaaagataaatgtccttatggcaccaggatgtctgctgtttcttgtgccctgggtacaacctttcatgtttcaaccttagtgtttcaagtgggcatatcatctgttggtcttatgggaaggtcctcatctaatgagctggttttggtgctcagctgcaagctcagcttcatagtgggaggggtgagaagcttaaagggtcaaagtggggtacttccatatgttaaaagtgactttggtgcacgtgtttctgttttggaaagacacataactctcacattcgcactgactctgggacagagcccgctggcgctagatgttgttttccttgatcatatggattctgcccctcccccattctgagagttctctttctttgagcacaccttctttctccattggggaaaatatactgccttctacatgcttttcctaagccaagatggctgtttttctcttgcttttctggctgtacagttcacatgggcagttggtcaacagcaccctattgcgctgtggatttcaggggtgctgcataattgcagattgttcttttccaaatctatgcctggctttgctgatttatgctaatcagtggtcaatcttcctcctgtaccttaccctggatattttgggttttttcccccatccttcaaatgctggcttacttgaagtgtgttattggtagttttttttttccattcttgttttcccatttataccttttcatatatcacctatatttctcatagtttatcctctattccctctacaccatacagtccctttcataatccaagttaacagtgttgccacctgttcattggtcatctccaggtgactgttggtcacataatggcagttttcttttggttcatttgtcttggggaatttacaaacccagttgttaataacccaaaattttaaatctagaatactactattactaataggtagcatttattgacactctgggaactgtgttgtttgcatgtaacttttactttgctagttttcacaattatgatatcttgtgggtattcgtgttctcattctgtaggtgagtaaactgagtctcggtgcccagcacgtgagcaggagagcatgtaatttttatgagctcgtctcactacaaagcccgtagtccttctcctactcacttctggtctaaaagtaaaatcctttttagtaaaagatttgctgataatttatatatataaactatatatacataaaatatattaaaaaataatatatattttttccctctgctacaaaggtatccctttttgggataccttagacattctgccgctacatactttcttttgagattagagaagagatttgcagtccctctgttacacattttggcatgtggtttctgagttcatgttaaacggcagtttttagtaatagcacatatgtaatttgccacctttccaagatagaatatcttgtttttcagaagtattgcaaaaatactgaagtgttagtatttacagaatgtcaccacagtgacattatcagaatcctcttcattagcattttcactgttgagtgtcctgcagttaaccaccacgtaggaatctttcacaacagtgctgcggattcaaagccccatgtgatgtcaggggtttcccctgggtatctcagcgtggaaagtctgtttctatctccatgtcttttgaaatgattctgcggctgttggtctatgggtaaggactagctgtttctacaagtgtttaagtttattttgatcctaaatttagtcaaagaatgaggcatagcagggaggggcagttcatgcagtgatccacgtgtcaccaaatggagaatctcctctggtctggggattttagctaagttcaggatagttgaggtttgaattctgtttacacttggctaaacattacttcctgtttctaaggaaaagaaccttaacaaaatttggacgtagcccatacaagtgttttcaaagggggaagtataaatgagtcggaaacgtttccagattagatttcccctaaactacccctgggcttatggagcgaagggggagtacttggcaaggctgatttggatctgtgagcagctgggacactttaccaggcccatgatggcctccaggttgcaccgtcactgacacccagcgccggagccagctctgccttctcgccgatgaagcaggactctcatcaggcttactctgactttttgcaatttagaagctcagtcttcctgcctaggttaaatagattttgccgctgaactctattttttggtcagtctttaaaaagagcttagcttataagtgttgtactattaaaacattagggactttgcctactggtgttttatttacttcggaaaatccactttaaatgcaaaatatgtttttatttttagctctcagaggactcattgggaggtggaagagacttactcatcttgtatttgaatctaatggactaatatttgaaagaaataattcactgtcatcatctatatcaaattgaagtggaaaatatctttttctttcaacgtgtgtgtgttacttttgtaattagaaagaaggctataactatgttatgaagataaagcagcgtgtcatctgaagggctgtcttggcatatggtccttgtgcctaaagtgaaagtgagatgctaactcatttcctaattcatctttctgttctttcataggtatctgttactaaggctgaacaagaactgggatttgccatccaaacgtgctttatctctccatattcgaaccctgataggatgtctcattacaccattattgagaatatttgtcctaaagatgaatctgtgaaattctacagtcccaagagagtgcactttcctatcccgcaagctgacatggataagaagcgattcagctttgtcttcaagcctgtcttcaacacctcactgctctttctacagtgtgagctgacgctgtgtacgaagatggagaagcacccccagaagttgcctaaggtttgtgggccttcatccattcggatggttattttggcatttttaggtgaggcagaaaagtttaatcccaaggtcttgcaggttgaggttttttgttttggaactgcccaactgaaatattaaagtcactattagcagggaactgtgagttttatggagtcttagataataaatcctgacagcatgattttcttttttccatgcgtgctacttagtagtaccttacgagtgataaatcaagacgcttttccatggagggagatttctggctttatctttgcttttcagatagtttgcaggccaaaaatacagcaagccgaaaggacaagttcattgtgagaattaatttttccaggtcctgctgggactggcattgtcattgttttttaaccttttctgtgtgaaatataaggttgacttgtctcagggagacttctaggggaaactaacaaatattttagcttttctcagtttcatatcagttcatcatatttgcctcctgtcactctccagattgaatgttctattgccataacaaaaagcagaaccatttgaccttggtggaatgcatttgataggggagatctgcaaggttaactatgatacccactaggttggtcttgtatatgaaaggtatcttctgccatagttttgtttctgtgatctgccataattatgtataatttcatatgtgcatttattctgtggctatctcacacagagtaaactgatttccagtcctttcgcagtcatatatcaatgtctaaaaggctaagaatcaagcagtattattaataatgtatgtatggaattttctcatttaactcacagattttaagtcttaggtatggaggtaggaggaaaaaccaccatttccaaatagattacaattgatctgaattccttgcatcattatagtcccctgggcatccttttctctgataacacccaagagaattttgtttgcatacgaaaatagagcagatatgatcataatcattggggagcacatatacagtgatttagactatattcctaggtttgcttttgcggcggtgatgccttagccttgtaggcattcaccatcagggttggggcttagtggacagtggtagagagccatgaggagcttcatgtgtggctgtgggaccagctgcttcctgtgggcagaagggtaacgtttaagggttagaggtcttggaggggagacctagcagttaccagggatctttgctgtggctttggctgttacttctctctgacctggcctggaacagcccagcttcatgtgtgttaatctgggaaaattaatcgtaaagagagttctaagcctcaggggatgacatgatgggatataaccctaaacctcaagtcgccctttacccccaaggtaagataacatggaaagagcctgggactgagaaggaagctctgctgccaccaatgggactttaagccagtctctggaccccttagagcctgtatttcctcataaactgttataatcatacctggcttccctcctgggtagaggagcaaataggacagtatgtacaatgacagccctttatctggcagaggcttggatgagctgttaccactgtctttctgtttgctgcttataggtaatattttcacatttctattattttctgagtgctttctgtgacaatagagagcgccaaagaatcttctaggaagagatctcagagattgttgagaccaaccctgccctttgctgatgaaaccgagacccggagagcagagtgtcttgcccagggtcacactccactgagttaaatgcggaatcatagactcttgcttaactgaagagctcaataggaaagtaacagtaaactaaaacaggaaagcaaaatgcaactcttttcagtcatcatgcctctccacagaaaatttgttgtttttctttacaagagggctcttgttaaaggcttttctctttttgagggggtaagagtagggcagtgagggttgtcttataagaagtgtctgactggcatgttgctcagagcagcaatgacagcaaggcctaaagtctttgctcttttgtgtttggaaaagatggaacttgattagctttttgggatgcctgctatagacttaaaatgatggctgtattaatatgtcttcttaccatagaagctgtcatttactttagagttatacctattaggctgggcgtgggctcatgcctgtcatcctagcactttgggaggctgagcttggcagcttgctgggagttcgagaccagcctggtcagcatagtgagacccctgtcactactatatatatattagctgggtgtagtggtgcacacctgtagtcccagctactggggaggctgaggcaggagtatgacttgagcccatgaggccaaggctgcagtgagccatgattgtaccactgtactccagcctgggtaacacagcaagaccctgtctcaagaaaaataaaaaagaactatacctattgataaatatagacaagaaaacaaagttattttaaagaaaaagtgcggagtgtgatcatattttttcaaaacagatgtagtgggcctgagcatgctcattaataggtttgaagcggctaatctcatggcctccacaacctgggcacagcccccaggatctgcattttgaaacattaaaagcagatgaccctggaaagtttagttttacatgagcctataccaggattaaaaatgaaacaaactcagcaacatgattatcttattggagaaaaatgtaaaatctgtcaccttcataatgcagtatagacagtccccatacaaccattctgtttttcaatctaagtattcaataaattatgtgagctattcaacactttgttatgaaataagctttgtgttacatgatttttccagctgtaggttaacgtaagtgttctgagcatgtttaaagtaggctggactaagctgtgttgttcggtactttaggtgtattaaacacattttcaacttagtgatattttcagtttacagtgggtttgtcaagatgtaacctcatcataagttgaggagcgtctttatgggaaatttcccacaatcaccaatcacaaacatgaaccgtgtatatgaagcccagcttggtgaggaccaacactaggcatatagtttttctgtttttcaaactaacactaaaatgtttagttttgtgagaagaaggggagggggaggacaatattgagaagctatccagtgatatttgcatcttcaggtacaaccaaaaatccactgggcctgctgtcatatctcccaggttatttggtgttctctgaaaaacacccaccttcttgcttttctgtagtgaacagctgtgtgctgtctgataaaaggccacaggacagctgtgcaggtagagctggtgaaggcacttttgagtggcccctgattctgtgctttgttctgcctgtctgcagtgtgtgcctcctgacgaagcctgcacctcgctggacgcctcgataatctgggccatgatgcagaataagaagacgttcaccaagccccttgctgtgatccaccatgaagcagaatctaaaggtgtgctttgggaggcacgatcagagcatggggcctgagctctgcttgttaagaagacccaatagtgtaaatcaaagtccagctttattcacaagataactaaagggccagttagttactttagaagaccattttttgcccgaagagtcttttctttagctggttctcttacagccattatggcttagttgtaagtaatctatttgaaaatgatttcctctgtaaaaagaatcaggtctaggttgttcctgtcataaggtcactctcccttgcattcaaatatgcttccttgagtatgcaaaaaagggttctagttagtcccatgtcccgggaattgcacacaatccacagttcatctttctgtgatctactgctaaagtttatgctggctataacctattgtattgctttatcaaaattgcagatgcctttgagaatatgtgaacattattcatcttaggtgtaacagatgagaaccactgcccaaatgcatcttaaaattcagttttcagaattttgcacaatcacatttgttgcttggagccaagcatgcctctttctccacaagcaggaacattcagcaagctgtatcttctgtgagaaaaggaaggctgtgccctaaggggtgtggcatcagtacctgagaggacaggcagggcagagccagacctggcatgggtctggccagccagagcagtagagaggcagaactgggccctaacaaatgttaggagtggatatgaggccctgtgggcggtgagaagagcatctgacaaggacccgcatcacagctccaagggttataaacaagcaaggacacaccaggcagctgtcagcatctgaggggtggaaccaaatgtcacatgggatatctaggcaattacagttgtcaccatctagtaacattgatatctaagggtgtcaaactgagagaaggctgggagagtgaaagtggattccaagcggggttagatatttcaggattagagctacaggctgcctctcgccactctgaggggcacagaggagcctgggcaccaagggccttgacaaaagccagcacactgtctggctccagtttcagggtattagctggaaggcctgctgggtggtgctgacaccagatctagggtttggtgtggccctgggatggcattcctgatctgagcatgttggattgggatttggcaagactaggcagcaggggtgacccctggacagtgggcagaacctaccagaacagaggcatgcaggtactgtctagtgtcttattggttgactaacctctgtgaaaacagctgtgccattccaattgtgtatctggtggtggcatctgcccccttcctatgaatgaatgtgctccctcaaaatggcagaagagtataggtggcaggcacactggattggagctgggagcctaaggcactgcttttagctttctctgctaactggctgtgggacattggagaacccccctaccaccagctctttgggtttcattttctctatctggaaaggagaggtttggactgggtgacttccaaaaggtcctttcagttgtaatactcaactatgctgtttgaagaagcaaaataatctttaattcatttttctggccgtcctaaagttgttgtgaagtgtacatgagatgttctcggcaacatttttgttgttgtttgttttacttttattgattggttttcaaccatttgaaagttataatagacccagtctttatataaatggatggtccaaatagttcctttttattgggttcaggagaaagaaataagaatataaattgtgttgcagagtaatcacaattgggcagcagctggctccattttgtactatgaaagtgattttgttaccagaaaggagtcccaattcagaccccaatagagggttcttagatttcacccaagaaagaatttggggatgagtccacagagtaaagtgaaagcaagtttattagagacgtaaagaaacaaaagaatggctactccatagacagagcagccccagaggctgctggttgctatttttatggttatttgttgatcatatgctaaacaaggggtgggtaattcatgagctgtcctagaaaggggcaggcaattcccggaactagggttcctcccctttttagaccatatagggtaacctctaggctttgctatgacatttgtcaactgtcatggtgctggtgagagtgtcttttagcatgctaatgtattatacttagtgtataatgagcagtgaggacaaccagaggtcactgtcattgccatcttggttttggtggtttttggccagtttcggctggcttctttactgcatcctgctttatcagcggggtctttatgacctgtatcttgtgaccttctctcccatcctgtgactgagaatgcctaaactcctgggaatgcagcacaataggcctcggcctcattttacccagccctattcaaggtagagttgctctggttcaaatgtctctgataatttaacaataagagcagctacctcggattccatctgttactcgtaactattttgagagaggtaattctgctagtaattgaaggcagcggcttgctttttcccatgccagacaataattaggcattaatattgccgcagtataacttccagcaattcatccattcttcttttgagcctggtgacatttttctaagtaatttctcttgcaaattaggtaattacttttatttaaacttagtataattgtactgaaagttcaatgttttcttgtataaaagttcaagaggaaagttttaccaaatatcaaagcaattttatgagatttgctaattgagactagattttagttgagaagcatgtgggtgaagaaagtttattacttaggtttgttaaataaattgaggcggttaaactgtaggccagcttcccaggggctgtatgcaaatttgctttctaactttgcgcttactggggtaagttttctggcaggtttcagctgtgtgtgactcctctcaccttttaagtttattttcttttgactctaaatcatttatcctcaatgcagaccactggagtctgtgctttctgcctcaaggtgaattggaatagtcatttgaaaagagactgtgggctgggcgcagtggctcacgcctgtaatcccagcactttgggaggccgaggcgagtggatcacaaggtcaggagttcaagaccagcctggccaacatggtgaaaccctgtctctacctaaaaaaaaaaccaaaaaaattagccaggcgtcatggcacacgcctgtaatcccagctactctttaggctgaggcagagaattgcctaaacctgggaagcagaggttgcagtgagccaagatcgcgccactgtactccagcctgggggacagagcaaaactctgtctcaaaaaaaaaaaaaaaaagaaaagagactgtgaccatttgcctaattgcattggtttatttgaataataacaggtcacgaatgtccttcctgccagacagctttatgtctctttattgtagaatctgtgactttttgggtaaaaatttcctaaccaatgggacgcttcactgtgcttttactacacaggtgctctttgaaggccatgccaaaactccagctctctctggtcatttggttcatcttatttttcaacacttggattttctgggacagcagataaaggctctggttggcaacttcacagctgggcagagagctgctctgtggccaccactgccaatagcattgacatactttagtgtttcttctgtggacaggaaagtaggcaatcaagactataaaaatgtttctggattcctcctctgggccactgtttttaatggaaccttcctgagcacatctttgccacttttgatctctaagtcccttgggaatcagtgttgggttagcgttcttttaccatttaaatttttaacaatagatgaaagtttaaagctgatggtgatgatagtgatggagatgaggatgatgatctaacatttgttgagcatttactttgtgcaaggctctgtgctaaatgctttatgtggattattatattttatcctcatagcacctctgtatagtgataacttggccaagggcacacaacatataaatggtggatctgggattcaaattcaggcactgtgattccagagcctgtgctcttaaaccctatgccttattccagatggaggttgattctagtttttactgaaaactagaatcatgtgcatctatgtcttcacacccctcttcctgccccacttctcccttttctttctttctttctttctttttttttttttttgagacaaagtctcactctgtcacccagactggagtgcagtggcgcaatctcggctcactgcaacctccacctcctgggttcaagcgcttctcctgcctcagcctcccgagtagctaggattacaggcacctgccaccacacccagctaattcttgtatttttagtagagatggggtttcaccatgttgcacaggctggtcttgaactcctgacctgagatgatccatccacctcggcctcccaaagtgctgggattataggcatgagccactgcacctggccctcttctcccttttcataccatatcacattagtattcaaggtaacaccccaaataccctaatgattatgaactaaaaggaagatgaaggattttaggaaaaatgtctgttcacccaaaggattaagatgttgggaaatgtgtaacctgtttagcagagtattaaagttcaggagaagttctgtgattttcagtagtaactcagaaagcccagagaacataaatagtttatgcatattatggtttatgacaaaacatttaaaatagttgaggtggtgccatcctaccctattttctgaaattttgaagtataggcatattagtgctgtttgccttggattctgtgaccgctttttacagcatttgagaacacttgggcttatacagtaaaaatgattacaccacgtcggtgatgattttttttaaattgtgaaagagaggagtaaccatttctctgaaacagtgcacatacacagaagagcatggatgtggatgtcatcaggagcaataaatatcattccaaaatttgccgtgatttacatacctatagatgtgtttaattcttagcaagttaaatgtttgagatactgaattttctccgtattttcaccacctaactttaaaaaataaaaatgcctgcatatcttggatactcagtaaatgttaatttcctccccttcctctcaacctctcagcaaactagaggttttttgggaagggagggttgaggaagggaaagttgtgaacgtcagttggaagttgatccaagagaggcattactttttggaacacatttgatctttccagaataaaaatactctaaaggaccagccaggttttgtcctcgagctgaggtcgaggtgaggggaaactgagtggaaagatggtagaaatgcttaattgacagaccagggcattcattctctatccaagaagggaaggagggatatcatatttttttttttaacatcgtgtattttacattatttatttatttaattttgagaaggagtttcattctgtcacccaggctggagtgcagtggcgcaatctcggctcactgcaacctccgcctcctgggttcaagtgattctcctgcctcagcctcctaagtagctgggattataggtgcctgccaccacgcccagctaatttttgtatttttaatagatacagggtttcaccatgttggccaggcttgtctcaaactcctgacctcaggtgatctgcctgcatcggcctcccaaagtgctgggattacaggcctgagccaccgctcccggccagtattttacattttaaaacctttttattttgaaaaatttcaaatatatacaaaaatagaataagtctcaacaattgccaatttatggtgaatcttgttttatcactttctgtcatccactggattgttttgaaggaaacccagacatttaatttaatttcatccatacatattccagtatgtacctctaaaagttaagaaccatcagaagatctcaagcaggaaactgatgattaggtcatttatttttattttattttattttattttttgtatttttagtagagacggggtttcacagtgttagccaggatggtcttgatctcctgaccttgtgatccgcccgtctcggcctcccaaagtgctgggattacaggtgtgagccaccgcgcccggcgattaggtcatttaggaaggctactctgaaaatggtgtgaaggttgcattgctggggaaagtactcaagaataaaatatacgtgatatttgtggttatttattcaaaaaaatatggtaggtgtatagtggacaaattatcttgtctttaaggcctttacagcctagtgcaaagtttctcaatctcagtacaatcagtgtttgggctggaataccctttgtagttggggggctgcctgtgtgttacaggatgttaagcagtgtccctggtctctacccactacatgctagtagcaacaccctcccaccaccagcccagttgtaaccattcaaaatgtctctagacgtttccaaatgtcccctggaataaaaatcacccaccacgtgagacacactggtctagtggcaggatacagataagtgaacaagtaattgcaatgaatatcataaatattgaaagaatccagaaaaagggttcagttacagtgacgttaagttagtaaaaactctgtcttaaatggggcctgcacaaagacctcctgagtctccaggaggaatcttcctctccccattcttctctttgccaaatgccaatagatgtgggtaccagttggacgtcttgtttcactgtgggcccactccgtcctatggtgcctagtaccaaattgagcactaaaggccaaaagctgtggtcagttactcatgcataaccccagaaatatcccgtttatgaaaaccatgctgaacaatctgaagaggggaattttggttctagaggtagaccaaaatttgctcagcgtatatgaaaagatttaattcagaacattgattatagtttgtcctttctgtaaagaaatctttattgttacagttctctttacagcaatagctaagattcctttcttataatcttaatcttatccttaaaccaaaagtaaatattgttgagtccactcttttcctctcagcatgccaactcgatgatagggttccggtggagatcaagccattttagttatactcaggggttcttagggattcgggaagagaaaagttcgaggatagaattctttaacctcagttctgcagcttctgcttgttattgtttgtgctcagaaatcacgaagagacttcacccaggggaaatgaacaacaactgtttctgtttagctctgtgagaaggctcctatttggggtgggggtaaaggattagatcataacagaaatccattaagaattttaaaacaatgccatccatcacacaggccttactataaaacttaaactcttacatgggaggtctccttaggagagagtcataatttttcaaccgcttggggattctgagtgagaaagtttaaccatgggtggttgattggatggaattattcccagaagtgtgtatatttcttacatgatgcatcttgtagcaacctttaaatgcctttgaacttagttcagggaatcaaatactacgtcttgaaaggagaagtttgtgggtagatactcttccttcatagagttcttgggagtttaaaatgagacaatataagtgaaggccgaaggctttttgtctattgcaaaacaccatacaaatgtacaaatgtaaggcatcattgttgttattggtgccaatgaggctgatgggacccagctcccagggtagtgcattctgtagttagcgtaattagtgtgtgttctgcatactgaattagattttcttaaaaacatacaatcatttttattttcttagtaattgtatttaagtatacttttgcatatatcctcattccagggccactatgttgcacaactccagggggcaccattcaattgtggtggctctgattcatccagtagcattccttcccctagagccagacattgataactcatgtggccagaatgttgacccacccatcggagatggttaatcctgagaatttacaattctgttttcttttatcctgtctagcttctttatttttatagacatcaattcagatgctgcttgtttgggtcacattttcccaagttctttttgcttccctgtgaattcagacataaggtgtgtgttccttctgtggtgaatgaaaatggagatgaaaagagaggtgctaaacatgtatcacttttaaactccaaagagtagggtcaaggtctgtagcaggactcagcacactttttctgtaagggaccagatagtgattattttttatttgtggctcatacaatccctgtctcaacaactcaacgctgctgttacagcatgaaagcagccatagacagtatgtaaatgagcatagctgcatccatataaaacttcatttatggagtcaatttgaatttcatataattttcacgtcatgaaatatccttttttgatttttaaaaaatcatttcaaaatataaaattcattcttagctcatgggccatacaaaaataggtggtggaccataatatctcaaccgctggtctcagcctcactgctgaggataatgagtagctgtgcacaaatagttacttcatcagtgcttccccagctagggacagagctacgctcaccagtcatttagcctgctaggcagaactctggaattctgattcaacttctgccctgatgctttccagctgtgaccttgggctctagtcacacgatatcagagtctcaggctgctcatttccaaaacagtgatacaaaatttttttctgccttcttcatggcactggtgcaaactgcatatgaacgtcttcatagtctgattgctggtttcctctgtggcctccatttgcaaaaagtacattaacattttaatcatccttcaccaaacatttctggaagacctattctatgccagtctgagcccttggggatatacagatgactgagaactagaccttgccctcacagcaaaaaaaaaaaaaaaaaaaaaaaaagcaaaagaaagagaaaaagagagagagaactaggaggtattgtggcccaagtgtaacagaggagggatggaatgagcaagggtgggagagactagctctgctgggatggagatggaacagtgggagactcagcaaaggtcccccagagaaaatgccaacaaagcaggtctggggaggagggtgtcttgggatggcttgcaaagcatgatgacaaagagcagcatagagaatttgggaagcttaaattactaagtatggggagcccaccatgggtgaaggactccatcaggaaaggaggctggagagagaggatagagaagggagggagaactttgtgtgccatgttaaagagtgtggatttttttccctataaaggaaggagagtcatcaaggggtttagtcagggttataacatgatcagctctgggctctagaatattcactctgggggcaaatgtggaggaggaaataattggggggagggtagtggtggagataagggggcctctgtgataatcctgatgagcaatgaaggggagttaaactataggataatagcactaaggctaggagaacaaagatacttttagaaaatgtgtatattaaattaaaagaatattttgaaggctgggcgcagtggctcgcgcctatagtccctcggcctttgggaggtcgaggcagatggatggattgcttgagcccatgagttagagaccagccagggcaatgtggtgaaatcctgtctttacaagaaatataaaaattagctggtgtggtggcacatgcttgtagttccagctactcgggaggctaaaatggaaggattgcctgggaggcggaggctgcagtgagctgagggcgccactgccctccagcctgagcaacaaagtgagaccctcaaaaaaaaaaaaaaaaaaagaatattttgaaagcagaataatattagactacactggaaaagcatggtacttaaaggtattgaatttttttgtaagtaaataaaaagatatacacaaacacacacacaaattgtcggacccaaattccctaagtttaggtgtttgccttcaaattttcttcaaattggagagcctatgcaactgattgtcaacaaaatgcaatgcttaaaatttctgggtaactcattatagttttgatatctaaagaggatcattgacagagctttctcacagtatttattaccaaatggaaaagtgtcagtttctgctgagactttgatgaccctttgcttaaatcttggttctccatagaatacattgtgatttatgtttttgtttcagaaaaaggtccaagcatgaaggaaccaaatccaatttctccacgtaagtctttatgcaactatttcgaaataaaacctcctgggctttcctaagaatgagttggttagtgaacatttgccaaactttgagttttgataaggagacttctgctctcattcccccttcccccttcccctttcccctttttgctcatattttttcctttcctctgtcctttgtttatccctgctttctttttccctttcacctttaccactttaaaatattaatttgttgatccattggcatgtatggcttgaatgggaaggtagtaacttatttagagagacaagttaatgacttgcgtgcttatgtctgttctaacctgcaagaattcacatacagccatggaagtggtttgctttaagtcttatcaacaatatttatctgctcagaggcgtaatgctaagggaactcattgctatactttcaagacaatccgtagtgcaagggctgggggccccaggaagagcatgtaagaatgaaagagaaagcaacaccaattgctgcagaataaggacttggaaattgtctaggccaatttcattattttatgcagaagaaaatgctgacccagaaatattcctgcctcattggcattgaggcaggacttcaacctggacttcccagctgtccacccagagctcttctagataatgttgtcttgtgaggagaatttgtgaatctgtgctttttttcctttcctaagattcccaggattagtctccatggctgattcactacatttaacaatcagtctggaaagttcctttcacaaagcacttcataaaccattgtcttaagtggattattttttttaaattatggaacaatatgaactcaaacagaggcacatatggacacatatctatctttggagatttagaatagtttcattaaaaacttgtaatcatgttcaatttttgcatctgtgggtataaaaaggcaaatcatcttctaatatcagttttaaggactagattaaataggttgatggctcggttcaacttcacctccagggagctcttcccacctcttcctccacctgacttcagcaggtgactaaagctatccgcatttttcagaaggtaaatgaacacaccaaagagcacaggtctagaagagtggggaccagaacttgggagttcggatccttccagacttgttccaccacagcatactttccccgagcctttggagtgctgggctgcccaaaggtcacaggagtgtatggcagtcttcaatgtaaaaaaaaaatagctttctttacactgaagtgagttgaaaggcagggatttaatttatacagagatcactggagttgcttctgactggagcagaaagtagaaataatatgataatagtggggagatcctgtatttcccacttatattcaaaacccagagaccttagaaattgtattctacctaaaactcctcccccttggaaaccaattttaactttttataagtgactcaaagaaggtagttctcttaaatgaaaggaaatgttctatttctggggcctggaattaatttcaaatataaaaacctttgccaaatggagaaacaattggttctatttatatgttttgctgaccataaaactgacatcactccccactgggaagtatttccgttccccttatagaaagatcatggttggaaaagtgttaaaaagtaggttgttttaaatgatacaatatgaagctgttaagattaagagtttaatatgaggagatcggtgaaatgttataatccacaggaatagtttatttttattctatattctcctttctttctgttatctttcatacttgtaaatgttcacaaaaatatgtgtataaagtattctaaggtgtgtgttttctgtgcagtgtgtcatttttggagatgttcagtgaataagcagcagtaagccagattttgatcatggaagttcactttattttccaaagcatcttaacctgtgaattttcaagctaccctccattcaaatagtaggtccttagagtgagacaatgagatgacagacaagattttactgagtttgcaaatctgattttttagttagtttgttgatcaaaataaattgcaaactgagaatactttggaaacctgataatttcatttaacctttgaaaaaaatttgcaagttacaaaatacagtgtattttattggaatcttcattgcattctccgattttattagtgctcaacctttatgacagtgcttgtgaaacaaatataaaattgcaatgcatgatgcagactaaccaaaaagttgtgtgtatcggtttctctcctttatagcaattttccatggtctggacaccctaaccgtgatgggcattgcgtttgcagcctttgtgatcggagcactcctgacgggggccttgtggtacatctattctcacacaggttagtgtgactgttgagtaagagttggtgaacagcttgtgttcctgccacacaatagacactcagtgttttgttggatgaaataacgaatgaaagagaaagttcattcctactatttttacatttacatatttggtataaattgggtttcacaaaagtataatttgccataaacagtggaaagaaaaggaaggtttaaactgtgctaattgcgattgtgatgttggtgaaatttagccgctaataaagctactttgttgttagagtttaaagttaatgcagacaacgtacagaaatacaaaccattccgtcaaaaccaaagacttaaggataggcatatacatgagaggaagtgaaaaagaaagccaagattttattaccacacctgccaaggtattgagcactgtccatcagagtccttaatcaatgacttaaaccagattttctcaacctttttttaacccatgctatgtcttctttgataaaacataaaattttcatgtttttctataaagttaaattttctaaatagatttccatgaactgaaaaaaaaaaaaaaagtgatgaaacagagcacttcattttcaagctattatccctcaatcttcaaaattcagatgtgctcctccctaccaatcccaaggttgaaacatactagcctgatgagagaacctgttctgaccccaatacagaatgcaggccagcaaagggagtctttagtgcaatggagaaagaacaaatggattgtcctgctattgattctttcttagtttcctttcaactatgggcaggagtgacatgcattttgcggcattctggagaactagaatgtataaaatcggtcttgttcttgtttgttcttggatccttgtagttttatactgtgaacctagataaactgtgctagattgatccgtcagaggcaagtggcaggcccagcttctctgtttataatttcattaattgtccattaaaccaatgaatgccatgatctttggcttccccttgggccaagctgaaaggatggctgatttaaagaggaaggaagtactgaaggatattttggagagtcatatctttaccctcttgattgctagacaaaacgtcaagctgttgagaataaaagcatgacacagtgatcctctgatagttaaaagtgtcagattcaaatcagaattttcactttaaatactacatctcctgcctgaggtattttagattacgccagaaggagaggaatggactctttcatgcctagcatgggacattcacccaaaaggcaacctcttggcaaaaatgtagaagacttgaatagagagactttgagtcctcaaatgcttgttcctagtcaggatactttgagtaaagtatgtttacgtgaaagattaaaaaatgacttctcataatcctagcattttgggaggcaggggcgggaggatcacttgagcccaggagttcaagaccagcctgggcaacatagtgaaaccatgtctctacaaaaaaacacaaaaactagcatggcgtggtggtgtgcatctcttgtcccagctggctgaggtggggatcgcttgaacctgggaggttgaggctgaagtgagctgtgatggtgccactgcactccagcctgggcgacagagagagaagttgtctcaaaataaataagactccagtgtcatgattctggagtattatataaccatctgtgaatcagtttaggaggattctccctcatgaacagtttataaaaggaccagaaagacagaatttagcagagcagcattttaaagtaagtaattttgtcgcaggaataccgacatgttcagatctcaagctaacagttctttgcaacttttccaacctcctgcctggctgagaggttctagggctgttggcagcctgtgttggctgttgggagtgagtttgaaagtcctccaagaagactgggtcacccacagatgtttaccatgtgcctgctcagccactgactggccttggtcacacagctgcactctcatagctaatcttgggccaggaagccaggtccaggcagaatatagggcaaccagataatactcactactggaacatgccccactgaaatccccccaataatccagactgttacccacagccaagcacacaaacctgataaaaagcaaaacttggtggtatggcatgtattcatcctcattgaatttggaagtctgttgttactgatcctttttcccccaagccagagacttcaggagggcctttcaagtactgttaatgtagaaataggtttgtaagtaaatttaagaaaaatgaaaccaaagacctccctcctgtgatgctttccagcaaaatgaattacactgattcagaaggtaaaaggtttatagacactgtcatttgggcttaaaatccattggcatgacttatgagacagcttcaaaattactttttattaaaaactgtagcctctggttcattttatagattgctcttgaggaataccagcatcatacaagcatgaagaagactcacttcaggaccacatgatagttcttttccagaaccccttcagtttgttacctgggtcagctagcagcaatttagattaataaggaagattataatgcagtgggcaatggggagagccaggatacaaatactggctcagtccgttcaatttcaacagtgattgaagctgtggaactcacagatcgtatatgctgtatttgggggttcagatagcatctgcctctgtgtgaaaaacaatccttaatttgaataacttttcctttgtttacgctttccattccatgtgcagcacggagcacaaaaccaagtcacaaatttggattgtggatatctacttacatacctggaatgtgtgttactctacaaagactgggttcccactttatcatatgacaactctgggcacaataagagatattcccttaaggctggattaattctgtttggaaaactccattcctaaaacttacattctctcctaagatgctgtagagaggaggggtgcttgggggctgaaatggtgctggaaccatagaatgttcatgctcctaggaaccctacctagttcaggggtccctaacttctagtccatgaaggtccctaaagtcacatgcaaaatcttatctgtttttttcttgaagggaggaacaaatgcttttatttttattttctagtaaaactttttagcttcatcaaagtagtacatgcaaatagtttaaaggttgaaataatcctacaagactcattatgaaaaaaaaatcacacccctactgtccttaccttcttttctcactccccagagcattatttttggcgcttagctcatccttttggatgttaatccatacttctaaataacctgagtatattgctgctttttgactttgcaggtttacacctttgctctagacctcctgttatggaaaatgtccccttcccccaccatcctcttaatagaaatatactgacattttggttagagcagcatttactgtttacattattatgactacctaaatgctaatcacagttaactcatgtagtataatatcctgcatgacttttaattttccctagaattaattattatctttccccaccctaccccattagcttaattttcttttcttttttttcttttttttgttttgagacggagtctcgctctgtcacccgggctggagtgcaatggcgcaatcttggctcactgcaagctccgcctctcaggttcctgccattctccttcctcagtcatcagcttaattttctatgtatttatcattaattcttctgctgaccctgccagctgtctcaatctccttttaatacattgagacatatggaatgttctactgattccttttcttcagctctttcctggagcctctgacctgctcctgtctgaaccggttccctccatttctggacactgctgtcttcctatgatcttcttcgctaccattctgtgcattcccttcacttctcttttgagttgtggatgtcctgtgtcatgtatctcctgcctttcttcttcctggtttaaagcgtacagaggacgcaaatgtttttcacaccttgcatgtctgaaaatatcctcatttaacagaaacacctggtagacagtttggcaaggtacagaatgttagattatagacactttttccttcggacttttgaaagccctcctcattgtcttctagctctgaggattgctgttgagaagttcagagctgtgcagattcctgatcccttttgtatataacctgttttttctttctggaagaaattttacaatgatatctcttgagttaggtgtatgtttatacattatgctggtcactaattgggccctttcagtttagaaactcatatctttcagtactgagatttttaagaatgatttatttttttctcacccccttttttctgttttctctcattttagaaatcattttatttgaaagttgaacctcttgtcctttaattttcctttctttcctgttttccatgtgtctgctttctttattttctgggagattgtctcatctttatctttcagttttttactgagtttttaatactggcttcaaattttttaattccaataacttttttaattctaataacttttttcctgtgaatttcttttcttttaaaaaaagttctattcttgtttcatgggtgcagtatcatctgagaatattaatataggattatttaagaatgaggaaaaaaaaagaatgaggaaattctaagctgtgggtgggatgtattgattgtgaacttctttaagatgatctgactgggccattttattgatgaatccctgatacctcatcattggatctttcctctttagctcttcaggcttccataaaatatgtttttttgcctcctgcttgaaaggtataggactggctgttgaaagaccattataatgggcactgataaaaataaactgacatggcaacaaattatatttggcaaatagacaccggaaagcaaatatccagacttcccggccagggtataatcctggcgcttttcccgaatgcaaatagtgaagcgcatggcaaattctgcaggagacaaatttgttacaaagtaggactggaaccctactttcttgattcagagtttcactgttgctagatgaggcaaggccatctggctttatctccttttaggctgagcaaaagaagcccaggtgagccaaaatacgtattaatatatgtttgccgaatcccccccttttgaatgtggtactcttgccctcaaatgtgcctggtgttgatcatttctggaaccttcagtttcctcctcttaagagagtaaaattcccgtcttcttcctggattaggaagggcagatctcagcccagtggagcgagggaggaaatgtagagaactattctgcttctcatatagttcagccaacccctcttgcttatagccatatgttcaagggaggtttccagaggtgcctgatgccaccattccctgagttttttaagggttcggcgacataaattgcttgtttctcagtttttcccactgttggcttaggtttcggctctcttgagtctgccaagtcagttgctactcacccatttcctcaccagcttccaatatattttattgctgttatctttacttttgttatctttgttttcatgtgtttatgcctttaaaagtccatttactgtcattctggtaagatttgggaaaggaatgcaagtcaatgcctttaaatgcactatctctatgcaaagtcgtacccttgcttttttttttttttttttttttttaatcagtttcttaaagggagtccttggaaaattactagtctgcatcagcatttcctttttacgtagcgagaaaactgagcccagagaactgatgtgacaagctcaaagttacccaggcacagcggccaggactgaaggcttgctttcttgattcagagttcactcttttcttcctgttctgttattacaaattcaaaggtcacgtagccataatctttttatcctccttctgcttatcagataataaacattaattaacatgtgttttggtttttctttttgcctctgtttagtgtcagctaaatttttttggtttgttcactcatgtattcgttctttcactcaacttattcaatggattttttaagctattgttaaatgccaacgctattctaggcactggtaaaatagccatgagcaacagaaagtccttgctgtcgtggagttcccatatattcagaggaagagaataaccaaacagactgattataagcagattggctcaggcagaaacccagctacaggcacacatgccaacctttaggaaagcaatgacctgatgaactgtgtcagaaaaatggagaactgacaagggaagtctcactggagaaagaagaagtgtttctaatctgaagaattaagttttctattaaccttttatggaaactgaggggagggtgagaagaagggggaagggtatgaatggccagatgctccgggaggtgctttgttttttgagagaaaaagacacaccaatagacaccaggaaagccgaaggcattcatcttaacctctgtgtttaatggttttataaaataatgatatgggcatttgagtgaaaagagagtggagcctgccttctttacagtcacattggggtttccgtctgttccagctgcatctgtctgatccctgggacttggtctcttgcctcctaccttatcacaccttagtctgtctgcttgctgtttctcttttcatcgggctacacttgggaacctggagaaacctcaggcctctgaacacattggcacctcccgagctacttctaatgaaaacctcttacctgacttgggtggacttttgggtatgcgcttgacttttgctttaagaacacatggtgtgttccatggagggttgttgaaaactgcctgatgagttgggacgggcacacctaattcaaaacttcagcattttattatgctctgtgaaacagtgttccttacacgcttagattttttttctgcttacacatcagagcagccttaaagttgaaaaagcttttattacgcatttcttgttttaagtacgctcaccctaataaccctgtgaagtagtgattatctctgtgttgactaaagggaaacacaactaatacacctactaaggtagcaagtctagccattgaacaaaccagagcttcaagtccagtttctgactcagggttgtagcgatagctgtggaggacagccttcctcctccacctgatttctctttccctcttgcttttcttcttcttcttagttattatcagattttgcatcctattcaggggccacaaaggcagggaagataccacagaaaaccaaagtccatatacaaacaggttggccacactgcaggaatatagaaagaaagtagtaggcaggacattgtgaaaaactttaattcttgatatagtcttttccccgtgacttctaacaacatctaactcacccctcctggagaattttgctgcaaaagaagagtcttttgtgtggaggctggggaggaatgaaatttgaaaatgataaaaagtgattgaagacttctctaaattaaaggtagtatcgttcactctgcttaaagagtgagcttgtgaattaattacagttaggagatcaagaaactgagacattaattgatagaaaatcgcatccaacacgtagatctagaagaaaatatctttattttctttctagcatcaaggaatattaaatctaaagtgtccccaggtatatggttttcaatcctgtgcttaaatatctcctgagaaggagattccataaattccctctataactaaccaatcctcataatcagcaagttcttttctatctgatctaaatccctagtcctgccatttaaactcatttcctcatgttctgccctccagggagataaagaacagctgtctgctcctatttgtaataatcctcatggagagtatttgcaatagtctcctttggcctaaataccaagcttgccctcacctttctttttaactcttctcttgtttccccacagagtcctcccatgctattcacatctttcttgaatagtttcttccccaggacctgccatggtgaaagacttagaaataagaatacagttgtaatatagacgccaaagaggtagcaggaagtcagatctgggcaactccatgccatgctaaagaaataaaacattctccattaagaaatgttttttgtttgtttgtttttgcttctttttttcttcttccccctggtagagacagggtctctctctgttgcccaggttggagtgcagaggctcttcacaggtgagatcatagctcactgcagtctctaactcctggcctcaggagatcctcccccttcagcctcctaagctggcactgtaagtgactgcacctggctttgtttttctatttcttgaggcatctctggcagtatctaggcccagccataggctaactgtgagatgggtggaattaatccttagtgtccttatcctcagtgtactctcctcctccagagtatgtcaggcaccaaattcctctctcccctactcactctccctcctctcaaatctctgttccctcaatgtggtttgatattttaggaggaaagcaggaagactgagtacatttcctctgctggccaagtctgatatttatttacaagcaaggcgccctccttgaatttcttagatgtgttaattgggcctagtctgcttagccacgaggtcctccctgcccatctcctttaggagcagccttgttatacttgtcacccaagggatgttttagagaaagttggtgctccacgaaatcagagaccactgcagtggagagcagacagccaaagacccatctcagaaaacccaggggtctctgttggcccattaagtagaagcatctgtacattcaactttcttcctcatggtgaatttttctgtagcatcacttccatttgacagtgaaaaaactttttcttaatctgtcaaaaggtaagagttatttttaaaacatggttatattgagaaaccttgcatcttacatgtgaaaatagccacagaactggaaaggatggtctgaagaggggactttcaatatttcccagcagattctcagacagagactcaccttggcccattattggatcaaagtcaatataatattaggttaacttgacttatccagctggtgagatgcatcctgcagtcttgagtgcggaggcttctttgttttgtttggggttttgttttgaagtgttttgcattaccagaacaagagttcccaaaactcgggaagttgaaaggtctctttaatgggcacggatgaaaataaactgacatggcaacaaattatatttggcaaatagacatcggaaagcagatattcaggcttcctgggcagggcatagtcctggcacttttcctgaatgtgaataatcaagcacagggcagatcctggaggagcacacttgctccctattgcttgatgaagcaaggccttctcttttacctgctgttgggctgagcaaacaaagcccaggtgagccaaaaaagaaaaagatggagttggcctcctgcttttcagatgtatccttattaaaataggaaaaaatatttttaaaatgtggttcatgcatagccacattagtccttctgattgattatgtgaggatccagctgggtatggaccaacatgtggtttgtaagggagtcaaattcttaaagtatatctagagttgtttgggtctctggaggttgtttttgttttgacctcagaatagttaagagatttgattcccttctagaaataaagctcctactctggggaaagtgaatttttggcagaaagttattgccatggaggctaatttccccagccttaattatacacacacatgaagagtagagggcagtgctggggagggtccaaaacataggtttccaaaaaagtcaaaagcagtgtttcagccgggcgtggtggctcacgcctgtaatcccagcactatggaaggccaaggtgggccgatcacgaggtcaggagatcgataccatcctggctaacacagtgaaatcgtgtctctactaaaaatacaaaaaattagccaggcatggtggcacatgcctgtagtcccaggtactcgggaggctgagacaggagaattgcttgaacccggggggtggaggttgcagtgagccaagatcatgccactgcagtccatcctaggggacagagcgagactccgtctcacaaaaaaaaaaaaaaaaaaaaaaaggcagtgcttctccgcttctcaggaatattgaccccagtcccctatccatcccgccaatcccagaagaaaagataattagaggaagtacaacaagggccaaacttacaacaagcacataaatactttgaggttgatgcaaaagtgtgtatagctgtgtggttcatgaaaggggtgacaggaaaagctgtaaccagacccagggacatgagccagttctacattttgcagaactgcttttttcacagaggcttttgaggggccccagaaagagaatggaagtaatggggccaagttcctgcactggagggcagggcctttcctcgagtgttttgttttaatgaagcagctggaagggttgcttatctccggctgatagatgtgtatttcagcatgacaggaaagaggaggctcattcataaacaggcctggccctctggggtttcccacattgaaggaggggatgctgcttacaagaagtttatgaagtttatgctctgacttttcaaagtaaatgcagtgttttttattggagagccctgatcgcttttccctacctagagccattttttgagggttgcactgaggccggttttgccgaagagaagactaactctagggccttttgcactgttaaatgcaaaccatgtgtgtgacttgaggtttccttcctctccaaagcactgcacatttggcacgatgaatggctttagctaaaatgcagtggggtgtgtaatgaaaagtgggatgcttaaagtgttaggagatactcacactgcaccccacagggaacctcagtggggaagagaggccattcgctggcaactgcagtccccatgtgcaaacagctaaaccccttccccaaaaggtttttccaatagcagctatcccccaccccggtttctcaggtaatttatctgtttggcacacaaggctctctctactgtagctaggacaaagtctatatttcactcctgtttttaacaagtgcattcagaacaaggctcccaaacttccagggttctcttaactacaattgaaaggtcacaccctccaaatcctacagtgtctttatgagagaagatggacagtgtttcctgaatacaggtgctggtcagttgccagctcacacagaccaagtggtggtgatttcatcaaaggttgtggaccctgaaatccagggactttgtcatcaactctcaggggtcttagccactagagctgcctgtcagtcagctgtcttctttttcccattcatgatgctttaaaaataaaacaacaaatagcaaaaccttattttagaaggtattccagccatctaggacctagtctagttgcttctgccctggttgagaaaaatatcagttaaaatggcaaatgcggaataaatgatcttttcaggaatgcacatacataatatgcgtctttctctgactctgccttttctttattaactgcaggggagacagcaggaaggcagcaagtccccacctccccgccagcctcggaaaacagcagtgctgcccacagcatcggcagcacgcagagcacgccttgctccagcagcagcacggcctagcccaacccagcccaacccggcccaacccagcccagcccagctcagctcagctactgccaagggcaggaccaatggctgagcctcgtgtccagactcagagggctggattttggttcccttgtaaagacagagtgaatttcagtataaagatcacccgttgtattcaccccacacccagggctagtataaacatgaccctgggcttctgtaccacactagaattcatgtgagaaagctaaaatggtggtcttctccaccagcccctcacaggcttgggggttttcaatgtgaaacacatgccagtttttaaaatgctgctttgtccaggtgagaacatccataatttggggccctgagttttacccagactcaaggagttggtaaagggttaatagccagatagtagaaccagtgaggagatgcggccaaagattctttatatctgaaccaagatgtaaaacaagaaatgctttgaggctttctaagcgatcctcctgtctaatttgcacctttgtctggatgcacacttctgaccttgctgccacaacctgtggggtctgatgtgtcccttgatgggtgctgccctcagggactgcaccctgacaagtgttaaggcaacattcctttcttgtgccctgggccaaaaccaatgctgatgaccttatcagcttcctgtttcttcccatacttgcatacaccactgcaaaatgtcttaatgcaaattttgtatttcttacaggcctacagaaattgaaaatgaccaaaatcaggaaccacagatttgtgcccattcctaatattttgttctgcaaattaatgtataatttgaggtgaaattcagttataaagtcaaggacgaatttgcacagtgatatatttctatgtgtatgcaagtacaagtatataatatgtcacctggcacattcattttctcagttgaagaagagaaaatttgaaaatgtccttatgcttttagagttgcaacttaagtatatttggtagggtgagtgtttccactcaaaatatgtcaacttaaaaaaaaataggccctttcataaaaaccaaactgtagcaagatgcaaatgcatggcaaatcctgtcggtctccagttggttatctgaatagtgtcaccaattccaccaagacagtgctgagattggaaaagggcactcatttggattgccttacttctcttgccttaaatatatcccatatatttaatatgtcaaaaagggcttgaggtgaatttcattaaatggaataatatgatgccactttgcagctaaaataagctcagtgatacctccttgttaaaaaaaaaaaaaaaaaaaaagaatgccaggggggaattatcatgctaaattattttactgctgaagatagcttcattgcaaattattctttttccagaatttcccccaaacaacttagaattccataagtagaacaagatagattctacccccaaaatattcataagcaaatcccactgcccttaaaataaggaagttatgcctggttgtctgtgaatggaacctcagtaggtaatcctgatgaagcttaaaaccttagggcagtgtctacatgggaaacaagtatgtggaaattgacaatcatttttaccaaatcgttgagtaataatatgacttacctgatagatatacacattcaataaggaacatttttttttttcaataaggaacattttaactaaaacattactttagggctgagatttccaggctatctacattgatctactgaaaaatttctagatttccatatacaaacgaagaagacatgagtttagagaatttttttcctttaatttttttttaacagaagggtatcagagtggaggacctagattacgctacctgtgtttgaaaatattgcgctttgcctaaccttcggtggaatgtattgtttcagcatattctatgtataaaaaagtttaaagatgtcttcaaagaagactagagtctttaagtcacttatagctatattttactacaaaatttgtgtataaagatatatttaagtgttttagataaatttaagttactccatatgaaatgtttaatttcagctactgtgaattctttcgatcagtcctttgcttttttaaaaaatcttttccatcgtgttaaaaagaaaattagctattaggagatattaaaagattgatgtcttagaaggacagggttaaaaccttctgtaatatatttaaatatatatttttaagagagatgctacattgccaatgattttataaataatttaaaattaatttacaaatttatagatgcaaaccaaaagatctttttaaaagagagagagaggaaaaaaatcaccttttatttgtttgggtctcattgtcagaattattattcagatcaagaaatctgtgtcgataaaacctaatctcatattggagagtgaatgtcgttaagtatttctgaaatgtttctaaaaaatgaacatgaaaaaaataaggtattttctccctagcttctcattacagtatttctaattgcttcacactttacagttttaatacaaagtacaagctctacttttataacgtgtactacaagtttctttaaaagtattgttgtatttcagctgaactcttgtatctgcagtcttttgttatttctgcaggctacacccttaatttgcagaggccattttgttgtttgtttgatgctgaagctgttgttaaaatgccccaaactccaaggcagattgtctgtataatacgctatagcttttcaccatgtggtgtttaccagctgttactctgtattttaaaaagccagagatttcttctgtctaaactgtttctatagcattttctaaacaaaaaaaatggtttttttctttgccttgtaataagattgtaaatccatttcctgcttgtgttcttagtgggcatgattgtgagtgtgtgtggggtgctcacacgcgtgccagtctttttgtactgtaactacctcatggtttgaatgatgattgtactgctggttgtgttaacagagcacattttgttgggtgagtcctatgtgatttttttcatgtttgttttatctgggggttgttcatgaaactgacagatgtttttctaaaaaggactattatcagtttccaaatacaatacttctctcttctggtttttcctgaatgagcctgattttgttgctggttttcatcatctatgagggtaaaacgagtacccttaaaatccctgtggccagtttgaacacccctgttgtattcttttctctgttcagtgtgtcagctattttgtga

SEQ ID NO: 12202 - DNA, 12164 bp, Human
ccagtaaccgcccggttccagacgaggctcctgccactcaggccgcggagtcgcagcgtcgcccagcccccggctcctcctccctgcgtctctcctccctccgctcccggctccccagcggataggagccaccaatcccagccacagacaacccttcaaacgaaatagcgaggcggccccctctaacgggcggcgggggcgctggccccctccctgcgccacatctgtcccgcaccgggcgcagcagctgattcatctgcagccaggtccgggaaggaactgtgctcccggcagttgcagggcagcgtccgggcgggtggcttgtccccaggaccgcgctccccccgagccgttttaggtgtgtgttctcttctgtcccgagcagtcagcaaaccacagaagaaaaaaatcgtaaggttgctgccttcttagagagacgctttttttccctgttgattcattttagtcctgtaattggaaaaaccacccaggctttttaaactctggcctccacgcattctaggggcgggggtgtttttttttttttttttgagggagggtggcaggctggctctaattcctgaaacagacgctccgaagtcgagttagttatcccttggccgtcttagtactcctcgggtttaatcttatttccacagagtttcttctgccgggatctccaccgaggttaccgaacaaaaacagcacagagcccagactggaggcagacccgggcgctgtctctgctaggcttatttacgtttagggcttttctttcctttttttaaagtgacgggggaagtctcattgtgtggcatgtgacagttcgtttgcttcaaaacaacaggacgtaaccacgcgaaaactagaaccagaggagggggcatgcgtttcttcaagtcagccaaacagcatctggtctttgaaagcgcaatttcatcaagaaactcctgttggatccctcctaactgtggaccaaaataagccaacaggaacgggtgtttacttaatggctagtttctgtttgaaatgggaggagggatcccctagcagggttccaatccgaagagtagacactgttgaccgaaacagacgagcaggcacggcgtggtcaccccttagctataaaagtggccgctgccggggttcggcgactcggggtgtcaggcggagtcttggtgaggcaggcgcgcgcccggccgtccccgggcagagacgtttaaagagcatgtgagcgtgacaagtgtctgtccgcaacgtgtcagatttcgaaactgccttgcaatccagtccggaactcgcagctttagcccgggggaacagacgttcgtttaggctgtgtctcatcattcccccccgccccacccccgccgacctcccactgtcgctgctggaggaagagccccgggaggagaagggtgcgccgcgccgcgcccgcgtgtcaatggcagccgcgcattctggaagaagttggttcttgtctcgaatacttttcctcccgtgccccgccccttgaatcagaggcggctgtctcgtgcggctagagcagggccagtagagttcggggcagctgtcaaaaacgagacggggaggcttttcttcccgggggtggaggagggaaggagggaggtgtccttttttccatctgttgcagtttccgaaccaaacgcaccctcgccagccccgggaagaaaggcccaagggagaaacctggggcgctcggctggtgcccccaccgccgggcgagggatgcgggcggtccgtgcgcggcaggcggaaaggatcgtgtttctggacccggccaccccccgcgtccgcaccgccgcccccgagggacgagtgacagcggccgccgcgctcggtccagtcttcccggctggaaggtgcgggggaggggcggaggagcggcggggcgggagggggacggggcgggcggctgggggcggaggcaggacctcctgtaccttccctcctcgcctctctcactctgacagcgccgaggtgcgccgagcaggagcagggaacaaaggagcggagaggggaggggagagagttgggcgagggagagcccccggccggctgccagaagatcccggcgggaggaagcccaagtgtcacttgaattccacccaaggagcgggcgcctgggatcagagcgtcctgtttagcaataacggctggagcacgtcctacaagttacgggagagtcggctgtgaaggagacgttcgcttatcccctgtgtccccgctcctggcccctccagacccccgccttgcctcgcgctgggaggggagatccagaatgaaaggcaagaaaggtaaggcggccgcgggctgcgcgcaccagaagacgcgagtccggggaaacgtgctggccgggccgcgccgcgcggagtcacttggtggacttttccgcccaggggctctcatgctggagtggcggccgtgctctttgttgaggctgcgtctgaaacggcagcggctgttttcctgctagacacaacacgaggggctgttgtggggcgagcctctccacgctgctggcacgttgtcaagaaacacgctcagcgccttgtttgtgcgcctgcaagtttcattgtctccgccgacaccccacgctcggcccagccgccgcgtggcttctcgctctttctcgcgtgctggggatatggggtccgagtagggaggacccagcccctcgtttttcccgatccggacccaggcggccggggccgcgggaccgccgcggctttgtctgaaagttccactcctaggctccccccgcccccgcccccgccgcccccctactcccagccgggccctagcactgttctttagggatgtggtgtttttacgatcgaaggaatgcgattctggaccccctcatcgccctcgggtgtaaacagctttggaaagctagacttttacaaatccccagtctctaaaagttttcccacgatgaattttggggcaggaggaagagttagcacccagggccagcagcttcaagcggcatgcagtcaaaatgcgtccaaatgtgacaagcaggcttggttgtaagtgcaaagagcaaggctgtcattgtttccacgaagtgttctggaagctttacaactaaaacttgccgtcagtttggtttaaaaacaaaatacaccggagggggacggggggtggagaaaccacacaaaacaccccgaaaggtcagagtgtgaagtcccttttgaagttaacaaaaattgagtccctggctgggaggtcccccgagtgttccgctgtgggctggaggtggcgtttctgtcgtgatttatgtggagtggttcaaaacagaagttaatcactcgggaagcggacgggaggggcggcgctactgcgcatgcccgggagccgcctggagtttggaactccacattctttcagacccggcccgctgcggggcgttcctggggggtagcctcaaggccagcggggttccttcggctgcgtttctgtgggaggccctgaaacgcgcggagcttccctctgcctccaggctttcccagcgagagtgaaattaaacttgaaactcggatcaactggcagtcgttgttggtagaacgccctaaggacccctccccgcgggacggagggaggactcgggacagggaattggccctgggagaaaacgcgcggggggcgtccgagacgccccgtgaaagccgtgccgacccttgggaggactgacaggtctagagacacgcgctgtctgttgtggtgggcctcccgggaataagtgaggggctctgtgtttcgaggatggttctagcgcagagccgggtgtctgccggggtgggctccccgcattgttcgggctccggcgggggcggctctgattcctttccatggcccgcctcccaccccgggaatccccagtgctccttttccacggcttttctggcgtccccccgactctcccgcggcactttggcctaccttcccccagcgccgtggtcctccctggcgaccccctctgcgctcctggggtcctcctgcgccccccctcctccaccggcgcgctgcccacagccgcgtgccctctccccggagctggggaccaaggctgggccccgccggccgcatcggtgggaacttccgcggtccccatcccagggcgcacagggtccagctcctcggcgccgactcctggaaacaatgaaaggtgacgggctgaaggggaaactttgcgactggttcagggctctttgggggagccgaggctgccgaggttacccgggtttctttccccttttaggtttccctggcgagtcgtctggggtgggcaggcctctgagaaggtgggattcacggcctcatttctagtttcttgggtcctggagttcctttgcttgtgctaactcgtgcagtgtgcgggccggcctgtttcacttgaggccgaggaactctcaagaacaaaagctacttgcttttcctccttgggcccctccctctccccgtgctcctccgccgtcctcctctaaaactacctgggaggggggagccttccccgtcggctctggaaagactcctgaggaagtcgggccctccttactgtcttgtcttataaaagtctgcaaatcttttcaagttttcttaaaacaagtgcactttcagctccattcctgagcccggggtaagcttggtttgtgataatagtgtgtcctcccagaaagctgagagtgacgccaaaagatctcctaaaatgacttaaaaacaatgagaaggatcgataaggaaaatccactaagtctttttgctcccagtttttaactgttgaattcctgctttgggattgctctttggctggggtagccaaccataccttggatttggtggcttgagtgttcaatgcctgttgcttctcccaaggagatactgattttttttttcttttgttcctggagaccgggtctggctatgttgcccaggctggtctcgaactcctgggctcaagaaatcctctcgccttggcctcccaaagttctgggattacaggcaagagacattgctcccagctcaaaggagaacttctggtcaggaaacttgttgagttaaatttgctttttcctaattgtgcatctcgacttttcccatcaatcttatttctagagtctcttcacaaccggtgtctccctgcctccctgtctcatgatgttaccgagctattcagaaaagaaagtgcagggctgggcgcggtggttcacgcctgtaatcccagcactttgggaggcctaggcgagcagatcatctgaggtcgggagttcgagaccagcctgaccaacatggagaaaccccgtctctcctaaaaacacaaaattagccgggcgtggtggcttttgcctgtaatcccagctattcgggaggctgaggcaagagaatcgcttgaaccctggaggcggaggctgcggtgagccgaggttgcggcattgcactccagcctgggtgacaagagcgaaactctgtctcaaaaaaaaaaaaaaaaaaaaaagaacgtgcaggaacaaggtcgctgcttagggcggtgggatcctcaggccatgttgtggctttctccacaacatttccttgtatgtggatagcgtgaaagaagcttgtgatcctgcccccaccctccccaccgccacattttttaaagtgtaagcaaagcaagacgtttggaaacaagtcttaaccgggaaacttttcaaaagcgctgttacaataggaaatgagtaaggaggaaaaaagtctttgtttttccaagctgagccacaactaggagggagagttttaatgaaaacagtcctgacagcagcaaacgtggttttactgcagtgaaatatcagctggcgtagccaaggcactgaagtcttaacttcctgttacttcagcttttgtgcacatattggaaatatttgttaagagttccagaggtctggcattcatttatttaaatgaactgagaacagagtaaagtcgcgctgcagtttggtgttgcttaactgaaacctgcttttgtgtgtcactaacctattctgaaagatcaggcttcttgtcaaactaggcaagcagatcaaagggcagccttcaggggctttttttgtttcaaactctttgtgattaccaacttacagttgggaattcactgttcaatgagcaaattttcacactttttctagattaaaaaaaggaaggagataatagccttgagaagaatgtctggcttttcagacgttggagagtttaaacaaattgctttattcaaatttgctttagtcatttaattaacttaacactttttttaaaagttcgatttctttaattattaaagccaatgtgagacaggaactcagctataatttctttaagctattttattaatagttcttcacccaaatttcaatataggttttgaaagtctcatcttgccaatagtgaaagtagtttcagttttaaatgggcacttttaaaaacctttttaaaaacttaaatcatcaggggaggggaatttcaaatacatggcagttaaaacttaggattcttgtgcagtttatttgtagctgtttgttaagctgtgagctaaagtgaatttgcaagatcatccacctctttgttagaactttactttgtctttggagagttctgccttttgtaggaataccctgcagcaccttctgccccctgcagtccaaaactaaaaatgtgtcaccaagtcagagtcattaaaagggtgggaaaaattcctttaaaaaacacggtgtttagcttaagaggaatattccgtgtttatttcctgtcaaggggaactggctcaattaaggtcaagtcatattttcaaccaaaattacatactacagaggaaagaaagcatacaaagctaaaaatgcttacctttacatttttgttattttaattacttcccctaatatagaagtactgatttttttcaagcatgccattgtttgtaattcatttctgtttttaagattctagattgtctacaagcaaaagaatgtatttctttagtcattcggagtagcctgctgtagtttttgaaaggtggaattaatagcgtttgttatttaattttttttaagttcagaatgatgtttaaatatctgtaaaggccagttctggagctttattgaaccccgtccatctgtgatttaaatattctctatggcttgtgaattcttaaaatttctggcaggattaaagtacttacagccaaaagagcttcctctggggcttgcatattcagtttcctttgtcatgtaatcatttaagactgaactctgcttattgatatgtagtattctattctaggttgagctcaaactggtagctgaaatttaggagacatttttaattcatttagtattaggcatcttttgaccttactaaagtaccagtagtagaaaaatatttttgtgtgatgaaactgaaaacatcagtggtcgtatttaataaaaggtgactagtactgcccatttaaagtaggtgtctaactttgaataaatgtggatagcaatgaataagaaatgaccatgcatggtgttagcagaaaattttaacatgtgttttacctttagaatactaactgggttcagcgtagtatgtaattttccttccttatatccatgaaaaaaaatgtacgagtgctccctttcatttcaaaccttcagtagaggaaggaggaagagtagcatttaaaatgtacattaggactggttaggttgcttttcctagttagcactgatcttagaaagaaggttggtaggcatattccaactgccacagcacccttcctgtttcaaatgtggcaggttattcattttgggtgcagtttgtctcctccaatgattagacgaaagagttttctgaccatcattcaaaaggaatgtgagaagttaatgaatcctagaggaaagcggctgagaaaaggcatctggcatttggttgagagcctcctatgtggtgctagtcaaactacttttacttggaccctgaattcaggacagaaaacactgctccttctcctcgctctcagttgttgggaaagcatggttacattgaatggtcagcgttaagtgagctttgcaatagttgctgtgcttataaagcaactgacaactggcccttgtcctttcctaggtattgttgcagcatctggcagtgagactgaggatgaggacagcatggacattcccttggacctttcttcatccgctggctcaggcaagagaaggagaaggggcaacctacccaaggagtctgtgcagattcttcgggattggctgtatgagcaccgttacaatgcctatccttcagagcaagaaaaagcgttgctgtcccagcaaacacacctgtctacgctacaggtaaagaaagagagcgtgaggtttatggatgcatttttagtttcaaagtcattttatggcattcctgtgtgtcaagtcattaagctccttgccactcaaagacagaaggaatatctttttattgtaaacttgatagtgttaaaagctaataactagctatttagagaacacagaaacacttgacagtcatctatcagatagcatttcctttaatgcctaaaagaaccttcctttatgcaacagacattaaaaggaggttaaaccttactctattgtccaggaaactggtttgatatttaaacaaggacgacttcagtgaggtaattcatgttatgtctgttgacacagtcatttgaactgggaaaaatcagttactgggaggagtggcccttttcataaggagaggttttcctgtagttgattaacttaaatgttggggcagtaggtgataggttaaaatggggagagttaaaaagtaaacctctctctcaaatcatttttaagcatttgagattgtatgtctttttcttcgtcctgaaaaggtttaagtatgaagagacaaaaaaggaaatttgtattagaaactagaaggcttatgacaggtggtagcttgctttcttggcggagctcagataccttgaaataacattgtaaattcagataaggcttttcatgctttctttaattcagagagcaagatcaattaggtaccccatagaacattctcagaacccgttggctgagtgaatgaggaaaatgttaaagcgtaccgatatgatttcaggtctgtaactggttcatcaacgcccgccgcaggctcctccctgacatgctgagaaaggatggcaaagatccaaatcagttcacaatttcccgccgtggggccaagatttctgaaacgagctctgtggagtccgtgatgggcatcaaaaacttcatgccagctctagaggagaccccatttcattcctgtacagctgggccaaacccaaccctagggaggccactgtctcctaagccgtcatccccgggatcagttttggctcgtccatcagtgatctgccataccactgtgactgcattgaaagatgtccctttctctctctgccagtcggtcggtgtgggacaaaacacagatatacagcagatagcggccaaaaacttcacagacacctctctcatgtacccagaggacacttgtaaatctggaccaagtacgaatacacagagtggtcttttcaacactcctccccctactccaccggacctcaaccaggacttcagtggatttcagcttctagtggatgttgcactcaaacgggctgcagagatggagcttcaggcaaaacttacagcttaacccattttcaagcaaaacagttctcagaaatgtcatgattgccggggtgaaggcaagagatgaattgcattattttatatattttttattaatatttgcacatgggattgctaaaacagcttcctgttactgagatgtcttcaatggaatacagtcattccaagaactataaacttaaagctactgtagaaacaaagggttttcttttttaaatgtttcttggtagattattcataatgtgagatggttcccaatatcatgtgattttttttttcctccccttccctttttttgttattttttcagactgtgcaatacttagagaacctatagcatcttctcattcccatgtggaacaggatgcccacatactgtctaattaataaattttccattttttttcaaacaagtatgaatctagttggttgatgccttttttttcatgacataataaagtattttctttaaaaattgttgtaattcagagtatttctgttgagggaggtgcttcttaaaaataagtaggaatatagcaccccagtgagcaggaagctgggggggtagggtgcagtgttagggggtgtcaccagctctttgaaaacctgtggacaacaagccagtttgcataaacaggatgtgtgatatttactcttgataggaggcatagcaggcccttagagctttacttaaactgcatggcaaattgaaatgaatcattttagtgtttagctagccactaaatcccttgctgatctgtcctgcgtagtttaaaacgtggccatgttataaagaaaagtcttgaagcatccggttattgctgagttttcagaagaaaacaacgcaagcaatctcttgccctttttccacgttaccctttaaaataacctttgttcagtggtacatttagttaaggcatttgtattcaaatgtagcatagtatttgcagagaaattaccttttaaaacatctcaaaagtgttttctaaaatgatgaaataaacggtggggttctgtctatggtgggattgtcagtttattaggtgagtattttccaaggtctcagtttgtgaaaaaatggtgctatgtacaagtggagtttgttgggatagacaatcacttacaaagcccagatggccagaagggaattggtgttgctcctttcacttgtatggttgagcagatttgtcacatgccacaaaaccattctttgtagtcatgcttagtatgagcttgctttgttgttacggtcatgttctttccagccctgccccagctatgaattgtctaagtgtgagggagcatcagagcttcagtattgtttaaagaatgtagaaaaatacaaatttgtctaattttgaaactattttagaaagtccctactgtagaaagagctaaactcaaagactttccttgtaagtgaaagaaaaaaactgctgatgattaccaagaggcgtaagaaaattaggtgagggaatgttgtgctctagcctgtggggtgcagcttcgtagggcacatcagcttagaatggtctggcctcacctcagagagtcacagaaatagacaaaaacccaaaaagtactagtaaagtaaatacaaggaacaaaataaacattaataaaaatgaatgacgcaaaggtgatccagaatcattacttgctccaacagctagatcaaaggctgaacattttgctttagtatagatgagggaaatgagcaagtcctaaaaggtttgccctgttacggtgtttcatcactcatactggaaggagaaggaaaggagccatatgactcatttaaaagaaaaactgtaagtcaccttaaattccctatgttttacttcattttttccctattgaggttgttacaggtcatggttgataatagttggtgttgaatgaatgtaatccattatttaaaaacaggtacatttaagtgaaaagataaatgtaaaaagctgttcatatcaaagccaaatagaaatgatttttatgcttataatttacatggtgcaatatatctttttaatttgtttacttttcacctatttgtgtttttgaagttcatcccatagcatatagtttgggtcttgcttttttatttagtctaatgatctctgccttttacttagcatttgtcaatttacatttactgtaattattgatatgtttagattgagtttaccatttggcttttttctttgctcctcttttcctgccttctttcaggttgaatatttttattatatatcattatatcattattattatatattatatatcatatattaagatatatgagaatatcagcattctcatatatataatgtctttttctctgattttgttttaatttctctttttaaaaaagtattctttttttttttttttttttgagacggggtctcgctctgt

SEQ ID NO: 12203 - DNA, 49052 bp, Human
agaccacacacagaagcatacagagcactttcacacccattcatcccatgccattcatggagctgtcctccagctttctggcaggatgaacttggcgtcatgaggcctcgcccagagtcacagctagtgcccgtggtaagagccaagaccacacatgagtctcctcttgggtccaggctctttccatgtccctctctaccctctgctcttttcttagtcatctgccagagccaacagtgcatcccattctgcctggcatgggtgcacagccagctgtcttagagccccagaggcctgggaaaggctgcctcatttaggcgctgacctccaaggttaagcaaacacaggctctggagccatttacatatgggtatgaatctcgtggttggagactcaggttaatctctctgtcccccataagatggaaataataatagcccctttgcatagggttgctatgaagatgagaaaagctaatatatgtaaagtgtttagccagtgcctgcccacagtaaacactaaatcaattagttattattagtaagcactaaatcggtagttatgattcccatctttacagtgatattgattcacttattcaagaatgtgcatgttccagccacgtgtcaagccctgtgctagattctgagaagaagatttgaatgatatgcaacctgtaccttcaaggagctcagtctggagatggggacatatataaacagatagttccagtgcagtggatacatacggtaatagaggttctaagatgtacaaaaggctgtaggggcctaaaggacggagaaaggacactgatttctctttttcaattttccaagccacctgcctattccgtcttttctttctcgagatcaaacattctcacttctctctaaagacccaaccttgtcatcatggtgctcaatcttccttccacactgtgatgctggggaaagccttggggcatttctgttctctcgtgaatccttgaagcctcactttaaaaaatatatactcactcctttgtccatcgtaaaccttgatatttgtaaatatcgataataggaactttgaaaaaacatacgcccttagaaacaagcaagcaaacaaaaacacgtagaatgtcagagcttctccccactccacaccctttctttaaactgatgtcaaggtgggcccagtgagggtcagtgacggaccctgcagtctgagaaagacatggcagaagcataaggttagaggctgttcctgctgcctcattaaaaacaacaattttcccccaaatctggactgaaactgacattcaatgccaagtgtgatctcagtttaacctgccctggtagatatgcatacacttcccatgcgcaccatctcatgtgatcgtgtccacagctttgtgagttgagaggggtgggagtgattatccccaaccacaagcaaggcttccgggcttcaagggttggagaccacccagggctcggccagcatcagaaccaacggcttctaattccaaatcaaatgatggtttatgccacactacaaccctaaacaaatgaactgtgatgtgtctcacttccctgtgcaagtggaagatgctaatacatgtgtatcatgagaaaggacctcacaattttcttcttctgggttctgctgagacgtttctttgattcagagagaacttcccaggatcagcaagaaaagcatgtcatcatttcctaaaccctacaatccaggaaatagtccatcattttataaaattataaaagcgaactatttgagtttctttattatctgcccccttctccccaagctggtcttgtacaaacatgatgcacgtccattgggtgacaagtctgtcgtaagtgaaacgtttacaggcactacaggaatgacctggtgcctcgcccacttcattagaattctaattggggtgtgtaggagaggattctataaatggtaaggcaatccttggcagcctgtctgtcagcactgtccgtgccattcccagaggagcctgagaagaggcagaggaaggcgaaacatggctggtgagtgcatggcatcttctccatcaggtccttgccagaagcctgtgcttcccctgggccagcctgccaagccagagtgtccggccaggacagctgcctgccttgggggctctgaaggccagacttcctattttagggtgctagccagaggcggctctttctcagtggtggttgggtccctctagcatattcttggggtagaacatcattggaatgtagctctgaataatgggcagggtgttcagtgcagctggacatcgcatctccttaggcagaggacaagctttgccttgtttgtgtttgtgtttcttttacacatccgtcgccacccgtaaagccaaagcagacaggactcgggtctcgtgtttctcagtgtagctgtatccagctgtcagcagtgtcagcaaagaagcacatctcagaactaccagggagtgagagtggtaacatgtaagttgatttgaaagaaaccattgtttatttcaaatcaacttacttaggagcattaggaatgctcctaagtaagctacacatcagaagcatcagacaggctctgtgtaagtgacttgatgagctgaagcctccccgtagcaggagcaggtgtgccacaagatgtcctggtccacaggagagcaccagggaacaggggttacaaagaacaacaggaagtgcaggttcccccactctatgcttactgtcgaggatatgggcctttgttaatcagcacccctgctaagcagcatgctaattattatctgtcttgtgtgctcagcctagtaggttgacagggacgccaaatccaaacaagatatgagtcaaacttgtaaaatattgtgaatggcgattagggctgctggaagattggccaaagacatcactgagccaaatgcaacaggcaaatgctggctacttcagaagccacaaaaactgggacaggtgattgcacattaggccccctcccctgtctcccattccttgctgtaatgtacagcatggctgggatgctaagaagaggagctctggaccctacacactgcagcaagaggggaggtcagatgtcatctagcccatctccctccctccaggaggtggctgaggcccaggaaggggtggaaccttacacacagtgaatccatcgcagagccagctaggtctcagcagtgccctttccaccacgtcctgctgccagagctgagctcctacataagtgcacataacatctggaacataaaaaagcaattctgaacctggcttctcatttgagctttgtgaccaactgcttgtgtgttctctgccacccctgagcctcaaattttcaagatgaaagctttgaaatgaatgcgttttgaggttccttccagtaccgacttttctttctccacaaaaagaaaccagagccagggagtggacaggcacgtgcccagcccccaggaatgtgcacctcccatccctgtgcaggacctcccgtggactctcaggaatggcctgcccgctgtgaggcatgattaaatgtctctgttaacaaccagagatgttctaaagtcacaacagaatgaggctggtggggagaaaatcaattttgaaaaggtggtggagagacaggcgaatacattcagtcccttaaatttgtcccacttgcagttcccagctcagctccgagtcactcagccaggaagttcccaatcagtgtttcttggatgaatgaatttattcactgaacacctaagggagaagagctgtgccaggtgcagtgggaaatatggaggtgaatgagatgtggttctgtcctcggtagcttttagtctgatattttttggtaccaccggttttttaggtaagcagcatgcaaggcagactgttattaagctgcatgacaaatacaaaacaagtgctacggggaccaacaagagaaggagattagtcttgtctggaatttgggatagggaagactctgaaaaatggtcacagacaatgagttggacttggtctggagaggttttgcagggcagagggaacaggaaaataaatgtcagtgtgagcaggtgtgacccaggggactatcgggatgacaggtgtgctgctttgagaggactctgtgtccagctcctaatttaaggttcttgttgcaatcagaaggggttccattattccaccccttggtggagaaggcagcctgggctgtggctggaaatgaaggtagtggaggaaggcctggcagtgatccgcaccaagtggcctggcatccccagagtgggtgggagagcagtttgtgagcgcagaggagggccccagtgtggaggggaggcaagattccccatccccaaagccacttggaagccctgggttagtggcagagttctcagggtacacacctgaaccacaggcttctgcctgcaaatgaccagaacctctgttttggggactaatggctctgtccctctggggcagtgagctttcttgccaactacttttccaggcagagcactggccttggcttcagggacttcccatctcaaggcctcatttcctccacccccaaaggacctgtaccattcccagcgtctgggtctaccaccaaaccgttctccttggagctgggacaccagtcgcccctcctcccatggaagcggtcaggaattgctcttgggttctggcctccttctcttctgtaaatcttctaggtgcttcctggaccctcctcatatttttgtgtctggcgctgggaccaaggcaatatctactctctctctctctgaaaaggagatggcccctctgggctcagagtcttgtgactccagctgctcattgtttgaaatgaggaccagctgcctcctgtctgcccggctccatggccttcttccacttgggacagcggctactccctgttccttagagacagcccatgagcagcttcattccaccgggaatgacagctgcccgtatttcagcgtttgttcctgtaggattccttacaggatagctgatgggttaagagtgcaggttcagaggtgctctctggatcaaggctccactctgccccttacgagaagagtggtcttgggcaggtcacttaacttgtgtgtctcagtttcctcatctccaaaatggggttattgcagtatccacctcatgggtgcttacgattacctggaaattttttcatgagcctgttttctccttgtcttggggggacttaagaaaaaccctatgagaggaattacattttctaatcaggggcgattcccaggggaccctctccattaagcgcctcagcacaagtcctccccactcccgcttcatccattcccaagtccaaagtcctcatgcctgagcactccccttgttcacctcaagtaacttcatgcggctccaccccgcagggctgtctctgcagatggagcaatcattctcctccccagggcccacgtgccaggctggggtgtgtgctgaagttaggaaatctcgcttagcagtggagggcacaaggccctaggatcttggtaggagctgagagatgggagtcagaaggagtcagccttcccctccctcagcctgattttccttatttgtaaaaagaggacagtgactcctcccctgcctccttcctatagctgccgggtggctctggtcaggtaatttatgtgaaggagcttttataagtgtagatgataaacaggcctaaggtagtgaggtctcagtccctgctgcacattagaatcaccaggaaagctttaaagaaaatgctggccgggtgcaatggctcacgcctgtaatcccagcacattgggaggtcaaggcgggtagattatctgaggtcaggagttcgagaccagcctggccaatacgacaaaatctcatctactaaaaatacaaaaattagtggggcatgctggcacgcgcttgtagtcccagctacttgggaggctgaggttacagtgaggcaagagaactgcttgaacccaggaggcaggggttgcagtgagctgagatcacaccactacactccagcttgggcaacagagagagactccatttaaaaaaaaataaagaaagaaaggaagaaagaaaggaaaggagggagggagggaaggaaggaaggaaaagaaagagaaagagaaagaaatagaaagagaaagaaagaaagagaagaaagaaagaaagaaaaaaagaaagaaagaaagaaagaaaagagaggagaagagaagagaagaaaagaaagaaaatgccagtgtcatccctaaccaaagattctaattgaatttgcctgggatgggtctcagaccaatagaacattccaggtgattcttctgggcagctggggttgagagcctctggtctcagagattctaaactctctcttaggaagagaagtccttctgtcctctccttttgccctgaccatagggtgtctaggcagggagtaggctgtggatggcccctccaggacctgtgtctaagtcattgctgccttggttggctacagggcggcagcttggggtcatatctggtcaggcaaaattgactttcagtctgggcttgagtccagcctctgcctgagtgtttgatattgcgtaagtgacttcacctgactggacttccaaagccctcatctgtgaaatggggacagcaacaccattttgatagtcagtatttcgtgactattaaaaaacataacgcaggtgaaatgcttagctcagtgtctgacacataagaggtcctcaatagcagcccattaaaagctcaaagcctcttctgctcttgggttgtttttgccattacatatgggatcccaacagtattagtttcccccaatctctgggggccccggtgctagtgatgggtatatgttgaatcccaacaataaccctaagagagaagatgttccaggtctcactgtccctcttctacaggtgagaaaagtacaattcagagacattgagacccttgctcagggcctctcaccggttcaggcaccaatctggggctcatttctcttcatcctcaccagccccttactctccctgaatgccaagaaattgtgccacctgtgctgcacagagcttgaaaatgtcatgatatgtgggggaagttaaaaggaaatgacacaggctagaaagagagaaaggagagagagatgggtgctgagcaggaaagcacgtgtgtccttggagccagaggaggggccagccaggagctaaagatgttcccagtgtctaggggtgggaagtgggatgactcacagcctgtcggtgaccaagatctgagacccggcttctgggctaagatctgcttcaactccgtgacttcccctttcatgaaggggagatggcttcccctttcagggcctcagctttctgacctgtcatgtgggcatactagattacatcactgtttttcaagctgccagttgccatccattagcaggttgtgaaatcagtttagtggactgtgaccagccattaagaaaaaaaaaaaaagcagaagagaaaatatcagagtatattgatacatagtaagcattagccgtgtgaaaccttgtgtcagttccagatccatgtatgtaaagactattagatagatttcttgatttggcttctctcaatagagcttaaaaaccactcagctagatactttttagcatttttttttttgagacggagtctccctctgtcgcccaggcaggagtgcagtggtgagatctcagcccactgcaacctccacctccccagttcaagccattctcctgcctcagcctaccaagtagctggaactacaggcatgtgtcaccacgtccggctaatttttgtatttttagtagagacagggttttgccatgttggccaggctggtcttgaactcctgacctcaggtgatcttcctgcctcggcctcccaaagtgttgggattacaggtgtgagccaccgtgcccagccactttttagcatttctgttagccctcattaactctagacttctgtaaaataaaaatgcatctatgtctagagaaaaggtgtgggaagtagagtctggttgggggctagggatagtcccagccactagagtagcatcactccatgttgggccccctgtcagcccctctgtggtgtggtcctccctggaacaggagatgggagccccatcacacacccagcgaccaagtcattctcacccgtgtgctgcaggtgattcaattatacagccaggctgacaaggattgagacggctgactagcaacttccctttcacagtctggagtctttctctgtgcttttcatgtgaaagagggaccacagaataaatgggcaggggttatattaacatatttgtgattatgtttggctgtgattaacagtgaacccccccaaaaaacaatagcttagaaaaataagacagaagcttatttcttccttacacgaaaggcctggaaccaggcagttctgggcaggccaggtggtggcaccatcctcaggccctagctctgtccagtctcctctccaccatcgctagggtacgtatggccctgcatggtctaagatgtccgctagaggcttgtccctgtcacacccacactccagacagcagaatggaagaagaggaagaaaacaggcaaagggcatttgccaactgtttatataaagaggttttctaaaaaaaaaaaaaaaaaaaaaaaaatttaaaacaggtattcaaacaaatattaccatgtgcacattcatagcagcactactcacagtagctaaaatgtagggacaatccagatgtccatcagctgatgaatgcatcgacaaaacatggaatattcatataatagactctcattcagccataagaaaagaatgagctactgatgcatcctccaacatgaccgagccttgaaaacattatgctaagtaaaataagtcagacccaaatcacatattgtgtggttccatttgttaatttatgaaatgcccagaatagggctgagcgaggtggctcacaactgtaatcccagcactttggaggctgaggtgggcggatcatttgaggtcgggagttcgacaacaggatggccaacatggcgaaaccctgtctctattaaaaatacaaaaaaattagccgggcgtggtggtgcatgcctgtaatcccagctactcaggaggctgaggcaggagaatcacttgaacccggaaggcggaggttgcagtgagccaagatcgtacctctgcactccagcctgggcgacagagggagactccatctcaaaaaaaaagaaaagaaaaaaaagaaaaagaaatgcccagaataggcaaatccacagagacagaaagagttggggttggcaggggctggggataggcggaaatggggagttcctgctaatggagttgggggattctttgaggagtgatgaaaaagctctgccactagatagtggagataattgcatattgtgagtgtactaaatgcccctgaattgtacattttaaaatggtttaaatggcaatttttatgttgtgaattttacctcgattttttaaaagagagagttcctggaagttaatacctgtaacttctgccgaaagcttttggcctaaatttaccccatggccaccgagccagagtggagcctgggaaagtagtgcctgcacatatgggggatttcattaccaggaaagaaggaacgagtgaacgttgggatagatatttatctggcagtccaccacattagaattgctgctggcactgatgttctcaggaaaaaaaatctgggaaattgccccaggcctgacactggagttaagcattaactcagggaggtggcacggaatcagagtttggagatgtcacactgtgggcaaaccacctctctggcctccatgtgctcacatctggaataaaggttaggagtatgtgattgttctctaaggtttttcccgctgatgtcttttaagtgtgtacgttgatgagtcagttataagaatcatgcgactcctgtctcttcttctcctcccttcacccagactgtgcagaagacataaggtgcagaagacagccctgaggctcgtaaatatacaaaaagctgtaaacctgagaaccttagacagctgagtaccttcccctcctctcctttcctacacattctgacagggtgggctgtgatgagtgacatgtcaagggctttgggattggggagacaggatcattggatccttgaattggaggctggcagagcaatcctagggttaagggacaggacgatgactgagggaggcagccagtgaagggtttagaaccacactggaagcttgatgagcacgctctcagctggcagcccctactcagggatgcagggcaggctgtcccctttgtccagctcccctgaagacggctcttttggaagagatgttttccttccaggagctcgctctctcccctctgtcggaatccaaatgctagcaggtggacgatgcagcatgagggcccctcaccacttagggcaccttctggactcaaaatcctgcatgagaccctcttccagaaggaggtttcgggaccacagtgacagggtagagtcagtaagtcctggtgaaaaggaaacaccattttttcttccagactactcttaatacttcttaaccgccaaatgtgtggggtttgttctcataccaagcgatttgcagtggacacccaccgggtgtcctacccttcaactcaattctcacactgtttggagttagcacacagcctacagggagtgcacacacccctcagtcccacaacactgcccccacttcagatgccagtgcttcagaagttgtcacctgtgcttctgactgaccagatttaaatcgggagttcccaccagcccattctcaggtttgaagatttgctagaacagctcacaggactcaggaaaacagacgaccagcttatggtaaaaggatacaactcagaagcagccagatggaaaagatgcctgagacaaggtgtggggaggggcacagagcccccatgcccctctcccagcacttccatgagttcagcctggaagctcctcaggccccatcctttggggtttgggtttttatgaagacttcatttataggcatgattcattaagtcatcagtcattggtgatgaaatcaacctccagtccctctcccctctgtggacgtgggtagtgggcataaggctgaaagtcccaagtctctagttggttcccctggcaaccagctcccatcctgaggctatccaggagctgccagtaccagtcatctcattagcatacaagaagtcactcatcattttggaggttccaaggctttcaggaactttgtgccaagaaaaagcagagatcaaatacatgtttctcattatgccacacctgggttcaggatcctggctctgccaatttccaggtatgtgacctcagttaaactacctggtctctctgagcctttgttcctcattgtaagatttcactgaccacatacataagatgttctgtggactgcgcatagcagttggcataaagaaggctgatgacaaaagtgagccccacttttcctcctcctccagctcggagcagtctcgcacatcccacagccaccctaacagggagcaaggctcgttggtgctgccggggctcaagcttggtgtcagaaaaggcagagatgatgagtgcaaatgcgagctctggagcctgcagtcctccactgtggagtggggtgacaacgaccaaggcacctggtttctctacaccttggcttccttgtctgtaaaacaggacgtctacaagtgcctgcctcatggagttaatgagctaatgcacgtaaacactttgaaagatggctggcacacaaatgcccagtaaacttcaactaatagtatgatcaccaccaccacagtcaccccaggtctgacctagtgtggcgtgcaaaatacccctcatattcttcctgcaggtttccctgttgggaggcaccctggagctcagttttttctttttcagcctctctagggacaagacattggtctctgggatgaatgggaggagcctctactattgacacagccacagcaaacaatgcatgagctttgctggagcaaagaagggtgtgggcctgttgggagaggcaggtgccagcaagagatgctgagtaccccgcccctctttccttaccactgtgctggacaaacagccatctggagcagactttctactttcaaagaactcatggtctagaatgagctttatctggaaaaggacatgcatcctttgggatttggaggtggggtgaaaaatctctaaggctcaagtgctctgaaaccacatgttccatagagttcctgtttcctaaaaatatatatttccagaggttcttatttgagaggtcttcttttttctttttcttttcctttcttttttttttttttttttcattttgagatggaatctcgctctgttacccaggctggagtgcagtggcatgatctcaactcactacaagctctgcttctcaggttcaagtgattctcttgcctcaacctcctgagtagctgggattacaggcgtgcgccaccatgccaggctaatttttaaatttttagtagagacggggttttgccatattgtccaggctggtctcaaactcctgacctcaaatgatccacccaccttggcctcccaaaatgctgggattacaggtgtgagccactgtaccccgccagcccttcttttttctaaagtgagtaaagttttaccaaatctcaactggctgggatgcacagaaagtagtgagcaaggttggcaggaggagaggggagaaagttgggggccatttccctagagagatctggcatctatcagctgtacacagccatctagggctcagtgtttgccagtgtctgagttctgggctgtctctgttggttattcaggtacagaatgctcattttccccctgctccctctgtcctttctgtcctcccttatttcttcccttcattcaacagacccttgttgattgcacaaatgtctcagtttccctgaatttgtgcaaaaacctattaatttattctttcaatgaatatttgttaaatgaatgagtgagtggatgtttgaatgaatgaattttagcaccctcagctgggagtaagctcacctcttgagtcccctctctccagtggcaggttggctcaccatcccagggagcctgcattttactggagagggtacctatggtgaccctctgccccatctccagtgctcttgagtggaagcccctccgcagtcctgccccaacccccactctctcctgtctcacctttctctcttctccacgcagcgcccctgctccagacaagtaacatcactccttctcttgtgcctttgggcctctccttcccactgtctagaatgcaggcagctctatgggcacccggcaaaattctctctcctttcaaggcccagcattttcagtgtagcttttcctgatccctacaactgaaagtgactttttttgcctgcctgcatctctcatacacctttcctggatttatcccattccaccattcatgatcacttatgcttgtcttatccactgctgaagctcttggagagttataactacacttcatacacgtgtacactcccaacattgtgcctcacacaatgtcctatgaataatagctgctgtaatatttttattgaatgaatacttcatattcacttttccttgtagactaaattttcagctgtcgtcatgatggtcatcgcatgatattagtcttttctttctttgttcatttattccttcatccatttatttacctaattatcctaatacagtcaagcagtgtgctaggcatcagaatataaagatcaagagggggccgggtgcagtggctcatgcctgtaatcccagcactttgggatgccaagacgtgcagatcacttgagcccaggagtttgagacaagcttgggcaacatggcaaaaccctgtctctacaaaaaatacagaagttagctgggagtggtggctcaggcctgtagtcccagttactagggaggctgaagtgggagaatcccttgagcccaggagccagaggttgcagtgagccgagatcacaccactgagctccagcctggggcaatagagccagactctgcctcaaaaataaaatagaataaaagattaagaagggatgttctgatgcagagagatggacacaaataaaaaagagctgtgtctggcactggaatgcaccttcacactctcatcagagccatggcctctgtaaagacagagaccagtttggtttgcagaagaatgggtgatgtaacctcttaaacataactcataggaagatttcccaaaaagtttatatcagcgaacacctggtacatcatggcatctctcataaacccttctcagtttagctccgtcatcttcacaaccatgtgagagtaaatcaggagggtggattttgagatgtttgtcctcgggtcttatccaggtcattcatggcctttgacctgctcctataaatagctcttgccagtgagcatttgcaagtcccctctgggctgaggattccccaattgctaggcctagaaacactgctcagagtctccgccagcctccctagcatcagaggcccaggccaataccgaggcattgcaaatacagggaaggtaaaggatgcaaaagtaaacatttgctggatactggagaggcgaaacatgcttggtgtctggggacacacaaggggacaacaaagaagccaaaccacggtgatgggggtgagagaggtatcctcccttcagttcttttttttttttttgagacagagttttgctgttgatgcccaggctgtagtgcaatggcgtgaccttggctcactgcaacctccgcctcccagattcaagtgattctcctgcctcaccctcttgagtagctgggattacaggtgtgaaccaccatgcccagctaattatttgtatttttagtagagatggggtttcaccatgttggccagtctggtctcaaactcctgatctcaggtgatctgcctgcctcagccacacaaagtgctgggattactggcgtgagccaccacacccggcgcctcccttcgtttctgttggagcccccatccacaaagcaatgagaaatgctgaaagcagacagaacgtaggtgctctggtgacatgtactcctcattgattggatggagctccactgaacatttggcccgttccttaagggccgagtgacagctcagcagatggaggggggaaagacactctcagctgtgggaacaggatgcacagaggttcagctgtctgaaagggcagagcattttctatgatcttgcatcctgtgagctggcataactgagtctggaaagattgagtgggaataggttgtgatgttcttgctatgcaagatcaaggtctttggattttaatgtgattctttctaggaatttggctctgcccttgacaagcctcaccccaaagctgctctttggtaacttacacccttcccccacaccaccatcccttgcctcctaggacttcaggttctcctttctgcctcacagctctaggagtccagagtatcaactggcagaaggccttcaaccgacaagcgcatcacacagacaagttctccagccaggagctcatcttgcggagaggccaaaacttccaggtcttaatgatcatgaacaaaggccttggctctaacgaaagactggagttcattgtctccacaggtacctgctcattcccctccttgcccaaacacacacatacttgagtagcccttgtgcattcaaggactgatggggaccacactggggccactggcattgggttctagccttgctctgtcattgattcagtgtggccttgggcaagttgctgtccatctctgagcctgagagtcaccatcctcaaatcaagagggatctggcctgtatgtttgttccagttacttccagtggtagaatatggcgcttcattggctcatgtcccccagaggggggttgtattggaacctggtctctccacagtctgaccagtgcttgttggttttctcaacctctgtcttctttgacagggccttacccctcagagtcggccatgacgaaggctgtgtttccactctccaatggcagtagtggtggctggagtgcggtgcttcaggccagcaatggcaatactctgactatcagcatctccagtcctgccagcgcacccataggacggtacacaatggccctccagatcttctcccagggcggcatctcctctgtgaaacttgggacgttcatactgctttttaacccctggctgaatggtaggtgtctagccacccacactctcagccctggcctaagctagaaaagaaaaaggggatgggggaaatgatcttcacaggctcaagtttgattagggaaagtccatgggctgtggaaagggcgcagaagctagaaatgaggagctctgacacttaagcagctgtctgagtgtgggcagtccttctatctctccaagccccaatgtcctcaccattaaatggacatcctgctgtttcttctgggaatattgtggagatcacattgagcttttacaaactgcatagcatggttcattttaagggacaataccacagtataattccacagcatggagatagctttctgccagaaagagcaggtgtcttatccctggggtctcattttcagaccctcgggtcatcctagcttctctttccagctcatagttcccacaattggagttggaagagttacagcccaagggtcaggggagggctaaaggtggggcttgctccaacccccaggccggttcaggagtgggaggagaggaggaacgatccctacagtcctccgaggattctagtcgctggtgtctgctttttgtatcaaatagtggatagcgtctttatgggtaaccacgctgagagagaagagtatgttcaggaagatgccggcatcatctttgtgggaagcacaaaccgaattggcatgattggctggaactttggacaggtaaaagggtcataaggaagctaagggtaatgtccctgttacccaagaagctcagcagcttgccccacagatcaatgggaagtcccacatctgtccatctgcctgcccttctttttgttcatgtattcagaagactttcattggccacctattatgtgtcagaccctgggatccacactaaggataaaggagatgaataagacagatccatctttgagggggttgcaatctagtgggcaagacagaacacacacataactcaattgatgcaatgaagtagtattggtgccaggatgcacaaataaatataaggcccccaagagacactggggacagtaatgtagcttctgtttttcattccatgtaacaatgcgatgacacttccttagtgtgcccactcagcctttccaagccacacccttttgttcctttattacagcaatccccatttgagtctacagagttctcagatttggtcagtttagaaaactttcaagaatgccctccaccttttagtttatccaccagacaaaggcattagaataaagcacctcgggcggggtgccttggatatcagaaagatgtgtgcttggaccatctacagaccctgtctgtagtcaactggagcaagttgggaggaagaaaaaagagaaggataggacatagagtgcacctaggagtggaagagaggctatttttttttatggcatggttagggagggcctcacttagaaaggagcctttgatcaggaacctgaaggagatgagggcaccagacagagatcttgggaaagagcatcaggcagaaggaaaagcaaatgcaaagacctaaggcaagaggagctcggccttctcagtttgagaagcaatgacttcaattaagtcttattttgtgaaaatcacttcaaatacatatactttagcaagagattttatttttataactagttctccaggagtctcaataacgtgctcaagattgcaggcaggccaggtgcagtggctcatgcctgtaatcccagcactttgggaggctgaggcgggtggatcacctgaggtcaggaattcgagaccagcctggcctatatggcaaaaccctgtctctactaaaaatacaaaaattggccaggtgtggtggcacgggcctgtaatcccagctacttgggaggctgaggcgggagaattacttcccaggaggtggaggtcacgatgagccgagatcataccactgcactccagcctgggtgacagagcaagactccgtctcaaaaaaaaaaaaaaaaaaaaaaaaaaggatgggaggcagagctagaaggaaactctgagatgagtttggcctaattatacagatggagaaatcgaggccagacaggctaaacagcttgctcttgaggtttgtggcagccggggcgtcggctagaccaagccacctcccatgcattcactttaagagagtttgcacaaggtcttatgcttttttatttttaataattttttatttattatccttttctgtctcttttttgttgttgttgtttcaaaagctgcctttgaggaaatacacagggtcttgtgtgtagtgagtgctctggatgagtttgcggggttgagggctgggcatggtggctgtcctcagtagctctcagttccagaggccacagagtcaaaggatctgatagttcctgtggttcttgccagtgcagttcccttcttgagccaactctccttgtcatttctttaattgtaatgtatggtctcgttctgaacagtttgaagaagacattctcagcatctgcctctcaatcttggataggagtctgaatttccgccgtgacgctgctactgatgtggccagcagaaatgaccccaaatacgttggccgggtgctgagtgccatggtgagtaacaggaaaacgatcacagctagttgtcatcatatattgaacaccacctatgagctaggcacgcacactctttacatatgtcatctcattaaagcctcaccaattacagctggtggttagaaccatccacattttactaacttggagcacaaggcccctctaagttacagggcttgcctgaggcacacagtgagtatgtggcagaagcagagccagacccaggtccagccagcttcaaagccctttccaccacatcatgaagcctttctcagaggaaaagggagcttgctctttgagtgcctgccaaggatgggagaatgcaaagctagggctctgctccatcattgggcctcctgggaaaggaagcgagaccctgattgagctggaggtggtgacctcctttgcctaactcatctcttccacagcccagagcacagcccagagtgtcagatggtaggctgcctcattcatggtctagatggggaaacaagcttggagagctgaagtggcttgctcaaggcacacggcatgcaagtcagaccagaacaaggcctccatggaaaaggcctgtgcccctacaacacacacaaacacacacacactcacacaatcacacacactctctctctctctctcagacacacacacacacgagctagatcccctagaaggcatctatggctctgcactcattgtgtagagaatatctccaaccagtctgggcgtggtggctcacgcctctcatcccagtgctttgggagatggaggtgggaagatggcttgagcccaggagtttgccaccagcctgggtaacgtagtgagacctcgtctctacagaaattaaaaaaaaactagccaggcataggcagacacggtggctcacacctgtaatcccagcactttggtggggagatgacttgagcccaggagttcaagactagcctggacaacatggcaaaaccctgtctctacaacaacaacaaaaaaaattagcagggcatggtagcatgtgacagtagtcccagctacttgggagactgaggtggaaggatcacttgagccaaggaggtggagattgtggtgagccaagatcatgccactgcgctccagcctgggtgacagagtaagaccctatctcaaacaaacaaacaaaaattagccaagcatggtggtacatacctgtattcccagctactcaggaggctgaggcagggggattacttgaacccaggagcttgaggttacagtcagctatgatggcaccactgcactcaggcctgggttatagagcaagaccctgtttccaaaaatattcatccagaatatctaaacctagatcaacctgctcaaaagttgtaagttaagatgcaaaaagtcgtgatcaggcagagtggttcacacctgtaatcccaggactttgggaggctaaggcagagaatcacttgagcccaggagtgtgagaccagcctggacaacatagtgagacctcatctacacatacacacacacacacacacacacacacacacacacaggagccaggcatcgtgacacatgcctgtagtcccagctacttgggaggctgagctgggagaattgcatgagtccgttagttgcaggctgcagtgatctgtgattgcgccactgcacttcagcctgggtgacacagcaaaagcctatctccaaaaaaaaaggcgaaaagtcaaagtgaattctttactttaatcctcttaaactaagtaattacccagaaatcctgtaacctttatttatttatttctatgtttcatggtttaggcatttcttgatctcttgacttttgagttggatatgtccatgctaatgagctagttacttggttaaaaatgtgaacaacttctcagctgcatgataaatatccggggtgcatctgagagggcttttggaaagagctgagtcttagactgagcctggcaagaaaggagtaaggtgggcccagggaacttagtagccgagggagagtatggagaggaagtgagcctggaacaaaatcttgaaaccaaatggcctggaagaggtgggattaaagccctggtgacttagaaggctgagtctctttggcctaggagagagtgggtgaggccagcggctcctgcagctgctgactcactcgcaccccagggccaaaccactttatcgtggagccaatttcctcagctgcacctcccagatgctctattcagacctcccagctgggctgggccatgaactaattatggcctgtgcggagctttgaagtgctcagctttcagccagagatgaccgtgctgatagccactttggaggctggagcaccagtgactcaggagatggggaagggctgcgcaaccttccatctctaaggaggccctgtcttgcctgactctgccatgacagcccaggacctcctggaaggggtgcagaactcactactgcactgagggcctggcaaggctgggcatggcctgtcctgggcaaggatccctctgtgtccagactgtccattctcattggccttgccacttacaggcactccaaggagaaggggtaggacacacaggctggaggagccttcagagatcctggtccagcctctcattgcacagttcagataaacgacagccaaagtttcataaaccctgacccttgactacaaaagacacctcagagcacctttgtcctaactttcccttgaaaattcccttccctattggaaggtgaagaactaaggcctagagaggtgaacagacctttgtgcaatcatcaagttggcaagtggcaaggtggggcttgtaacctcagtgtctccttctctcttttaacttttattatggaaaagttcagacctacataaaagtagagagaaaagcataatgaactcctgtgtctgcatcacaagcttcagcaattacctcttcaaggctggtgtcatttcatctgcgaccctctctttcacagatgatttgataaatcttagacattacacatttgtcataatttcacctgtaaatatttccaagtgtgtccctaaaagacaatggaactcaggtctcgatttctagtccagtgatctttccaggctgcctcttggttgtgtcacttagattagaaccttaaattgaataaatgaatgagtaaactaacaaatgaacaaatagctgaatgaatgaaagaaaagaaatactctatctttattctttccaagaagaagttagttgctaaagttctaaagtgatctttttggccgggtgtggtggctcacacctgtaatcccagcactttgggagctgatgtgggcagatcacttgaggtcagcctaagcaacatggtgaaaccccgtctctattaaaaatacaaaagctagccgggcatggtggcacgcataacaccagttactcaggaggctgagccaggagaattgcttgaatccaggaggcgaagcttgcagtgagccaagatcacgccactgcactccagccagggcgacagagagagactctgtatcagaaaataataatagtaataaataataataaataaataaaataaaaataaataaaataaataaagtgatcttttcgtaagaccatacaccaaaaaagagtttcaaaccatggactcccaggcagactgtgacagcagtgatagcctgtggattcttacctgccagaagtcctctgcaagctggagttgtgccctgccttgccacagcacaagctgtgctgtctgtttcccatgtcaggctgctgcacaggaatgacgtatggatcaaggacaatcaaacatggcctgtttgggaaagcacctctaaactcgtaaaccactccatacccctaagggttaagtgttacaatgatcatccccaagtcacctagaaagacaaagaaaagttcaatcatggcctttggcttccttcctcatctccccaccttgtcctctgaattctgcatgtcagtctccctaggaaaggcattagtgctgactcattttgggggggtggtttctgcccagatcaatagcaatgatgacaatggtgtgcttgctgggaattggagcggcacttacaccggtggccgggacccaaggagctggaacggcagcgtggagatcctcaaaaattggaaaaaatctggcttcagcccagtccgatatggccagtgctgggtctttgctgggaccctcaacacaggtaccttgggtgtggtgtgccttggctgggtcagtgggtggcagtgggctatgccaaggtaccatctccaccacctgagtcctcacgcccaccctgacttgcagcgctgcggtctttggggattccttcccgggtgatcaccaacttcaactcagctcatgacacagaccgaaatctcagtgtggatgtgtactacgaccccatgggaaaccccctggacaagggtagtgatagcgtatggtaagtatctcaccttttccctgaacttcgagcaccacatttgagtggcttctcgctctcaccatccttctgggacccaggtccaaacaggtgttgcaaggcaagtaacatgtcatcacagggtgtagaatggaactgctggcaatgctgattacacacttagcagcacccaagacacctcttctcggtgctctgcggtctgctagtctggtctatcttgctgccgtcagacaaaggatctgatcccagtgaaagacagggctcctaaattcactctgaatttatgggatccattggaccttatactactatagaatatacaagttgaaactattgcttttccagcaagaaatatacatttgtttcatttcaagtaatccatatgacttacaaactttcttaaagagaataagaaaagcaacacatcttctcttagcatatatatatatatatatcatatatatatatatatatacacctattgcataccttggttgacatcaaaagttcagagtttattctggattccggatgaaaacaattatttttttgagatggagtttcattcttgttgcccaggctggagtgcaatggtacaatcttggctcactgcaacctcaggctcccaggttcaagtgattctcctgcctcagcctcccaagtagctgagattacaggcatgcaccaccatgcccggctaatttttgtattttagtagagacaggctttcaccatgttggtcaggctggtcttgaactcctgacctcaggccatccacctgcctcagcttcccaaagtgctgggattacaggcgtaagccactgcacccggccaaaatgttttatatatatttgggcatttatattcctaaccataagtatgccatgtgcacactatcaatacacacacacacgtaatttaatgatagatgccactggaagtaggaaatgtgtagacatatatctgtaactgcatagagcactagatagatagatattatatagataaaaatagacattgttacaactgtttaaggttatatcatataccaagttattaccggatggcaattggcaatgatgtctatatctgtagatacacagagatatctatgtatctatataaagtacccatctatctattgttttaatccatttcaaaggctacacacacacataattgctcacatgcatgtatatggctagataatcgtatgacagatgtaatcttattttcagatgttcaattttgagatagtctacataaaatgtttgtattacttatcattcccagaataagtatatctaacttatctgaaatgtgcttaatgtaactaagggtataaaatgaaacgaaaatagataataatggaaaacactgttaaaacaaataaataacaactccatgccagcaaccgagttgagtaataaaagcatcccttcccttctgaaggagagtgaggtttatgtaactcaccccagagtcaatggattctggggttttactaggggagagaaagcttatttaaggagtttctttcttgatctgcacatacacaactttctctctaatgatattgcttacttgtggccagactttgttttccaacttctcatgaatgagtgtcttcttttccctgggcttttctttgttcttgtgtccaaaatcccatcgcaaccagctctgatcactggggctatgccattcctaactttagtttcttctacaaaaggagatggttggtgagacaagttgggggtcccctcggcataccctttctgtgattatcctgtacattaggaactgcagggacgtggaaagcttaagtctcagttcctccactgaaagcatttttatggtgctgttaggaggcacggggtggggaagccactagtagaggctaattagcaacacagcatggtgtgtgatgcccaggcaagtgactgagacagggataccaggaactcggaggaaatcctcaaggaaggcgtcctggaaacaggaaagtgaggcttttaagctaaatttagaattagaacccaggtctcctggttagtgattcacactgccccccacatcagcttaacatcacctttgggacaagtaggagctgatggagacattccagggtggctctgtggtcatttctgtggcctcatgggagggggccaggcgcagaagctctgactgttcctgaggatcttgtcacccctcccttcctctccccttttctgaaccttctcagaaagccaagggagctgatagttactccctacaccattccctacagctgatggttgggggagccagccctggagggcatgaggacagggagtcccaagcactagctccagccctaccacccaattgctgtgaggcttgcgcaaggcaatttatcctcctggtcccaagtttcttcatatgtgaaatataagggttggcctaggactagatgatttcttaagtcctttgccagtttaaatgtttaaattctcgggagcttcagcccactccactttctataagggagctagccctcccaagggagccctgctgttccttcctccttgaatcccatgcaggggagagctaaaccaagagccagtttctgcctggcgtgaaattactaagctattcttataagggcaaccggagtttggacagaaaacctctgacatgaatctttgtatgttaccaaaaagtgttgaaagctttagaaccgtgcccagatttgcctaaagtaatagaatgtgagaatcaagggagattaagcattagaagtgcttagtaatagtaacagcagcaactaataatttgttgagcagttgttgtgtgccaggtactgttataagtgcttagatttcatcttcacaaatgacgtaggcattgttattttcatccccaatttatttttcatggatgagaaaacaaaggccccgagagaagtaacttgtctaagggtaaacaccgggagacatgtagacattctaagcgcataacattatgtaagttccttgcctttgctacacctcaatttcccacttgtaaaacaaagggccagatcaggggacctcagtgacattttctaggcctttcttttaatcagattcacagcagccagtggggtaaatttttttctaagccactctgctcatgccaatggtttggcttaagaggcacgcagttccggagtattcactctcttcagagtgaggacacttttcgggggagcttagtttgggatgcttctttgagatgtcctccttcgggtccactgcaaaggaagtctctggagcctattcagccaccgagcagcagccgaatgatttggaacagtttagccaaagttatcttgacttttctggcttgttttcttcattcatttggcttgatcccccaatttctagagtcatagatctgactctacctgtagactttgcagaactctgaggtagaaggtgcctagagactgcccagccctgccagggaggtgaagtcaggcagtgcctccagctgtcagcacccacacctcagccaagcccctggctcctcatgcaatctctccacggcctctgcctctgaatacctgcttccactaatcctgaactggctcctaggcccttagtgaggaagtgacagagagtggtttcagcccagaaacaactcaattcagcaaacatgattccatgcacatctgcactggactccgggcaccaagaggaacaagatgcaggaactgtgctggaggagggtttttgtttgtttgttttgttttataactaggccttagagactgaatagacgagtttacagctgcattaaaagcttggcaattatggagtagcaatgaaatcaatgaattatttgcaagagtcagagacagcacagaggtattattggcactctcttggcgtgtcaggaaaggcttttttggcagaggtagtatctgaacaaactttgggaggacaaatgggagtttacctacagaagggcagggtttggggccactttctaggcaaggtctcctaactctgtgatttcaaaggtaagcatagctcagttggtgtctgtagagcagtgttttataaacgtcaaagactgcatgagaattaatttgtgtggggaaagatgagagcagcggaaatctgcactttttaataaatgccttggatagttctgatgcccgcagcctgtcctctcctgagcttatgctcctgaaaccctcaggaaaggagtggagcccgaggttggggggtgggagacagcgtggcacacaaccagaaacccacaccggaatttccacatggcgccactgggcattggaaagatgcacatcccaaatatttctgtgtaactgaagtggctggcttttgcatgagggaggaaccaggatgcagttgttatctgctctgccttaaattcctgccttgcaagcaagtattaaaatacagctacttatcaattttttttttttaaccagcctgcccttccccttgggtgctctgccaggagcaaattgagtgtgaaacttggtgtccttattcactttctcatccctcccttgctcctctcacccacctgggaccatcttcccacactccttcccttgccttctccttggtgagttctaaccgatcatgaaggcctgttcaaaaagactccctggatcctggagatcatttttatgatgcccttttaaaaataattataaaaaaattcaaaatacatacagaaataaaaatcatttctgatcttattcacatatcttcaacacttggtagttttccattcatcttttctctatgagttattgttatttacagaattgggatgatacattttccaaggcatgagtagaagacggagcatataatagacacatcccactttttcccacacctcgaaaccaatcacttcaccattagttttagtcatgtgttttttactaaacattatatcatgagcattctccctatgtcattaaaaaatcttcaaaaataagatcatttcaaatacgtcgtaagtgcatcatattctattatatggaatggaacctatgtaaagtcaggttacataaaatggaatctactgttaacctgtttcccttttttaaccccagctgcctggattcaaatcccactctgcttaattactcactgtaagaccttctcaagtcacttaacttccctgaacctcagtttccagagttgttgaatggggaataataatcatttctgtcttttagggtgttgtaaggattaaataagttaatatatgcaataacacaggactcaactttctgtgttaacactgtgttagctatgatcatccaacttacatatattttctaattatagaagtaatgagtaattcacatgatagaaaataaaaacattatagaaataagtaacataaaacttagtttgtatgcactatatatataacacatacaccaaactgttaatggtggatatctaagaaaatagaattattgtagactttctccaaagttttatgtataattttttaatgaacggctttatcatacatctacatatatacacataggtttttttctttttccttttttatttccataggtttttggggaacaggtggtattcggttacataagttctttagtggcaatttgtgagattttgttgcacccatctcctgagcagtataccctgaacccaatttgtagtcttttatccctcacccccttcccaccttttctctctgagtccccaaagtccattgcgtcattcttatgcctttgcattctcatagcttagccttgacttatgagtgtgaacacacaatgtttggtcatactgattttcttatttcatgatatctcttagacatctctccatgtaagtactagattgattttgcttgtcctttttgacagctgtttgatatcccattccatggctctgccaccatttatctgccaattcccttattgatgaacttttgctccaacatttttgctgttacaaacaatgcctcggtggacacctttagatatacatgtatgtgcacttacgtgagtttttccatgggagaaattccctgatgtggacttactggctcagtgagtatgtagatttttacaagtttttatattcattgccaaattgctttccacaaggtcatagcaatttaaactcccaccagtggggtatgacagtgcttgttttcccacctggaaatgagcaccacaacgagtatcaccatatgctttaatctctgtcagtctaataggtgtcatctatgtatctctgtcatgttatctctttgtcattttaattttcttttcatagtactgaggttaaaactattttcatatgtttggtggttatttgtatttcttataaaaattgcctgctcgttgctatttatgggcatgtttttctttttctatttcttattttttcatcacttagttcaaggaaagtatgctttctcttatcaatttgtaagtacattacaatattgatacagtaaatctctatctagcatgtatgttggatatattttctctgctttattgatttttttcaatcatttgtctcactttgccttcaaattggataatttctagtcatctatctccaaatttattgactctttcctctgtcatctctatcctgctattaagtttatttatcatttaatttcagatatttgtcctttttccagttaaaatttttccatttggttctttttttcatattttctatttctctgcccaaagtttatctcttttcattagttatgagcatattttcctttatttcgttgagcctcgctctagtagctgctttagtctttgtctgacaattccaacatctggattattttatggtgggtttctgtggattatcttttcccttgaggataaaccacattttcctggttctttgtttgttgagtgattttggctcataccccagacgctggatgtgtctgaattctgttctcttgttttggctgcctatcttgggtcactcaacatgcaaactgtctcccttgcagtaggcagtggctctgctctcagttcagggcttttatctccagctgaacagctcatggtctgcctcatccatgcatgattgagggtcacctagaggtttgggcagcttccttgactcttttcagaattcccccctcactctccagcaacccaggttggttcaggctctgctcctggttcctcagatcagaaagctgtgggctgcctgtcgagttcttgctccatgtactttaccccaactgtggcctttccttagagcaaactcataaaaagtgcagcttcctctacgttctgattcctctctaaaatcatagtgctttgatcatgctcaggtgtctttcctagtttttcatttttttccccacagtttatcattatatgcaaaaggattcatctgttttgagcttatcctccacaccagaaacagaactacaggtttgtttgtttacatgtaacttcaatatttttacatactcaaatatatgagtctcttcctttatgctttctgaaatgggtggtctgcttagaactatcttttccacctcatgagtatagaaatatttttttccacgttgactagaacttggatttatgtcgaacttatattttcttcatgttgaactgaaaagtgccaagaccagtgtgactgtagtttccatgggagtggagaggagagaagagggcagaattgggggacagaatgagtaagaccttggctacctggctgtgcccggtgaggggtgagtggtgactgaggcttactaattgagacataagacaaagaacatttgaggactggcaggtgtcattcttcagttcagatcccagccaagagacggtgtggctcttagataagtcagccactcctgcagcaaccccattcattttcggccaacaccaagcacagaagcataccccgccaggcagagggagaaagctgtgtgggtttgcccctgggtggctggctccaatctggattcgttctgctccttagaaaggtgcatgctggtcaaggctttgacttttgagttaggcatacatgggtccacattttgaccctgccattgttagatgcttaacttctctgagcccaagtttccctttttataaaacgggcataaaaatggtacctatttcacagtgctgtgaggatttccacgagacgatgctcaccagggcttagcataaccgccgtcacagggcaaactcactcgatgcatgttgtcatgctgcactgttggggcaaagatgtgctgtcttgccactcatctgctgtgtggtcttgggcaagcgctgcagtctctggttctatctgcaggaatttccatgtctggaatgaaggctggtttgtgaggtctgacctgggcccctcgtacggtggatggcaggtgttggatgctaccccgcaggaaagaagccaaggtaacttctctgggtgtggttctgagtcgtgagcctcacagttatttacagccatggacagcagcatagggaagtaactccaaagccctctccctctggaatgcatgatgggattaaaacaaaaatagtttaaaaatagatctcccctgctaattttgcttggctcgggctgctgtttaaatgagtgcctgccctgcacccacaatggccactgttgctgcacagagccttggcacaggccaggtgggcagagagagcagccttcctctgccagtaatgattttccttcaccaactgcagcagcctctccttcccagcacagaaaattcatggttccctgttgcccttggggtttagtccacattctccactggtcaccacccacagcagctctctctgccacaccaagctcccccttaggcaggctgcctctgccatccctatcccgggcctctgcttcctcctctggcctccctctgtctcctgccccatcaggggttgggtcccaggctctcctggagcctttcctcttcccttctctgacctctagagcatgacttgtctgttaccctcattttcagttgttctttgaaacattaaaaagtgatttatggggctgggagtggtggctcacacctgtaatctcagcactttgggaggccaaggagggtggatctgttgagatcaggagttcaagaccagcctgaccaacatggtgaaaccccgtctctagtaaaaatacaaaattagtcgggcatgatagtacatgccttaatcccagctacttgggaggctgaggtgggagaatcgctggaactcaggaaacggaggtaaagccgtgagccgagatcatgccgtggcactccggcctgggagacagagcaagactccgtctaaaaaaaaaaaatgtgatatatgaagtaatatgtgcatgtagttgaaaaaaattcaaactattctaaaaggactaacaataaaacttaagtcttaccacacccccaacccctagctcctctaccagaatcagtgcacgttactagatttgggggcttggaggtaactgagacatttgctaggccacaattttccaaaagtttcattgcaacccattagtggttataaaatctagttagtgggctgtgtccatcattttaggaaaagaaaatgaaatggaatggaacggaaagcagggaaaagaacataaactatcaaggctcattagatatagttagactaggctgggcgcagtggctcacgcctgtaatcccagcactttgggaggccgaggtgggtggatcacgaggtcaggagatcgagaccatcctggctaacatggtgaaaccccgtctctactaaaattacaaaaaaaaaaaattagccgggcgtggtggcgggcgcctgtagtcccagctactgagagaggctgaggcaggagaatggcgtgaacccgggaggcggagcttgcaatgagtcgagattgcaccactgcactccagactgggcgacagagcacgactgcatctcaaaaaaacaaacaaacaaacaaaaaagatatagttagactaaagaccattgtcctgtgaaacttttgtttctgtatcatatgtgtgccaagatgtcaaatgtatttctttctaggggttgtggtgaaaaaagctgaaagtcactgacatctgtctatctatctatctaagcttcctatgctgagagctaagaagagggaagaaatggtcaggcttgggagctcagaggaacaagaggtccctgcaggctgcctgttcagggaagtcttcctggactaggaaggtgatgagcttctaggccagaatgacttgcagaggtagaaaagaggcagccaccctgagcacgagaaagcaagactttcctctttaggaaacagaccaaggacagtgggtcagcatggattaggcgcccggaatgcggaattgtgtagtcttatgtagaggttgagttcgaccagcaagagaatcatagcccgggagggtctctgcagaatgccaaatgagtgggacacacagtcaggggtgaaggaatttgggcggggcagaggcagggggttgcagtggtcctggaaggccctggggaatcgggcactgggtaggttgtggccttggcatatatccagcctctgcatcttggcctccaggggtgttccagtgcggccccgcttcggtcattggtgttcgagagggtgatgtgcagctgaacttcgacatgccctttatcttcgcggaggttaatgccgaccgcatcacctggctgtacgacaacaccactggcaaacagtggaagaattccgtgaacagtcacaccattggcaggtacatcagcaccaaggcggtgggcagcaatgctcgcatggacgtcacggacaagtacaagtacccagaaggtaggagggacgctggcggggcagtgccgcgagaggttctattgtgggaggatggctctgaggctggagaggagaaaagtcctcacctcccccgcactggcagccagttctgcctgaatgataggattgctccctagcacctaacatccacctcccaggactgtttccggagggaacaaaaccatcacgggcagctgttgtgccagtggaagtttgctgcagggcacaggtggctgtcaacccagcccatctccagctgtgtccctgtctcaactacacagctagggtgacagcaccgtgactgaacatcacagggagagacatggcccccatgaaaggcccccaagggctttgggagagatttctccatcagtctgctcccttagcctctgagaaactcagggagaaaaccatctgaacgaagaaagggacaaagaaacccagagacctgagcttgcactgtgcacatttggaggtctcccaagaagccagatgaggtgtgattacatggtgtgaatgcctgagctcctgaaatctcaggcatgctacattgctcgtccccctgaagtcaccttggaaagccagttgctgcgaggctgcctcgactcaattatattcactgcccagagtttcttttgaaaccagcagcgcatctcttggagcattctcaatgatgataaaagttctgcatttgaagacaaagttcatttttagaaacagccaaaagtaatttagtgcttgctcttgcaggccacagtcactcctaaatggggtcaacatttcacactttctaaaatgctttgaaattgctcattccattgatcttcacagttggttctgaggggtcaagaaaagcatcctcataaaggtgcacacagtacccacaaagtaagccctgaatctctaagtgacggttggctaatggtgttggccgagtttacaaaaaaggaaagctgagcgcaggtgatggggtctgacttcaagtccaagtgggtgcccccccaggtgctggtatttgtgaacatttggaggcacagttttagggttatgagattggtggcctcaatttggccccagtcttcctctgcaggtcattcccaggactgagctcagatagacctttgctcagtcaataaacatattctgagccccatactgagtgcctgcttcatgctgggccttggggatgcaacagaggacactgtagatgggctggaggtgtggggatgtaggacaagtattttcaacaatgttatgacgtagaaacaagcatagggggccagggagcaaaaactcgggggcggaaggtgaactctagccctaccagccataattgtgtgacctcgagcaagtttcctctgatctctgagccctcgcttcctcacccgaagaatgagaagagcaatgcctgtcttcagcgggatttaaatgagctaaggtatacaaagtgccaagtgcaatgcctggcatatagtcaagacttgataaatagcagtggtgatctttatcaatttgaacctctatagcctcactggaacaatgacttcccaaggtgactattttgcaggcgctgcttacatgactgtacgatcctgtggggttccttaccttaccccacaccttgatctctggctgtctcagccaaacttcctaaacaatggagaatgggcaggtccgttgtgggggtgggggagggggtccctgaaggactcccagcaatgccccagcccttatgcgacaggacagatcaccctgcctgatgttgcccagatcttcttacctaatgactctagcttctctctgagggccccagagaggaaaagctcataaaatatgttgctaagtattgatgcaatagcaacagcaaagggagaaaacagcaggaggaagcttagtcttgagtaaacccagcaggtgacctatataggcatcaaggctccaagcctcattgtgcaaacacacctgcttcaaggtcccaggcacagaaggctcagatccgtgcactgccttcagctctgggttgaacttacagctggactagaggatgggaaggcatcaaaaggaacccagcccaccaggaactaccagcttaggtaatctggctgcctgccttctttttagcagggtgtgtgggaggaaacttagaccaggggtccagacaccagggaactggccccctctctgcctctgcagatgactggcccagtccatctcagagtggtctggacaagttgtgtctcttcttagggccttaacttgataggcatggacgagttggcctctgaagtctctgcaaatcacatgtaatttatgggaaggggcttgctgtatcgtaaaatgcttacaataagtcatctgggccaggtgaagtggctcatgcctgtaatcccagcactttgagaggccaaggtgagcagatcacctgaggtcaggagtttgagaccagcctggccaacatggtgaaaccctgtctctaccaaaaaggcaaaaattagctgggcttggtggcgggcacctgtaatcccagctactcgggaggctgaagcaggagaacctcttgaacccaggaggtggatgttgcagtgagttgagatcatgccactgcactccagcttgggtgacagagtgagaccctgtcacaaaaaaaaaaaaaaaaaaaaaagagagagaaaaaaaataaaaaaagaaaagaaagtcatccagtgccttaagcatttcacaggttgttggggaaggtgggagaatgtaagtgtggtctgcagacgtcaacatggtcactcttccttgtgtacctgtgttcctggaaggtcaccaccttctcctagatctatcttcaggtcaagccttttgtgaactgctcagtcagccctggctcagaggcttgcagtcggttactcagctctgtgtgccctcagagccattttcaggtacatccctgtcattctctgtgggctacttacgccatcacactcagcagcacccatagcctgagtcagagtcagaaaacccatctttttatccagtctttgcagttttgaaaactgaaatctctggacaatttcaactagtcataacttggaaccacaccgaccatgggaagtccttgtcaaccggcacagatcaaaatgtcactccttgactctcaaagcacctttagaaacaaggcagaagaacatggtttaccaaaaaaaattttttaattaagtcagttctaaatcatcaccttgctttttggcttatgaatgtattctaatctttttcagctcagttcttatgatttattttgaaattatctgttttttaagtctcacaaaagacattttatcagaaaaaaatggaatctaacctaattaacgcaagcaaatgatcaagccacatagtaattgtgtgcaggtgtgataaagcttttctacagattttgggaaatttagagctgattagaaaagcgccagagaccaactggtctgtgagtctccggttaagacaggcgagctggagacctgtgaaagtcgaatgcctgctagggcagcaatggagccagcaccagtcctaggccgcctgtccaggcagggtactgtcctttgcccaggttgccatcacatccctggcatgtttctgtcttttcccaccacacaggctctgaccaggaaagacaagtgttccaaaaggctttggggaaacttaaacccaacacgccatttgccgcgacgtcttcaatgggtttggaaacagaggaacaggagcccagcatcatcgggaagctgaaggtcgctggcatgctggcagtaggcaaagaagtcaacctggtcctactgctcaaaaacctgagcagggatacgaagacagtgacagtgaacatgacagcctggaccatcatctacaacggcacgcttgtacatgaagtgtggaaggactctgccacaatgtccctggaccctgaggaaggtaacgcatcccgcagttggaggagatccacgaatccgaggtagccaatggccttctggggctgcagggtgtctgctgggctccaggttagtcagctacgaatggagcagccagcggcccctgtggttaagccatgtattaatgctttggaagtttctgtctctatgaacagagtgatgccaaccaaatgtcagggtggtgccaaccaaaatccttttacgccccaagggaggaaggagggaggctttggcagttcatagctatggcacaatatcccttacaagtatataccacctcacacagtttgaccgtctaaaaaaaggcagattttcagtgtccatcttatagaagcagaaagtgaggctgggagagatttgtgacttgcttcagagataaagtatcatagatagtagtggtagtgctgagtcttggtcctaggtttcctgatactgagtccagagccaccccctgttttctatgttgtattgttcttacccacctcacccccactcccacaacaaatcgcttttcaaatttgacctcaggagggtggcaatgaccacgggaccctaaaccttggcccatggccctcccacagctgccacggggtgggtggaccttctggaatcctgacaacagtgacaggttttcttagaagtctgagcgtttgggaggaacagtgactccttgcccttgggtagcagggatgggaagggaacaaggtggagcagataaaggttgtgctgtggaaggattagaatgcaggtgtgcccacattggtaaaatccttcaagctgtcatgaaaagtttggacttacaagccggattaacagggcagggtggttatttgcttcacataaggaactaatagaaactgattaattatactgcccatcttgaaagaattctgtctccagagaaactgagaggtgtcacacctgtcagaaagcagcatcccctagcaatctgtcttctggcagaattttagcagaaatcttttcaatatcagaagcaactgcctggctgttattgaccttagaaactcaaagaaagggctttttttgtttgtttgtttgtttttgtttatttgttttgtttttagacaggatcttgctctgtctgccaggctgaagtgatcatagctcactgcagcctcaaactctgggctcaagcaatcctcctgcctcagccccccaagtagctgtagtcccaagtaactaggactacaggcatgccattatgcccagctaacttttaaagttttttgtagagatagggtctcactatgttgcccaggctagtctcaaactcctggcctcaagcaattttcccgccttggcttcccaaagtgctgggattacaggcataagccaccatgcctggccaaaagagctaattttggaaatcaaaaaaaattcacaggatggaaatagttaaaaaaaaaccgttttgcagaatggaatggaaaagagagagaaggcaggtgtagtggtcttagagtctggtcgtctgccaagtagttgctagatgaccctggttaagtctccctccctttctgaacctcggaggtcactgacggtgagggttggaccagctgatgcaagggcctgtcctctccacatttggggcagggatggcaaattccttcagtgctaaaagcagaggcagcttcctcctcacagtcttacctacaagagtatgtaatactgtgggtgctggggcatccccaggccacccagcatgacagcctgagggaagggagcacctaagcccatcagggtagggaaagggccccgcggcccacagggtcagaagagaggacttaaagcgtggggaaggagccggatgcatggagagaagccaggggaggcatttccatctgggggaaccatgtgagtcaaaatatgggggcgaaaaggtgcctgttttgtctgcagaacaagaagtgtggaaggttcttttaagggacaggtgatgcagggccaggttgaggggtctgaactttatctaaggcaatgaggagccacggaagatttttgaagtcacatgtgacacagaagaagagtgatttagaaaacaaaacagaacaaaacgaaaaacagctttccaaagctttgtctggctggtgtgtggatgatttagaagaactagagaccagaccagaggaatgaaggggatgctgtggcagtagaaccccaggctattagatgacggggaggatcctaagcgtttgtttagccaataccctggcttcccttcctacctattattgtgttactgtcatgattgctactgttgttggcaatcaggtggcatttgtattcttccactgcccctcagaaggacacctgtggctgggagcagtgctcacgcctgtaatcccaacactttgggaggccaaggcgggaggatcccttgagtccaggagtttgagaccagcctggacaacatagagagaccccatctctacaaataatttaaaaaattttaaaaaaaaaggacacttgccctcccacatttttcggagtcgggaggaagcagcggtatctttagcccctgtgagcccatcctcctgggaatctgcccagccagagagagtcctggggcctccttgccccctgctccggagcccaccctgaccgggggacgcttcccacaggacctggcccaaggagggctcagtcaagcccggggctgcagatcctcccaccagctcaccctgccttggcttggcatctgttctgaggaaggttcagaagccatccccactccccctcactcggatcccctggcttctccttccagaggcagaacatcccataaagatctcgtacgctcagtatgagaagtacctgaagtcagacaacatgatccggatcacagcggtgtgcaaggtcccagatgagtctgaggtggtggtggagcgggacatcatcctggacaaccccaccttgaccctggaggtaatggggctccccatcctgtgggaaggggttctgcccccagccagcccagctcccaggagccccactgtccctgtgagccacagctctcccagagggcaaaggagagttttttcttgctgggaggggcagagaactgggcccagcttcggtccagcctctgccaaatagccaagagctcccactcaggcccgtgttcctgctccctgtctggtgagataaacgcgtgcatttgcctggctgcttctcagattctagttcagaaccactgggggcatcagctgaggaggggcctgggggactcttttcagctcattcccttctcactcagctactgagcatttgctgtgttctgggccatgccaggcttgagatctgctgtgttctgggccatgccaggcttgagaatcacagacaggcacaggtgtaggtctcacacacagccagctgatgtgccagggccacagcccagccctctgtcatggacagatcagaaataggcctgacccacagcatctctcccctgtctagaccctggagttacagaattgtggactcttaggagcctagtcacatgctcctgtactctcatttcacacaagtaaaccaaggcccagagagaagggaacagctggccaccgccagagtcaaggctaggcctcagaacctgggactcccagcccatgcccctccaaggcgtcctggtacatcaccagccagcaacagcatcttcaaagtggctgagaacaaagacccctctttctctgctcatagggcttcctttactttgcagcattcactcccaggctccttctcaggagcccaggaaggtggggcttgcaggtctgtgggaggcccctcgtgccactctgtgtcttcctcagcactggtaggagcacctgtgcggactccaagcctgtccctcaccctgtagccccctgtgcctgatccccacagcccagggtgaagggtgctggaaccagggagtataggtctgaagggtaaaaggctggacaaggacaggcagacaaacggacagagaacatgaggttttcccttggggcccaatcaagagcctcatgggccaggccctgccctctctcatctgctgtacccaccgtctgccccagttgtctagatagaaattgcctttccctgtacaatcacaatgccacaggtttcccaagccccagaaaccaggaagagccagataatcatggctgccctggcccgcccctccttaagctgtaagctggctgcaggcgttcctgacctcagaaagggcagggggatctaggatgctggctctgatgccgggcctggttctcccacatagctggcctgcaattgcacccttttactgtcctggttagtttggactgtgcttcaggatgggggagttggtcccctaccttaggggctagagagtcagtgactgggcagccagtctgggggctgagaagggcagtcgttcaggccttgggccatgtaaccaaatggatctggcattgtatctaaacccctccattgatcagtggtgacactgagcaggtcccttaatctgagtctcagttgctccaactctgtcactgggacaataaattacttcccttgcagagtgtcatttcctcagggaagcctttcctgagctcccaaattaggctcccaaattcatctcaattatacaccctcagaacattctgtccttttccttcaaggcatttgtcccagctggaatattatccttctttgtgcaattatttggttgtgaatccctacccaaccgtaaactccatgagggcaggcattacctctgttctgagttcatcactgtctcccttagcacaatgtcttagtggatagccactatttgtaaaagagaaatagccccttgctcggggcatgactggaacagatccccttggctctggacttgcattcttccctgcacaggaaagtcagtccaggcttgtgccctgcgtgtgacagcctctcctgcttcacaagacatttctgagaaacactccccatctctctagacatggtggacagcagagtgcccattccaactcctgaggctagaaaatgatactgggtggctgccagttcagttatgagaacattctgtactaaagtgatcagtgtttaaaagaacttagtttttggccaggcgcggtggctcactcttgcaatcccagcactttgggaagccgaggcaggtggagcacctgaggtcaggagttcaagaccagcctggccaacatggtgaaaccccgtctctactaaaaatagaaaaaattagccaggcatggtggcgggcacctataatcccagctacttgggaggctgaggcaggagaattgcttgaacccgagaggcagcggttgcagtgagccgagatcacaccactgcactccagcctggctgacagagtgagactccgtcaaaaaaaaaaaaaattagtgtttttccccagtgtattccccattatgttcccttatccaatgtcctcaaaccttcttccagcattatcttttattcaacacttttgctatacatcttccagatttccatggcaagtctacttatctttaagatactacaatatctttagaaaggaaatcagaatatataaggctagaaatgtgccatcactgactctttttaaaaatttaatctttttaaatgactcctgatcttccttcttcgaggcaagttctttcctccacctaagccttcacctaatcgagacattcttgtctctattgaacggatcaatgcctagctcactcagagcaggcacggatttttaaactggagaaggtgatctgtatgaaaagataataatttgggtaaaaccccattatctaacctggtactgactggcaattagcactgaggaccttagaccacaaaaccaggccaaaaacaatctgaacattgtttccaaagggtgatgtcctcccaattgatccatcatctgtgacaagcaaactcaggtttttggtggcttttatcctttcctctgggtacatttacagagttgggtcaataggagagagtggtaagcggcattaaaaaaagaaaaaaaagcatggaaatctcaaattaaatatcaccatgaaaaatgtggcaacatctgtatagctttcttataacccaatagcataaaattatgctgcactcttcaaattatgtcatacacttaaatgagtttcatggaagaaatgaaaatatagaccatgatgtgtaaaatgcttcaattactcacaaattactgggaggtattgcagacctatcagaaacagcaaaggctttagatccagctgggctctgctgtttccttgtgtgtgaatgttccaggttattgaatcagcctgaacctcagctctgtcactgtaaaatggttgctctgaggattagtgacaagaaaaacaaaacacagcaacaacaaaacccagcaacctccggtcatcctcaaaagaagaagaaatccaatagccataaaatgtccatttctatgtccaaaatgctttcttccccatccttgatctcatttgaccccttctgggagggaagagatgattgtccttctttaccagatgaggaagttgaggcgcaaagagatgacttgtctgcccagaatgaattacggctgtttcttggcagaaacacaacagctttcatcttttggtctgaataaatagtccaaattgcttttctgaccccaaacccagccttcatctgttctgatcactgagcaaggaccgtgtggtattagagctccgctcagactataaatggtgcacagggaacctctgggctctagaagtttagaaggacattggtagactggggtgtcagcagaggagagtagcctgggttgagctggggggacccaacccctggaaaaagagttaagggagctacagtgtgagccagggtgtgagcagctgtagggcctggggctgcccttttcaacacctgtggggcctcccagagacggaggttcaagctttaagggaagaaacaggacccataagcaggaaagccaaggaaagtaatattaaacccagcaagtggctgggcacagtgacttacatctgtaatcccagtgctttgggaggccaaggcaggaagatcacttgaggccaggagttcgaggccagcctgggcaacacagcaagaccctgtccttgcaaaaaataaattcagcatgaaaaatgtcctgaccctcacagagcccacagtggggttgggctgtcctgggaagcagggtctgaactggagtcggggcagggaagtaacagtgttgttggctgctgcagggggccccttccccctcaaagctgaggttctcatccacagcacaggataatgtcctgggaccatcctgtgtattggggggcagggggcgtcagacacaatgtgcctggcacctaggagggctaaatggtctccccttcttcatcctcagtgacatcacccccttcactcagtcaccctgcccagccctcaccaaggtgcaggcaggggctgagcagctggagtcctgactcggcagcccctctcccccataggtgctgaacgaggctcgtgtgcggaagcctgtgaacgtgcagatgctcttctccaatccactggatgagccggtgagggactgcgtgctgatggtggagggaagcggcctgctgttgggtaacctgaagatcgagtgagtcctgggcctaagtggccggtgcaggagggcgggagggggcgggggggccctccagatcccctgggtgggacagacagagctccctctgaccttgggttctttactcttttgggggtcttggaactctagaatctgcttttgcatttggtttgggggttcaccaaacttgaactcctgagaagaacaggtcaccagagctaagagctggccttcagggcttagaatatttgggagatcatgggacccccccctcctgcttcccctgctgaagagttccagggctggaggggccccgtaacccagagagacagctagagggagctaaagaagcagtggccttgcccagcctccatcagaacaggacaggaggtcacaggaggcccgtccagcccaaggtccgtgtgtctcgtatcaacactgatctgtgccctccccatcagcgtgccgaccctagggcccaaggagcggtcccgggtccgttttgatatcctgccctcccggagtggcaccaagcaactgctcgccgacttctcctgcaacaagttccctgcaatcaaggccatgttgtccatcgatgtagccgaatgaagggcgctggtggcctcccgtacaaacttggacaacacggagcagggagagctcaccatggaatgaaccccccgcccatgctgtccggcctgggaaaccctctccatctcccaaggctgccagacatggacctccgggctccagcacatccccctctcctctcccccaggttggggctgggtccaccctgtcctatgacttgatcacttttgcacattccctggccgcttctccccagagctgcctgctctgtgagccccacagccctgctcattcctcacgcccttcaatgctgcaggatggactggcccctgacccagggactctccaaacgggatacaggagagaagctggtctagactgtttgctgatccccaacctgcacggggcattcctgcttctctctcaggccaccacagagggcaggggatggttagccacctgccccagcactcacaccctaactcaaaataaatgttaaataagtgcgatcacacagcaccgactctacctgactgctgttgcacctaaggtggtgaaggagagaggaggctgtggccgtgaccttctggagcagggaataaatttgaggaggccatgttctctgtgtttcaatgtccaaagggagtgggcttgatctgcaaggctgtagatgcaaaactagggaaacatttcaagccagtttaggaaaactttctaacatgatgtccaaaaatagatgaggctgccttgggaggtagctcctggtcacagaaggcttcaaacattctctgtgtggttgggcaaacttttcaggcctctctacatgcatcagagtgagaggggacgtcacagtttttgctggaaccctctggcagagctggtcccgggggtggcccagcctctgctcacatggggctccacgctcctcttgtggccaggagcaaatgcgtccttccgccagccacagcgctgttaactcaacctgaaccttctctgcctttatacacactctgatggttcctcagcctttgtcccttaaaataacctcaaacaaatcccattagctttcctgtcgcttgtgctgactaatcccattttgacaactctgcctcattttctgaactcaggagacaagtagaatctaaatagaaacctcaacctcacatccagctcaaagcttctcccctgggtgcagcgcaggccttacttacgcctgcagagcaggcactgtccatctctcaccttccttcccttccttccccgaactggggagttgctagatccctcagagttggagcagagagagaagaagaaaagtgacagttgtctgtatcactggtgctgatgtaatgcagccaatgatggtctctgtgtcgccagtgtttaaatgcaggctttctgtactgcttgttgcctgagcccaggagttcaaggctgcagtgagctatgattgtgtcactgtacttcagcttgaatgacacaataagaccccatctcttaaaaaaaaaaaaaagcggtcagtaaattagggatttggggttgaatcacttaccatccagctgccttgaacccatcctcatcccatattatcccaggcaatatggattgggtacatctgggtggatgccctcaaacgttttgacttccaaactcctctggaccctcagagcccatagacaggcctggcctccttcctattaagatccagtaacttctctccccacctcctatcccatatgggaagacactgaagaattctctctcctgcagcaggggccctactcaggatttatttctgcctcttctcttggcctccaggctgatgtcatgttaagttgcagtgtaactcagttggggatgtgccatatctgataaagaaataaagagactatagtccaaaggatccgaaaaactaggatcatgtgacagcaggatcacgggagaactctgggagtggatttgagggtgcttaatcaaggaagccataacaggagcctaaacaatgaagaatttattgacttggggccattcttttgtgatacgagatttaatacccaggtgaggatcctgagagctggtgcaaactggcttagtggctccaaacatctggaagaagtgatgacttacgctaagtacagttgaaatggctgaattcctatgctgcatgatagaggaaagaattaaaaggctcagggaaatgggcgtgctggggttgacatattatgaggggccaggagacatcttccaaaggattgtgttccctcagagggcccaggggacccacccaccattcaccaaggccatcagaaatgagtagtgacagaggcatcaacatcactaagaaattcagtggtggcatcctctacatttaaagcaaaaataatagcaacattgtagaagtaaaatgtatgaaaataataacacaatggccaggaaggaaaaaaaaacactgatgtaaatttcttatataatacatgaagtaataaaatattaattgaagatagactgtgacaag

SEQ ID NO: 12204 - DNA, 41737 bp, Human
  misc_feature (1)...(41737): n = A,T,C or G
acgggccacgttccaatcggcttaccttctgtctcctctaaacagacttgcctgattctgggctgccagattttacagaaggaggcccatcttctctgtacctgcccatcggcacgtggagtcatgaatacataccttcctgctccccagtgagtgtcacggtcttcaccgcatgctcctgaagtgctgagcagctgagctgcctgtcttcagctttaatcaggaaacacgcattctgtggactgaggaacaggagaggccgtggcacgcagagtaggggatgccgccctccatgttctggccccaggaaaaactaacctggaggcagaaaaactcaaactgatgaatggataattatccactgaaaattctttaaggggaactggtttatactttttttgaatttgagataacatcaatctatttaaactactttttaattcaaatgatgactttgtccctaatagcttaaaaagcaaaataacgtaccttaaacatgacacatacactcttggaggcttttgtctgtgcatgtgtcggaaactgatgtttgccaagtgataaataaacaggtgccattaggaaaaacagaggttttcacaaatgaaagctccttccctctcccacacccgctcgcatatcctccctgaagacagaggccagaaagtgaggcttgctcttcatggtgcctgccgacctctgcagcgctggacccctgtgggggaatgccaggaggcttaagagacactcccctgccacagacacagtaagggttgtgtccacagaaattcgctttaatgttctctaactaggacttgacggatccatggccaggctgacaactccacacaaacgtgaaggaacctgacaggcaggtgccgacatgaagcaggtgcaggtggctccgggcaaagcagcagctccccagtcaccatccaccccacctggggaagtagcacctcccccatccaaggtccaccccaacccaggagaagcagcagctcccctgtctgccattaaccctgacctgggagaaacaacacatccccagccaccttgcacactgacctgggagaaacagcctctccaccatccacctttcacactggcctgggagaagtggcacctcccccatccactgtccagcccaacttgggagaagcagcccctcccccatgtaccatcaacccccaccttagagcagcagcttcccctttccactgtataccctgacctgggagaagcagcccctccgcatccatcgtccaccctgacctctgagaagcggtgccccccacccccatgcagagtgcaccctgattgcgggtgatgcctgaggtgtgggaggggcgggggttagctgctgccactgcttctcgttctctcgagtccttgctctgtgcctgcacgtcaggttgttcctgtgatggggccacgtgcaagtgtgcaccaaggggacttggccgggtactgtacgtccactgggacacacccttctacgggtattgcacgtccactgggagacgtccttctaggggatcctcactgagcaaatgaagcagaatttgggtaaaaatgaattttcccaaagctgcagtacagcttttcagtcctctaactgcctgagataaatgttggcaacttccttttatattaaatttcatttttgtcacataatacacttgattattgaccataataactttattaatatacagactgattattgatactcaccgatgtatttcatgtgttattgagagtcactcatttggtttagaaagaccaatatcacattgagtaattcgaaacatatttaaggcatagaacttgcatttttttctcttaagcaaaatgaggagttctagccaatcttgctagtgttatttatagcatcttatttcctgagagaagacaggaaaagtgagtccctgccttccctctctccgtctggctcctcccaggcctgtctggcaggggccggggtgcaggaggaggagacggcatccagtacagaggggctggacttggacccctgcagcaggtactcggagcaaatggtgagatcagaagggggatgatgtcattccttcgaaggaatgaattaaacgtgcttcctcgtgtgtctgattgacagccctgcacaggagaagcggcatataaagccgcgctgcccgggagccgctcggccacgtccaccggagcatcctgcactgcagggccggtctctcgctccagcagagcctgcgcctttctgactcggtccggaacactgaaaccagtcatcactgcatctttttggcaaaccaggtacgattatttcttaaactcaatcaattatttaatggtgctctaattttaagaaattagagttctcgaactctaagaagcggagaagaaaaaggagcaatttcgattcttaacttaaggtgggtggtgtatctattaacactaaatggcaagtgtttcttcacgtggtgtttctactgcccgcttgaagagcaaggcacgtggccgctcctcagcttttcctccgtggctgtgctttcaccagccgggcaccccttcctctctgagggttgtggctgctgctatttcaatgtatatacctgcctgggaacccgggtaaacgctttatgttttcagtttccgaagaagaagattccacatgagagtttgttattgaggagagaattagaaacaactcccggaatatctgaaaagtaactggagattagagagagactctgattgttaacatcattattagtagattagagagagactctgatcgttaacattattagtagattaaagagagactctgattgttaacattattagtagattaaagagagactctgattgttaacattattagcagctgaaaagtggttttgaacataactagagagtatttgtggtaagtctatggaaaatcctgtgactgccgggacacacagcgacttttaacagtcttggggcagtttgcatatgaaaagcgagctggcaggttgcctggctaccacttaaggaaggtgggtttggctgcccaggactgggagctgagcacccaggagtctggtgtttaatcagactgctgttggtggtggacggccggtaaacaattagctctctgcaaagctatcttttactttgattgttcatacgaaaagagttttaaaagacctttgcaaattcaaactacattctgctgcagacaggcaccgaaatctttcttttggaaaaacacaagcataaacgtggatgtgtggcgtgcagaggctggggcaggggtgagcggcactggctcatccgtggctccatccatgcatgcccggtgtccctggatgggctgaggccaggtagcctggctgctcatccttcctgtgggatggagcctcactgtcctttgacaatccgcagcaggggatgctttgttagcctcctgctcttgtaagaatctacctcaaggcagagacagtaggatctggtttcgtcaaaggagtttgatttagtttttctaacctgtccttatgaagctgggcatccagaactttcgcatttaccatcctgttcttggctggcctctgcagggccagccccacacagctgtccttaggggactgcgacgtacccggcagtgtgggctgatgaggtggggaggtgggaagagcctgccaaggctgtacctgagctgtgtattctaacaccgttctgtggtgcttactgcatgcaggtactgttctaagctcatggccaagtgttcgctcctgtcattaaaccctcttaagagctccatagaaaggccctatcagcaccaccattattactgcagctgcctcgggcagttagagtagaaagcgccccagacccagaggcacattctgctccggtaacccatgcctgtggctcgctgggctaagtcagcccctggtgaagtttcatttgccgaattcatctctcatgacaacccgatgaggtgggcattttacatgacgctacgtttcattctacggatgaggaaactgagacagagaagttaagtaagtttccctaggttgcacagctggtgctcagcattgctcagcctggtgctgactccggccgcaggccgtgctgcttccggagccaggacagatgaaacaatcaccaaggacccctggggcggcactggggggagcagatggtttggggggggggtcccagcagcagatgggtgggggggtctgcaggtgctgccaagcatttctcttcttctgaggaatgtttctctattcctggaaggtgaggatttccaggttaccaaatgttgtttctggagagggagagtccttggattaacaatgagaagttaacggcctttgatattctaaatatgggaagaattggggtctcagtcttcccttcaacctagagcagggtgtgaccaattgctggaagggacctggggagccctgggaccctcaggctcatgctcgcccggaagaggagaagctgagatccacagggttaatcgcccagccgggctttggaccacatctcctgacttcggggccagcctccactgagctgtgccaacttaaaatccccaagaatggaaaaacaggcctgcaggaaaataaagaggcagggtcaaaatgatggctaagtcaagtgttctgttgttttgtaagtataattcaccaaattaagtttatttgtaacttttttttacagttgatattcattctatttaattaggttatgcataactgttttttgctggatatttacacaaaatgcgttcacagattatttttgtcaggctggatatttttctaaattcaaactttctacatctaagtcctgtctacgagtcgtatgaacagaattactccaggcaagcgctgaacttgcccatcttccatttgctcatctgtaaaatgaggacaattagagcagcacatacctcccaggctattatgaagatgaaataataggaatatttagaacgtgatgtgcagtgcttgccggcaaatgctagctcaacaaatcttatagttagaagaatcctgcttgaagagtaaatttcctccttcgctctcagtttgccacaaatccagttggtgctgagttttatatgcaaactgttattcaatggtcatgtgagtcactgggccagtctcgctcacaggcagggttgcagctgtggactcatcactaacaagggtttcctgtattcccaggagctcagctgcaggaggcaggatggtctggaggctggtcctgctggctctgtgggtgtggcccagcacgcaaggtgagtgtcctcagagcctgtggtctctctctggcttgtgagatatggcttagctgcaaggggagagatgacaaaataaagtgtgtggttggacaatcttacccgtgaggaccttctagctcctttataaatcaaatagtaacttacttctgagccaatatgacatgagataatttatctttggaaaattcaggtgttagagaaaaatgcaattccacctagagttgcacagtttatccttttttctatagaggatgttcacaacactgcaagtatttggtgtttgttgaattctttttgctccactttcttcctcctttaaatattttcccatgtgtttacttttctacagtatgatttttaatgaccacataatatttcatcacagataaagcctgatctttttcaatcaattcccacttagattggtttattttcattagcataaatgatgacacaaaaaatattgacgtggataaatcttaagtagcatttgtgattatatcctttggataggttacaaaattagaattgctgaatcaaagcttttaattcttgccaagtaactctatggaaagtggtccattgcccacttctgtcagcaaccctgtgtattatcctgttctaatttgctaaatattagatgaaaaggaaggctttggctaaactttctgttcagtgtattacttttttttttttttctgggacggagtcctgctctgtcacccaggctggagtgcagtggcgtgatctgggctcactgcaagctctgcctcccgggttcacgccattctcctgcctcagcctcccgagtagctgggactacaagcgcccacaaccatgcctggctaattttttgtatttttagtagagacggggtttcaccacgttagccatgatggtctccgtctcctgacctcatgatccacccacctcggcctcccaaagtgctgggattacaggtgtgagccaccgcgcctggctttgaattatttaaactattatgattttcgtgagatctgatcacttttcttgccaatagcttaggtggtgacttaaaaccatttgtttctgtacttgatactgaccactctttcagatccttacccacagggtgcattaagagttggagaatacatttttacaaaataacaacctgctgacataactggttttaggcagttgatctcaacaagaaagcaacatacgatttagccgctttctgacactctatcaatagcaaggctaaagatccatgtctttcccagtttattcatttatttggttttttcctgagcaatcaactggtagacaggatggctgcttttcagcctcagatctgagatggaagagccagacagagtgacctgggacatgtgccaggatgtcaagcgaggccgggattccctcaccaagaaggtcgggctatgcaaagggccagctgaacggacagggcgctgcctgtctccaccgatttaccttctggcacacgctcctcgaccagccaggggcagaaactgaccccacagacccgcagctgcgttgggcccacactctgagtagcggcactggcacggaggatagtggcttttcatcagaggtggctccaggattcccataaaaaagggagagaagctgcgggatattgggaggcctcgttaatttccttacacgcgaggttctggtttgtcaccctgggtcaggccaacctcgccctcttcccctacgtcacccttctccactgcggttccctttgcagctggtcaccaggacaaagacacgaccttcgaccttttcagtatcagcaacatcaaccgcaagaccattggcgccaagcagttccgcgggcccgaccccggcgtgccggcttaccgcttcgtgcgctttgactacatcccaccggtgaacgcagatgacctcagcaagatcaccaagatcatgcggcagaaggagggcttcttcctcacggcccagctcaagcaggacggcaagtccaggggcacgctgttggctctggagggccccggtctctcccagaggcagttcgagatcgtctccaacggccccgcggacacgctggatctcacctactggattgacggcacccggcatgtggtctccctggaggacgtcggcctggctgactcgcagtggaagaacgtcaccgtgcaggtggctggcgagacctacagcttgcacgtgggctgcgacctcatagacagcttcgctctggacgagcccttctacgagcacctgcaggcggaaaagagccggatgtacgtggccaaaggctctgccagagagagtcacttcagggtacgctctgcagggaggtggccgccgtgagggaggaaagagcttagctgggaactgatctgctaatgcgtctggtgatgcgatgcttgagcaggcagagcctggccttagagaagcacactgcacatcccggcatgtgctcacacacatgcgtgcacacaccacatgcacatgcacacactgcccaccacacgcagccacaggcatgtgcacacatgcacacacaccacacacacacacaaacacacatgctcacaaacacatgaacacacatccaaagacatatacacaaacactgcatatgcactcacactcgcatatgtatatacatcacacatgtacacacaccacgcaacacacacacacagacacgcacacacacacctcaccacatacacatgcatgtgaacacaccctcacatatgcatgcccatgtgcacacaaacaccatacatgggcacgcacatgcagacgcacataaacaccattcatacactcatgtgcacacatgcacaccacacagacatacatgtgaacacacacatgcacacacgtgcacacaccctacgtgggcacccatgcacatacacaaataaacaccatgcatgcactcacattcacagacgtgtgcacataccacacatgcacacacaccacacacatacatgtgaacacactcatgcatgcacatgtgcacacaaccatatgtaagcacttatacatgtgtgcacaaaacaggtgtgcacacaccacccacagccatgcaatgcacgcacaccacacacatgtgaacacacacatacacacgtgcacaaaagtaccatacacagtcacacacatcacatttacatacctacacaaacaccatacatacactcacacatcccccacacataaacacatgaacatcatatagatgcatacacagtaaccacacatgtacacacacatacacatgcacaaatgcacacatactcatacacacgtatacatacacacaaacacctcatgcaaactcatgcatgcacatacatccatcacacatgtgtatacaaacaggcacacgtgcacacacaatgcatgcagagccacaggcagttgtcagcacatacgtactttcacacaggcactcaccctttcacatgcaaacaccacatacaagcgcacacacacacaacgcacgcctttctaaaccacgattaatcagagagggctgccccaggtgtgcttccctaactgcactaattatcgtcagttgagattgaggctggtttgatgatcaaggaatcaaccctattcaaatgtttctagcaatcccagacttttttgatcacaaccaaaaccactcctaaatgtttgctttagtagcgaaatgatgggagagcaaagtagcaggtgcccttttccaagggaaagggctagtgatttatgagggaatggtttcatgtccattttggttaaaatatgtttggaaatgaatcttaaactgcaggtctttagaatcacaatggtgtatggtacattgctccctcccggacgtgtagggccttggaaataagtacatggttaaactcagtaatttgagtaaaaggtctagagatgcatagcttgttgttgagtcaatttctcatgggtgtccaggagttccataccatataggactggcccagccccgtcataactcagctgcggaaggcgctcctgcaggcccagggtctgtgtctctgagaggaccagtgggactctgtgagcctctttgccaaatgcagaaactcgctaatcatgagtgacttgcaaggaacgaatggccttgaacgtccatgggaacatgcccagaacacacagcaggccacacctctccaagggccatctcactcttatttatgaaacatttccttcttctaggtagatttcttacattacacttccatttcttgtgtcatgcttaaaaacaaaatttcaaaagtactatatacagaaaaactgattataaagagattgcaaacctgctacgtagaaggaaatactctcactacttgaagattccaacttgtatttttagaatgtcagttagcttggcatcaaacattggatgtttatctgttgctctatttttctgcttgtgtatacttacagggtttgcttcagaacgtccacctagtgtttgaaaactctgtggaagatattctaagcaagaagggttgccagcaaggccagggaggtaggtgtgttgtgaaaaatgcattttatatactggcttggatggatttctattgtgacatggtgtatgtgtgtgtgtgtatgtgtgtgcattcatgcttgtaaaaatttaagtaaaaatatttgggtaactaccactattgtctttgagtgacttagctggtcaacttagacatgttgatatctgaaaataataaattgattaaacagttaattttaagtagattttaatcatccaaataattttattatagaagacaaaatataaatagctggtgctttaatatgagttgaaatatagacaacttttccagtatattaatgtgtgatgcttgtctgcctaaggaaagtcatagatatttgtcgaacttgacttacagaagttttcttttttttttttttttttgagccagagtctcactctgtcacccaggctggagtgcagtggtgcgatctgggctcactgcaagctctgcctcctgggttcacgccactcttctgcctcagcctcctgagtagctgggactacaggcacccgccaccacacccagctaattttttgtatttttagtagagatggggtttcagcgtgttagccaagatggtctcgatctcctgacctcgtgatctgcccaccttggcctcccaaagtgctgggattacaggtgtgagccaccacgcccggcctagaagttttcttatactgttcatagttgttgactccatcatatgatggaaatctatgctacttaaatcattgacagatgatctcatcttttctgttagttacaattgtgaatcatatttccaagcacactttccaatattttcttgagcatttaattctgaaggtcactatgacaggttcattaaatgccgtacatcatctaatcttcagaatgactacgtgagatgggcactttcactttcttcattttacaaagatgaaggctggcacccaagggagtgctgtgtggctgccatgttgagctccccagtgagcagggagcagggctgctgcctgggtctgtctgacagcctcaaagcggagctcacgtctgccacacggtgtggccgtgtgcacacgaaggccaggccatttcaattccaaattatgacaagcgtaaactgttatgtcatgaatctatacatcaggaatatgtgagatttggtatctttggtgcacaatgactctgtgatcccaccgcctacttcagaaccggggtgcgtagcccactcttcagttacactttgcaggtccgggtccttgtgcacgtcctgtgaggaaggagaacaaggagacatttgatcatcaatgcagggagaagggtgttctaagaccaaccctcattccagctacaactgtcacccccaccacgaccctcactgtgcctgttacctgaggggtgatttgcagcacaggcagagttatcttggctccagcactctgcgtgccagggcctcagcttcatgaggcagtgctcttctgggggttcctggggtgcagttggctgtggggcttttgggtactttttgttgcaataatgttttttcagtctgatatatttatatgtatacgtgtgtgtgtgtgtgtgcgtgcgtgtgtattttcactaatatagaaaaatattgtttttataaacaaaacatatatgcaaatattctttgtatgaaagaaaatatacccttcgcggtgttcctaatcacatgtttgtactataatttcacgtgggttcagttaaactagagctaaggttgtccatggcatgttgagtcagttgtcataatggtcagtgagtaaaactaacctactatgacaaacgtgacttacacctctatgtgagcaaacaccttgtgtgtgtgtgtgtgtgtgtgtgtgtgtgtgttaccagcatacaccctagtaggtgcagcctccttcagcaggtatttcctaggctcacaggtacaagtcaataatccctggaactatcaaaagcaaacctttaaaacttatgggaaactcttagatcttccaaaaaaaaaaaaaaaaaacacagagaaatctagatctgttatctccagatgtgtagaataagtatggatctatatacatatatctaccggaccatatgtggcaatcacccatgagttagtctactcaaaaccaggtggatgccaatgtcccatttggagatctttgccaacacaacaaagacttcttcttcactggttatgtcagacttaaggaaaattggtcttatacaaacagctagttcatgaattggttcttggtaatgacatccccttttccactgtttgttaaaagtgagagtaaccttgtgaagaggctgagccattattattttacaactgagaatactggcagaagcctggagaaatgcaagttagctggaaggttttactaccaggtaaaactacattcctgtcagagccagagcagaagcaaagatatatgcggtcttttgtttaacttttagaggaatgaaaaacaaataccctaggttagttaaagattagtgtgctgggtaaaatccactcagggtggtttctttgtctctattaatgtgttgatattgacctgattgtacatggttatgggcaacatgaatccgaggggaagcttctgagcttagtatgaattgcagcacagtttataaccaagtgattaaaaactcaatcacggaatgcctgacagcgctgtaaaatgtctaagtctttcctcaataatggactgtccgagagaagtcaggcatttcaaagatgggatcttcacccctgagagggagcagggtcctacatgggggtgaggtgagctccggcctagagcctgggccctgactgcaactgcgcaggccccgctgacctgaggactggaccccgcctccgtccctgactcgcctcaggtcaatttgtaaattacatgccatacccacccaggtcccatgatctagggcttcagagggagtggtgggaatgtggaaaggtgggagtggtgggaaggtgggagaggtgggaaggtgggagaggtgggaatgtgggaaggtgggaaggtgggagcggtgggaaggtgggaaggtaggagtggtgggaaggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaggtgggaagatgggaagatgggaaggtgggaaggtgggagcggtgggaaggtgggaaggtgggaaggcgggagtggtgggaaggtgggagtggtgggaaggtgggagtggtgggaaggtgggaagatgggaagatgggaaggtgggaaggtgggagcagtgggaaggtgggaaggtgggagcggtgggaaggtgggaaggtgggagcggtgggaaggtgggaaggtgggaaggtgggagtggtgggaaggtgggaatgtgggaaggtgggaatttgggggaaggtgggaagttaggagcagtgggaaggtgggaaggccaggaggagcaaggcacagtctcaaggggactggctgtttgagcaagaggatagtgaattttctttaaagcagagcaaggagccataagaaagggtgtttggggatgaaaaaaaaaggatgaagagtcgagaggagccgtcagaacatatgggggatgtgttcaagaagcagatttgtggtcggaagctttgcaaagaggggacctgggtctgagtgacatgcgtggccactggtgctcctgcgtttggactgtgcaggcctctcctatgctgatgcgtctccccactcctgagctaatttctgctctgctccttctgtgacatgtggcagcgtgggaaatagccactgtcccctgtccctgctgttcctggtgtcacccagcaccaggccactctgggagccagggcagatggtcctccctgtggtcctggcctctgctgctggcccagtcctccgccttgtgtctcccagcaccaggccgctccgggagccagggcgggtcatcctccctctgttcccagcccctgctgctggccccgtcctctgtgatgctcacggcccttctacgcttgccctcagctgagatcaacgccatcagtgagaacacagagacgctgcgcctgggtccgcatgtcaccaccgagtacgtgggccccagctcggagaggaggcccgaggtgtgcgaacgctcgtgcgaggagctgggaaacatggtccaggagctctcggggctccacgtcctcgtgaaccagctcagcgagaacctcaagagagtggtgggtactcacgcaggggccgcgggggtcatagggcatgggcagctccgccgctggcccatctcagcaggtatcaacattccctggcttggcagtgcctcatgctcgatgtaaaaacccacagttcacaggggaggtgtctgccgggctcctcaggatccttgctcaatattcagcattgttagagggaagttgggtagatcttgggaagtattcccaaggaaaacagtcctgggcacagtctccaaaataaattcttaattttgggaaatttacctccttggtaaatctgtaggtatgagtgtacacacacacacacacatacacacacatacacacacacacacacctgcagaggaaaataattttatttcaaggactgcatgttggcatagctgaagaggcaggacgggaagttcctgtgaggctggcaggagtgaaatgggtttgagcggcacagcgcggccaggaagagagagcgatgcctgcggggctcaggacgggcagctcgcagtttagagaaagggactgaacataatgaggtgctccgggccacggtgccccacaacgtacacatggctaaccagggtgcagtgatgctgactgtcactcgtacccagagggcatgaagtaaatgatgccaggagatggagcccagggcagggagggcggcaggggcaggagtccggggcagggagggcggcgagggcaggagcctggggcagggagggggtcgatggcaggagaccggggcagggagggtggcgagggcaggagcttggctgtatccctgcctgtcgttatggctgctgcctggggacctagttcccaccccagtcccacctggcgtccccagtcgaaggagccccagcgttgctctgcactggtccaggtgtgatgtgagccacgcgatttccgctctccaggaaggcaggtggatggggagccccagaagcccaggcagtgacgaagctgtggctcagaaagccccgtgaggatggaggacaacttccggaacttccacccagggatgagtcaagtcttacttgactttagagctttttaatgaaggaggaactttgtttttcatccacaagcatgatgactaaataggtagtattattgtctacacttaaatgtttcacttgattttccagtcgaatgataaccagtttctctgggagctcattggtggccctcctaagacaaggaacatgtcagcttgctggcaggatggccggttctttgcggaaaatgaaacgtgggtggtggacagctgcaccacgtgtacctgcaaggtgaggccccagaacacggctcttgggggaagaggccaccatcggacacttggcagaacctgactgcctggaaatgccagcgttcagtgctgatgtgtgaaaccggttcagctatgtgaggaaatttcagtgtaagaaacacagaagggccaggaaccgtatttaggacttgaatcaacctctttgtttgcacataaagaaccagagcccagagagggggagcaacctggccagcgtccccagttggttagaaacaggaggaacagagaagccagacatggccctagaccctgcatttaattccatccggttccaacagagcctgaggctcagcagaaacgtttgggggaaatacaagccactgcctgaagtcttacagacagacaatttagcttttaatgttactctatttctgctgacaatggcctcagcattaccttagataacaggagttcctgctgcccgtcttttcttccctccttccaggaagcttggagctctctgttgcatccttgctgctcagtgaagggagaaaggaatggaatggatgcaaagagccatctgggggccctgttcttgttaggctgtcagcactaatgggagaaaaagatgcccttattttcacatctctgtaatgtatggtccgtaggatggaaaacattcagccattctgtcgaccccttctagtctcagcccttgtaccagcgtcccctccttttaaatgagtgttccatgcatgcctttcttcacttgtagaaatttaaaaccatttgccaccaaatcacctgcccgcctgcaacctgcgccagtccatcctttgtggaaggcgaatgctgcccttcctgcctccactgtgagtatcgccagccggcaagcgcatcctgcatttttaggaattccatgcttgtttgtttatttattcattggttggttttggcagagaagagtgaggttcagccccctgagtacaggtgagagaatcagagggccaccccaggccactggtcatccactgaggactgactcatggctagaaaggagtgtggaagccctgggaacgcgggggtgggaaggccagtcctgatgcttctcagacgaggaagctgagcccagtggtcacgcaggtgagcccagagcaggccccgatggagccccagctgagagtcagagaacacacgtagatctgtgactgtgttatggcagcaagtgatcactgtacacacactcctggaaaaaacaatagaaaatcagacaaacaaaaaccaaagactgttatccgaagaatatgttctaagggatagaaatacattctaaggaacagaacctgagatggagaggaaccacgtgtgggcaccctgggggttcctgggccaccctggaaactcagtgcacgttcagagactgagttggccccaacgctgccctcaggtctctgtgctgcctcccacccctgccccgagttcccttcccaagttagctctgctgaccccacccagagctcctgagccatccgtggctccccagtgccgtgccgttggcaaggtgcttcaggtctacaccccaagttgctgctgcactaagatcaggcaacgcttctcccaaactaaactagtcaccatcccccaaacattcccagaatgtccctgtggccccagagctgtgtcatcctcagggcaccttacctctgatgtggacagagaatgaagggactcagagctcacgctctgccactctgtgattttgaataaaatgggatttttctgagtttcaaatttattgcctgtaacatgcagaaaatgtatcccctatacagttagtcttataattaaaaccaacaattcaatatgcgtaaaagtgcctgttaggtattcacaaagtcagaatgctcctggcaaagcataaaaatataatcttgataatcaaagggcccacattagactagaaggagacattttatgttatcaggagcatcatgaccaggaaaagacctccttgaccatttttcttttctttcatttccctgctttctagaacactgagtcatggcgcattcactgggcttctctcctcacgggaatgatttctggcgtcaggttgctctttccccccatttagcggctgtgattacctatgaagaatttctttacagggaatctcctttttattagcttgtttcagtttacttggaaataagtgacctgtaattttcaccaataattgaaatgtttcactacattatgtaaatcagcgaacagaggttaaatggaaatacgttacatttttgtaactttaatgaaacctcatgtagaaaagattcaacactgtctttggcaagctattttataaaatcgattaagagactttcctggacacacatggatttagctcccctcagcaccctaatagtagacccagaaaggcgtttttgctcttctcttgaaaggcagtccctgaactcccgtgcaggtcacaaacttgggtcccacggagccacggcccagccactgggatgtccacctgccccagccaggcagtggcccctcagattcctggatgcatgaactgtggccccacgccagctgccctgtgcccgttctgttctgtggcacgtctgtgaggcagggcctgatgccactgtgtttgcttcctctggcagcggtggacggtgaggagggctggtctccgtgggcagagtggacccagtgctccgtgacgtgtggctctgggacccagcagagaggccggtcctgtgacgtcaccagcaacacctgcttggggccctccatccagacacgggcttgcagtctgagcaagtgtgacacccgcagtgagtgtcgggcaggtgacacccgcgtgcctgtgggggtggggccgcgtttctctcagtcatcgggacctttgcaagggacagagctgccctcacgaggtgctgggcctttgcaaggattctagccaggtgaggctctttctcccagctgatgggaggggttctccttccctctcctcagcagctgtgagatgctcctcagttaataaggcacaccgcttacaggcaaatacccctctaggcggcacagcctgatctctctctgcttcttgtgttagtccggcaggacggcggctggagccactggtcaccttggtcttcatgctctgtgacctgtggagttggcaatatcacacgcatccgtctctgcaactccccagtgccccagatggggggcaagaattgcaaagggagtggccgggagaccaaagcctgccagggcgccccatgcccaagtaagtacggtgaaggcggggccctgggtgggcgggcttgcaggcagctcacagtgagcagccacagctggagccgggatccggggtgtcagggcctgttccagcccagcccagccccagccgagcagcaaagggggctgccatcccgggcctggctcggtaatgaacccatcctttgtgattaattctgctcacctgtgctcagcgcaaacctctctgagatagccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccagggaggcctggctcgggaagtgcatggatgtgctgagaaaaagagggtgtgcagggattgccttcagctgtgctcacgcctcatgggaactgcctgtgaggacattcggtgtcataccaggcttctgagttgaggccaccctccatggcagagggacagcttggcgaggagctctgagcttctcggtgtaaatggtggtgtggggccgggcacggtggctcatgcctgtaatcccagcactgtgggaggctggggcaggaggattgcttgaggccaggagtttgagagcagcctgggcaacatagcgagaccctctctattaaaaaaattcttttattaaaaagaagaggtggtatgatttgtcttctggaggccaagagatcgcagcaaagccattggaaacactggcttctgagtcactcccggaatccaccattgcagcaggcgtagtggtgcgatcacgctctgacctgtagtcagccaacctggggagaaaccagtttgtggggctgtgtagggaacaccatgtcccacctgctcttccctctcactcagccaactcacgttctccaccccgggtcttgctctgagctccccctggttggctttccccgcagtcgatggccgctggagcccctggtccccgtggtcggcctgcactgtcacctgtgccggtgggatccgggagcgcacccgggtctgcaacagccctgagcctcagtacggagggaaggcctgcgtgggggatgtgcaggagcgtcagatgtgcaacaagaggagctgccccgtgggtgagtgaggggtagaagcgggggcactgaaacccgggcttccattctgatgaaaagcacaaacgctttgggaaactagatgaaaaacacagaaaagaaaaatcaattttagttgcacacgcaaagataactacttttaacatctgtgtttcagtcctcctgtatttctaatgtaaaaacaaaaaagatgccaggtggcgtggcctgtggaatgtgggtagttgtgtggcgtggaatgtggtgtgtgggtaattgtgtggtgtggcctgtggaatgtgggtagttgtgtggcgtggcctgtggaatgtgggcagttgtgtggcatggtatgtggtgtgtgggtagttgtgtggcatggaatgtggagtgtgggtagttgtgtggtgtggaatgtggtgtgtgggtagttgtgtggtgtggcctgtggcatgtgggtagttgtgtggctgggaacatagcatgtagatagttgtgtggtatggaacatggtgtgtgggtagttgcatggtgtggactgtggcatctgggtggttgtgtggtgtggactgtggcatctgggtggttgtgtggtctggaatatgtagttgtgtagtgtgaaacgtggcatgtgagtagctgtgtgttgtgaaacatggtgtgtaggtagttgtgcggtgtggaacatggtgcatgggcagcggtgtggtgtgaaatgtgacacatggtagttgtgtggtctggaacgtggcatgtaggtagtagtgtggtgtgtcaccttgcatgtagttatgtgttgtagaaggtggtgcgtgggcagttgtatggtctggaacatggtacatgggtagttgtgtggtctagaatgtggcatgtaggtagttgtgtggtatagcacctgacgtgtgggcagttgtgtgttgtggaaggtggtgcgtgggcagttgtgtggtctggaatgtggcacatggtagttgtgtggtctggaacatggtgtgtaggtagttgtgtagtgtggaaggtggcgtgtgggtagttgtgtggtctggaacgtggcacataggtagttgtgtggtgtggcacctggggtgtagttgtgtgttgtggaaggtggtgcgtgggcagctgtgtggtctggaacatggcacgtaggtatttgtgtggtgtggaaagtgacgcatgggtagttgtgtggtctggaatgtggtgcataggtagttgtgcagtgtggcacctggggtgtagttgtgtgttgtggaaggtggtgcatgggcagttgtgtggtctggaaggtggcacgtggtagttgtatggtctggaacatggtgtgtgggtagttgtgtagtgtggaaggtggcacgtgggtagttgtgtgatccggaacgtggcgcgtaggtaggtttgtggtgtggcacctgacatgtagttgtgtgttgtggaacctggtgcgtaggcagttgtgtgttgtggaaggtggcgtgtgggtagttgtgtggtgtggcccgtggcgtgtagtcataatgtacacgtgcttctgcaacccgctgcactgtgtccacctgagcaatgcggtcttggagatgatgcctcttgatgatcatccagaatcacaccagagtgttcctgactacacaattcgatgacaaagacatcccagagtgtttgacagcccacagggcgggcttccttctgtgctgcgcagggcgcgtggtgaactctgctccgccttctcccacccagatggctgtttatccaacccctgcttcccgggagcccagtgcagcagcttccccgatgggtcctggtcatgcggctcctgccctgtgggcttcttgggcaatggcacccactgtgaggacctggacgaggtgggtgaccccgccctgggctgtgggcgccctgaggtcgggagcggcctctcatgtctgcttgtccccacagtgtgccctggtccccgacatctgcttctccaccagcaaggtgcctcgctgtgtcaacactcagcctggcttccactgcctgccctgcccgccccgatacagagggaaccagcccgtcggggtcggcctggaagcagccaagacggaaaagcaagtacgcaaggccggccttccttgtgtgttgcgagcggctttggaaaaatcagatgagctcagaaaagcagcaggaggaaggagaggaaggggtggcgtggcccgggagaggcatgggaggggctggcccggggaagctgagcacctgctcggctgggccgctgctctccgcgcggggtgcggggcgtgctcagccgggcctgtgagggtcaggccgccacctctccgctgttagcgcagcccttggtgagctgcagccgaggctcagaaacgatggctgagtcacaaacggagcctcaggaacgaacagcacctcaagtgcgtgtccagaaagcccttcccacttcaggacttgggtccgcttgggaccggacctgctggggcctgcggtgcccgacgccccgcctcgacgcctccggagccatcgtcctgcctgtcgctaaccccgcagcccttctccccgtaggtgtgtgagcccgaaaacccatgcaaggacaagacacacaactgccacaagcacgcggagtgcatctacctgggccacttcagcgaccccatgtacaagtgcgagtgccagacaggctacgcgggcgacgggctcatctgcggggaggactcggacctggacggctggcccaacctcaatctggtctgcgccaccaacgccacctaccactgcatcaaggtgaggcgcggggctcgcagggcacacggggccacggcggtcagccctcctcctggcgccggggacgctacgcggacgggcggcgggggcagcacagggaatttggaaggagggtctctcaggcctcttgcctgatcaccaggttgaatgcatccccctggtcccctctctggaggtccttagtagacacaggcacactctggcgccgcccactgctgggcacagagaacctcgggcacgtcggcccatatttgcaattgcgcgcatcgttaacgcctgaaactgagcagagggaggacgccggctccacgctcggctccaggctgtgcagaggccattgtgtctcaggcaggtctggccaggctatgtcacttggaaagagttaggacatggttttcttcccaaagcccaagcgtgttgcagtataaggagctgctcagctggaagaaggagctccttcggggcccatcccaggctggactgctttcctgtggccgctggaacgaacaccacggcccgggaggctcacaacaacaggaatctgttatctcacagctctggaggcctgaaacacaacgtcaaggtgctagcggggccgtgctccctctgcttctcccagcttctctggctcaggcgtcgctgggcttctggcgctggtggctgcatggccctgacctctggtcggcttcacaccactttctccagtgcctttctctccggaaacttcctctgcctctctttgataagaacacctgtggttgtatttagggcccacccagataatccaggatgagcctcactgttcaatgtccttgacctaattccacttgttaccatacaagatgaaattcacttcagccatatcaggtgacatccccgggcgccaagacactaggacgcggacatccatcgtggggactgccactcagtccaccgcacagggtgccccaaaatgttttagtgcagttttatgccttaagaaggtcagacatggaaatgccacaaactgacacaaaatatcatttgaaaatataaatatattcatttatttaatatttaatcattcttgcaaattttgtgttaattttctctgtcagtcccgcttgattaaagatgccaaatactcactgaaacaaaatatgagtatgttttaaaatcaacgaggcactgatcccaacctatgttacaccccttggctacccagcctacccttcttgaagcccctgatttcagaaggtcagctgcagctgagtccgtgctgctagaagatatcccgattattctttccatcattgtggaattttagatggaaatttaataacttcgaaaatggtatataatttgcaaagttatatgtatatatacacatacacaaaaggatttaaaagtgagacttgacaagggacccctgtgcccgttcccatattaacccgacacacaggtgctggatcctccccattgccaggggcccccgtctgggatccgtgtcctccatgacaagcaacatgctctcctttcttaatctgtaagtgctgaaactctgggctccagcacaagaccccaggttctgtcttctgattcaacgagtgatgtgctttgagccacggggatgacacacccttggggctcttgtactgaaactgaaacggacacgctactctctaccttttcctggatttccaattccctcaagttgttagtgtctgcacagctcagctttaaattatggtataattggactgaaatgaaaggagttttttgcccaattacatgcattacccactcaccgtgaaaagctgagttagcagataatttcaagttctcagccctggtttctgaacatatcacatacatatttgaaagactcttttctttgagattttttgactggtgagggttaaacgtttataagctttggcattttgatttatgagctgaagtctgtgggaaggaaagcaccactaaagcctcttttctctcccatgttctctcagagcaataccttgtcattctcttcttgtttctgcagttgtttggcaacctcactgggattctgggctccgaacacaagtttcttttgtctccctcgtgagtagtggtgacataatttccagggcaggagttgagaagaaattcatgcgcttctggcctcctggctcctctctgagctcccgcttgagatcgaggactgatggggcacgcttccttcctcggcgccatgctggtttcatttcacctgcattcctgaaagaggcgctttcctaaatgtttttccaagtattcttccttctctaattgcaggataactgcccccatctgccaaattctgggcaggaagactttgacaaggacgggattggcgatgcctgtgatgatgacgatgacaatgacggtgtgaccgatgagaaggtaggagcagcttgtgccgcgcacctgccctgggttccaggagcagcgaggtccacaggaggccactttataccaaacagcccttgtcaacgtaactgccattgtcctgcaagcgtttgtgcataggcagttcccaaaggtcactataaagacagtcctttgcaaaagcggattttacctcagtgcatggggctgcccagggtgtgctgccggaaatgttttgaataattttttctattttaactgcaaaaaaatagaagacctcctctccttctgctgaggagccagtgatgggcaaggctgacaccaccatgagtgatagacttgcctttatggcaacatttaaaatattaccatttttctaagaaaattgctgcaaacacaaatggtttaatgtatttgtacacaaaacagctctagcaagaatagatcaagattttactcactgcttttttacatctgactttgatgggagacattgactcactaatccattcatttatttgatatttacatatctctcctcaccatgaagtgtatgatataccatttttgccttagcaatctacaaattttcaacaaaagacagatgcataaataatgataaaatgatttgatatggaaaaagtgtttggcgagggctaactctttttttttttttttttggtcgctcaggcttgagtgcaatggcatgatcttggctcactgcaatctccatcttctgggttcaagcgattctcttgcctcagtctcctgagtaactggcattacaggcgcacaccaccacgcccggctcatttttgtatttttaggagagatggggtttcaccatgttggccaggctggtctcgaactcctgacctcaggtgacccgcctgccttggcctcccaaagtgctgggattaatggtgtgagccactgtgcccgggcctaactggctttttaaagcactgggattaaaggtgtgagccactgcgcccggccctggtcttgaactcctgacctcaggtgatccgcccgcctcagcctcccatagtgctgggattaaaggtgtgagcctccgtgccctgccctgactggctttttgaagtgctgggattacaggtgtgagccacagtgcccagctgtgattaaaggtgtgagccaccgtccagccctaactggcttttgtgtttgtttgatttctatattgattttcatcaaccttgagtacataacttataagtgctaaacggcccgacacacattcctatgatcttcgttaaagtcttccctttcttggttttccaggacaactgccagctcctcttcaatccccgccaggctgactatgacaaggatgaggttggggaccgctgtgacaactgcccttacgtgcacaaccctgcccagatcgacacagacaacaatggagagggtgacgcctgctccgtggacattgatggggacggtgggtgcttctgctccttcccatgcgtgcacttttttttttttttgagatggagtttcactattgttgcccagggcagtagcaccatcttggctcactgcgatctccaccttttgggttcaagtgagtctcctgcttcagcctcctgagtagctgggatcacaggtgcacaccaccacgcctagctaattttgtattttaagtagagacgaggtttcaccatgttggccaggctggtctcaagctcctgacctcaagtgatccgcctgccttggcctcccaaagtgctgggattacaggcgtgagccaccgcgcccggcccaatgcatgcattttaagggtcgcaattggaggcattggcaagtttcatgttttattctgaattttgataagctcctttcatttttacactactataagattaaatgattcattcagttattcccatagggacccatgcttattctgccttgccttttcctgaaggtcaggggacaccagccacaggaccgccctagagaaagctatgcatttggtatcctcctctctctgaccccagccttgcagtcctgggcctcgtgcttcttcatggcatcttttctaatgttcacccttcattcaaaaattccaagaagccatttcatgttttcatcaaactgagcttctaggagttagaataacgtgggtgtattgtggttacctctgccactgatcccggttgctgctttatccggagagttcgctggccttggtaagcgagctctgcaacccagtgccactgtcaccgcatggtcatcccttctcttggggtgcctggagaccaggcgagtgcttctgtagaaccagcaagagctgggggcaggctcgcctccacgctggagctcggccccagctcctccacacttcgcctcgtggggtcctcttcccagcccggcgccagccaccccctttctgagccaccccaacctgctgttctgtctcacagcgggtttctcagtctgatcttttccactgatttctgcctccaccctcctctcgttctctgggaatgtggtgggttgctgtctgagggctcgtggtggccagggggctcctcggctccccatccaggatggcgtctgtgatgtgctggatgcagatctcaagctccagtcccttccatttttattttttaggtgttccttacttcccttctccagacctcacctgaccaaagcaaggcgagcgtctcagctcagttctggctcttcctgtggactcgctgccgtgtaacattttgctctgtcatttgtgacactgtcactgatggtattgtttagttcagtgctagtttatatttttgtaacttcagtatcaatgcaactcatcactttcagatttcttaagataagatatgacatctaaaaaccctgccactctctgccattgtttttttcctactcatgtgcatggatgataaactcctgggaactcaacacatactttccaagtgggtattagggagaaataagcaatttagcaagctcagatttacacggcgacagcacattcaactacccctcctgcaacattacccagaaatctccaaaagttggttctatttcaaatgaaaggtatttgaactgtaatgaaatatgtcatatgttcttctaaaatctaatagtctttatattttactatattcttaggcgtctttttattataattaaatagaagtgtggctgtaagcaatttcgtgtgataggaaaaacaatgtgctttttctaaactcacctgtccttctggtttgtttttgttttcttccccctttaaacacttacagatgtcttcaatgaacgagacaattgtccctacgtctacaacactgaccagagggacacggatggtgacggtgtgggggatcactgtgacaactgccccctggtgcacaaccctgaccaggtgagggcagccgcagacaggcggggttggaggtcctcatcagagggacgcggggacggtggcggtgtgggggatcactgtgacaactgcccctggtgcacaaccctgaccagatgagggcagccatgggcaggcgggtctcaggtcctcatcagtcccctccatggggccttgggagttttccatgagctccacaaagacaggataacatggagttttcaatgatttcaattgaaaacatttattcaactcaaatctcagcactattcttgtatctcagtggccacaggccaaatgaatagacgccttcacctcatcagctggagcgaggttgtgtcttcacagaattctctccccattttcctgatgccaacataggaattggcttcatttccaggtttgcgtttgaaagagacaagggaggacagttatcttgatgcagctcataggatatattatcctatgatgtaaatggtgtaaatggcgcaaatggtgtaaaaaagagacataattacctggtagttcatgcttttccagcgaagaagcacatcttcctttagtgaagtgaattactgtggagaggtggcagagggtggagagattcctggaccgagaggcctggccccagtgcttgtcctgacgtcagggtcagtgtgacctcgggccagccgcccctgcgtggccctggggcttgtgctgcaggacgaggaggccggctctcaggcttgcgtcctgctggttcctctccacctcctcaaactggcagtcctctgctgtttctctcacgccccatcccctagaccgacgtggacaatgaccttgttggggaccagtgtgacaacaacgaggacatagatgacgacggccaccagaacaaccaggacaactgcccctacatctccaacgccaaccaggctgaccatgacagagacggccagggcgacgcctgtgaccctgatgatgacaacgatggcgtccccgatgacagggacaactgccggcttgtgttcaacccagaccaggaggacttggacggtgggtgctctctcagctcatgggcgtggaggaaaatggcttctgagcaacccgccagggcagagatatgtatgcacggagatcatcttaaatctgctgctggaaaaagggcaatgactttgggcctcttaaagctgtgggtccatgcaatatgagtttcttctcccctgacactcaacacattcttggctgtgtgtgtgcccttcaacaggtgtgctgcctcaagtgtgtgtgcacgtcgggaggaggagaaatccctgcctccatataacttccagattgttgacgatctcctagaaagaatgcgggttacgaacgtaggatgaattgggaatttggtgtatggggccaggcaggggacaaggaggatttttttgaaagcaaagccaacaaaagtggcacgagtgtgaagcatgagaggaagagctgctttgctcagcagtgagcatgaataggtggcccatagccacgggggcccaaggaaggagctggatgggctgcagtcctctaagtcagcgtccctgagtaataaacaagggcacagctgtgctctggggcttccggggaggctgtgagaaagtggccctcacttggagtggggcctggctgacacaggctctctttggaagccacgtccttgacagagggagataaggacttgaggggcatctgagacagcatgactcagaagtacgtgggagatgctgggatcagaagggcagctcctgtgttctccccgagcagcatgaagggatggagtgagcacagcaagcctcatctggactccgtgttcgggcatgcaggggcttgctccccatgcagcctttccccagggagggactgggacagagagaagctgataggcagagcagcatttcagcatttcagaatgccctgataccaactatgtgcctgccacgtggtagctggagtatgttcttgaacagaacggaaactagttgaagaatatgatgagatattcaatccaacttgcctttcctccaaaacggcaggccacgtgatagctaattcagtacattgcaatctgcctgtcaggttatcgtcatcgccgtagactgatagactggacacatgtggcaaattcgtggtccccctgtttgcaccaggcccacctcatccccactccccaccatgccacaaccccgctgaaaacttgacaaggacccactaaacagcggaagtccatgtctccctaggaaaaaccattttagtgtgagttccgctttaatgccaaatagactataaaaggcaaggatgactaagaaaagtaataacagacattcagaaaactatccaaacacaaagctggaaatgcaggttgatattacttgacagccattcaggttttatacctgcagcattgagtttggaacacggtgagaaatggctttatgtgaatttgctgtgctggcctttgctgtgtatttatcacaaaaattttgtgaaaagagttgaggttcctgtgaagtcaaatgttttggagattgttgagcacgaatccacaaaacactgcaaagcactcagtcttagatgttctgggaaagatgcactcatgtttctcagacacggaaaagcaaatggcaaaccaccgaccaccgactttgcttctttgtttttgtttttgtttttgcttgttctttgtgcataggtgatggacggggtgatatttgtaaagatgattttgacaatgacaacatcccagatattgatgatgtgtgtcctgaaaacaatgccatcagtgagacagacttcaggaacttccagatggtccccttggatcccaaagggaccacccaaattgatcccaactgggtcattcgccatcaaggcaaggagctggttcagacagccaactcggaccccggcatcgctgtaggtgagtctctgagacacggcggtggtgccagcatttctccgggggaggcgcccacagaagatgcagactgcactttaagatcatgcaggtgggatgccatgtggtctttctggaagcccccatccttccatggtctgtgaaactgtctgcctaaataaccttgacaggtacatgcacctgccgctctgaagtctctgaaatttcagtaaaccattttattttatagacttggtctatgaaatgggacctcataatcctctcagaactcttgtaagttggatctaaaagaaataccttcaattccactaatctcatggtaaaagagcccatcgggatgatgaggggagcccgccctgcctgctgggcatccactgtcagatggtcacagggccaagctggggattgcctgaaacctgtttcttttttttttcttttttttctttttttttttgagatggagtcttgctcttgtcccccaggctggagtatagtggtacaatctcagttcactgcaaccttttttccccggttcaagtgattctcctgcctcagcctcctgagtagctgggattacaggtacccaccaccatgcccggctaatttttgcatttttagtagagacaaggtttcaccatattggtcagaccagtctcgaactcttgacctcaggtgatctgcccacctcggcctctcaaagtgctgggattacaggcatgagtcactactcccggccacctgaaaggtgtttctaacgaaaccttatggcgttgcatccaggttttgacgagtttgggtctgtggacttcagtggcacattctacgtaaacactgaccgggacgacgactatgccggcttcgtctttggttaccagtcaagcagccgcttctatgtggtgatgtggaagcaggtgacgcagacctactgggaggaccagcccacgcgggcctatggctactccggcgtgtccctcaaggtggtgaactccaccacggggacgggcgagcacctgaggaacgcgctgtggcacacggggaacacgccggggcaggtgaggttggctggccaggcccacacatctcctctgcaccactgtggctgcagagtgtttcagcaggactagcccagtccagagaccccacttttgtctttattaattttaactccaggcacagttattttaataatcttactttattatagacactgtgcctggggttacaactcaacacagttgataattaccagttaaatacagttgctaatccttttacaaattaaacctcttttaccctcttctggagatagggagtgagcataggacataatgatcaaagatataatatgaaaaaaatattttaaaaattgaagctagggagaattgaatatcaaaacttcaagaattttgcccaacatcccatatcaaggaaagagaagatccagacatgaacccaggaatctgaggatcaggtgcctgggctcttcaatccaggaatctgagggtcaggtgcctaggctctcagccctgagccacactctgtccatgggcttcaatccacagtagagatttggatgataaacacatcagagagatatggagcaccatgagccttaagcatgaacttgcaaagtcatgtttttgcttcctgcttggtgttacagagctgtggttaaggctccgggtgcccatggcactcaagagtgctatgttctctctcaggtgcgaaccttatggcacgaccccaggaacattggctggaaggactacacggcctataggtggcacctgactcacaggcccaagactggctacatcaggtgagggcaggtcagcacagctgcatttcttccaaggggcttcccatcggacggcacatttgaacattaatagacaaataagctcaagtgaattctaactttttgttttactctggattcttcgtcattaactgctttctcttttctatcctgcatctctactaaatattaagtatttttaaaaaatggttgaaaaggagaatatacaatctgctttgttttgggatgataaccatattttctcctaatgaataccccaggcaggggagaacacctgcaattaaaataactgcatctttgcagaattagcatgtgctttattggagactagatttgtacctgatataaatggctgaatttaaaacacggttgtatgaagttttgacacggttagcccaacagaatcttttcccttggcttaacagtatttataattgatttttattcaaacaaaatgtggtcaatttaaaatcaaggtgtttttgttttttcaaagttaataagcaccaagatcaggctggactctgcacagatgccaggagtgtgtgagtccctggcaatagagggcagatctgtgtgggtgaagtgcaggctcgtggcctcgctggaacgtttccctagggggcctcctgtttattcatattgatgccccatcctcctgtcgggggcttggtgtatccagtcctgctcccacgcagcttccacagtggggaggagagccggtgagctcatggttttagcacaaggtgaagtagggagagtccggtgcatcttcccaggaagtgggaagcttcctcctcaccccaccaaaggtagagtctcctctaaagcccttgcctgggtgactgtaagtgaactcacagattgtgacaatagtgtggttgcaagaaggaaggcgtgccctggatcagtgctgcaccaggggtggctggagctccaaaggagaaagccagcaatgccccctggggcactgaagccctgggcggagtatccacagcttgtgtccggagccaaccttccatcactggtgaatgcttcacagagttcatgttgtctttctttcctcttcttctttttaaacaccatttttagagtcttagtgcatgaaggaaaacaggtcatggcagactcaggacctatctatgaccaaacctacgctggcgggcggctgggtctatttgtcttctctcaagaaatggtctatttctcagacctcaagtacgaatgcagaggtgagtgtgagcacttcaggttagtggggaaggcatgtggcacccagaaagggaaaggggtacacagtgcgctcttccacttacaaaagctgtacatcagggcaataaacctaatgcacaataccacacatgagccccctgcacattccaagcagccatttcatttggtcagcttggattgttttgtttttaattgcatttggatgcctctggtagaacactttccaattatttacaggtcccacccatcctcattgtgccatagcctagagtttcctagatttcctccacttccaggctcctgacgccattttagattggtacccttgcattagcaatggcaggcaggcaggaaggaaggaaggaaagaaggaaggaaggagtttctctatagttatctcgctacaggtatatttgaatcaaaatattatagacctggaagataacttgaattccatctgctctaattccatgccttcaaatgcgcattacccttccacagatgcagtaaataaggctcaggatgcttctcaagaatcacacattgaaaatcatgtgtttggctgggggcagtggctcatgcctgtaatcctagccctttgggaggccaaggcgggtggatcccctgaggtcaggagttcgagaccagcctggccaacagggcaaaaccctgttggggttgatttatctgcttgcttctgtggaggttttcttctccttatgttaggatgtctttcaaggcatctcatttcctcccatccatccatatcattcatccacccacccatatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacccatggcccagttatgctaattgtttattgcttttttttttctttttgtagatatttaaacaagatttgctgcatttccggcaatgccctgtgcatgccatggtccctagacacctcagttcattgtggtccttgtggcttctctctctagcagcacctcctgtcccttgaccttaactctgatggttcttcacctcctgccagcaaccccaaacccaagtgccttcagaggataaatatcaatggaactcagagatgaacatctaacccactagaggaaaccagtttggtgatatatgagactttatgtggagtgaaaattgggcatgccattacattgctttttcttgtttgtttaaaaagaatgacgtttacatataaaatgtaattacttattgtatttatgtgtatatggagttgaagggaatactgtgcataagccattatgataaattaagcatgaaaaatattgctgaactacttttggtgcttaaagttgtcactattcttgaattagagttgctctacaatgacacacaaatcccgttaaataaattataaacaagggtcaattcaaatttgaagtaatgttttagtaaggagagattagaagacaacaggcatagcaaatgacataagctaccgattaactaatcggaacatgtaaaacagttacaaaaataaacgaactctcctcttgtcctacaatgaaagccctcatgtgcagtagagatgcagtttcatcaaagaacaaacatccttgcaaatgggtgtgacgcggttccagatgtggatttggcaaaacctcatttaagtaaaaggttagcagagcaaagtgcggtgctttagctgctgcttgtgccgttgtggcgtcggggaggctcctgcctgagcttccttccccagctttgctgcctgagaggaaccagagcagacgcacaggccggaaaaggcgcatctaacgcgtatctaggctttggtaactgcggacaagttgcttttacctgatttgatgatacatttcattaaggttccagttataaatattttgttaatatttattaagtgactatagaatgcaactccatttaccagtaacttattttaaatatgcctagtaacacatatgtagtataatttctagaaacaaacatctaataagtatataatcctgtgaaaatatgaggcttgataatattaggttgtcacgatgaagcatgctagaagctgtaacagaatacatagagaataatgaggagtttatgatggaaccttaaatatataatgttgccagcgattttagttcaatatttgttactgttatctatctgctgtatatggaattcttttaattcaaacgctgaaaagaatcagcatttagtcttgccaggcacacccaataatcagtcatgtgtaatatgcacaagtttgtttttgtttttgttttttttgttggttggtttgtttttttgctttaagttgcatgatctttctgcaggaaatagtcactcatcccactccacataaggggtttagtaagagaagtctgtctgtctgatgatggatagggggcaaatctttttcccctttctgttaatagtcatcacatttctatgccaaacaggaacaatccataactttagtcttaatgtacacattgcattttgataaaattaattttgttgtttcctttgaggttgatcgttgtgttgttgttttgctgcactttttacttttttgcgtgtggagctgtattcccgagaccaacgaagcgttgggatacttcattaaatgtagcgactgtcaacagcgtgcaggttttctgtttctgtgttgtggggtcaaccgtacaatggtgtgggagtgacgatgatgtgagtatttagaatgtaccatattttttgtaaattatttatgtttttctaaacaaatttatcgtataggttgatgaaacgtcatgtgttttgccaaagactgtaaatatttatttatgtgttcacatggtcaaaatttcaccactgaaaccctgcacttagctagaacctcatttttaaagattaacaacaggaaaataaattgtaaaaaaggttttctatacatgatctctctcccttttttaaaaagaactagcagggtttctaccgggggggaaaggggtagaaggaattggcattttgcttcctgtcatgtaagtaggcctgtggtgtgatcacgggctatctcctcgcaagtcacaggttaaaatgcaggctgaagggcctggtggagaaggaagccctgcttgacacaggtctctgttctgctgagcctcccagcacggtgtgggatacaaccatttagcaattcatctctcctgcctctgctcattgtcaaacgagggaacagaacttcgtagggaatttggcaaacatgattgaaatgattccgaaaaaggcaacagcacacgggaccctctccctaatacgagctgttcttccctcttgactcattcttctgagtcaggtggagggaagtagcggaccccagaggaagggcccatttccaaccacagcactgcctaaaaatgggccgatcgggctcaccagttggaggaggcaatggcagcagcacagaacgctggggtttctttagcagctccagctgctcttgttgggatttctgaatattatgcaggcagacacagagaagaaaaacagggagagagggagagagggcatccagagagaaaggggaagagagggagggagagagggagagagggcatccagagagaaaggggaagagagggagggagagagggagagagggcatccagagagaaaggggaagagagggagggagagagggagagagggcatccagagagaggggaagagagggagggagagagggagagagggcatccagagagaaaggggaagagagggagggatgggggagagagaaagagacaaagagacagagggaaagagggggagttgggggagggaggaaaaagagagcaagatgaataaaaacaagtatacttggctgaaacacgctggagtgagtcagacagtgaagcaataagatataggaaaggccgtctgaggcaacgggctgtgaactgaaggccctggctttgagttgtgaaatgagtgagttttagttcatcaatatggaggaaaaagctagacctacatgtgtaaaaagaaaagtttagaaacaaaataatgatggcagtgatagtggctggtctatggacagctactggaggaagctcaatgtacattttactcatgaaacaaaaaatacatataatatgttgaataaggatgcttagaagtcaggcattaaaatgagctacatttctcgtgcattcaggttttgctgtcatttatcgaaaagttgaggtttcctgacaatcatgttccctgtcgatggccttagccacatcagaatggttgtctcccaggattaatgtgtggtgcctttgtgagctcacctgggaggaaggtgtccctggacctcgatgactccgtgcgagcacctgccctgtggccctccatctcccttctgcgaatcgctgccagcacaccacgggagctccgcaccttccaccgtggaccgggagggccgtcgttctagacgctgatgctgctgctcacagggaaaggttcggcccaggcccacgctctgagagttgtctgtacaaggctcaaccaactcgccctcagggcaggcacaggccttggtcgtgtggaacgagtcggtgggtgaaataacacatcttcactcccaagtatccaagcgtgggatctgtgattgccgggaggagagaagccttcataccgtgaccaactcactggctgctgcgtgtcccagctataggctacatgggggcagagggctccttccgtcattcctggaggaccaaaatcttaggccagctttgctcagtctgcgtttcacaaagtgatgcttttgaccatggagcaagtggtgcctaggccttgaggaacgcaggtgtggggtgatccaggagctgccactccagctccacggccacagccctgtgggctgccaatgcccaaatgggagggccctgctgaggg

SEQ ID NO: 12205 - DNA, 21856 bp, Human
  misc_feature (1)...(21856): n = A,T,C or G
accagggcctggcatgtgcaactgctgcatagtggcagctcctgtttccctgacatggcccaagtgggactgtcattttccaagccaagcccccgtcaattcctgggtaactctggcccacatcatctggtgttagttctgccggctgcaatgcaggtacagtcctcagtggggagcagtgtctttgggcagcccgtcctcacgcctctgcagctgtgtccacaactctatgggtaccagaggctgtcacacactgtgcgccacttagaggtggtggtcaaggagggtgctgcccccgcccctgaaacaccagagcaaagtgagcagagtaagccctgcccagatgcctggggaagctgaccctacctgggggtctcctgcctggttcccagcctgtgggctctatgctgtctgcaggtacccacagctccccaggatggtggtgggatggccttcctccagggccacaccagacctgagggccaaaaggtgcccccagccactctgtgaggggcccagggagcctgggtgtccacccacagtcaggctcacggtgtggcccagagctggccttcaaggaggacaggtgtgagtcaggtctacccaggcccccaggagacaacatgggccccggaggcgacgtgagctgcagctacagtgctgcagcattgcccggagcgctcctcacgacagaccccctcatactgccagctgctggcactggtggctccgagcgcccctaacacagcccctctgggcatgcggacaactgtaaggggctgatccagagctcaggagggaccagaggcagcaacatcccttctaagggcactgccaacaaactctgcaggaaaagctgcccctgagcctctgtccagggcccagtgcatgggaccgaacctgctgagcccagtctcgggcctggcacaatgggggctggggtcccaagtggtggtcagaggcaggactgtgctgaggcagctcccaggcagcagaatgcccaaaggaatctgccaagctgctctgaggagcctggatactgcctgcccctgccatgctggcagctcccgaccttcctgcagctccccaccttcccgcagctccccaccttcctgcaggagcctggacacgaggtgctcgcaggctgctcccaaccgtcctcccctgcagcggccactccggctcagcaatccccctactgcctcctgccctcccaccctgacgttaatgacccgtcgagccctgacacaacgaggccgtctcagcacctgcagcctccaccccagacacaacgagcctgtctcagtgcccccagcctccaccccagacacgagcctgtctcagcacccccagcctccaccccagtacacaacgaggctgtctcagcacccccagcctccaccccagacacgaaactgtctcagggcccccagcctccaccccagacatgaggctgtctcagcacccccagcctccaccccagacacaaggaggctgtctcagtgcccccagcctccaccccagacatgagggtgtctcagcacccccagcctccaccctagacacaacaagcctgtctcagcacccccagcctccaatccagacacaacgagcctgtctcagcacccccagcctccaccccagacacaaggctgtctcagcacccccagcctccaccccagacacagaggctgtctcagcacccccagcctccaccccagacgtgaggctgtctcagcacccccagcctccaccccagacgtgaggctgtctcagcacccccagcctccaccccagacacaatgagcctgtctcagtgcccccagcctccaccccagacacgaaactgtctcagggcccccagcctccaccccagacatgaggctgtctcagcacccccagcctccaccccagacgtgaggctgtctcagcacccctagcctccaccccagacgtgtggctgtctcagtgcccccagcctccaccccagacacaatgagcctgtctcagggcccccagcctccaccacagaaactaagctgtctcagggcccccagactccaccccagacacgagcctgtctcagcacccccagcctccaccccagacacaacgagcctgtctcagcacccccagcctccaccccagacacgagcctgtctcagcacccccagcctccatccgagacaacgagcctgtctcagcacctgcagcctccaccccagacaacgagcctgtctcagcacctgcagcctccaccccagacacgagcctgtctcagcacctgcagcctccaccccagacacgagcctgtctcagcacccccagcctccaccccgacacgagcctgtctcagcacccccagcctccaccccagacacgagtctgtctcagcacccccagcctccaccccagacacgagcctgtctcagcacccccagcctccaccccagacacgaggctgtctcagcacctccagcctccaccccagacaagaggctatctcctgaggagcctctggtgccatctcactgcctacctaatgctctgaaacggaaatgagtgtggcaaatctctggttaatagacccactctcccaggattagtgagaaggctggaagcaggcgggctctgtctcctgctgagacacccctctcctcagagggtaatggaaggtcagccccggcagggtccactgcccacggctcagcaagaaccccccaaggcagggcctgggattgtccctcagccaggaacgcaggcacctgatcctccggcaaagctggggcccctcagaggctgtgcagacgacaggctccccatagccttgcggacatccttacccccactgcagtgcgcctcccagcctcccttcacacagctccttgtcttcctgctgctgccaggcctcccaggagggaagcagacagaggagcctcttggacacatccggtggggggcacactgaggggtgctggctgagggagtggggtctgggcaccaggatccagtgggcgaccacattgaggggtgctggcggagggtgtggggatctgggcaccaggatccagtggggaaccacactgaggggtgctggcggagggtgtgggggtctggacaccaggaaacaggactccagggctcttctggagccggggcctgggagcagttccgggaagagccttggactgctgcctcccagccagtgagtccctcagagcacagtgggaggagcggcagggctgcagaggctggagccactcacaggggcagggcctgtaccggctccaggctgagggtcctctgagcccctgggcaggaatcctgccctacccctcatgggctctgcctcaacaatgtcccttccctccctcaagcttaagatctgtgtggggacgctgccccaggtgggcagagcctggacctgcagctcctttgcccacagcagcaatgggatgaaagtgccatggctgctgcaggggacaccatgcagcctgagctcaggcccgggctcttaaagcccaaccagaactacttcaggtggtgggggcgggggagccgattccagaacccacggctcacacagaaggctgaagggctggacagctgccatagggctctgctgtccaggcacccgcggtggagaccgcgccagcctcgctcgttgcaaccagtggagtgagaggagtccacctgtcctgagcatgtcgaggacgccccctaccaacatcctggggagcagtactgtccccctgctatcttttgcggggcagtcgcccactttggcagaacagggaaggtagctgtttcggtgagttggcagggctgcttgggcaggaccaaggaagggccattcctcagggctgtggtcagtccagtccaggccaggtgggggagccatggcacttcctatcactccctccgttcctggtcatgtggcccacagggagtgggaacccgcgagggtcatgggtgggctgggctctgatgtggcaaaaggaggcgtgagggagtgctgtggccgcctcccggtggagtggactgctacaaagcctgggggcctgggaggcattccccagaggccgccatggcggtccacaccacgggtcctggccgtgctcagggacacccccaggaaggctccccgaagctcagtgaggagtttctgcttgtgtccaagctcaacctgctgtcaccatctgggccatctttctcttgccaagacctcatgaatgagggtcctcgagttcctctgaccgcccaagggaggcatcaggcctggcgcagcaatgcgctcggagccggctgcctgccacaggctgcttccacttttctgttcggagccggctgcctgccacaggctgcttccacttctctgagcaggtgtccatcttttgtgcagccccgtccccaccccaggcacagggactgtggaaggaaggccctccccaaacccctggtctttcctccagcctccttcaaacaccagggccaggaggagggccacccaccaccacctgtgcccactcacacgcgcttctggcttagcagctggttccagacctccaccacgaagccatcgaaatgctggttctgaaagaagcagtcacaggtgaggagggcctggaggcccaggagggatgggtggaaagacaagaagcccgccacctcggcccacatggtcaggttgtggcctggtcactcacgaggcaagacccaagcctgggctgtatgcccagaagggcctgtctgaaggaggaagtgtgggggtcccagaggaacaggagtggaggggccagtggtctcgtgcattctgcccacccatgcacctcccccaaccccaccccgggggtctgggggctccctgacccgaggcccaggcatactggcagccagcagggctgggtcccctcccaggagggtagcaggcagctgggctttgcccaagggaagaaccctggcccagcagacaggtctcccatgcctgggacctccagaggacccatggtcaagaaagcgagcagcagcctgagcctggctgatgctgccttccctggaagatgggggctgcaccagaaggtgcccagggcagaagacagaaaagccgagtggaggcctcgcgggaggcccagccagacggccaggtgggacccggggggctgtgctcagaggctggagcagcacacaggtctcacctttgccacctggaccacggtcttgctcagctcctctatctcatcctcactgtctaagacgttccggaaatcatcgtaagtccagtcctcaaacaggagccgaggcactgcaggggcaacagacacacacgggggccgtgactgggagatgctggagggcccctgctgtttgctgcctcaaaaaggcatccccttggcctccagagggaagtgagaccagacagtgaggggcagggaggccacctggagcacccacatgtccagagaggatgtcccagagcctcacaggctggagagggaggggtggtggggaaggagcgagcagacactgacagtcctggtcccctgacaccagctccccacacggctcagcatggttgtggccccaccttacaggagggaggctgggacagactctggctgctccagctcagccctgtcacctgcttctagcatcccccagagtctctcccttggcaacttgtgctcttaatccactgcctctgaggctgctactggacgtggggacacatgtccccccttccccagccgtgagctacaggggcacagatgggccagggtcagcatcaccctcaggccaagcccagggcttggccccagctgccctgataggactcatcatgtgaatgaaggaagaaatgggattgagaacaattagggcaatgccactggccaaggaggtgctggctttggagggccacagcctgtgtggggaggagagctcaggactccagccagactaagggctgtgaatgccaggccagggccagcctcatctctgagcggtcaaagtaacctgtgccgcagcagcacagccgggtgatcaggaacacgtggagaccccagtgcccacctgtccacccccgcaggttgagccatcagggcctccactcctggcctgccggacttacctatgtgcaggcccttggcatgcttcctgacagctcgcatccaccctgtgggacatggaggggacagtcaacacaggcacgtgcgcccaactggaagacccagcctacctgaggaggaaaacgtggcagccgcacaatacgcaatgggaagggcaggggcgggcaggcaggtgtgagaacccacccctccctggcccagggctggctctccacaccctcttcctgaccccaactctccacccttctggccaaggcccccttcctgaccctgcagagcagctctgagcttaccctccctgagctgggacagctcagagcctgtggccggccaggggaacaggcagctgcatcctagggcctggggacggtcagggtttctccgagctgagggatggccagacccgccaggccctgacactggctgacattccatcacctccccacggttctctcagtgtcagggaaaaccactcctgctctctgaactccaaaactgcctaacacttcccctgccatttctctctgtccgagcccaaacgcaaggcgcagccacgtaaactcgggcagacgtcatcaggtcaggatgtgccatcaggaggcagcctccgcctgaaccccaccttcctccctggcattgaatgaaaatcgctgagagagggacagaggaggagaagccaatggcccgtgccgtttgctgcccagaggctgcctgagtcattgtagagcctgtcctgcacacgcctgtgtgcagcccggaagtgcaagggaaggccaccctcacagccacctggaccacacgcagacctgggcggaacactctgaggcaccaacttggccttgcagagggtcccaccgtggcgaccacctcagaaaccccctctaccaggcctgccctgctccacactcaccttcccacttagcacaccagcccacaccatgggcctgctctgccggctgggccccaaggggtgagggcgtggttctcacagtcaccacactcacactcacacccactgtctcacacttagacatgtccacaccgacagtcacattcaacacactcacaatctcttctctcccacatcatcagtctcacacttactcacattcacacttaaatcacgcagagacacacacacactcccatacagagacacccacagagacatacctactcacacacacacacccctgctctcgcactcacactcttttcagcctgtggggcaagcacagtcaagcaggaaggatgagaaccttggtccacgtcgtggaggcccgtgacctcaaacatctcacggccacgtctcttcagctgcagccagacgggtgagatctgtgtgaacttgctcccaaagaccttggtgacatcgtagccatggctgttccactggcaaaagatggagacatcagacggaggacaggtgagtgagcacctgtctcaccatggtgctgtcattctggcgcctctggacgtgcccagggctggccagcgtagacagataccagcccgggactgacatcagctcctggcctggggtatccttctcctactctggactgccactcacagcctgggacccaggccacgacatccctttcaccaaaagtgactggtgcttgtcttaagccccacctggagctagtgcacaccactgctgcaggctggcagctgggaacagcaagagaagaggaggctgggtgtgagaacccacccctccctggcccagggttggctctgcacatccacttcctgaccccagacgacctgcgagcccacctctggattcagggggaacccacagagatcagcacagcaagcccctggagagacccccagggtcttacactctgacatctccagaatggcatctctcccaccgtagcctcacagcagcagcagctccgggagatcagaacatagacccccatcactgactggccagaagaggccatcacggggccagggcagcccacctgagcctcaggacctccctctgcactgtgagggccccaacttactggagtgacatagcccagtacatccccagcaaagtgtctgtcccgggcctttgccgagcagtagctgcgatgctcaagaaccacactctcagctttgaggtccgtcaccaccaaaccccggtcttgcaccggcttatctgaaaactgactctgaaataaaaggagtgagagaaaagcctcagtcatctgtccacagtgtagagcacagagccccacccagcaagtcccttccattcagccagcagccgagtctctggatccacacagtgctgctgacccggagaccctgtatgttgaggatcgaggccacagcaggcaattcaattcagaagcactctggccgtcaacagacactggccgacggtacagggcctttcccacccttgctccgggctggaaggcaggcaggcagacagacagttatggtggctccctccttgcatgtgagggtggacggtctgcaccagctctggccactcgatacccatccgggcactccagggccatacgctttgctggacaagaacatgccaggtgcgctgggtgcattggctcacgcctgtaatcccagaactttgggaggccgaggcaggtggatcacctgagatcaggagttggagaccagcctggtcaacatggtgaaaccccatctctactaaatatgcaaaaattagccaggcatggtggcgggcacctgtagtcccagctactcgggaggctgaagcaggagaatcgcttgaacctgggtggcagaggttgcggtgagccaagatcgcgccattgcgctccagcctgggcaacaagagcaaaacttcacctcaaaaaaaaaaagaaaagaacatgccaggcacacgccaccatgctggccaaccactgcctgccaccgcccccgccaacgtgaccctgctggccaaccactgcctgccaccgcccccgccaatacgaccctactggccaaccactgcctgccaccacccccaccaatgcaaccctgctggtcaaccactgcctgccacccccctggccaatgcgagtcttttcctgccatgtcacacctgcccctactccacctctgctcctggaaaccttccatccagttatcaacttgtctcttctgtccacactctgtggcccggctcagcctccccttgacctcgccccaagcggccccgtgagagagagatgtccactgcatggtttatttgcccccatacagcacagagaaagcatctgccagtccaggactaggtcacagttacagtcctgtggcagggtctggccagcggcatggggactgctggggctgagaggtggttctatgagtttacacccttgaaggtgcaatccccagggccatcccaggggaacgtcccaaaaagcatgaggcaaacacagctcaaggccatgataaagacagcaagatgaagatgcaggtgatataaacgagaggtagagcatggaaactggcaactggcacataaaacaagccccacgtggggtgagtggggaggcaccctgcttgccctcaaaacctggctccagaggctgctcactcagaggtgctgactggccagagccccagagccacacaggccacccaccggctgcgggctcatcaggtgcctttgtgaggagccaagcccctcgagcctcctggctcacaggccccagtggacagaaagaagaggatgatggatcagccctcagccagtacagtcacctcaagtccccaggccacccttaccttctccagcagcgtctttgaggcggcttttttggcatctgactttgacagggtagtgtgaacagggctgcaggccagggcaagccagaggaggttgaagagtgtccgcatggtaggtgtgtcacagtagggtccaacctcggggtccagagggctgcagggaaagcagagcacattcaaacaaccggcagagaaatgcagcacacgggcaacccctctgctgatggggccactttctcctaatagggcctgggtcctcatggcactggatggacccttggccactgggacagagccctgacctggaccagccctggcggccacagtctattctccagtactcctgggcctcctgactgagccactggttcctcctagatacccagaaagaagcttcctcaccatcagccacagaaccctcccctcacagcccaaggccgccctgaccaccactggcaatctagaaaagcattggttcccacctcctccttcaaacccaaagaaagccaaaccatggtagggcttaagtgtaaaataatgaagccacaggctgggccacgtggcggctcacgcctgtaatcccaacactttgggagaccgaggtgggaagattacttgagctcaggagttcgagaccagcctgagcaacatagtgagatcctacaaaaattaaatatttgggccgggtgcggtggcttatgcctgtaatcccaacacttaatgggaggctgaggcgggcggatcacctgaggtcaggaattcatgaccagcctgaccaacatggtgaaaccccatctctactaaaaatataaaaattagccaggtgtggtggcgtgcacctgcagtcccagctactcgggaggctgaggcaagagaatcgcttgaacccaggaggcagaggttgcagtgagccaagatcatgccactgcactccagcctggggacagagcaagactccatctcaaaaaaaaaaaagaaaaaaatcgtaggctcagagaagcctacgataataacgatgatggtggtgatgccacgttaagtactaggagaaaatatagctacctatttatgcagtctcagggtggagaaggcttttccagctatatgagcaatgggagagattaggaaagaaaataccactggagtagaactacatacaaatgtaagactttcattcaggaaataaagaaggaaatgtgaagacaaataataaaccagaaagaatatttggaacacacttgacaacggatttctacccataatctattcataacatgcaaataaatctcacaaatcaagaaaagacattccagtaaaaaatgtcccggctgggaacggtggctcatgcctggaatcccagcactctgggatcccagccaccaccacacctggctaatttttgtattttaatagagatgaggtttcaccacattggccaggctggtctccacctcctgacctcaggtgatctgcccacctgggcccccccaaagtgctgggattacaggtgtgagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcagtcccacagagaaagcatgtagggaggggtggtagaaagcaaacgacatgcccttcacgtggaagcttaagaaccaaaacaaaaaagtagcctgggcgcgggggctcacgcctgtaatcacaccacgtcgggaggccaaggcaggcagatcacctgaagtcgggagttcgagaccagcctgaccaacatggacaaaccctgtctctactgaaaatacaaaattagctgggcgtgctggcgcatgcctgtaatcccagcttctcgggacgctgagacaggagaatcacttgaacctgggaagcagaggttgcggtaagccgagatcgcgcaattgcactccagcctaggcaacaggagcaaaaactccctctcaaaaacaaagaaacaaaacaaaaaataaatgagcaggctatctggaattactggtcattgtttcttctcttttactttatctgtatcttctggtcttcctgcactaaacttttattacactgttcactttcaggttctaggggccaccaacaaaagtgattctactttccggccgggcgcggtggctcacgcctgtaatcccagcactttgggaggccgaagcgggcagatcacgaggtcaggagatcgagaccatcctggctaacacggtgaaaccccatctctgctaaaaatacaaaaaattagccaggcatggtggcaggcgcctgtagtcccagctattcgagaggctgaagcaggagaatggtgtgaatccaggaggtggagttcgcagtgagccgagatagtgccagtgcactccagcctgggcgacggtgcgagactgtctttaaaaaaaaaaaaaaagtgattctactttctatctttcactggggttgggggcagcggcggtgggagctgaaccaccaccatagcccagccagactgttagtccttcatgaagctttgggacactgctgggaagaagctcttggctagtttcacagctctggcagcacagacccctctagaccagctgagaggcccacacagcctgggcagaggcagatacctgacaggtggggagctcagcccaactcactacccagcagctgggcacatggccttccccttgggtcacaggctcctgagtatatgggagctcaggcccaagaggctccaggaaccccagccaggcaggtgcacctgtcagaagatgctgccagagccaggcctaccacagtgcctaccctcctacccaaaagactccctggccaggaacctgttttcacttcctctgaaaccgtccccttgacctgctttcttctgcagaggcacacgctgccccactttgccctgtctcttccctgggtgagactggtgctcctggtgcagactgaggagactgtggctacccccaggcagggagtttgcatgctttggtacccaatacacccacaacacacctgcatagaaagaacacgctcctggagcaagatcaaccagtgaagctcccccacctaggaggcagggagccacaagacagcctgacctgcaggcttatggggagttaggaagggaactcacagggcaagcacagcagcacccagtacatggagccacaggcaaaggcagtgagtgcttgaacagccacggcagttccgagaggctgtgcagggggaataagaaggcccaggcacagatcaccaccctctgccccgatcaacctctccagcccctctcctcagtgatacatcccagaatcagaaccaagggcagcagcctgctgccacctccccttagccccactatctttctgctgcagctgaggcttggtctgagtcagcaacagccccagggaaggtggggagggttctggccatggcacagggaagacggcccagaatcacttgcctggccaggctgaaacggtggctgcctcagctcccaggcacccagtctttgaccccagcccattccatgaccactggctccttctctgtcttctgggtggaaatctgggtcagggaggaaggaaaggaatgaaaaaccaaacggtggttctccaggggactggcccaggagtaactggagggcacactcaggtacccagtgaccaaccactatagggctgggtctctgcccctacctgccgtcctgcagatttgaaacagggccactgtccacccacctagtggcccctctgcctatgacctccctgccccccaacctgtgatttcacacttcagggaaggaagaggaaagggtggaagaggaagacagtcctgccagcatgtgtccagcagaggggacactaggagaacctaactgaacacaaggccagggtactgcctctgtccactcgcgcttaacttgcccgctctgtgatggagtgcttggatacaggctgctcacaaatgctgggctgcttctttgacttgccatggaactttccagacaactgccccagggagatggtgtgtgtgatgtgtgaggggtgctcacactgcaaccaggcccttgtctgggctttggtacctctcccgctccccactgctcaccggccgctcggctctgaggcccgtgaggacactctccatcatgctcttcacataacacagactcccaggttcacacacactgtgttcctgcatcaaaccgtttcttccccaaatgccaatgaccttcccttgggcagaacggccccgcacacaaagggaatgtgttgtgttatgaagaggcacaggccccgaccctggtcacccaaaggggtcccagaaaccgctctgtaacaagataaggtggagcgctactgctcccactttcctgcgctcccagtccgtaggtccaggacctcctcggtggtgttgatggaaatgatgggagtcacagcaggggctttccaatgcttttcatggagaccagcagtaagaaatgcactttacgtcacagcccagcacacgtgtatgtcatgtgtgcacatgtgttgtgcatgtgtgtacatgtgtagagcgacagcagccaatcagagctaactctattctgcgatggacgcactgacaactcctgttctgttgtgttttgaagaactaactggtgcatggcggctctggcctgtgatcctagcactttgggaggccaggagtttttgactggttttggcaacacagccagacctggtctctacaaaaaatatttttctgccgggcagatcaccccatcaggagttcaagaccagcctggccaacgtgatgaaacccagtctctaaaaaagatacaaaaattagctgggtgcagtggtgtgcgcctgtactcccagcaactcgggagactgaggcaggaaaatcccttaagcccagaagcggaggttgcagtgaaccgagatcgcgccactgcactccagcctgggtgacagcgtgagactctgtctcaaaaaaaaaaaaaaattcttagctgagtgcgctggcgcacacctgtagtcccaagtagctaggaggctaagagattactagagcccaggaagtcgaggcggacgggcgggcgggtcaccctccagtttggacagtcagcaatggaagcttcaagggttggggctgaaccaagggtgggtgggatcgcgtctgatgcgcccgcccttcacggggaccgcgtgcccctcactgggagggcagcccgcctggagccctactgcctctgctccctctgggggtcctggggacccgatggccaccactctgccacacgagccgcgcgctcacacactcctcacccgccggccacatcccttgtctgcgcactcaggccccttccacccagcgcgcctagatctcaggcttgctcgccccagcgcacgcgctccacctcccactcgcggtccccccgacacgcgcccccgtccacactcgccctccacccccgctctcgctcaccctcgctctcatagcaaccctctctcaccctcgtcctcacaccctctcacacgccccctcacacacttgctctctctcacgcacccgcccggcgtcgcccgcgaccccacgcccgtcctcccggggccgagcctcgctgcccggcgcgcccactttgcgggagggaaactgaggccgtgcaaggaggaggagcaggggccggccgccgcggggctcacctgcatgtcagggaggccggacggccacaaacgcacggccggaaaacgctccagcgcgccggaagtcccgccccaggcgcccgcgcgccgccgccgcgcacggcacgctgggatggagaggggctgggccaggacaggggactgggcagggctgcccgaaagtcggggccggggccggggccggggccggggcggggccgcgccgggggcggaccccgggcccggcgcgttcaccttgagcgcccctggtgctcgcgctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacgagccggagccccaggaggcaaaccaagttcccaactcagcccctcgcgcttggatgaacgagcgcgtggccagcacttttgagtcaccgcgcattctacgcggcacaggctgtccgacccccacccccagccctagccgttcccagcgcagtttcctacagaaaaccgcacggccgggccccaccctgccccgctcagccgttcccggggcgcgcgtgggctccaagacaccctgcacagctgcttctccatttctgctgcttgggagctttctccttaaactaagctttgtctttctttctagtcacgtttccttctttcccttcccggtattttctgccagctgacgcccacgcctttcctagaaggggctgggggctgcatgcggtgcgaggcacgtcccccaccagctgtgggctcttactcagcttagcactcgctctcagcaaacggcctggatggtggcctgaagcctgacctttgggggtgaagacctcaagtcggcagagctctggagagggtcccagtaagctatggcaggtgtcctcagggacatatgcgcagtcctcccaatgctaaggaggccatggcaacatccaacttctcttaggaaaggcacttagccattttaggatctcattgaggtcagaggtctttggcgctaaagaattgcagaatcgatcgggcagccgccgcctttaatcctagcactttgggaggccaaggcgggtagatcacttgaggtcaggcgttcgacaccagcctggccaacatggtggaaccctgtctctactaaaaatacagaaattaggcgtggtggcgcatgcctgtaatcccagctcctggggaggctggggcaggagaattacttgaacctgggaggctgaagttgcagtgagcagagatcacactgcactccagcctgggtgataaagtaagactcggtctcaaaaaaacaaaaaaaagaattgcagaatctacttagggttcactctgggccagaactacagacctcaagagcagatggggcccgcagatgggaggataggaagcccagagccaggcccctctgcagagctcccaacggccgggttcctgggggagtcttgtcagttgccagcacaaagcggtccgcttcccaatctgcatagtttgtgccaatgggccccgtgtacctgcattgaaaactgacttcttggctgggcgcggtggctcacgcttgtaatcccagcactttgggaggctgaggcgggcggatcacaaggtcaggagatcgagaccatcctgattaacacggtgaaaccccgtctctactaaaaatacgaaaaattagccgggcgtagtggcgggcgcccgtagtcccagctacttgggaggctgagacaggagaatggcgtgaacccaggaggcggagcttgcagtgagccaagccattgcactccagcctgggcgacagagtgagactctgcctcaaaaaaaaaaaaagaaaaagaaaaagaaaactgacttctttaggtgggcacccaccttttagccttaggaagatgctgaatgatacataccaagatttaggagaatcagaaccgaagtgttagcattcctgtattaagtgaaacttgaacacatttcgtattttatgtttttggaacatctaagataacttgcagttcaccacatttaaaatttgaatctgttaagttgtatgagtttttagccaggtgcagtggctgacccctgtaatcccaatgctttgggaggccaaggcaggaaaattgcccccccccgcaaaaaaaaaagtatcacaatgaaataaggtttcactctgtcacccaggctggagtgcagtggattatggttcactgcagcctccacttcctgggcttaagcaaacctcctgcgtcagcctccccaaatgctgggattatagacataagccacctcaccaggccaatgcatgagttactgaagcacccgagattctgttatcaattcagacaacctaaagcacgcaaaaaggagtgaaaagaggcttcatttataaattgtttgaaatgttgaaaattgcttaattgagtttatagatgggaccaaatattatgcagaagcccctttaaagtgactgcaggccaggcgcagtggctcacacctgtaatcccagcactttgggaggccgaggtggacggattgcctgagctcaggagttcgagaccagtctgagcaacatggtgaaaccccatctctattaaaatacaaaaaagtagccgggcttggtgatatgcacctatagtcccagctacttgggatgctgaggcatgagaatcgcttgaactggggaggtggagattgcagtgagctgagattgagccactgcactccagcctgggcaacagagtgagactctgttaaaaaaaaaaaaggccaggcacagtggcacatgcctgtaatgccagcactttgggaggccaaggcaggaggatcgcttgagcccaggagtttgaaaccagtctgggcaacatggtgaaaccccgtctctactaaaaatacaaaaaaaattaatcggacgtggtggtgtgcacctgtaatctcagctcctcaggaggctgaggtaggagaattgcttgaacctgggaggcggaggttgcaatgagccgagatcgcgccactgcactccagcctgggtgacagagcaagactccatctcaaaaaaaaaaaaaaagtgactgtaaagtcttctaggcttaaaagggaataatagggggtttgtaaaattgaacttaacaggttaataaattgggttttgaatttctaacttcaatgtattgaaattaaattttaataaatcaaatcctaattgttgaaatttaatataaatccaagcataaccaccttgcccaggcactaaaccagccctcagcccccattcccagccctccttacccggggtgggtgtggagtgccctggcggaggtccaggctctgccctgtaggcccaggtctgacctgccctgaggccctcctgcttgcccactgcctgtctgccgtgggcatgggggggacagagtagggcaggggcaggccggtggggtgaggaggcctgcagagatgagtgtttctgctgctgactggatccctgctttaggagaccccatgccttacctgggatattcctgggtccccagcctgaggatgcctctcacagacatcctcaaaagcactcgaaggctgggagtggtggctcacgccgtaatcccagcacttcgggaggctgatcacttgagcccaggacatcaaggctgcagtgagctgtgattgcactgctgcactccagcctgggcgacagataggaccctgtctcaaaaaaaaaaaaaaattactcacacctggttgttggaggtgcctggtggctgtggggcctttggggctgggtttgtgtcttccccaggctggccagtgctcctgggtggggtcgcggcggctctgggcgactcctcatttgcagagtcagcacaggcagggcccttcccaacagtggcagcctcgtgactctgtcctgttctaactaggagaccttggcctgggtcacccaagggcaggacctgggccactattgctgaccacgtcctgtcactcctaggccttgaaacattctagttcagaggccggaagcccaggaagagagggacacacaccagcactccctgctgcctagccctccccacctgtggacggagacatcctctctgggtgctgggataagcaaatccagggcaagcaggagggggaagtggcacactcacgcccagcggaagcttctggatccagtgccagagccagcacagcagttctctgcctgtgttccacgtgtgggcccccgctggcccagccggccctggccagtgacagttgcgtgtaggtgtctggttggttgctgggctgatgctgagccccgaggtgggcatgtgtggtggcacgtggccctagctttgtgtatttgccctttgcaaaggctgcgtgcgtcacggcaccattgtgggttttatacttctcactatcacacagccaacttaaagtaccgcaagctggctgggtgtggcggctcacatttagggaggctgggacaggcagattgcttgaacctcaggagtttgacaccagcctggacaacatggtgaaacctggtctctacaaaaacatttataaattagtgagtcctagtggcgtgtatctatagtcccagctcctcaggaggctgtttgggagggtcatctgagcccagggaggtggaggctgcggggagctgtgatcacaccactgcactcctgcccaggtgacagagccagaccctgtctcaaaaaaaaaaaaaaaaaaaatctaggctgggcgtggtggctcacgcctgtaatcccagcactttgggaggctgaggcaggtggatcacaaggtcaggagatctagaccatcctggctaacacggtgaaaccccgtctctactaaaattacaaaaaattagccgggcttggtggcgggcgcctgtagtcccagctactcgggaggctgagccaggagaatggcgtgaccccgggagttggagcttgcagtgagctgagattgcgccactgcactccagcctgggcaacagagcaagactttgtctcaaaaaaaaaaaaaaaatctgaaagcaaaggggaagggccggctgcctggccttgatgagatcaagaggtagtatttctccgtggtggtgggttgaatggcagcccccgaaagcttgtctaagttctcactcctgtacccatgaatgcaacggtgcaaccatatctagaaataggatctcagccaggcgcagtggctcatgcctgtaatcccagcactttgggaggctgaggtgggtggatcacctgagatcaagagttcaagaccaagcctggccaacacggtgagaacccatctctactaaaaatacaaaaattagcctggcatggtggcgtgcacctgtagtcccagctactccagagactgaggcaggagaatcccttgaacttgggaggtggaggctgcagtgggctgagatcgcgacactgcactccagcccgggaggcagagtgaggctcttgtctcaaacaacagcaacaacaacaaatagaaatagggtctctgcagaggtatctagggtgaggatcttgggatgagatcattctggatatagggtgggccctaaatccaatgacaggggtccttgtaagaa

SEQ ID NO: 12206 - DNA, 5349 bp, Human
cggctcttcgtccatgggcaatgtgagccatggagggtcttaggtagggtgaggcccaggagaggggcctggtggggtgggtggcctagctgggcaagggcaggtccctgatgacctgaggaggccgcagcagtcatcccaggaagatggtggcatggaagggctgggagtagggggatctggggaagttccctgggcttgggttagggggtagtaagagtgagagggtgggtgggtcagctgtacccctggagtacacagaggaggagatgtccaggagggtctgtagaggaaggggcatggcccatgggtctgcagcaggaggaaggcagtgactaaagtgatagctgggagaaggcagtggtcctcagagccatacctggtggggagaggccacgtggggctgagcaaagagggtatgatttccttccagcctcagggctgggcacacttgccttcagaacctccccacactaggtgagccagacgctggccttatctcatttaccatctcagagccatctgaagggggagaagggaaccgggccccaggagggagaaagtcatcaaacctcccacatctgtgaccagcctcagtgccatactttttctatggagggccctgtccaatggaactgagcacagaccagataaaagaactgggcacccagtggcctcagtccagggcctggagttcaaactttactggaaacaaaggggccgagagagactggggaaagaactactagaaaggggctggtgcccccatggggctgtgggttttggagccgcgtgcccccacctgagcctcagggggcccggagtgtccacaccagtggacctttcgagaaatggctgggccattgtgcagaagaatgcccggaaatcccgcgcctccctcctccagcaaggatgggggctcttcctcctggccaggaaactccaagttggcttccggagggtggcctgggggctggggtgccagggacaccatcgccactggtgggagggcagggcacagcccctccgtgtccctttgtctctcctgtctgaaggccagagcaggctgctaggcctggggccaccactgcccctgggtgctacacccagtgtgctgggtcactgggaacttcctgaagtggtgtcacctgaactgggcccccaaggatggggtgcgggcagtaccgcaggaagaggagcagcccctgtgaagattgagaggtctgggaagcccctgcggcttgggagagtgggggtcgccaggcagggggaaagcccctgtgccaccgctttttgccagagactcaggctccagagaggcagtgagtggcatggggggtgaggctggggccctgggcctgacctccacacgcctgcctggcctctctgtttgccatgggatgagagagacagtgctgggactcagagcggggctggagagtgagagtgcgagaaagggcctgggtggggcttggaccccggggcgggctttctggagagcccccctacgagggcctctacggcggtgacggggtggggggcttctgcaaaccttggtcagggaagtggagctggctcgagtggaagagaccacccggctcagtcggggatgtgggagtggactgggtggtgcagactgggggtcgagcgccttctgaagtgacggggccgggacgcgcagggaggcggcccaagaagcgcgccctaggccagcccagaatgcgctcggccgcgactaggacaacggcgggtggggctgggggcggctgccgggcggggagcggtcccgcgccctcagctacccctcaagagccgttgtttccctaacttcagctgccagaggctctgtgattggctgcggcacgatgacccgcgcacggattggctgcttcgggccggggggccgggcccgggggacagaatccgcccccgaaccttcaaagagggtaccccccggcaggagctggcagacccaggaggtgcgacagacccgcggggcaaacggactggggccaagagccgggagcgcgggcgcaaaggcaccagggcccgcccagggcgccgcgcagcacggccttgggggttctgcgggccttcgggtgcgcgtctcgcctctagccatggggtccgcagcgttggagatcctgggcctggtgctgtgcctggtgggctgggggggtctgatcctggcgtgcgggctgcccatgtggcaggtgaccgccttcctggaccacaacatcgtgacggcgcagaccacctggaaggggctgtggatgtcgtgcgtggtgcagagcaccgggcacatgcagtgcaaagtgtacgactcggtgctggctctgagcaccgaggtgcaggcggcgcgggcgctcaccgtgagcgccgtgctgctggcgttcgttgcgctcttcgtgaccctggcgggcgcgcagtgcaccacctgcgtggccccgggcccggccaaggcgcgtgtggccctcacgggaggcgtgctctacctgttttgcgggctgctggcgctcgtgccactctgctggttcgccaacattgtcgtccgcgagttttacgacccgtctgtgcccgtgtcgcagaagtacgagctgggcgcagcgctgtacatcggctgggcggccaccgcgctgctcatggtaggcggctgcctcttgtgctgcggcgcctgggtctgcaccggccgtcccgacctcagcttccccgtgaagtactcagcgccgcggcggcccacggccaccggcgactacgacaagaagaactacgtctgagggcgctgggcacggccgggcccctcctgccagccacgcctgcgaggcgttggataagcctggggagccccgcatggaccgcggcttccgccgggtagcgcggcgcgcaggctcctcggaacgtccggctctgcgccccgacgcggctcctggatccgctcctgcctgcgcccgcagctgaccttctcctgccactagcccggccctgcccttaacagacggaatgaagtttccttttctgtgcgcggcgctgtttccataggcagagcgggtgtcagactgaggatttcgcttcccctccaagacgctgggggtcttggctgctgccttacttcccagaggctcctgctgacttcggaggggcggatgcagagcccagggcccccaccggaagatgtgtacagctggtctttactccatcggcagggcccgagcccagggaccagtgacttggcctggacctcccggtctcactccagcatctccccaggcaaggcttgtgggcaccggagcttgagagagggcgggagtgggaaggctaagaatctgcttagtaaatggtttgaactctctcccacctgtgtcctgttctctgtccagccatcttccgtgtccagcagccccattcatcacccaccagccccgccctcccaaggactcctgtggagacctcctcccagggctggaggctggggctcttttccccatcctccctgccaccttcccaccaggtgggagacacagccaccacttactacagcccagaaaggcgggatctgcggtcagaagagctgctgcgtcatggggccctggggcccgggatgggacaggggcgggggcagcggcagaccccagcagaagatgcggggtgaagcgccctcaacacaggctggtgagtgggggtcctgcggtgtgggaagtgctgggggtgagcagccaggccgctggcttctcccagaaagggccaagccccacacagcacagggtgaggttttccactgccctctcagggcttgcctagtcccaagccccatcaagtggccacagaggtctgtagaatccccgaccaggccctttccaatggtgggtggggcaggaacaggggtgaatgcaggacacgccggtcaacagtagggttgccatgggaggaggtgctggcagctggttgcctggagtaccacagcttggctctagcccctcgtcctggctcctctgccagtcccagcgcagctccctacagagcctgtacccaccctgctggcctggcagcctgcccagaatggtgctcacaaccagcacctgtgccagcccctgctgggggcactctgggtaaccttcctcctccaggggctgtgtggcctgggagtcagtgctggcccctgccaggcacctcggaatgggggtgtctagagccatctaacatagccactgagagctcactgtttttagccttgttctaggcactttgaattaacacatttttgacatttgacataaagctagaagcagaagagagcagctgatgaagggggcatgctgcagggaagagctctaagcccagccggaagggagacttggtatctgccccaaactggacttgggggccctgcccagaaatgtctgggccacatccagtggcagggagtctcctaggtctggccaggctaccatcatggagcagtgggagaaccccaagaatgcaggctcagagtggcttagggcagctgctggaatgtgtggcagcttcctgggagctgctgtggaaccagccggtgggatgagttacagggagaggggccccacggtgcagaggtcctcagcaggcctgacctgtaccccacctgggcctgtacaacagggaccaagaatagtccccaagcttgggagtgtgtgatcccagagctgtggccctgggcagagccaaaaacaatggtccttacactcttgcacctggccaccgggactgggtagtaccaggtctggtgtgtttggtcagaagctgaggcccaaggctgcctgggagggcattcctaagaaagccttttcctaagaaaggacaggcacggggctgggcacggtggctcacgcctgtaatcccagcactttggaaggccgacgtgggcggatcacagggtcaggacatcaagaccattctggccaacgtggtgacacccgtctgtactaaaaatacaaaaattagctgggcgtggtggtgtgtgcctgtaatcccagctactcgggaggctgagacaggagaaccacttgaactcgggaggcagaggttgcagtgtgccgagatcgcaccaactgcactctagtctggtgacagagcgagactctgtctcaaaaaaaggaaagaaagggcatggaaaggaagctgcacagcctttgaattttcccaaatggccagggtaggcagctcaagggtcccgggaagctgtgcaaaccaccagaggtgaggggaggggcccagcctccagtccagctctcacccttttgtgcccactgccctttgccaagggctgcaccaagaccagccccacctacctgtgtgctcttttccaggccactc

SEQ ID NO: 12207 - DNA, 8095 bp, Human
catgcctgtaattccggctactcgggaggctgaggcaggagaattgcttgaacccaagaggcggaggttgtggtgagccgagattgcaccattgtactccagcctgggcaacaagagcaaaactctgtctcaaaaaaaaaaaaaaaaaaaaaccaaaaacaaaaattagctgggcgtagtggtatgtgcctgtaatcctagctactcagaaggctgaggcatgagaatcacttgaacctaggaggcggagggtgcagtgagccgagattgtgccactgcattccagcctgggtgacagagtgagagtctgtctcaaaaacaaaaccccaaaaaaccaaaaaacaataaaaactaaattggaatcccatgggtctccctcaccctttggcaccctgcctgcctgggggaggccttatttagcttggcccagccctgctgagctttccttgggaatgtctatatataggggaagggggcagcccagttgccactgtccatctgcattccttggtgtccagcccccctttcctggccccagagcctgctatcggttgtcttggtgctctttctgtccacgtagccactgtctacaagccttgcctactccccagtgcccagcctgcaccttgtggattctcaggttgggctccctctggacttggtctgcccacccctttactccccagatgaccagatttcttcactgagctctaggaaggggccagctgtccttttaccacttaaagaaccttcccctgcctactccttacttcaaaaaaagtgaatccaaacaccctttccctggagaaggtaactttcagagaaggatctttgctttcaatgattatttctcctccaaatgcacatcctcctctcctccatccctccatacatttttccatctggacaggtgccccaaggactgtctgtcccaacttccctccagtcaggattaataataagaatcatcaacatgggtgggcatggtgcctcatgactgtaattctagcactttgggaaaccaaggtggaaggatcccctgagcctaggagttcgagaccagcctgggcaacatggtgaaaccccatctctataaaaatacaaaaaaaaaaaaagccaggggtggtggtgcacctctagtcccagctactcgggaggctgaagtgggaggatcacttgagcccaggagatagaggctgcagtgagctataatagcaccactgcacatcagccttggtgacagagtgagtatagacctttataatttacaaagctctgcagtcaagtggggataatagttgctacctcataggaggagcactagatgagatcatgttaaaatgcttagcacagtgtgtggcacgtcatggggttcagtaaacagtggcctacctgtcactttctcctcctatcccctgccccttaccatggttcaaagacgggacattcctcttgccaagcaccaacgctgtgtacccagcacaagctaggtgacttatacccgggttcccatttaccatggtctctctgtgagggagaccccacagacaggtccaatcccacagatgaagaaatggctcagagaggcactgctaccggcccaaggtcacacaactcgcagaggctggccttggatcttgggttttggacttcaaggcttgtactctccccattttaccatgctgcctcaccctttactactctgatcatccttaccatcttggagccagtgtgcttcctcggtcggggggactccaaggcagtggaacagggcaggccttcctcacaagaatctaggacgtcaaggcctgccacctgcttggaggcttaaatttctctgcaagggcccttggctaaattaggtaatgggttcagactgtgggaggggtgggactcgctgaccccaggatctgattgggcagggtctccagtgctggggagcagggaggtgggaggggagggtgcccctacaaatcccgggggctagagcaggccaggtcatctttgggtggtggagtgcaaaggaggcgacctgcaacagaggagtcccggtcaccagcaaccatggtaaggacaagaggggactttgtgcctttactcacgggagcactctggacccctttcaggccaggcctgggtgctctgtggggcagtaacttggatgtttgaggttggagcatggaggttcctggaacccaggtgtcttggaggaaggcctttgacttttcttgaaaggggagggctgggatattccagagattgatccttaaggcttgctgactgcctactcacttctggaaacttccagcagtgtcattcatagacctgtgaagagctcttagcttgtttccttcacacagtggggactctgaggggtcagagtgagtcacccagcaggccagtggcaggggtgagccagaagcctggccaaaccctcctatcatcatggagagaagaaagcctcctccagaagacgggaggccggcagggcgtggggcctgctcagatgcagggctctgggagccctgaggatgatgggaaggggcagaagatgacagaccagagttagagagactccgctctcctagagagggcttctgatttggagctgttgttttggtctgagatccccctccccacttcacttcaaggagtaactagatcccagaggccagctgctgttgcccatgcctgactaaaaatagcctgccctcctggcatagggaaagaggaggagaggaaggagggggagaaggaggagcactggtggccagccggctgaagagctccttggaagcctcaccctgtcctcactgccagcctcaatccaaagcctctgacccagatggcctggcttggatatgacgtggaaacccctgcagaaatctcactttcatgtcaaggcctccatcacattcggccccccatgaggggccttttctccaatgactgaatcctaagaaggaagctgacggcctccgactctgccagttctctgaggggcgggatgatgtgtcttttatctcttctttgtggttccagtgcctgatctgtggcctgacatgcagcaagtactcaataactttgtgttgcattattatttatttgagaacaaacattttattgagcaactattaaagtaccgggcaccattaggagctgcagaaaactggaaaatagtgctggaatggtgctagccctttacaaagccctttcacacccctgatatctcatccctgaaaagctacagagaaaagatgaaggcacgctaattgacgtgcctaaggtcactggggggtggggggggttcccgacttggccttcaattgacaagtgagaaggccttgggcttaacttgttgtctcctctcttttgctcaaaactggggtcacaggctgcgcgcggtggctcacgcctgtaatcccatcactttgggaagctgaggcaggcagatcgcctaaggtagggggttcgagaccagcctgaccaacatggagaaacctcatctctactaaaaatacaaaattagccgggcgttgtggtgcatgcctgtaatcccagctactcgggaggctgagggagaagaatcgcttgaaccccggaggtgggggttgcggttgtggcgagctgagatcgtgccattacactgcagcctaggcaacaagagcaaaactccgtctcaaaacaaaacaaaacaaacaaacaaaaaaaactggggtcaggccgggcatggtggctcacgcctgtaatcccagcactttgggaagccgaggtgggcggatcacctgatgtgaggagttcaagaccagcctggccaacatggtaaaacctcgtctctactaaaaatacaaaaattagctgggcgtgttggcgcatgcctgtaatcccagctactcgagaggctgagggaggagaatcgcttgaacccaggaggtggaggttgcagtgagccgagatcacgccattgcactccagcctgggcgacagggcgagactgtcacaaaaacaaaaagcaaaaacaaaaactggggtcagaagctgggcacagtggctcaagcctgtaatcctagcactttgggaggccgaggtggcaggatcacttgaacccaggagttcaaaaccagcctgggtaatatagtgggaccccatctctacaaaaaattttaaaaattaggcgtggtgtatgctatagtcccagctactcaggaggctgaagtgggacgattgcttgagcccaggaggttgaggctgcagtgagctatgatcacactactgcactccagcatgtgtgacagagcgagacaaaacaaaactgtgattgggtgctgtgcgggcacacaattatgtgacaagtttgaagttgttcttctggagaaccaagggcgctgacagagtgggggttgggaagaatggctttgaggtgaggaactgctctggggctgcctcttcagctcagactttctctgtgtctcctgcagacggaccagcaggctgaggccaggtcctacctcagcgaagagatgatcgctggtgagtgaggcgcggcaggctgggggctgggtggatgtatgctggggacatgttggcctctaggcagggtgggggttgggggggggtaggtgtgaggctgacagtccagcaggcctcacctctgccctctgccctccctcgcagagttcaaggctgcctttgacatgtttgatgctgatggtggtggggacatcagcgtcaaggagttgggcacggtgatgaggatgctgggccagacacccaccaaggaggagctggacgccatcatcgaggaggtggatgaggacggtgagcgggtgtccctcggaggcaggggatggtggggagaggcggcagcggctgggctcaggctcagtctgccacctgctgcccgcaggcagcggcaccatcgacttcgaggagttcttggtcatgatggtgcgccagatgaaagaggacgcgaaagggaagagcgaggaggagctggccgagtgcttccgcatcttcgacaggtgcgctgggggcccgggagccgagggaggggcttagcagtcagaacccggccggcagcgctggaagcttccccgtgttgggagtgcggaagcggggcgtcgagtgtggtggccagggcagctcgccccggccctgagccctgccctgtccctcggacctgaaggaatgcagacggctacatcgacccggaggagctggctgagattttcagggcctccggggagcacgtgacggacgaggagatcgaatctctgatgaaagacggcgacaagaacaacgacggccgcattgacttcgacggtgagggccaacgggagcttgggaagagcgggtgggagccccagaggacggcgggcactggtgcctggctccggtgcagtgtccttggccttgtgggctgggctgggcgtaacttcaccaagttccccatagtctcctgggggcaggtatagaagcgctccacgactctgtgcagtttatcaattaatgaccaggcaggggggcgtggtggctcaggactgtaaaatcctagaactttgggaggatgaggtgggaggattgcttgaggccaagagttcgagaccagcctgggcaacatagtgagaccctgtctttacaaaaaataaaataaaataaaaaggcaggtgtggtggcacacctgtggtcccagttgctcccggggctgaggtaagaggatcgcttgagcctaggagatcaaggctgcaatgagttatgattgtgccactgcactctagcctgggtgacagaccttggcgaccttggcaacagagtgagactctgtctcaacaaaaacaaaaacaaaaagtcatcccctctgtgtggctggagccctggcctggcctctgcgtccccagtgggacccctgaccctctccctctcctttccctcagagttcctgaagatgatggagggcgtgcagtaaggagtggacagtcgcctctaccaagatcgcgtgtccctagggtgtgggagactccgccctgccgggtccccaccagggaggcgcggccccttgtgggtctttgtctggaaggaataaaagcaaatgttccaaaactcgtggcctgaatgaggggagagccgaggacagcaggtcgcaagggctgtggtccagggcgccatcccggctggcaccacccggagcacccttggggatccccgggagaggctgtctgagcggcgggatgtggaagggagctgggccctggagcccgaggcggcggctgcgagtgctcgatggcgctgactcgctctgcaggtttgcagccggctcctgacagctggcgctgggcgtgcacagcttggcggacaggcagtggtggctccaggaggctgcaggggcttggagttgagtcagggtgagccggcggactgcggaggggtcctgagacggcaggtagggtgagggggtgggagaggctagaaccctggggagccgggaagctccctcacttccccaccatccttttctggaacgtttgcgtcttagatgttgtcgtagctgccaccttctgcaggctccctagctggggagaggggaagtaggtgcccatccatgccaggcagcattgtttctgctcgaccttttacttcttctgttcttccaagtgcttactcctcaaattgtactggtggttgtaggggagggtggaggcacccactaaggagattctgatctcatcatttgaccccagatccctgcctccacctggtctctgccagtgcgctctacagagggccatcagcagcagcgagctaaaatatctgacttggccactgccctgttgaaagtagttcaaggctcctcactgcttctacaatgagatccaaattccttccctccctccctccctccctctctttcttcccatagtcctcacagggctgcagccacactgggcaatgtattcctgatatggacctggggtgcattttcaagcccttggtactttgcacatgctgtttgccctccctggaatgcccttgtccttcttataagctggcagattcttcaacctacaagacccagctcaactaccatctcctcccttgaaccttgccctcactggctatttgctgccatagcaattcgtatacaacaggtatcagatggcagctaattaagtgtaggggtagtttagctttagagacagaatgcctgtgtgtgagtgctcactgcctgtgacaagctaaaccactctgtgccacagtttcctcatctgtaaaatggggatagtgatagtaaacacggggttgtgagaagaagttagtgtgtgcaaagtgcttacagcagtgcctggcacatagcaagcatttttttttttaacagagtttcgctcttgtcatccaggctggagtgcagtggcgcgatctcagctcactgcaacctccgcctcctgggttcgagcaattcttctgcctcagcctcctgagtagctgggattaccggtgtccaccaccatgcctggctaatttttgtatttttagtagagaccaggtttcgccatgttggccaggctggtcttgaactcctgatctcaggtgatccgcctgcctcggcctcccaaagtgctgggattacaggcatgagccaccacatctggccttctgttttgttttttaaatgagacagggtctcgctctgttgcccaggctggagtgcagtaggtgatcacagctcactgtagccttgacctcccgggctcaagcgatcctcctgtctcagcctcccgagtagctgggactataaatgggtgacccctccccactagtttttgttatttttagcagagatggggtctcactatgttgcccaggctggtctcaaactcttgagctcaaagaatcctctcaccttggcctcccaaagtgttgggattataggcatgagccatcgtgcccagcctctattgtcaccttactcattgctttagttcttcctctccatctgtctttttctcttcctcttttgtcctattcatgtttttctgtttttatttccagccaggatcagtgctggggtttggtaatcattactatttactgagtgcct

SEQ ID NO: 12208 - DNA, 30244 bp, Human
gtgccttgatcaccacaaaaggatgatgggaacggggctgtggggtcccagggaggagcccttcacctggcctgggttacaggatggctcctgggaagacaatgccagctgtgcgctgaaagtctgtgcaagctgctcccgtgaaaaggaggacattggcatggcagggctgtgggcaggtcttagtggctggacattcccaggagttagcactggctatcattctgtagggctccctcccacctccaaactcctggcttctacaccagggcattcacagacagattgcagactcacatggtggcatgtgaggctacagatacacttgcacaggccagaggatactactgcgtgtcccctggagccaggcctgggctggactttgttcctggcttagggatgcaacacagaatgggacaaggcctctgctcacaatggtctgtaatgtcacatctctgtggtctgccctgaactgcctgaagcagggactattgtccctacatgtccctagtccccgggctggcctggttgggttgagcaagaatctctggaaagaatgaaaggcagcaaatggagaaaacattactgagagcacgagagcaggctaaggccgtggtggtaagggactcgggcctgtgcaagagtaccaggaagacacctgtgggaggaggtggccgggtgaaggaaggggcagtgggaggagcttccatgcctagggaccagtaccaccccaggctggaagcccagagtggagtcctaggacatcagatcctaaagggcttgaataccgtttaaggcttttcttccgggagcaagtaggagccaaagaagggaagttgcgggacttgttttcgtggggccagttgcctggtggttacgcgcctctcctctgaagtcaggcatcctgttccagagtatcctggttgcgcttcaacttgcggagtgacctggggcaagtgactttaacctcagcttcctcatctgtggagtggggagggcgcagcgctggtcgccctgaacaggaagtgagacaacctcggggtgcacacgcgcaggcccgagccgcagggtccacgcccgaggcgaggcggcagcggcgcctgcagggcgaggggacgaatcgcgatctttttcagagtaacccgcgtacaataaaaagtccccatgaaaaggacaaactagccaggcgtgaggggcggtggctcacgcctgtaatcccagcactttaggaggccgaggcgggtggatcacctaaggtcaggagttctagaccagcctggccaaggtggcgaaacccccgtctctactacaaatacgaaaattagccggacgtgttggcgcgcgcctgtaattccagctactcgggaggctgaggctggagaatcgcttgaacccggagggcagagattggagtgagctgagatcgcgccatggcactccagcctgggcaacaagagtgaaactccgtctcaaaaacaaacaaaaaaggaccaactaaaaaaagaatataaatacaataaataacaggacttacgggggcaggctgacccctaaagtaaggggtcgggctggaaaggatctcaaggggtcagagtttgagccgccgaggcgcgcgagccccagcactcctaggcagctgcatccgccccggaagatcccctggggccctgcgctggctttccacagcgccatgttggacggtcctcccacttcccaccttcccagtcctcccgctactctgaccgttctacctgtgattctcgctggtggagtcaacctggaatggattcccgccgaaccacgcctccctttcctggttcgcccgcagtttcggcctatcaggttgagtcgggtaaaccaggacgggccaagcggcactctcattggatatcactggtgggggcgggaagaaggcggagcacgtgcccgggcggaagtagccgtcgcatcgcggattacgaaacgccgcggagctgaggcagttccgctggctagtgtgtacgcggcgagcttctcccggcgccgcccgctcggctcccatagcgcccgcgacagcggtccggacgccgcccgaacatggactccgccggccaaggtacctgccgggcccggccccttcgccgcagatgggcccaggctgcccgttgttctccgtctcccggggtcgcgtctgcgactctctgtcctctcggtctcggttcacccaccccgcggcccctcttcagctcccggggccactgacctcgaagcttatgatggtcgtggtgtgttttttgcccgcggcccagaccgcttcctgggctctctccagccgccctcctggtctcccctgggaccgttccgaggtgtggttccctggcgcccgccgttgctcccgtagtttgggttctgtcgctcccagcaggtctcgcttatgccgcccaccccgtgccctgctcttgcttgctctgccaccccccggtccctgcgcggggccctcgggttcacgctgtctggccctggacccagtccgaggtgttgagggcggctcccgagcagagaaggggtcttcgcgttcagcagagctccccttgggcagcaactctgctcggagctcagcctgcttaggggttgcctcatggagagggggtggagtgagtcaggggcacacccagcataccaggcctgtttccagaacagtctccccagagcagtatgagatggccactgaggggcgtggagcgagcccaggagattaaaatcttgagaagatgataaaagtctgccttgcattttggggctctagagagggatgctaaatttctttctttctttctttctttctttatttttttgagacggagtcttgctctgacgccaggctggagtgcagtggcgcgatctcagctcattgcaacctcgacctcccgggttcaagcgattctgctgcctcagcctcctgagtagctgggactacaggcacgcgccaccaggcccagctaatttttgtatttttagtagaggcagggtttcaccatgttgcccaggatggtctcgatctcttgaccttgtgatccgcccgcctcagcctcccaaagtgctgggattacaggcgtgagccactgtgcccggctacatattaagctttataattcctaggtgctgcattattctggagggtgttttttgtttgtttgtttttgtttttttgagatggagtctcactctgtcgcccaggctggagcgcagtggctagatctcggctcactgcaagctccgcctcccgggttcactgccattctcctgcttcagcctcccaactagctgggactacaggcgcccgccatcatgcccggctaattttttgtatctttagtagagacggggtttcactgttagccatgacggtcttgataccctgacctcgtgatctgcttacctcggcctcccaaagtgctgggattacaggcgtgagccaccgcgcctggccttttttttttttttttttaattttttttttggggacagcgtctccctctgtctcccaggctggagtgcagtggtgcaatcatagcttactgcaatcttcaactcctgggctcaagcgatcttcctgcgtcagcctcccaggtagctgggactataagactacaggcgcaccatgccaggttaattggtctttctacttttttttttttttttgagacggattttcgctcttgttgcccacgctgcagtacaatggcgcgatcatggcttcccgcaacctctgccttctgggttcaagcgattctcctgcctcagcctcccgtgtagctggcattacaggcgtgcgccaccatgcccggctaattttgtatttttagtagagatggaggtttctccatgttggtcaagctggtctcgaacttctgacctcaggtgatctgcccgccttggcctccaaaagtgctgggattacaggtgtgagccattgtgcccagcctcatttgtctttttttaaatagaacagaaaggctgggctcggtggcttacgcctgtaattctaacacattgggaggccgaggccagtggatcacttgaggtcaggagtttgagaccagcctaaccaacgtgccaaaaccccgtctctactaaaaataaaaaaattaaccgggcatggtggtgtgctcctgtagtcccagctacttgggaggctgaggcaggagaatcgattgaacccaggaggtggaggttgcagtgagcggagatcgtgccactgcactccagcctgggtgacagagtaagactcgtctaaaaaaaaaaaaaagagaatcagtggataaaaaagtggatacgcttcgtttagtaagcgtttgtggagcgccaaggaagtgcacacggctccagtcctatgggacatttgaagggagtgagatgcagccagcttttaagaagagtatctttgttaagtgcatttaatctggtgtctttgtgttgtcttttaaaaggcatagtttttttttctttttcttttcttttgttttttttttttgagacagtctcaaaaaaaagagacggggtttcaccatattggccaggctggtcttgaactcctgacctcaggtgatccgcccgcctcagcctcccaaagtgctgggattaccggcatgagccaccccgcccgaccagtttttctttttttttttaaagaatttttttttggccgcgcgtggtggctcaacgcctgtaatctcccgggttcaagtgattctcctgcctcagcctcccaagtagctgggaactacaggcgcgtgccaccacgctaactaattttgtatttttagtagagacggggtttcaccattttggtcaagctggtctcgaactcctgacctcatgtgatccacctgcctcggcctccaaaagtgctgggattataggcatgagccactgcgcctggcagtaagcctgtttcttttcagaatgttttggtcaacagggaaagtgttacaatagtcatgtgcttggatttggagagaatcgaaatagactgtttttctttatgtgaaatcttgtagacttttagggtagtcaggaagatgcatttgacatgaagaaaaaacagtggctgcaggaatttgaatgtgatctgggtgtagttgaggtgtgtggtggcagcacaccgctctgcacctctctgcctgctggcggccttctggcagtgggatgagaatcgggaggtaagtaaagggaattttgttttgctgcctccctgaaggagctgaatgagcagcatgtgctcctagtacgtaattttagcatgtgctctgtcagatgtgttgagaggaaagtgatgcttattgtgtatattaaccatattaggttcctttttttaaaaaaagtggaaatttgtcagggtatggtggctcacacctgtaatcccaacactttgggaggccaaggcgggcggatcacccgaggtcgggaattggagaccagcctggccgacatgacgaaaccccgtctctactgaaaatacaaaaatagccagcgtggtggcgtgcgcctgtaatcccagctactcgaaggctgagacaggagaatcacttgaacccgggagacggaggttgcagtgagctgagatcgcaccattgcactccagcttgggaggcagagtgagactccatcaaaaaaaaaaggtggaaggtctgttagattgagctgctttctctgtagcaagggtttcctgcctctgacgatagtattctcactgggaagccagaattcgggtttgcctgccttgggccggcatttgtcgtgccctgaagcagcacaagtggcattggcttttcagctcaggtggtctgaggtgtggctgccctcgtctactgcccatgctgtcctcacagacctttcagagaagaggtgttagtctccagggtctcacccactcccacctgtgcttttgtcctgctagagacctctaccgtatttacttggaactaacttatttgacactttgtggcctcattttgtctctggcagatatcaacctgaattctcctaacaaaggtctgctgtctgactccatgacggatgttcctgtcgacacaggtgtggctgcccggactcctgctgttgagggtctgacagaggctgaggaggaggagctcagggctgagcttaccaaggtgctgtggcttggctgtctgtcctggggtgaattggagttaaggccctcttggattagtgagaggccagggtactggccacgctcgggaggaattgccctgggtggtcacctaccctgctctgtgttccgactgataacggggttctctttgtatgtgcccagctccatgcactggactcagagccacctggcagtggagacagggcatgactcccttcccatacctctgtgcctggcccttcctaagtgctccctgaggagtgttcacacatgaaccgcctctgagcagccatctgctgggagtgtctctgttggaattaacacttgataatcatttttaagaccccatgaatctttcttgtcctggatcttaagttttcttttaaacatatttattttggctggatgcagtggctcatgcctgtaattccagcgccttaggaggacagggtggtaaggtgggaagatcacttgagcccaggagtttgagagcagcctgggcaacacagtgagaccttgtctctacccccaaaaattagccaggtgtggtggcatgtgcctgtagtcccagctactcaggaggctgaggtgagaggattgcttgaggccaggaggtcaaggcttcagtgagctgtgattgcatcctgcacagcagcctgggtgacagggcgagaccctgtctcaaaaacaaaacaaaaacttcttttctaaaaagtatttatgtgatcttctttaagtgagagtcccttaagagtaatgtaggaattaagaacaaaagcctccaaccataatttttagtcaaaccaactgccaagagttttcttttcaccctgtgatgtggtttaattccagaatctgggtccaggcctaggtctgagtaaggttggttgtgccgctgagtctgaggaccaggtttcagatcctgaggacatcacacagctatttctagcctagaagattaaaggagagtagcaggaagtccaaggacactttgctttccatttaacttcagaatatgtgagtttagaaactaaatccacaaggtttttttcagagttgaattacaataaggtgaagtttttttttttttttttttttttttgagtcggagtctctgccgcccaggctggagtgcagtggcgcaatctcggctcactgcaacctccaacacccgggttcacgccattctcctgcctcagcctcctgagtagctgggactacaggcgcccaccaccacgcccggctaatttttttgtgtttttagtcgagatggggtttgttttttttttttggagacagagtctcgccctgtcgcccaggctggagtgcaatggtgtgatctcggctcgctgcaatctccgcctcccaggttcaagcgattctcctgcctcagcctcccgaatatctgggattacaggcgcgtgcctccctgcccatctaattttcgtatttttagtagagacagagtttcaccatgttggccaggctgatctcaaactcctgatcttgtgatccacccaccttggcctcccagagtgctgggattacaggtgtgagccactgtgcccggcccctacaaggtgaagttctgtattgcttttttttgttgtttttcttgagacagagtcttgctctgtcgcccaggctagagtgcagtggcgtgatctcagctcactggagcctctgcctccctggttcaagtgattttcatgcctcagcctcccaagtaggtgggattacagacgcctgccaccacacctggctaatttttgtatttttagtagagacagagtttcaccatgttggccaggctggtcccgaactccgagtctcaagagctccacctggctcagcctcccgaagtgctaggattacaaatgcgagccgctgtacccagccaagaaagagaatttttttttttttaaggacggagtctcactctgtcgcccaggctggagtgcagtggcgtgatctgggctcactgcagcctccacctcctgagttgaagtgattctcttgcctcagcctcccgagtagctgggattacaggcgcacagcaccatgcctggctaatttttgtatttttagtagagacggagtttcaccacgttggccaggttggtctcgaactccagacctcaggtaatctgcctgcctcagcctcccatagtgctgggattacacgcaagaaagagtttttttttttttttgagactttttgctcttgttgcccaggctggagtggaatggtgcgatcttggctcactgcagcctctgcctcccaggttcaagtgattctcctgtctcagcctcccgagtacctggggttacaggtgcatgccaccacgcctggctaatttttgtatttttggtagagacggcctttcatcatattggtcaggctggtctcggactcctgacctcaggtgatctgcccgcctcggcctcccaaagtgctgggattacaggcatgagctatcgtacccggccaagaaagagaatttttaaagagaagctagtcatatatgagctgaagatactgagaactcattctaaagtggtaaagctttgaatgatgcccctttcagaggtcatgttctttttttttttttttttttttaaagacctgagaaagttcaagtcttcatgatcaggaatctttctgttgctcagttctaactacgttaagcacaaaagataatttaccttttggttcgtgtaactgactcttgccaaggtttggaactgacctcaggaacacaagtgttttcttaagggtgtttttttctgtcacctgtgtcactgtccatctgcctcctcctctctgcatatggaattctatgagtgcagacggtgcccggctgccaacagttccagcttctattgtccaagcccagactgagagccctgagggaaaaggatcctcactgttttttgtttgtttgtttgtttttgaaacagtctcggtctgtcacctaggctggagtgcagtggcatgatctcggctcactgcaacctctgtctcctgggttcaaacagttttcctgcctcagcctcccgagtagctggggttacaggcgtgcaccaccatacctggctaatttttgtatttttagtagagacggggttttgtcatgttggccaggctggtctcaaactcctgacctcagataatctgcctgccttggcctcacaaagtgctgggattacaggcgtgagccactgtgcccggccagggtcttcaccatttttttgttgttgttgttttgttttgtttgagatggagtctcgctctgtcacccaggctggagtgcagtggcacaatcttggctcacccgcaagctctgcctcctggattcacaccattctcctgcctcagcctcccgagtagctgggactacaggtgcccgccaccgtgcctggctaattttttgtattttttagtagagacagggtttcgctgtgttaactgtgttagccaggatggtctcgatctcctgacctcgtgatccgcccgccttggcctcccagagtgctgggattacaggcatgcgccactgcgcccggccggtcttcacctttttaataccatgcccagtcctagtaaagagctcggacaaacctggcatggtcatcctgggccattcctcatgaccacaaatggacatggtgattggtagctctcccagaaccatttagttgtggggcatgggatagttccctggagtcaagttcctagtaccagataaaaacaaatgtctgctggctgggcgcggtggctcacgcctgtaatcccagcactttgggaggctgaggtgggaggatcacctgaggttgggagtttgagacgagcctgaccaacatggtgaaaccccatctctactaaaaatacaaaattagccgggcagggtggcacacgcctgtaatcccagctacttgggaggctgaggcaggagaatcacttgaatctgaaaggcagaggttgcggtgagccgaggtcgtgccattgcactccagcctgggcgacgagcgaaactccatctcaaaaaaaaaaaaaaaccaaaacccaaaaatcagatgtctgctgtagatgctgttattcctaggacgagttaatgctttggtaagcggaaagttcttgtgtaactcatggcactgtgcatgaggatgttagtcacttcctgcagtagtgatggctcatcatgtcaactgcatgctttgcaggtggaagaggaaattgtcactctgcgccaggtcctggcagccaaggagaggcactgtggagagctcaagaggaggctgggcctctccaccctgggggagctgaaacagaacctgtccaggagctggcatgacgtgcaggtctctagcgcgtaggtacctgccccaggcgcacccctgggggctgaagagaacgggcaccacacgtgccccggcatgtgggggggcgtcgtcatgcccagggacgagttgcagccgtggagttgagtggcctgtttggaaggatccagagagaggctctgagcccttggcccagcgactgtgccttgtttgttcaaaaagcttggtgtctacatgtgttttatttatttttaagtttttgtgtactttattattattttttttgagacagagtctcactctgtcgcccaggctggagtgtagtggcgtgatcttagctcgctgcaacctctgccccccgggttcaagcgattctcctgcctcagcctcccaagtagctgggattacaggcgcctcccaccgcgcccggctgatttttttttttgtgtgtgtgtgtgtgtgtgtgtgtgtgtttttagtagagatggggtttcaccatgttggccaggctggtcttgaactcctgaccttgtgatccacccacctcagcctcccaaagtgctggccaccacgctggccttttttttttttttattattattcttttttgagatggtttcgctctgtcacccaggctggagtgcagtggcgcaatcatgattcactgcaacctcaacctcctgggttcaagcaatcctcccaactcaacccccctcgtagctgggatgacaggcgtgcgccaccatgcctggctaattttttcacgttttatagagacagggtcttgctttgctacctaggctggtctcaaatttctgggctcaagcaatcctcttgttttggcctcctaaaatgcttgggattacacgtgtgagccaccacatccggcttatatacgtgttctaaaaaggcagacacactggctagttgtcctggtggaaaatgataggaagactgtttcagggtccagacttgagagagcactgatcaggtccttggcaagagcggtttttctgtggtccttgttgtgggtgtggcatggtcacagcctctgacccagatatggccatatgggccgggcatggtggctcatgcctacaatcccagcactttgggaggctgaggcgggtgtatcacttgaggttaggagttcaagactagcctgaccaacatggagaaaccctgtctctactaaaaaataaaaaaatttagctgggcgtggtggtgcgcacctgtgatctcggctactagggaggctgaggcaggagaatctctttaacccgggaggcggaggttgcagtgagccaaaattatgccactgccctccagcctgggtgacagagcaagactctgtctcaaaaaaaaaaaatatatatatatatatatttatatataggaccatatggtcccacaaccctagggactctgaccctccccgatgacgacgtggtcctacatgacgacgtggtcctataaccctgggacacctgtcccagatgtcgctcagctctgaatttggggagtgctgctttctcacttggccctgtccacgtggcttctctgaaacatacccttcaaggttggggtggctgtggaatgtttcccagaagacatgttcctatacaaagacagaacaggtcacatttcataaatctcacatatgagaggcccatgtttttgtcctaggacatcgtaagttttgaatcccaagggtgttttggagctgtgggctgtgcccttccagtcccccacagcagtgctgttgcccaagaatctcctagcgagagaccaggggctactgccaggtgacagaaaagggaacatcagttccgctatacccacagctcacctggcggcctggggcctgcacagggcctggttgaggcagtggaccccatttttgggccgtctgtggagttgatgttcctgccagctggtccctctctgtcttccctggaacttcacctgcagtttgatgcctgagttaaaattgttcttctaaataattcactgtagactttctgtttttagctatgtgaaaacttctgagaaacttggagagtggaatgagaaagtgacccagtcagacctgtgagtgcctgtatcatcagcacctcctccttcctcctctccgcctcctgacactcagtcggggaagggggctgtgcacacttggcacaaagcttgttttggtatttgctggctattttttcttcctataacttttcttctctcaggtaaactatcctttaaacttttgtggaacagggaatagtagctgagagaaactcactcagccacctgaccacacttaaaactcccctctgcctgatatgcgtcccttatgtaagaggcctgcactggtcctggctgtatctctaactaatagagctccttggcttccggcagtgcacaagctggacaacaccacttggcctgggtttgttggtggcgaatttttgtttgttctaaccctaacccttttccctgcttagctccagctgttgggttctcagaattcctttcctcctttaggggtagttcttgagtggagggcatggtgtaggatatgctggtggaaatttgaaatcctcacgatctgggaggcactgcattgtcagagcatcagccagtgtggatcaagtgtggatagttttgtatgtgtgtgtcagtggtgttgttcagagtgactcctaatatttggagatccttaaactagataatagcacttcatttacttgtgctctgatctgattataacgtctttaaactgaggaggggaatatttttaaatagtctctgtgggattttttcatctgttatttagaaggaagcgctgtaatcgttgccacagaacatgggcagaaagtcctcccatgttggtctgaaaggaagcagttgctgccgagcttgtcttgaaggtcctgggggaccaggctggcactgcgtgcacatggagcctttgcgtctggtgtcacggtgggaggctggtgtcaggaaccccgggcggttctcggcatgttgccccgggtattccagggacccgggtggttcgtgggcatggctacagcagccagctgtacatctgggtgctctggggacccgggcggttcacggcatgttgccctgggtattccagggacccgggcggtttgtgggcatggctacagcagccagctgtacatctgggtgctctggggacccgggtggttcatggcatgttgccctgggttttttttgtttgtttggttttttttttgagacaacgtctcgttctgtctcccaggctggagtgcagtggcgccatctgggctcactgcaagctccgcctcccgggttcacaccattctcctgcctcagcctccccagtagctgggactacaggcgcccgccaccacgcccggctaattttttctatttttagtagagacaggatttcaccatgtcagccaggatggtctcaatctcctgacctcgtgatccgcctgcctcagcctcccaaagtgctgggactacaggcgcccaccaccacgcccggctaattttttgtatttttagtagagacagggtttcatggtgttagccaggatggtttcgatctcctgacctcgtgatccgcccatctcggcctcccaaagtgctgggatgacaggcgtgacccactgcacccggcttgagcagggtgttctagggaccctggtgggctgtgtctcgggctgttgaacagtgactttgctgggcagcagatggttcctaggttgggacagtgacggtcatccttgcagtttgggcatcaggcggacgcacagtgcagactcagtctgaaaatagtcttaggagacttcagtgctgttttgtaaaaccaactgacataaagctgccgggatcctatttcaaataaatagtgttttagagagcttattacaacactcagcgtcccgacccctctggagaaacctgtggctcagcatggaagcatatggccagtgcatcacctggccgaggccattcccctgagttctgtggcgagagctgtcaactgacggttccagagtggaagcgtttctgccgggaaggcccaggccgagggcgatggtttctgccgggacggcccaggccgagggcgatggtttctggtgggaaggcccaggccgagggcgatggtttctgccgggacggccgaggccgagggcggtggtttctgccgggacggcccagacggaagggatgcggcttgggaggtggggcctgaggatgtggccatggcgcgtgctcttcctggctggtgcctctcctagtcagcttcaggagatgggctgtagatgtacctccactgcccagagctctgcaggggaaggcagtaaaagctccctgcatcctgacccacgtgtttgtagatcctttcagctattggcgccctggaggatggacgggaaggagaacgtggccggtgggtggaggatagcactggtgcctggccccatgaggctgcaatgcggccacattctcagtgggtcatgtctgaatgcgagagcagctgtgttctgcgagtggtgaaacaattgcctgttgcattctatttataggcagaggtaactaaaaacctcagtgctgagaggggcatcatatagatcctgcagttatgagctggttcacttggagttgttttggttgcaggtgacagaaagcacgactcaaggtagcatcaaccaaacagggaggtgggagcactcaccaggcagagaagtccctgcccccactgctgcagcccaacagtgtggccccatatgggtctccctggactaatggctgcggccttggaggtggtgtgctctggccaggcctggatcacttgtccatcctgagtgggagtgggggcagcccccagagacagactcaggagagggggagtgcaaggatgtcccccagatgccctgtgctgcccaggggacagctcactggcagtgggacgaaaccgctgtctgtccagggctctcttcctagaaggtcttaggaactcccaaatgggtgctggctggggttgcccggcccggtgctctcaaggagagctgaagctagttattgggtgcagatgctggctctgacccctgccccttcctcccgggctcagcttccccatctgtcatggagtaataacaacccagccttctggtccactgaggaatgtgtgtgcctgtgtgtttgacgctctcagaacaggcctgcagcgctgtgagccttggaagggggcctcacagctgctgccgccaccttggaggcccaggatgggactgagaaggggaagggagaggtcagagccacagctgttgggcagggacctgctgtaggaagagaaggccagggaggcgctggtggtggcctcaggctatgcaggtgatgcccattgtttccagggccatcccagtttggaggttcctgtttctagaggaggttcccttgtgaccccctcatttccacacccgagcaatgctgagggctgtggggcccccaggggcttgagtgtggtttatggcacagcagggactgatcacagtggcaccgggtgtcagtggccagtggtcagtggccaggaaccctcaggaccctcctccttgtgtgggtggcatttacccacccacaggtcacgctcaggacccgcatctcattccgatcctccttgtgtgggtggtacttacccacccacaggtcacgctcaggaccccacatctcattctgaaggccgggcacaggcggttgttttctctccaacttcggtttccccatccccactcttagggcacaaatgcaggtgtagcttccccatgcccactctttaggcacaaatgcaggtgtagcttccccatccccactcttagggcacaaatgcaggtgcagcttccccatccccactcttagggcacaaatgcaggtgcagcttccccatccccactctttaggcacaaatgcaggtgcagctttcccatccccactcttagggcacaaatgcaggtgcagctttcccatccccactcttagggcacaaatgcaggtgcagcttccccatccccactcttagggcacaaatgcaggtgcagcttccccatccccactcttagggcacaaatgcaggtgcagcttccccatccccactctttaggcacaaatgcaggtgcagcttccccatccccactctttaggcacaaatgcaggtgcagcttccccatccccactcttagggcacaaatgcaggtgcagcttccccatccccactctttaggcacaaatgcaggtgcagcttccccatccccactctttaggcacaaatgcaggtgcagctttcccatccccactcttagggcacaaatgcaggtgcagcttccccatccccactcttcaggcacaaatgcaggtgcagcttccccatccccactcttagggcacaaatgcaggtgcagcttccccatccccactcttagggcacaaatgcaggtgcagcttccccatccccactctttaggcacaaatgcaggtgcagcttccccatccccactcttagggcacaaatgcaggtgcagcttccccatccccactctttaggcacaaatgcaggtgcagcttccccatccccactcttagggcacaaatgcaggtgcagcttccccatccccactctttaggcacaaatgcaggtgctgtgagcgctttagaatcctctgctgcaggtgactttgcttcagcgaaccacagaatgttcacatggttttatgcatttgttatttcagggaaaatcaaggttaaagatgtcttcagaatttgtatttttgggctgggcacggtggctcacacctgtaatcccaacacttttggaggctgaggcaggcggatcacgaggtcaggagatcgagaccatcctggctaacacggtgaaactccgtctgtaccaaaaatacaaaaaaattagccggatgtggtggcgggcgcctgtagtcccagctactcgggaggctgaggcaggagaatggcgtgcacccgtgaggcagagcttgcagtgagccgagatggtgctgctgcactccagcctgggctacagagcaagactctgtctcaaaaaaaaaaaaaaaagaatttgtgtttttgaaactaaatatagcaggtcattagttacttataactggtgttttattaataaaagaagaaaaaatttaaaaacagccatgattccagctgcacggagcctggatgggaaagtgcatcctctgggctgagcacggtggctcacacctgtcatccgagcgggctgggcgcagtggctcacacctgtcatcccagcactgcgggaggccgaggcgggtggatcacctgaggtcaggagttcaagaccagcctggccaacatggtgaaacgctatctgtactaaaaagacaaatttagcagggcgtggtggtgggtgcctgtaatcccagctacttgggacgctgaggcaggagaatctcttgaacccggaggcggaggttgtagtgagctgaaattgcaccactgccccccagcctgagtgacagagcgagactttgtctcaaaaaaaaaaaaaagaaagaaagtgcatcctctggtaggccttgggccgggggcgggcatgagagagctgcgctgggatgcgctgccagggcacacttggtgggtcacacactcttgtcaactgtttgggggctggagagtagtagcactcagctcacacgggccttctgcagggagtggtgggagggcctgtgagtaagggctccggaaggcccatcattgggacctggtgccgccagtgggagcaggaggagcctgtgccttctctggcgccagtcatcccagatgccactcagggcttggctgggtttgccagctctccaggttggcactggtaacgccaagatggtcctgggagcccatctccattcagcctcgagttccctggcttcactgagggaggagccgtgataaggtggctgtgggttcgcattttggactttgttatgtcagagtctgctgtgttttgtgtttatggtggcagctggatgagggccagcgacttcaggtgttgactgtcatggtgggcccaacagtatccctgcagccacagcatcctgcctgctgccctttgcctgtcctgcagacgccaaggccctagagctttgctttgatgggatgtacccatgtgggtggacactggagggagctggaggggatagaagcggggccttcactaggggccaggacagacccttgcactgtgaaaagaggcctgggaatggaactgtccgatgttctgaaggcacacggggccccgccgtctggagcaggggcaccttgcgggctgcatggccactctgtgacgctcgttccccacagacgtggttgagcttgcattttctcccctcagcacagtctcatttgggaagaggaaagggaaacttgcacgcatgggccggtcagggcactgagaggcctttctgctctggcactgcctgccaggcgtgcacctcagggggcccgtccgctctagcaggcaaatggggcgtgttctctgtagtcagaggggctgtgagaagacaggaaagcgagcttagtgggtatcaggcaagggggtgaaattgggttgtgagatgagaaagcagcgtcattgcagggctggggggccgagactcggcagggtcgccgagagctcagtgagcgagcaatgcacaggcggctcctcgccgcaggggcctctgggggccgaggggctctgggcctgcaccccctctgtagacacctggcgagtgtccaccccttggcccagctcctttcctcagttttcctcgggcgtgctcccagtgctttgtttgcttggctgtgggtggtgacccgcccatgctgtctggttgatttaactggtgtgtcttccagctacaagaagactcaggaaactctttcacaggcaggacagaagacttcagctgccctgtccacagtgggctctgccatcagcaggaagcttggagacatgaggtgagacgcaaccctgactctgctgccctgagacctggccaggagtgaggtgaggtgttggaggtgctacaggaagcctgcctggagatcagggctcagatgcactggctcagggatgtggccatccatcatggccccgaccagtctgtgtgcagacccttgcctgggaggttcgtccatccccgttggctgcttttctgccgttgctgtgttcttcagggagggttggctgccagtgctgttgggtaacttgtggtgctcggggttggtgagggaggagtctgcaccttgaagcttcactgagtggcagcgactccagcccaggggtcagagtcaggtcagtgtgggacggcagtcctccaccatctctaggacaggggctcggcgtggtacttcctcaggctgtttcccaggtctcagaaagtgcagtcagacgccaggaggccctgaatgagccttctctcccagaggctggtgaaagcctcctggccatcagaggtccctcagcaagcagggctggggccaaggagtgagcagggggccggcgctttgtggctggcatgtttgctcttccttccctgttctaggctccctgactacagcatggtgatgaggggattgagccagaagcctgggtatgatgcttggctgggctacctcctggctgggcaccccagctgggcctcaggcacgccttctttcacaggggttgtaggagtggatgatataggttgtcaccatcaacagcatcctggccccaacttctgggtgctgctgcccaccctgccctgacccctttcccattctcagaactggtcttctggcttttggatctcagggagtgcctccctgtagctctgacccaatcctggcaaagatgggtgcaggcttcctaaaggaccggtgtgtggagcacagtgctgaccccacccagccctcccctcttcccctcttgtggcccctgcaggattcagagatacgtacatctcctgctgggctgcctgcctgcctgcctgcctgcctccctgcctgcctgccttaggttaggtgtgtcctgcctccccgcctgtggttgccaggtgggggtcgtcctgcgccagtgctttcccctgaccactaagccacaggccaggacacagacggccacacacacccagggacccaccctgccaagcagaggggatggccactgcccaggagctgtgcccacttttatttttgtttttttgaggtaatctaccttcccatccctgcaacttctatttcgagaagttttaaacctctggagaagctgcagtcatcagtatgcaatgtgtgtgtttcctctgtgcaccctcacacgcccaaggctccacactccccagcagctgtgacttgggggggtccttgtggggcaccctacaaatgcaggtcttccctaccactgctgagctttggacccaggagggaccccctgagtttcagctgaactcagcctcgcagggctgttttcttcccgaaaatgctggtctcaccacagagcatcttcaggaagtaacaggtgtttgttgtgcctaaattatgccggccatcaggaggcgtttgcccactcttagtgtccacactcccttttgagtttgttcagaccattgtggtggaaatccaaggggcacgtggagcccttggcactgattggaatagccgtgcacaagccagtcctagggttttgatctgggcatttgtttgtatggcctgtttttctctggaagcacagggacacggtcctggttctctgtctgctcctccttctctgatggggagaaaggctttcgctctctgctcagtcctggggttggcagctgacccgtgtcgtgtagcctcagggcatggctggcagtgagcagagttcctgttgcagtgacgctggcacagctgtcagtgtgcccagccacactgtgccacgtgtttgcacgtgtgccctggtacatggggccagctgggggagcggggcctcaggctgacctgggacgagccagctcgctccagttggctggccgtgttcacggtgcccgtggagggtcctgtttgctggtgtgtcttgccctgcttgctcctccatttatgtttgtagtggtggtgggaactctgacgtctggagcccctggtgtatccccatcatctccccaagcagtcacaggtggtttctgaggtctgggcccattcacctcgagttagagactgaggttgagagctcactacttcctgaaagtgaaaattgggttctgggaggtttatgtcatgagtttagggctggatgaaccccggcggacccctgctaactcttgggcggaagcccctctggacagctgcccaacgcccgtgtccatgatgggcctgtcccagggcagccccggtctgtgaggcctttggtgtgccctggggcatgggtgatggggatgggaggaagggaactggattcaggtcagagtgggggtttacagcagggtcaggtcaccgtctgactccgtggtctcagatgaggcatcggccctctcaggacctcgggcgagttgagtgtttctcagttcttcagtggctccctccatgtcagagtgggcctggctgcagtgagtggcagcagctgcccttggacacacaggtttccaggttggcgtctgtgggcacggatggagcgcagagcagaaatgctcggcgccaagggtgtcccacatcctcccacggtgcgtgtgctccctcagctgacgtgatttggggaacacgggccgctctcgttctgtggagctggccaagcccagctgtcatgctgtggcacatttcacacctttgcgctgctggatggggctggttgtgctccaggtgctgtggcttctccaaacaggtgtgccttggggcataaggcgtggacagggcgtggacccaggggcctcttgggcacagccgtgaggctgagcagttgctagtcatgatcttgcgagagcctcctgttgagtcaggacttgaggagactggagacagtgctgctgtccccggtggtgtgcggactggaggagccgtcctggagggtcttcccctgctgggcctgactgagcacgagcagggggcctcccctggggctccccgaggagggctgtgagtgggtgctggcctcccttgcttacacttcgtttcctcttctctcctgctgccaccttccagggctcatccattttcacactcctttaggtaaggctgagcctggacacacctgtggaagacttttctctgaattggggcagggtggactccggcagggcccttgggcggctgtgctagtagagggcagtgaaagtgggatcaccccttccaggacagcagtgccagccaggtggttgctgcatctcagggaacaaagcagcagcgtgggatcgacgcagaggccccccggaaccccccggcccttctgtgtcccctcctcgtgcttcccttcaggctcacagaccgcctgctgccgggtctgtgaataactggcctggcgtccaggcctgagtttactcctgaaaaggagcttttttttttttttagacggagtcttgctctgtcgcccaggttggagtgccgtggcgcgatctcggctcactgcaagctccgcctcccgggttcacgccattctcctgcctcagcctctccgagtagctgggactacaggcgcccgccgccacgcccggctaattttttgtatttttagtagagacggggtttcaccgtggtctcgatctcccgacctcgtgatccgcccgcctcggcctcccaaagtgctgggattacaagcgtgagccaccgcgcccggccttttttttcttttttttgttggagtctcgctctatcaccaggctggagcacagtggtgtgatctcggctcactgcaacctccagctccctggttcaagcggttctcctgcctcaggctcctgagtagctgggattacaggcatgagccaccacgcctggctaatttttgtatttttagtagagacggggtttcaccatgttggccagcatggtctcgatctcctgacctcgtgatccacccgccttggcctcccaaagtgctgggattacaggcgtgagccactgcgccgggccctcaaaggagccttttcacgtgggagggctgtgccgactctcaccaccttcctgttcaacatctgtcctgtttccttgttttccttcagatggagttttgtcttgtttactacccgagagcccataggtgtgcctcccaaagggccctcctgcagaccagagcaagctcctctaggccaagccggggcgccgccagcacgtgcccttctgctggaaccgggaggtctagagccaggcccagaacaatctgtgatttcttgtgtttttacttgacttggtggtttctcttttgccaaaaggtccttacttgacttctgaaggctgtttgtaccaaatacttttcaaaagcccaagcctggtctcctcacagcttcctatggcagtgctctcccccctcccagtgctatgcgctgggcaacttggggtgccccccgtgaggccaagggaggaccctggggtcgagtttcctttgggggcattgtgtggaggggcaggcagctcgctccaactgctgggagtgggggaatcccagctctgcccatccctgccaagttggggttgtgtgtggatcttggtgttaactcttgcttccttctctgcttctgccatgcttccaagcagcagctactccatccgccactcaataagtatgccagccatgaggtaatgtatgcctgctcgctgcggctccagagccgggtgtctctggtgggggttggggcagctcccgccggttacaccttgcccttcccatattcctggattaattgaggactccattcccttggcaacctctgatgactaagggccggtaaaaaccccctctaggctgacgaggaagagctggtagggggtcaggctcttcacctgcagcctccagaggagatccttgtgtcaaactgggccgtgtcctttccaagtcctgaccctggctgcctgcagtgggtggggtggggttcgaggggctcgcacacagatcctggcacttgccctggtgggctgtcactcaggacacttcacggtctcagccttcacggaaacacccagagctgtggtccttattctgtgcctgtcaggcaccaccctgattctcaggattctgtgcctgtgccgtgaggcactgccctgattctcaggagagcccagaactgtggtccctattctgtgcctgcgccgtcaggcaccgccctgattctcaggagagccctgttctccttgtggggactctggctgggtgtcgcagacgtgctggcctctagagtccccgggcctgggaggggtatctgtttgtgtgggagggactgagtgggatggagctggcctgctttctcctcttgtctccttatcactctgctgtcccagaagtgtccttggtcttccgtttgcttctctgagagatgtgcatgaagaactgcacagacttttcataacttcagtacgagagcccagggtgtccctgtaggggacagcagagaggggccgacagccccccaactgcgcagacttttcataacctcagtacgagagcccagggtgtccctgtaggggatagcagagaggggccgacagccccccaactgcacagacttttcataacctcaatacgagagcccggggtatccctgtaggggacagcagagaggggccgacagccccccaactgcgcagacttttcataacctcagtacgagagcccagggtgtccctgtaggggatagcagagaggggccgacagccccccaactgcacagacttttcataacctcagtacgagagcccggggtatccctgtaggggacagcagagaggggccgacagccccccaactgcgcagacttttcataacctcagtacgagagcccggggtgtccctgtaggggacagcagagaggggccgacagccccccaactgcacagacttttcataacctcagtacgagagcccgggatgtccctgtagggtatgacagagaggggccgacatctccccagctgcacagtcaaggggtttccagttgccttgtgtgacgtctggacctgtccctgtggttgttgggcatggccgacctcacttttgacctggggagtctccggaatgacctggctgtctcacagttttgccatgagatcttgggatgttgttagggaccctttggaggctggccctaaccctgaggcccttccgagttaggagagcagcacaaccctctcctcttgacaccgacactcttccctctctctttaaaggaactctgcgaccttcaagtcgtttgaggaccgagttgggaccataaaggtaattgtacctggactgtttgatggtcttggcaaggtgtgacctgttacagcaacttgtttattattagtcatttagttatggtagactcacatacagttgtgggaagtaatgcagagaggttccttgtgccttttacacagttctctcctgtgacgacatcttggaaaatcctgtagtgcagcctccccaccaggacattggcactgactcaggacacagaacgcctccacactgcccttcctggtccccactgcccttcctggtccccactgcccttcctggtaccttcttggccatgctgaccttcctcccgccctacccccggcaacccctagtccactctccctttgtataattgtgtcatttcaagaatgtcacgtaaatggaacgatacagtgtgcagctttttggcattcactgtcttcatttggcatcgttctctggagacctgttggggctggtgcccgtccgtgatttgctccctgtccctgctgagcagtgttcgtgttacataagcttttgtagagcattgagcatgggcctgggatctgccttgtgttgtgtgctctgtctcaggtttttctgtcttcatcttttctctcctgtagtctaaggttgtgggtgacagagagaacggcagtgacaacctcccttcctcagcggggagtggtgacaagcccctgtcggatcccgcacctttctaagcctgtggttgcttcacccgctgcagagcacacgcaacccagcctcagcatcacagccgcagctctgttcagcggagcagccagccagggcggatgagcagagccggccctgaggacagtcctgcccatccacgcggagatgtggctgccgcgtttgcatgaatttgaagaacacaggcttgtacacagatgttttacactcacgtttgtagatgaaacagatcactgtgctgtccttcctaggggtgcaggaagtggacagggcggagggtttgaaagaatattgagccaaagcccaggctccctttgggaatcatgttagcccatcagaatgttgaaggattgaagagttctaagcataaaataagtggcattttctgacttcttcctcctcctccttccctgactcacagaaggaatgcaatcacccagcaagtcctacctgttacgcaattttttatctcaaaatgccgaacgagaaaactgtccattttctgagacccccagaaaggaaactgaccctcagcagctgcctgattgttacgcgaatctagctttaacggaagcaaattcattattttttaaatgcagtggacttttcaaaaagtttaaattaggcaaagcagctttagcctcatagaatattatttctttggactcaagctgaaatacaagccttacattgccttatgctttatttctttctaatttttatatgtatatagatgagggttccttaatggttgtgagcattgtgtggaattttacacctggcctgcgtggcagcctcttccagttgaggtgttttatgtcacgcacactccatcccagtgtacaaaacctgcttctcttctcaaccgtggcagctcccgctggctcctatgccctgccctaaagggctcttgagcctctgggaatgggaggggccaagagaaggaaaaccctgtctttagcaccctttaaaagaactgtgccccccttctcagtgctgcctttgcatgggcctggcccggctcgcattcgtcagtgactccaaccctcctgcttgctgtacttgggatgaaacgaccccacaggtcaggtggagggtggggcgtgggcatcagccaggattgccgttacagtctttttctcaggagctacaaagatctcttcctgttactaaatagtcgcaccccagcagcctctctcgcacaccggggccctgcatgtcagatggcgtggtctgcagggggagctctgtgccttagtggctcttggcaggacactgagggcctgcctgtggtgtgcccggctctgccactcccgggaggggaagggctgctcagctcaaggtgtcctgttcggtagagcaagtgtcctctgacagccgtgtccccggacagttcagacacccttggggatggcactccacacacgacagagatgcaggggccagggaagcccagcgctcggtgcccttcgtccagggttaaaatcggcctgtggggtgtggtgagaaggcaggttgtgcgggtgttgaccgatgtatcttttccttaaagttattataataatgggtaatttgtcaataaagcattcctttgggggaaagtccgcctcggcttgtgtgatgtatcgttcgggaccatgataagagtggtaaatgaactggcacacggtacctgccctaatgagtccgcacccttgggagaggcaggcaggggacagtgctaaagacaaagggcaggtcctcaatgctgggacaaggggagccagctgtgaggggagaatggtatatggccaacctgtgaggtcagacccagcgtcttgggaagaggagttgaaactgagccccaggaggcggaggaggagctcaccaggctccaggttgggccgggagctccagaggcttcgccagctgcccctgcaagcactgagctgctgctgagcacacctgtagtccccgccattctggagggtgaggcagatcacctgagcccaggagttcaggaccagcctgggcagcataccgggattccatctcaactaaaaacagtaggctgggtgtggtggctcatgtctgtaagctcaggactttggaaggccaagatgggaggatcacttgagcctgggagtttgacaccagcttgagcatcgtagccaggccctgactctacaaaaaagtgaaataattagccgagtgtggtggttcacacctgtaatcccagctgctcaggaggctgaggtaggagaatcatttgaacccgggaggtggaggttgcagttagccgagatcacgccattgcactccggcctgggcgataaagcgagactctgtctcaaaaaaaaaaaaaaaaaagaaaaagaaaaaggaaaagacccttgagggggaacctccactctgcccctggtctggcgctttgcatgtatccattcctagtctttggagttcccactggaaaactagtgggagcaccagtcttcctttggaggtcagaggtagctgggctcaccccagatgtaagagcagggaaagttaggtgacctcgaattgtatggtacataagccccaatacagcagggagctggtaccaataaagggtgaaatgcactattgccgcctgcagtcaagatttacactaatttattttggaatgagttcatgtgttcttcatttattgaacagatactgtaactgccctgcgggtaagagtctgctaggttttgtggggtacaagggtgaatctgatgtggacccagtgctcaaggactttgcaacccgtttgttggggaagacagattcccctaagtcactggcttgtgtttgacgaggtgaagcgattggagagcttcgaggatggagcaagtggagtaagtggacctgaggagcgggcagcaatgcctgaaggctcagtcccctcttctcagagtgagggtaatggtatctgcctcatcatattgaaaggcttaaccttataaagcacttagcacagggcctgatgtatcagaggtaaacatcagactcttcccaactgtagccactgtcaactttcctgtcttcttttttttttttgagacagggtctcactctgtcgctcaggctggagtgcagtggtgcaatctcagctcactgcaacctccacctcctgggctcaagcgatgctcctgcctcagcctcgcgagcagatgggatttacaggggcatgccaccacgcccagctaatttttgtatttttagtagagacagggttttgccatgttggccaggctggtcttgaacgcctgacctcaggtgatccgcccaccccggcctcccaaagtgctgggattacaggtgtgagccactgtgcccgggcgtaccttcctgtcttattttctccaagcaggctggaatgttcatggatagatatatgtgtgataatatactttttacatatcatgcatcgtgctcattttagtttcaggagttctttgctcctgtgtagcctttctacacattatctttctttttttcttctttttaaataagagatggggtcttgctctgtcacccaggcaggaatgcagtggcacaatcatggctcactacagccttgacttcccacc

SEQ ID NO: 12209 - DNA, 86127 bp, Human
cggcagtctaataaaaagtctgccacctaggtttcataataaactgttcattccccatttattcattgggtgatactctggcaaagtcatgcacatggtgtggtagaacatactggggagagattgtgagaagacaaatcccgtgttttcatcaacctgttttgtaatccatgacagtcagttaactttgtttcttcatctataaaatgaagtgattggactatggttcacttgaaactgggagccattctgttctatcactataagctctatactgaatgtcttctgcgagtttgttattctgttttcgtctgtgttaatttgaaattcttttctagaggtaatgtaaacagttgggaataagaagaaaaacattcaacttttctttttcctctgcactaaagagaacatgcttgtgtaagacttatggactgaataaatgatcaaggaatcagctgaaaccattgcacagccataagaataatttttgagacttaatggaggatctctgaaattctgtgggttggaaaccgcatgcataaggctttcctttataccaggtattcttaacttggtgtccatagacagaatccaaggggttcaaaaacttccgtagaaaaaagatacaaacctcttaatttttttcacatcaagtatgaatgtaggcaaaaaccagggtagttatgctgttatgtcaccaataaaaatcagttcatcgtagtgcagttttcaccgctatctccaaataattatattcttcactattttgaagttatggtagtttattagccttggccctagctcctgttatttaatgcaaaagaagtacacctgtaactatacacacacacgtaaagctcctgctatataacaaaattgcctttagtatttttgataactgcatttaaacataatttatttcctgggtaatcctatctatttcattgtatgcattttaaaacactgcttgagaaataggcctcaccagattgccaaaggggtcttcggcacaataaaaggctaagattaccctggcatgagcatagacataaagatcattagaggaccactatgcagcttgcagcaactgacggcaggcactgtgaatctggaaaactgaaaattatggctctataattgagtggacagccgtaaggagcaatcagaaacttcagtgtaagaggaaaaaaaaagatgtttttcagaaatcccggaagctaaggatcagcagaggataggaggggcccatttcagtctcgtgctttgttactggctacaaaggcgacggaatgaccaacaacccacttcctgttgactgaaactattgcctgtctccaccctattgctccccctcaccacctcacccccatcaaaggggcataacaacacaggggaacccaaagtctacaccccttaacctacgaccttccaaaatcatgtccggagctttcgccgacaccgcagactccttagcggctaagcgtgagtgcgccggctcccttgcctcgggtcagcagcaccccggggctggggctcctgcagcagccgcaccaaaaagtttcatccacaaccttaagtttggaaactatcgtttgccaagcgaagggttcccattattcctggctggcggtccatctccttgcccgtctctcggggagtgattcggtccgggacaccaggactctgcttggaggcctgctgttgcctaaaaaccccaagcgcgggcctcttcaaggccccaggttcgagatccgaaccctccagtaatgtcctcagactcctcccccttcactgcagcccgggcaatactcgggcctagctcctgagagcggcgccgttggcttacgtagcagcacgtgattggccaccgctccctggcaggccgggattggtggaagacgggccgaccccgcccctcgcccccgcctccggcccgaggccgcacgggtgtcctcgcgctgctagtccgcgcgcagcctggcagtttgccgcttcctcgtcctccatcctgcgtccatggccaccgctgcgactgaggagcccttcccttttcacggtctcctgccgaagaaggagaccggagccgcctccttcctctgccgctacccggagtatgatgggcggggggtgctcatcgcagtcctggacacgggggtcgacccgggggctccgggcatgcaggtgaggcggcccccgagggcccgggcgcgggggcgcgggcggccggggacgcgggtggggacacagtctcggagcccggcaggccaaagccccgctctgcggccgagtccgggccggggtgggcagcaccggggtgggcagaggtcagagccaggcgcgggagggacgggcgcccgccaaggggactcaacggcgcacagtgccagggtcgctgggcgggcgagggcccggaccccaggttgggccgtggtccccccagctcaacaaaagcagcgtgcccggcgcggctgcctggggaagcctgggtccccctttggccccagggactccccttccttctcgcttcggcgctgccaggccggaccccccaggctccttccctccacgccgccttcctctgcctacccctcgtgcctcggacaccggtcccagcctgacgtttttaaagagaattttacagcttttatcattggggtggggtggagacaccagataggcaactgacatgtgagaacttaatgtttagggatcgggagatttggtttggggaagaatagtttgtctttaagcacgaaagctgggtttccagaagataacccagtcctcttccggaattgtttcctgtggtagttttgtgtattctatttttaaacggtcttctgcagcatgtttgcttagggtcattgaatcttgtggcttagtcttcgtttacataaggagaattcagttaggtttggttttggcgagcttctcagaccttatgaaaatatgcgacttttttttttttaaacctgaaaacatacgacggtttttaaaaattacttagttttttgccttaggcaactttaaaatctgtagattcaaggtatcataccagaaggtagtttttttgaaagtatgttgtctctcgttaaaagcattctgtttaaagtctttaaagtttaacttttgtacttttaaccctttactgaaatccagtaataaaatttcaccgttattcaagatccatctcccagcatccctgactaatcctactgtatgctgatctctcgttgatcagcccctggctatcttatcctcctttctacactaaacactcatcctcctccccacaatgtcccttcccttctggatcctttatcgtgctttctgattattgaggtagcattttggaagtaacgagggggagtctggccgaatctgcttagaaacccctgggaatcttgattcctggtgtgtgttcttcagcaccactctggagtacagcacaccttttgtgaatcagaagaggatcaggtactgaattccctcccggtaactggagttatatagttgtcgttgtattaataacttaaagacttagaacaatgacagctatcaactcatttggggctttattacaaagtaataatgcttttcattcagctgtggagtgtgtttactttttataggatgagtgggaggaaaacagctgggataagtggttcaccggttcttttgtcaggataataagagggtcagaaaagtttggagaagtgctgcttggtagaatttgttggtagaatttccagatctgtttctcacattattctgttactctctctaaagtaacaataattttcaccccacagcgttgctgtgaaaattgattataagaggactggctaattacatgtgacttttttaaatgctcaagaaaaatattaaactattttggcaatgatatttattcttttttgtatatataatttcaacttttattttagattcagaaggtagaagtacaggtttgttacatgggggtattgcctgatgttaaggtttggggtgtgattgatcctgtcacccaggtagtgagcgtggtacccagtaggtagtgtttcagtcttatttccaccccttccctttgggatccccagtatctgttgttcccgtctttgtgtccatgtgtactcaatatttagctcccaccataagtgaatagaagtttatgctggatctttcatcaccaactatttggagggtaaatatatgttagatatttgcatgtaataaatattcagatgataaaatattgaaataaaatgaaagcataagtcttctcttttaacaaccttgactcagatattggcctaaacatagccagttaaaagaaattgggtacggtggcttgcaaacgtgaggatttttttttcctgtacctttaacagatttattttgtagatatatgtgtacatcattaagattagaggatggatagaaagaaaaaggaaggaaagaatgaaataggaggaagatgaggctgaactggcagtttggaaagccgggtggggtctgaataaaggactataggcacaagtgaaaacgtggaagaacacagtgggttgtctcagtctttggtgacttccttgggcccaattcttttgtgacaggtctgtgggcatgatcaagtggaggatgggtggcatgagaagagtagtagttacgtaagtgatttcatatttcctcagcagatattcaggcacctaccaggtgcctaagtttgtgttaaatgatatagtcttgcaaactgtcactcttgcagagattgacaaggattattggggggatggggcagggattggggcagcattggccagtaagagctggactggtcaggtttcacagaccagatggaacttggactagaccagaatatatgtatgcaatagccaggaggtctcccttccaccagtcttgtttctctttgatccatccttcacatttctagagttagattccttaaaaaaaaaaaaaaaccttgtattataccctcatttaaaacaaagccattttggaatctcaactgcttttgtgtaaaaattaaaaaaaaaaattgaatggtatatatgaggccatttgccatccaactctggcctccttatgtagcctcagttctcatcatttcttatgtccatagccccttcatccccacctttcatcctttgcctccccttgaacatttcattcttacactcacctagatgtttcaggtctttttgccaatacatgcctttgcatgtggcgtttcatcttccgtcaggcttctaccatccgtcatctgtaaactcctgcttcatcctttaagatccagtcgggtcttgacaccattatgttttggaaaatcaactgatttaattctgcgcgccccctccccccaccacctcgtatttatgtgtgtttgccattgtgttagggcctgcagcttcagaggtgagtaaggcccaatccctcctaagagttatttaggctttttgtctctttgctgttatagcaatttgcttagatccccttaatagcacctgaaatatgtattttagtgtttctgtttagataactttttcctggttaacttaaaaatctttgaaagcatgtatcaaaattgtatgacatgtgcttgtaatgttaaatgtttttgttgaatggaaaaaatatatatgggcataatgaaggaatataatttcctcatagagggaaaaaaaaggtttgaggaggttacgagtagtttcataaaactctatttttacattcactaaaattttattacctctctttcagttagctttccctcattccccccaagttgggttttgtgtttttacatgtttttgtatgctttcatagatagtgtcctaacctcttttttttttttccctcaaagacagggtctcactctgtcacccaggctggagtacagtggcacagtggcaggatcaccactcatttcagcctcaaactcctgggtttaagcaagcctcctgcctcagccactgcagtagctgggaccataagcatgtgccaccatacccagctaattttttaatttttttgtagagacagggtctcactgtgttacccagactggcctgacctctattatttgttgtcctgttttgtcatcatctctctacttactttttctttccaaccaatagtaacctttacaaaagcaaagattgtcttatttatattaatcattatattcttagaataaaagtcactggttaatatttattaaatctttatttgcttaaaagaatattttcagtacctttcctgaaattttaagtcaactcattaactttgtgttgtttatgatagattgcaaacttcccgccatttgttctggtcctctctgcaaatgtcctaccttttgttctggtcctctctgcaaatgtttggcaaatcttccaaccttcactaactcctctaccttactggttacattgaagacatacactaacttagattcttgacattttgggaaaagctttgggcaatttctgtttcatccagccaacatagcccagtaagcatttcccagtctcccaccccaggacccaggatttaataccgaagctcttaccgatactaactgcccatgctttcagtccctctttcccatgtgaagcctcccccttctcagagatgagtgatatagttccattgttagcagttcagcttcctcctttcctttacttctcccaaaacaccatggcaaatcctcagggggtttgcctttttaaaaccctcctctgaccctacatttctgtttttgtctttttatgtctagtgaagtggttttctttatctaatattaaagtaagaaattcatggataggataattgcatgtataataatttgtaatgaaaatttgtgtgtgtaggagagagatccttgtaagtaaagcatgtggaaataggtgacaaataagccattaaatcccattaggcttttttcctttgctaatatattgataatgaggtttctaatgagagatctatctgacttgttagtgctctcttgttattcttgatctcaagtcactcaggtttgcttattgaggtgaagataggtgatttgggttcttagtgctactgtatatctttcaaatttcgtattggaatacattttaaaataggtgattttcttatatgattagtacatgacctagctagttttaattttataaagtagtatcaactttattttgtttccatttttattttggtagattttcttacatttttctcttttttaattatatttttgagacatatagcctatctcttcagaatcagtatctgatttaagttttatagttgtatcagggtttggtatgattcccacagtgattttttttaattatgactttgagttttctgagtattagaattcttatttgttactattataggacagttcccaagaagtaaacatccaacttgagaattaccatacatgaaaataacagctgtgcctgggaggcctttatgaccccttcagctatcaggccctcagttgttccatggcaacaagattgaaatgagatttggggtccaccaaccacccatttgctttgtccggtaaaggaaaaaaaaatgtgtgcttttgttttctccacatcgagaatttccctctccttcttcagggtataccttaattacagagcttggaggttattgcagaggaaatacttgtgttggggtgaggggcatgttggtcagaaagacccagagcagtggacattaagctttgtcgtaaagagtgtgaattctccaggtggaattggagtctgaagactgtgctcttccactttactgacagtttctacggtttttatgtttctgtttctttcttgaggatggagtttttttgtttttttgtttttttgtttttcgttttttgtttttttttcagtcgttgtgtctctgttttctggctgattcctgctggtaactcagtacatattcctgaatgcaacaaattccctttggaaagccagccaagaaagagcccagaaattattttcccacaaaaatgtgtaaaaatatatattgttacttgtagcaatcatgttatggctcaaatgaaaatttgtggactggcaagaaatcaaacctttgaaaatcagtcttagtgctaagtaacttgtgtcttgtaattcagtaatgaagtattcattgaatgcctgacaggcactgctaggtagtgggtatatgtatgttcgtgaataaagtagacatggctcttgccttcatggagctttctattctaatagggggaacagatgaagatcacctacttgtatcattagaaatagaattatgttctgtgaaggaaatgaggtacagtgagaaaaaataatccagtttaggatggcagctacctaaaggaggtcatcgaggaggcctttctgcaggagggactttaatagaaaactgagagaagatagaatcctgtggaacaactgaagagataaagaattctaggcagaaggaacctgtttaaaaagtcatgaggcaggaaaaagtttggcatgtttcaggaattgaaaggaggttggcgtggttagactcctgagtaacggggtggcaggggtcagatggtgcgaggctttttatgcgagtattctgagtgctccatgaatacattgatgggcttaaaggagaggactgataaaatacagcttgttttaatacaggttgagtatcgcaaattcgaaagtctccaatgaacatgtcctttgaacttcatgtccatgattttggagcatttggaattttcaggttagggtcactcagcctgtattacttttgatggggccaagagtggaaactgagggaccacttaggaggtaattcacctcatggaggcaagagatggtggtggtttggaaagttaggatagtggtagtgaaaatgcgatggatttgagctctcttctagacaaagaattaacaggatttcctgttagcttcgctgtgaggagtcaactgaagtaaagaatcagaggaggattgttaagtttccagtgtgaacagctgggcgtggggattcctgggttggcaaagcctggagaaaatcaggtggtggggggcatgttaagcttgaactttgttgcgtttgaggtgctagtgtggcatccaataatggtgccattaaatggtaccattactactaaacattttttccccctaaagctctaaacttgtccagcccacagctcaccatctttagatcttttctcaaatgttaccatctcagcaaggccttccttgaccagccaaacttatgttgaaaaccccacactgaccatctcccttccctgcttaatttttctccatagttaattttcaccatctgacatgttcttttttttccctaatacccagtgtgatagcacatctgacatgttctttattttactttgttattaactgaactgctttctcgctataagatcgtcagggatttttgcgtatggatcactgccatatccccagcacctaaaatagggtgtggtctatagtaaatgctcagtaaatatttgtttattgaatatatgaaacgacttgaaggattctgtagtgtttccacgattaaattttcttactagtatttgttcaggcttttggcttaaaacagttcagttctcttttttaagtgaatgtagattttgtatatacacacacatatatatgtggatttgcattgtttaggaataaaaacctaaaatctaccattcatattttaattttcttaattttcaggttacaactgatggaaaaccaaaaatcgttgatatcattgatacaacaggaagtggcgatgtgaatactgctacagaagtagagccaaaggatggtgagattgttggcctttcaggaagagtgcttaaggtgagaccttttgtcttctttttgaatttttttttttttactcttgcctcaaagcatctaatgtttttaccttacatttggtggtggtattagttatccattgccacatatcagattacctcagaacatcctggtttaaaatgacaaatatttattacctcggagtttctgtgagtcaggaatctgggtgtggcttaacggggttccagtcgccctggaggttgcaaatggttagccatggctgtgacttcagctgaaggctcagcttgggagaagaaggggaagtttgtttccaagcctactggtgggtcactggcaggccttggctccttgccattgggcctctccgcagtgctgcagtacctggcagcaccttccctgggggagtgagccgagagagtccccacgatgaaagccacaggctttttataaaagtgaccttctaagggaccacctatcacttgactatattgagctcattggaagtgagttaataaatctagcacacacttaaggggaagggatttcacaagaaatgaatcattggagctgtcttagaagaagccattattttgttgtttgatgaggtaattagaattgggcggtatttttcagtgagcttgccaaattttatgttttgaatacaaagatagagaaagtaaccacatcatagctttgccttcatgttttactgtcccttcatagtattcccagttaacttgaccatgaagaaatacttaggctatagtagctgttaacttaaatggccagctttgtcttttttttttttttaaacttctttttttcttttttttttcgagacatagagtcttgctccgttgctcaggctagagtgcagtggtgcaatcttggctcactgcaacctccgcctcccgggttctagcaattctcctgcctcagcctcccaattagctgggattacaggtgcccgccaccacgtccagctaatttttgtatgattagtagagacagggtttcaccattttggctaggctggtctcgaactcttgaccttgtgatccgcctgtctcagcctcccaaagtgctgggattataggcgtgagccagggcactcggcctaccagctttgtcttattctatgtccttggtagaaaggcctgggtaagctaaacgtaaaaaataattataaagcaagcacagaggagctcatgagctaaggagcatgaaggatggatggcaagaatttgtgatcctgtactcttaagcagcattagtttggaacataaaattatggttatttagttagcttttcccaccttttgccatctatctgaattgttcttaggccttgtcttttaagtaagcttgttgtggcagcatattggctttctgtgccgtgtaataaagcaccacagacttagccgcctaaaaccttgtgtattcctgtatttattatatcactgattccatggggtaggagtccaggcatggctttttgtgggtctctgctcagggtctcacaagactgcagtcaagattaaaggctcagctgaggctcaggcttcttttccaagtttacatgattgttggaaaaattcatttcattgcagctgtaaaactcatgatagcttgcttcttcaaggccagtaagagaatctctgaccttggtgatgaccccagtctttcttttaaagaactcacctgattagttcaggcccgctgagaatcatgtcacttttgatttgctcagagtccttaattgcgtctgcaaaatccctacaccttctttacgtaccataacgcaatcatgggagtgacatctcattatattcacgggtcctgccttcacttaggggagggacgtgggtcttcttagaaatctgcctgtcatgggcagatagcagccattaataatccaggttctacttccttttctgtgtgttaggaactgattatctgtgtccccaccccctgccaaaattcatacattgaagccctatccctctttgtgttggtatttgaaagttgggcctttgggaggtatttagggttagatgaggttatgagtatgtgtcccctcaggataggattagtacccttataagaagagacatcagagagctctctctagagcaagctctttctagggcatatgaggacacagcaagaaggtggcctctgtaagccaggaagagggctttcacctatgctcaaccatgctggcaccctgatgctgagcttccagcccctagaactatgaaaaaataagtttcaattgtcagagtcatccagtttacggtgcgggttgagaatcccttatctgaaacgctggggaccagaagtgttttaggtttcagattttggaatatttgcattgaatataccagttgagcctccctaatccaaaatccgaaatgctccaaaatccagaactttctgagtgccaacatgacactcaaaggaaatggtcaatggagcatttcagattttcgggttagaaatgctcagccttctgaattactctagagtttggcctgtcttcccccaagtcaaccttgttattagaatatgtttcaaagggaaacttgggattcctgtgagctatggtactctgagaagctagagagaattcctagtaagtcttgcaggcttagagccatataaagtattactcgagcatttatttatttatattaattttgagatggagtcttactctgtcgcccaggttgaagtacaatggcacaatctcggctcacctcgacctctgcttcctgtattcaagtgattcttctgcctcagcctcccgagtagctgggattacaggcatgcgccatgacacttggctaatttttttgtgtgtttttagtagagatggaattttgccatgttggccaggctggtctcaaactcctgacctcaagtgatccacccacctcgacctcccaaagtgctggtattataggcatgagccaccatgcctggcctcatttatttttaaatagctgcagtaatcccggctttagataaaccacatgaactaataatatcactagtgttcaaaggtagaattatatgtgtaccatatgtattgctattaaataaagtcaaaaaaattataaggtttgtcttttctcagcttggtgacgtatttctttagctctaacattaagtattctcagcccctcattgtgggtttttaaacttaatttttaattgtgttcagtatgtcttaatagtttaaaaagacaaatatttttacaaggcttctaacaaaaagagttaaatcctgtcccacttctcccctactgttttctactttaacagtacattaatacattaaattatcttcagtttaaaataacatgctaatattttttatttcttgatttttttttctagtcttaatctttacttgtagaattaatatgtggaagaagagagtttaattctcaggtcctttatttccaagaattttttttgcattttctcttaggtaacttcctctccgttgttttgctgtttttttctggaactcctgttaattgaacattggacctcttgacttgatcctccaatttttaaatttttttccaccttttcttcattgccttaatctttttccttcctgagagatttccagcattttctcaacattgtaacccttgtgtgaattttttaaaattttgcctatttttaattgcaaaagccccttcatgttcactgggagcatatttttgtatcatgtatgcaacattttatctctgagataaaattttaatttttttctatttcattgtttcttccctccccttcctcctgttctcctttcttagtctcctattctgcttcctcctctcctttctccctttttcttcaccctctccttcctctttctctgcctcctcttccttgttctctgctttttatgttagatattttgtttaggtgtctaatcatccctagctgtcttattttagcaaggcacaagaaaaggtgattggaagctcctctgcttatgtagggtcttttggtgggtttcactatagggtaatgataacatttaggggaacccccataatatcagtatacactatatttttttccctcaggatgcccagttaccttaaagaagtccttagcccatttggcctggggtttaggggaggagtgagcaagaagtctggccgtaggtattcaggtaaccacaccatgcaaggggcctggagtgatgtcatgcagactcatttttatgtctcatcctttttgtattagttccttttcacattgctatgaagaactacatgagactggggaatttatgaagaaaagaggtttaatcgactcacagtcctacaggcttaacaggaagcatgacttgggagtcccaggaaacttacaatcatggtggaaggtgaaggggaaacaagacatgtcttctcatcatgatagagcaggaaagagagccagcaaagggagaagtgccatgctttttttttttttttttttttttgagacggagttttggtcttgttgcccagactggagtgcaatggcgcgatctcaactcactgcaacatctgccacccgggttcaagcgattctcctgcctcagcctcctgagtagctgggattacaggtgtctgccaccacacccggctaattttgtatttttagtagagacagggtttcaccatgttggccaagctggtctcagactcctgacctcaggtgatctacctgcctcagcctcccaaagtgctgggattacaagcgcgagccaccgtgcccagcccccatgcatttttaaaccattagatcttgtaataattcatcatcacaagaacaacaagggggaaatccacccccatgatccagtcacctcccaccacatccctcccctgacacgaaggggttatatttcgacatgcgatttgggtagagacagagccaaaccatatcacctgttctttgctttgttgacatgtcagcttttctctggttcagcttggttggtgaagtttgggcaggatgtgggatggggcaatgggagtgctcttatacaaattttccgccagtcttcttagtcagaactctcttctccatccatccataacatgtactcacacacatgttcagtttaatttttttcagggatgtgcaggtgtttagatattttgcagtagtcaataaaaggaagaattattaatcactgggattctgactagttgcatctctgcaactctttagtacatagttttcagaaagcagcacaatgaagtcttcaagtttctttgatgtagtcgtgcatttatttatttatttatttattcatttatttatttatgacagagtcttgctctgtcgtccaggctggagtgcagtggtgtgatcttggctcactgcaacctccgtctcctgggttccagcaattttcctgcctcagcctcccaagtcgctgggattataggcacccgccaccatgcccggctaattttttgtatttttagtagagactgggtttcaccatgctggctaggcaggtctcgaactcctgacatcaggtgatccacccacttcggcctcccagagtgctgggattacaaatgtcagccaccgcgcccagctgtcatgctttgaaatgaattaaatgtttatagtctgttttttccacatagcccataaactgctaacagacttttatttttctgtcagtttaagatcaactgttaagttaggtgctttgaacactttagtagcctcattctctaaggatgatattcctaggcttccttgagaaaccagtggtaagctacttatgacctatggtactcccatgagcagataaaagtacaaaagtgaatagaactttaaaaccttttattgcaaaatatacatacataaaatacataaaacacatatatacagttttatgaatagtatagctaacaccattgtacccacccagatcaagataaagagtattgccgtacatcagaaacttcctgcatcctcctatatcacagcctatttcaacttttgtgataatcattcctttgcttttttgtgtgtagttttaccatatctgtgtggctacataaaatatattgtttagttttgaactttacataaacagtctcatttcattcataaaatttcatcatacgtcatttttcccttggtgttgtgagatttcagattcctgagacttgcccatgttgtcacgggcagcaatgatttattaagtttcattgctgtgcaatatgccatggtttgtacctactacattctatccattctgctgtgatgtgtgtgtatcctgtgcacatgtgtgtggatgtctccagaatgtgtgcataggagtagaattgctgaatcatggagatatgtcactaggtcatgccaaacagtttttccaagtgcgtgtttgtttgttttttaactggacaggacatcttcttgaccaagtgtctgtattaaaggacatttccaggccgggcacggtggctcacacctgtaatcccagcactttgggaggccaagcactttggatcatctgaggtcgggagttcaagaccagcctgaccaacatgtcgaaaccccctctctactaaaaatacaaaaattagctgggcatggtggtgcacacctgaatcccagctactagggaggctgagacaggagaacacagaggttgcagtgagccaatatggcgccactgcacagcagcctgagtgacagagcgagactccttctcaaaaaaataaaaaaaagacatttccactagcagtgtataacaaatgttttctgaccccatgatcatagagatattctcctatatttctaagaagtgtcacagcttttctcttctgtttgttctagaattcacctggaagtgattttatatgcttagtttgaagagttctgtttccttttttctgtaaaaagacccagttgtcccaacaccatgtgttccacaattttcactctaatttttaatgccttcttttcacttggcacccttcaaaatgtggtgagcttctgaagtctctttcgtattctctttgtcccttcgtttttggatgcttccccgacttcctttattctaattttagtagcattttggaaggaagcacagtacctttttcattttaccacatttaactggaagtcattttaaaaatcaacacttagtcttaaatatttttggtttttaaaaaaaataaaataaagataaatccaggcataatgaatgacttggccagattcagcatggtacttagatgcagtgacagccaaaggaaactgtgcgtgtgccctggcctgtgtgatgaggctggcaagactgaaatcatttggaagcaaaagcctctaagagggcttcactgcatggtaccctaacactcagatgacacttagcccgttaagaaaaatgtttgatttgttaggcatcctctctttaagagagtcagagaaatgaggtgtaattggtaattaaaaagattacgtgtatcatatgacaatcagtcttaatacattgtagttactgtgttattagaaccatttttaagataccaacctaaaatggtcaaatgtaaagattttattcttagaaaaaataactttgtttatgtagaatactcaaatatgcaaaataaaatttcataattgcctcataaagttagctttactctaacttggctaaagttagatcagatagcccagattataacttttatctgatttttttggtgtaatttttgtaactagtctgccttcgtggtaaggaagatacatagttgtgatttgagaagtatctggttccatggaccgtgcagactttgatctcatttataattaaattatgtctattggattgtttttattgtactttatgtttttttaagaaattgtgattaaatataacttaacgactttctattttgcagttattttaattagttacttcatttaatcttttggcatttcatgattttctgtaatgtctgtacaaagaagttgctgctagccacctgtgtagtgggacagtagtgaataaatacttggaatttaaaagctagtgactacttccctttttgttgttgcagtgctttattgttttgccgtgggctgttgcaaaaacattaaagttcagaattcctattctttaaagaaggttcagttttgagtgaaaagtgctagcttgtatgccagcgtgtttgaaattacacattctgcagacatccagttgatttggaagtgattaatggcacagaggccttcaaaaggtcactatttagtattagctccttgaagctctgtgaatgattgttttcctctatttagttgtgaggaaatttcatccaaaagttttctgcctgggaagtaattggatgaaggacatggggatgagttaaaggtattgcacaagtgaggattgatgaggctaccagctctgagtgtttcaaccttgtcatttatacatatttaaaagctggttttgatgaccacggttccatgattgcaaagaatatgaataccctacattttcttgattgatcattcatgttggttgatgctcagttcacttttttgttcacaagaataaggtagagattttcttccttttacagatgaagtagaagcctgtgggttccttctagttagtgatagagtttggattcagagccagatttatctgactttaaatcccatatcctttatacagaatttttggtttccatgatagaactaggttccagttttcaactttcctcttgttcaggcaagtaatttgatttctctgctgctttgctttctctgtttgtaaactaggcgtactgtttgcatcgctctactaaaagtttaaagtgttttaaaacactttgagatcgtttaaaagattattacaagattttagcagtttattgagatagtgtatgttgaaagcactttttaaaccatgaagcattgtataaatgaaggtattattctagttgaattatttatggatgagaaaaaagaagtgataaagacattaagtaactacttagagtattaaacacgttgttgtacatgagcatccttatccaatttaagcttattagagtagaagtaatatacttttttgctcagtagtgtatcattggaattggaaagcatttagtgaatgaacaggttactctttttttttctgtagattcctgcaagctggacaaatccctcaggcaaatatcatattggcataaaaaatggctatgacttctatcctaaggcactcaaggaaaggatacaggtaatgtacaatctggtaccaatgagttgtattcttctgacttgtcttcttcctcagattttattcctactgaagaaaaagaaatatttcataaaatctcattaacttagttttttgggtggttggtggctttcaaacaatgactgcttaaagattctgctcaatggaatgtcatccgtgtaaacttgtgattcttgatcttgggtacatggataagtttagggaatctgtgaatacactgaaattatattcaggtttttgtgtttttctgggagatgggatatagctttcactggatttttgaaggacttttttttacttgaaaaaggctaaagacagtggattcaaaatccagaccaccttttcgtttctgttcctgtagtttctgtgataatgtccctcccctgtttaactagccttcttgctcccagttagtcatcatttagtattaaggtaagtgttaattcagtcctaaaactgctgaagtgtaagaagtaccagtgtgccattagaaaaataagagtggtaagcagaatgataaagagcctgctttaaaacagttcaatagaactttctgtgataatggaaatgtttgaaatgttcagtttctgctctaaccattatggtagtcactagccatgttgctattgagaatttgaaatatgtttagtgtgactgacgaattgaaattttatcttagtaatattttaaaatttaagtttaaatagtgtcatgtggctagtgactaccgttttaagaatgctgatacaagtagctgatacaagtacctaatacaagtccagggttgcagctgtaaaataaggtataatcctgggaagtgagcttgatggataagatgtgtggggccttgcctctgtcgtgttatttccccaagggcctgtgaagcataagaagttactcagattaccttatttgtcagtttctaatcattctgcaaaacaaacaagaataatgcgtataacttctattacataatatgttattttaaaatttcaggctggaatgcagtggcatgatcacagctaattactgcctcaacctcctgggcaatcctcccatgtagttgggactacaggcacgcaccaccacacccatctaatttttgtattttttgtagggatggggtttcaccatgttgcccaggctggtctcgaactcctgggctcaagtgatccgcctgcctcattctcccaaagtgctgggactacaggtgtgaaccattgcatgactgcattttatatagtatattaaatgtaatcagctgtgttgataagatgtgatttaatatgcaaatatagtgttgttgaagtggactgttcctttagctgcgttgggagttaccgtgagttaaagacactgaagataaaggttaaaaccaatttcagtgacatagaaccctatcaagtcaaagaggatggaaaaaaaaatagggaggacattgaggatgcctgcattgtctgtcaaaatgcagctgtagtcttactctagtcctctgcgtacactaggcttatggcatttcccaattttgtatgggcccagaatacaacattttcttccttttaatgactgggaattcagtcagtattcttggagaagagaaggttttaaattggggaatatgatacataaaaatacatctggatgtgtcttggtaaacttctcttaaaccctgggtgcaatgaattgactaaccagtttttagtaagtgatccatggctttatctgcttcattagaaactttttttttttttctctttgagacagagtcttactctgttgcccaggctggagtgcagtggctcaatctctgctcactgcagcctcagcctcctgggttcaagcgattctcgtgccttagcctcccaagtagctgggattacaggcacctgccaccccacctggctaatttttgtatttttagtagagacggggtttcaccttgttggccaggctggtctcgaactcctcacctcaggtgatccgcctacctcagccttccaaattgttaggattacaggcgtgagccaccacacccggccaaaaatgattttttaaaacctctctatgagaattgtgtagtatcacaactgtaccaacaaagtccacatataaatgcctgtctaggtttacctgagtatttgtcagcctaattgtaaggtaatttttctgtctttgcagaaagaacggaaggaaaaaatctgggaccctgttcacagagtggcccttgcagaagcctgtagaaaacaggaagaatttgatgttgccaacaacggctcttctcaagttggtgctagtcgatttcatttaaacattaccctagaaccatattcccatagagtttctacagaactaatagactgtttttccacaagttttcttttttcacaaattttcttttaagttggttaattttactaatttttcctttattatttatcctcaagtcaatgtacatatgtatgaatttttaaaatttaacacataatacacgtagggtaaaagtacataaattgtgtttggttatgaattctcccatgaaagctgcacctaggaatttctcttgtgccccttccttgtcactgctccctttttccttccgaaagacaaccaccaccttgacttctaacactgcagatgattttgcctattttgatttgtgtaaaatggaaccatatagtatggttttgttttttgttttttgttttttttttttgagacggagtctcgctctgttccaggctggagtgcagtggtgtgatctcggctcattgcaacctctgccttccgggttcaagctattctcgcctcagcctcctgagtagctgggattacaggcacgtgccaccacacccgactagttttttttttttgcatttttagtagagacagggtttcaccgtgttggccaggctggtcttgaactcccaaccttgtgatacgcccaccttggcctcccaaagtgctgggattacaggcatgagccaccgtgcccggcctatgtattctctaattatatgtattattgtcacttttaaaaagggtttcaaaatacttcatttttcagttaatatattagacctcaaggtccttgtttcaaaacatgggagggtgtagtccttggttcccatatactgatttgtggaattgatactgatgaactgattatctctaagtcacctgaattattttaaaagtaattaagttttccgggctttatcccctgataattctgatttactaagtgggattagaaacagcatcgatgtttgtgatagcctttacatgattgtgatttgcgtgaaatttagtaattattggccaagataataatttgctatcctactagtttctgatgtgacagcctcagattatcataaggacaaataacttgctcaggattgcacagctaagttgctgaattgagatttgaatccatatttcttccctctaggttaatactcacaccacactatttatagaaggcagattgattttaagcaatattaagtgcttttgatcaaagacgactacctttttcaataaattgccaaatagtaaatatttttagtactctcttatgactgctcaacactccccttgtatcatgaaaacctaggcaatatgtaactgaaccaggaaggccatgttccagtaaagcttcatttacacaactttgtcacaggctagatttggcccatgcaccatgatttgtcaacccctgctggatcttaatatagtaacatagtctagagatattcgtctcaatttcagtatttatatgcctttctatctcccagcttatttctgtttaaaccagtcattttcctaattatttgagtacctaacttatttttttatatacactctaggttagagaaatgttttggagaggtaacacctgctagtgccagttgttgtctagtgtgtacgtaatcgaatttaaagcacttggttttattcatgaccacagagctaaaataaggcttcacttacccccattaaatgcttctatttaacatagcagtttctaaaagatataagatgattcatgggttttattatttatttggattcttaagaaataaatttgagatagaataggtcctgatataaaaatctaaaagtcaatagataacctattttgtagcagttttagagttgcttttggaaataagttagataacaaatatgtaacaagcatatcttggctaaatggaatcaccaacgtgtagcacagtgtatttcccaaagcaggcctagtgagtgaataaatgagattgagtaaaataactgttttttagatctttattaattagatctgtattaatgggtatctgcttcattgaattgaatgacaagttgcatagatagaacaaaattttcttacattttttcagggtaaaataattttactatggattaacattgtatctttggctgtatgttaatacaacttttagaaggacagaatgtactaatgttaatcagttttccaactgactaggcaaataaactaatcaaggaggaacttcaaagtcaagtggaattgctaaattcttttgagaagaaatacagcgatcctggccctgtatatgactgcttggtatggcatgatggcgaagtctggaggtaaacttcatgtattttatacatcttcatttacaaatgttttcttttctactctgaaaaacattaaatgctcagagctgcacagaattttggtttattcgtgatatcactcagcaaaatcatttaagggccaaattggcatctgggtagttttggacaagccccttgaacttctagttataattattgacactaaacctgacttttatctgatttaaataaacttacttcattaataatttattagtatgttgaccatccgtatatttggaaatgtttcctcatttgttaattgagatagtggtgcttacagggctttgtgaaaattaaatttgatgtttctagatatagtaagcaatcaatgtacgctgttgctgctgctgtttctattactaaaactaataataataatgcgatttataccaagttacccatcatgtacgttttttagtttcttttttagtgccttatatactgcatatgtgcttcttggagttgattagtctgccttcttgagttactatctgcatgaaaacaggaagacattgttaatacagatatttagccatatgtgtgctttaggatttctgcaaaaaaaaaacaaacaaacagggactatttcttaaacttgtagtcaagaattacttgtagtctgcgtccctgcttatacacaaagaattgcatcacaaggtggggcacacacagatcatgccatgactgcttcctcactgctctcacaattgttcaccttcacagtgcacccttcttaaaggagggttctcctcccacgtgtgcaggtactaactcatctttcatcaaaggtgtatgcaatgttaagttgaatgagaaatttctgctcaatttggggatgatggtgttaataaaataactgcacataactctttcaatctagatattaaatattaatgcacttttgtgtgtattcatacatgttgttttgttgtgtgcatatgcatacacgttttgaaaaattattttccagaggctttatacagaataataaaccttgatacatccaccatctggggtaacatgatacagtcacactcagtgataagccttaggtgcgttttagtgtgggaaaggaggcaaggttaaattcaaggaaaatgctaaatacgaaacagagtatatttaggaaagtatatactacaaaagaacttaaagaaatactaaaatattagcagggattgagtagtgaggcaataggtggtttcatttaaagtgtttgctctaggttctgaaaacactgcagattactttgtcttaggaaaaggaatccggagtcaggatgtccagggtaccagtgtgtgtttccacaagatttccttggtcttcaaggtgcttgataaagtgactcacttgtagcagtttgttgacaactattctaagggttttgtttagaacttttgagttagaaatgaaatttaatctaacattaagtgaaataaaatctgaaatctcagaataacattttagaacattttattataataaatgaatatagcataattatactttcaggtggtactagatataatgtaacttttttgcataatacagtatatcctatagggctttgatctcagagatccaaaattttttgaagagaaccttgtagatcccagggtacataaggttaatccagtcctgtctgcagatgttctcatttcacatttcaaaaatgccaaccatttctgaagggaggtaaagtgacctattctttaagtaccgtgggttttttgttttgttttgtttgatgacgaatgtccagtctgtgctctccctgccacatttctgctaattgtttagcgcgtatctctgcacttaacgggtggcctcagatgactctgttctgagcatctgtcaggacgcagagcctcagactcattgtcactccaaatggaacaaaaactggttgagagaaacagtgtttacagaggattacataaaggagaagctattagttgatttctttacagtggattttgaccttgcttatgtcatgtttccttttagattcttgatgaaagctctagattctttccatagaaaattgagagatgtgtgaaaatgtcgagaaatacataaaacaaaagccttttctctcatcctccccacttacatgtaccctgctctgtgtatgagcctcattttgatatcctttctctgtattctagctgctacttgaattcagtcaactagaccttcagaaagttataaccttgcaccacattcatacttgtcttctgtcgtgttatttagagaagtcagtaataatttatgttttgatgtgttggttgtattgttgagtcattccaatgatggtggttataagaaactgacctgtggaatgtgtcactgtatttgctgtgagaatgttgttaaggatgatgatttcgttaattccttaatcatgtggcagatgtttattgagtaccttctttgtaccaggttgacaccatagaagctactccatggactctagattccatggaagcaagtgttgggaacgtctgaaccagtctaggaagaatcgagaaagatttcccaaaagtattaataacatcttacattgagacttgaaggatcatcacagtaaactaagcagagaggtagaaggggtgggggaaagatccagaggatgttggaggaactgtgagaagtttggtgtggccacagaggatatgatgggagcaggaggtgagggaggtgagcagatgattattaggggcattgctctggagtttcaatgttaagagccgttggaagacatggaaggttttcagcaggagtcaaatgtaggggcagagcaggccatcagctcatcaggcaacagcggtaaggaagagacagtggaaataggcggacacattatggagatgggactgtgcggttagatgggctgggggaagaacagagggaggactttgtagatgacttccaggatggatgctggccgattgcataaattttggagacaagtgctacttctgtagcatgtggaagatttggtgacatgcattttacccactaatctcaagcctgattctgtttaatatgtgacttgtttgctctttgcttcattttctccataagtgtttagtttcctataccttcgtatattctattatttgaaattacatcagtcatattagggcaatgcataaaaacaaatttttaagaatccttttttccaaagtgttgtaatttgttaatgaaatatgcttcagtatttatgataaatcatctctctgtgctctaccagtaggcttctattaatttacttggcaattttgactgacttgcatagcttgttaaaatacagttcttgcatttaaaacatacttagagctaaaaacataatattgaacttttaatgatgttcatttcatttatgactttttgaatattaagtgtattttgttttaatcaggctatcttctaaagtgttcggaatataatttaaaaactattttagttagtaaaatggaaaaaacatgaaggaagacaaccataaagtaatgtagaaaatgccttctgtgagaaataaatttaagtctgttataactataggactgaagctcagtaaaattcacctagtttcaaagagcttgtgtaagccgttagattcttgaagccattactaaaagaagcagctggaagttagacctaggccatgtgtctgaactatcctaaactgctctaaaactctaagccaagttttagctgtaattcttaagagtccaggtggtttttaacctagagttttgtgaaggagggtatttttaaagcactttgtgcatgatttaagaactggttgctgtaagctatcttacctaatccttactgcccactctaagaaacaggctaaaccaggcagtcattatatttatatttgttgtggtagaggtagtagtatagtaaaatagtggagagactatgttacatgatttttagaaaggtaagaaaataaattttactgtctccatttctttttaattaatagagcctgcattgattctaatgaagatggggacttgagtaaatctaccgtgttgagaaactacaaagaagcccaagaatatggctcttttggcacagctgagatgttgaattactccgttaatatatacgatgatggaaacctgctctccattgtgaccagcggaggtatcccatttcagattgaccaatgagatatagatttatgaggtgataaagtggtacgttgcgatagctcacagcaaccttctagagaattttaagctagagatcgtagctaaaggactaggtccagaatcataaaggtgatttgatttacctgcaagatgttgttttttaaggtcataaccatgtgggatccagtccaagaatataaaagcatgttccaacatcagaaaatccatcaataggctgggtgcagtggctcatgcctgtgatcctagcaccttgggaggccgaggtgtgtggatcacctgaggctgggagtttgagaccagcctgaccaacatggagaaaccccatctctactaaaaatatagaattagctgtgcgtggtggcacatgcctgtaatcccagctactcgggaggctgaggcaggagaatcgtttgaacctaggaggcggaggttgcagtgagccgagatcgtgccattgcactccagcctgggcaacaagagcgaaactccatctcaaaaaaaatccatcaatagaatttatctcatgaacagcaattttgcctcgaaatcttaactcttgagaaattcacccatgagtacagagaatcagataaaagaatcctcactacggcactctgtgtgatttcaaaaaagttggaaactaaatacctattaacaaaaaaatatattttttaaacaactgtgtgttattcttactgtgaaatacagtcatcctttggtatctggggggattggttctggaatgtccctcagatgctcaagtacctgatacaaaatgacatagtgtttgtgtataacctacacacatgctctcccatgtgctttcagcatctctacatgacttctaataccttatagtatgtaagtgctatataaatagttgttatactgtagttttttaatatttatatttttgatccgtggttggttaaattgcatgtagttggtgcggaacctgtggatacagagggccgaatgtattatatagcaatcaaaatgctgtgtgtataaacccctaatacataaattatattgaaaaaatatgtactgatgataaaacttgtaaaattctaaaacatgccgaatagtactatgcagtgtttatagatatgtgtgtttatatcgtgaaaatgttaaatatatagatggaaagattatgcacaccagctccaggatggtggctacttctgggggaagttctccctcccagggtagggggaaaaaggagaatgaagtgggatgactttaactctttaacgtccccctcctacctcccagttcattgaggtatagcttaagtacaaaaacttcacatacatacatatacataatttgataagcttttatgtaaatatatcagtatatccaggaaaccaccacaatcaaggtaatgaacatactcattacccccaaaagtttgctctctctattatccagcctttctccacccacatcccggggaaccactgatctgttttctgtcactccagattatttcacactttccagaattttatgtaagtggaataaaaaatatggttttctttccttcactcagcataatgattttgagattcattaatgttatgattataaagctggctctttatttctgagtaatagttctttatatagctacaccacagtttgtttatccagcttcccattgatggacgtttagattgttttggtatctgtcgacatatatttttatttatttttgggctgatagctgagagaaccagttggatatggtaaacatgtacttaatttttttttttcctttttttttttttttttttttgagacagagtctcgctctgtcgcccaggctggagtacaggtggcacggtctcggctcactgcaacctctgcctcccaggttcaagttattctcctgcctcagcctcctgggtagctgggattacaggcgcgtaccaccacacctggctagtttttgtatttttagtagagacagggtttcaccatgttggtcaggctagtatcaaattcctgacctcgtgatccacccgccttggcctcccaaagtgctgagattataggtgtgagccaccacgcccggccacttaactttttttttttttttttttgagacagagtctcgctctgtcgcccaggctggagtgcagtggcgcgatctcagctcactgcaagctccgcctcccgggttcatgccattctcctgcctcagcctcccaagtagctgggactacaggcgcccactaccatgcccggctaattttttgtatttttagtagagacggggtttcaccgtgttagccaggatggtctcgatctcctgacctcgtgatccgcccgcctcggcttcccaaagtgctgggattacaggtgtgagccactgcgcccggccttttttaagaaatattcaagctgttacctaaaggggctgtacccttttcactcccaccatggtgtgtgagaattccaggtgctctgtatcctcagcaacacttgctgtggtcagtcttaatagtggtcattctaactggtgtaaggtgttttgaaggaaaaaatcacattaaacttgtgctctcccaattttatctggggaaagaaataagaaagccagaatccgcaacattgggcgaatgttttcttgcatgacagcagctggctagagcagaggagtctcagcattgctgcagaccctgtttcaaagccacatagagatgcctgcctacttctcctggagctccaacacactatagtccccaaacattaaggcccagtgccagttgtcatttatcattgtgcttgtattattgtttttctgagactagtgggatatttctctatattcatgtcttttaagaaactttttcactaaaaggctagttttttgttttagtattactttatatataacatgtacaaaaacagatacaaatcacaagttgtacaactctttgaattaccacaaagtggacacttctttgtaactacaactcaggtcaagaaatgaaacataatgaaactcccatcatgccccttcctaatcagtaatgtaccctcccacctcctacagttaactactatcctgatctccattgccacattagtttggaccatatgatgttgctgtttttgtgatcggaaatgataaaatagtggcagtttcagatggttcagcctttttttcatttatatgaaaattcaatatacatttttgtatgtgacttctttagttcagccttatttttgtgagctttatctcatagtacatagtagtagtttattgctgtataattgtcagttctatgaattgatgtacatgtaaccatttactgttaatgaatcttgtggttgtttttaagtttttgaattttataaacagtgttgccatgaacatttttgtgggtgtcttagttacatgtgcacacattttgttattgtgtgtacctagaggtaggatggctggctcataggctgtggcagtgttcagctttcactccagccagcagtgtatgatatgtacttccatccacacttgctttgtcagcctttaatattttggcaattctaaaaggtacgtagaagcatctttttgtggcttaatttgcgtttcctagatgacgaatgaaattaaacatcttttcgtgtgtttatttgccctttgggtatcttcttttataaaatgctttttcaaatgtttgaaggggggattctccctttttttattgtgaatttgaaagatttttatatattctggatataaagctctttgtcagctatacatgttgcaaatactttcctttgtgacttgagtttttgctctccatgaacagggtagcagagtaatgtgtattctttttatcatgattaataatatgcaaattgaattgaataaactttcagtccatgagaatgttttgtcatttccccacctttgtgtctctaggagctcatgggacacatgtagctagtatagctgctggacactttccagaagaacctgaacggaatggggtagctcctggtgctcaaattctttccatcaagattggtgatacaagactaagcacaatggaaacaggcacaggcctcataagagctgtgagtgtttgtgagttgttgattcagaagattaatgattaatgatcttggatatttttaggtttataagtgctcctagtttaccaagaatacattgaactatatatagtgtacaggacttttaacaaagcaaaaatatttactaatttatttttaaattatttttattaaatattattaggatttggcctaacctttgtgaaaaaattacttacttcatactcgtcatttctagcaaatctcctaacaagcaattttgagatacttaaaaagaaagacctcttagccagctttctccatcagcctaagaggaatttaaaacctcagctaacattctgtacatcattttaacgtaggaaagtatatttaattttagtgattttttaacctaggaaggaccattccattccctctacctctgtccccctctaaccccactcttttctagaaatgctagttttttgtttttttttttaatgactacttttttatgtgtctcctcctacctttttgtgtttatgtgcttatatgtccaggtatatggtgatatgcctggaggtaacttataaattagaatatgattggctaagaaactataggattatatatatgcccttattttactggctaatctgtttctgtaaattgctgcctaaactagagtcttaatctctttaatagatgatagaagttataaatcataagtgtgatcttgtcaactacagttacggagaagcaactcactggccaaattctgggtgagtgttccttgacagttgtttagccatagaaccttagccagtgaagagtatgagatgtttttcataagtggattgagtgtcacggtggaagaaagaacagttgcagtggttagatgataactgtgttcaagaggactttcatcctcttgaagtcctgtttggctcgtaggccgcacacccccgttcctgtgttcacatctgtgacgatgttaatgctgttcactgcaccatgcctgaagtctcaactctgagcatgcctgtgctgtcctttgtggctcttccttggttaggtctccctcacagttcttctgagatatgcaacccacagactctggtgttttttcactgtcagatgcactgcatcctcacttctcttcccaggcaatttagatctgacaatctgtctatcattataattactagttccacaagcactctgaagccatcctcagttgtatatacatacccgacagacgcccagacttgctgaaattttgctattctctttagtgacttgcatctcatctgcaaaacttactgttggttgcgtatgttcactaactcggtcagttttcacatctcctcaatccattctagtgtgtctaggatgcacccccactcccctccttcctcgttggcttcattgtctttctgctgccaaatccagtgtcatggccttgacctaatgttaccttcctttttttcttcatagtagtagctatttgaaattacctcgagtatttacttgttgatcatctctcccccattcccatcaccaagctatcatctggtttttgagacatcactttacggtcctcgtaacatgcaccctgttatcatgagtcatttcattcttccctcttctctcacttctttattttacttaactgtatttctttctctactttaactttcatcctcttgaagccctcttttgctaatattcttccctttctcagatactcacacttacaactttgaagggtcctgtgcatggctctgtacctttttaatgttaacttcattttcttcttcatggtataacctcatctcctctacttaatgtcagtatatttttcttgtttgctgtcaagctctaagcaggtttcttacactttaaaatcttgctcttaagttcttcctagtgccttagttaccttttccacaaaagatactggttcttttggtcaatttctactcataattgtatgtacgaatcttctgaggtgtgtcttcaggactatgttaactgggggatggaaatagaaccacctattgcccgagtcactactaatattttactaccttgtagtatattttcccatatatattgttttgcacctagcattttccccacatttaatttggccttataactgcttccctaccctaaagcccaagtagggtatatcacttagaatggctgtatcatgttccaccaagggtggatgtaccaaaatttatgtagccatatatttaaacaaggttttggtactatatacactttgggaatagaggctgattatatgttcaaaggaattctctctttttcaggagaatttgtgaagtaattaatgaagcagtatggaagcataatataatttatgtttcaagtgctggaaataatggtccatgcctgtctacagttggttgtccaggtggaactacatcaagtgtgataggttagtttcctgttttagaaatagatttgtttagaaacaagcaaacaaaaaacaatagttaatgaaatgttacctgtatctctgctacacgtaagacactgtacaccttaagtgtgtcctcaggaaacttatagtctggtaggggaaccagcacatctagaactgaccgtaatttaaagtggactgaaataagtggtttcatagaaatacacatgcatgcttttaggtgcattagcatatttagtctaaaatatcctgggataaataatcctgggagataggtattttgtatccaaaagcaaagttcttagtaaaatgtctggtacatagtagactttcgttgtttccttattaaattttattcttccatcgtattagagagaggactggtgttgagagattaggcagtttactcaagtgaacagtggatttggaatcaggatccccgtttgttttcttttcttaatgattaaatccatcccacaggtgttggtgcttatgtttctcctgatatgatggttgctgagtattcactgagagagaaattacctgcaaatcaatatacttggtcttctagaggacctaggtaggtgcaggtagaacgcggaaccattacgtatattcggttaaactttacactgttgagaagggcagagttttagataagtttgctagtttttttctgttggtttttacttttttttcagtattttcattttgattaacagtctcatctcagggacagataaataaaataaatgaaatagtttcattgttacatggagaacatcactattctgagtataaattcttattcctatatccataattcttcatttataagaatctaaagaaaaagtagggacttggatatctttatatagtagtgatggccttgttttaaatagtttttgatatttgaactttggtgaaatgaaagccctaagcttttataaagcatcacagtcatagggcccacgtacctgtggctcatgtctttgaagttataacttactttgagcaattttgggtgagatccaaaagtaaacaagttctgactgagaaatgaagtctatctcttttggttccctgaagccctctgaactacatttatctgattctgtgaactgattttctgaagaggtatattaagtcctaatttatgtaattcttcgttatatcatcagcgggtacatgcaccttctgaaaaataaagcctattttaattcatctgtttggagttaatttataaaaagaatagactttgaatttagttcagcaaataccttagtgcctacagtgggcaaggcataaacgaacagtttgtgatctgagtttcaaatgccattttagtatgatgggactccagaggtgggagcaatcacttgagcccttcatggagaagacggtattgaagttgaccttaaaggatggataggatgttgagagacagaagaaaggagttctatatgccaagaataacatgaacccaaagatgagcaggtttcagtgtaaagttttttgaggacataactagtaactgagtatgtttgaagtataagattagtggggaatattggaagataagattagaaaaattgattgtgctcaggtgagatgcaataatgttatattctttgagttacagatatcttcctcattttctctaggtggtttcctctttaaaaaataaacttatcttagtagcttattataaagtgtcattgaaaacaaccaggccgtggatatccacatggatcagaaagctttgctttgcgctgtcattgtagactgcccctgccagcccagctaaagacactcaataagagtggcttaggagaagagccaaaagtcagcaaagcttgatgtgtttttgttcagttaataaaagtgtaaaattattaaacttattctcttctaaaactgagtttggaattttaagttttatcttattgtcaatgtaaaaacaaagtattagagaatgtttaaaccagcctttgccgatactcgccatagagcatttaaagaattattttaagaaaacaccaaggagttcatgaattatgggggaagcttggattaaagtagatactgattcacaaagcagatgttctaagaattgaatttgtttcatttttcataaacatgaaataatattagaaataatttgctttaattattacattagatggtataaaatatgaaacattgattaatggtcactgaacagagcatgttctgtaatctttgaaaaacgctgcctctgcatcagcattgactgagacacacagcaactactgacttccaggcatttgcacgtgtggcatatttcttaaagacgtattaccaaatgtctgggccgggtgcagtggctcacgcctgtaatcccaccacaccacttttggaggccaaggtaggtgaatcacttgaggtcaggagttcaagaccagcctggccaacgtggtgaaatcccatctctactaaaaatataaaatttagctgggcatggtggtgggtgcatgtaatcacagctacataaacaggtcgtgaaattttattatatattgtaattgagaagaaaaatattaactggctttttttgaattttaaggaaacatttctgtttcatgagacttttttttttttctttcctgaaacagagtcttgctctgtcacccaggctggagtgcagtggcatgatctcggctcactacaacctccacctctcaggttcaaccaattctgcctcagcctcccaagtagctggaattacaggcgctcaccaccacaccgggttaatttttgtatttttagtagagatggggtttcaccatgttggccaggctggtcttgaactcctgacctcgtgatctgcccgcctcggcctccgaaagtgctggaattacaggtgtgagccactgagcccagctgagactcatttttagaatactgatttaaacatctagaaatgctttatcatttaccactttaacaagctagtggaaaattaataaagagcaataagtagtcagaattcatgactctttccagttattttttccaatgctatcaaataccaatgctcattctgaacaccattaggcaatacagtgcaaacaagaaggtagaaaatcaccctaaaccttgttatctgtgatatgtgcaggtgacatattgatgaacatccttttagtcattcttccatgaattagtgggagatgacactgttcaggcacttttgtagcctacttgttattcagtattacattgtgagcatctttacaggtcaacagatatttacctagtagtaattgttctaagatggttcctaaaagaggtgctgtcagcccatttcaagaggaatatatatgtattgctttcagttctctataaaaaatgtaaagccaaattgctctagtgtttctacccaagagtaaaaatagttcactcagttgggagatggtataaggagagtctggcagcctctgtggggaatgtatggccacttagccagggaggcggaagtgtgctattctgtgccattccttctttacttggggcagaggacagagctttgttggatgataatgtggttatgaattctgagggttttaattcatcagactttgcttgtttgaagccctcagctggacagtcctgttagacttcagctgtccagtatggcagcagtcagggacgtgaggttagtctgcgttaagatgtgctgtaagtatagaatgtacaccaaatttcaaagacttggtacaaaaaaaacaatgtaaactaattcatttttctttgtatctattaattacatgttgaaatgctaatatttttgctatgtctagttaaacatactaaaattaattgcattaatgtcttgttagctttttttaagtgtggcttatagaaaatgttaatttatatggcccacattatatttctattgtacagtgctatattagaccttaaacagaaggaaagtttcttattacagataagagagatgtacactcatcaaagagtcagaacagtgacatttattttctctctctaaatatacctgacactgtggcctgtcacacatgcccagatatgtatatacacacagacatttctgtacacttacaaggaaaaaataaatgctgcctatgggaaaatggctctgctgggtgttttcccccattgattcttcatagtagtatctgtgtcactatttgtaatgagtgcagttagtacatagtgttatactattggatttaaccagtggtcgtcttaaaaatgcccatgtatgtttagctttcaccatcctaagcaaacttcaatggctttccatttagtgctgacggggcccttggtgtgagtatcagtgcgccaggaggagccattgcttctgttcctaactggacactgagagggacgcagctgatgaatggaacatctatgtcttcccccaatgcatgtggaggcattgccctgatcctttcaggtaagcgtgttctttattgtccttacattattgcagaccaatatttttgttttctgaagctctcatggtaagaacatgtggtagaattgataattccctgggcacaaagtagagtttaaggtaacgaataacttatgtgataatgataatttgaatgtgtgtttattcagcagtatatttgttggctgtccgctgttaacgactgtcaagcagtattttagctctggggctaaattagtgaacaaagcatcaaaaatagctgcctatgtggaggttacatcattatatatattatagttgggataaacagactctgaacaaaataaaaaactgtagatgttgcatgttagaggttaatggatgccgtgagcaaaatgaggtagaaagagaaggagggatttctagagtggtgcacaggattaaatagagtggcactgggcttagccaggactcagatttagggtagccaggctgctgtgaagctccctcctcagaaacgtccctctttaagttgtctctcctctgcctcctttcttccccgcttttctcacccacaccacagtttcttctgctcaccacatctcctcagcatggcctgtccacactggtgctatcagcataagcctgtgatgatgtaccacttcaagtgctacatccttctctaggttgagcccacactcttaggatggatcctaacatgaccctctttctagttctcttcagcctcaccaggtatttcaaggcctcttggcctccatctttgggtgtactgcactctgcctcgaagtcctgtctgccatgttgtggccttgcagactcctgtacattctctaagaggcggcttatctgtcagttcctctgatgtctgacaatatcatcaatgtttatgtgtttaatgagctctggagaggacaagaatgatacagcactcatcttatgaattggtggcctccatattcttcccataaaacagtaattcccaacctggctgtaccctagaatcatctgagagttgtttaataaataacaatctctgggacagtcctcagagattctgatttaattggtctgtcatgagacctcagcatcttttttgcttgagttcccctggggtttataacatacagttgggttgaacaccacagccaacagccatcttgtttaacccagcagtgtttgaaagaaaatgtcattcacatgcttttagatatctgctttgtacgtttatattacgccacaaagcccacaccagtctctctgcccaccacataatgagaacacagtgatttttgtggaatgaagccttcatgtaatgcaagcagtttgagtcagactgtttagttcaggtcttcaaaaaagattttaaaatgagtgttagaacacaagacattaacaccagagggtctacaggtgatcgatcatactggtgggcggctaaggtttcagatagtgagtgctacactacttgtttttgtttcttaattttaggtctgaaagctaataacattgactacacagttcattcagtcagaagagctctagaaaacactgcagtgaaggctgacaatatagaagtatttgctcaaggacatggtattattcaggtattgttgcctatatgaaaaatgggttgtaaagcatcattgagataatatcttagatattattgggtaatattttgttttataacagtgattcagtatatctgaattatggattatatggccatagaactacaagcaaaaaggatacacaaacaaattttgtagttaagacaaatctgttgcactaagatcaagaaatgtaatagatggaggccatgtagaggttagaaattcaaagaaatcgaggtcaaaaactggccaatcataacggcatagggattagttcctaaatttggtcacttgagaataacagtgtgaatagagtggagtggaagatgtgactggtgttgtttctaaaaatgtagaattgtcctcttagttggggtactaggtagttttgagaggtgaatatagacactaactttttgttttacaactgaaatcaaattgattggtaatttgcaacaaaatattttttgacccaaccatttatatcttaccatgtatattattttcactaggttgataaagcctatgactacctcgttcagaatacatcatttgctaataaattaggttttactgttactgttggaaataaccgtggcatctacctccgagatcctgttcaggtggctgcaccttcagatcatggcgttggcattgaacctgtatttccggagaacacaggtcagtaataggctggcagtaagctgacgtattcacatttgctgtttgaatgagtggtatcataataaagaattgctgtttgggccagtgttgtgaagagaatacatgaattgacagtatgattattttaaatcttagtcataagagaaaatattagagcaatttggggtccttgtacaatggcaatttagttagcatcttaaactaccagggaaaacagtagaatgagcctcagtgacccacagctttattaaattgtggataataaaatatcaaatttcttttccactttacctacttaggtataagacagagctttctgttgaagaatgaaaagtagaagcagtctaggagaactgcagctcgattaggtgtgaacaaaaataatcatcgctattatctggctgtcttcatttcagttgaatactatgacctgtgtgcagtaatgaaaacattcacttaaactctttattttaaggtcataccagtgcttggtgaaagtataaatgaatcatgagtaatctaaattgtaaggaagattatttgactgttttatttaagctgtgttttggatgcattttacagccaaccaaaccaagtcgctaaatttttttggaaagatgtaacatttttaaatggaaaaaaggaaaaaaatactcatctttaatttttggtctttttcgtgccagaaaactctgaaaaaatatcccttcagcttcatttagctctgacttcaaattcatcttgggttcagtgtcccagccatttggaactcatgaatcaatgtagacacataaacatacgtgtggatcccaggggcttaagagaaggattgcattatacagaggtattgatgtatcttcatttttactttcttcactctttaaaatgtttaaaaggttaaaaaaaaatccaaagtatatttgcaatatattgctttcttgctaagaaataactagacctatccatctgccaggttattcagttcttctggtgtgtctatattcatttaagcagtgagtttctaaagaatcatattttgtccttgtatgaataagtaaaaggaaagaagaggtacagcagaacctttcaattagatctccctctaactggtgttttcttttgtcagctaaacaaagctgcagttgcttgttgttgttgttgttgttgttgttgttgttgttttaagagacagagtcttgctctgttgcccaggctggagtacagtggtgtgatcgtggttcactgcagccttgaactcttgggctcaagtgatattcacaccttagcctcctgagtagctaggactagtggcgtgcaccaccaagcctggctaaatttttttatttttgtagagacaggatctctctatgttgctcagtcttgtcttgaactcttggcctcaagtgatcctcctgccttggcctcccagggctttgggattacaggtgtgaaccaccacacccagccagttataccttttagtactcagatgaagaaagcatctgttaaacaaatagttgtaaaccaggcatagaatagtatcacaacagtatctccacatctaaagttgtctgtagtactagtttgagctaatttttcagttgggagtaattaaaatgcacttattttgtacctgacgtctcattttcccatttcaactggtcaaatgttgctatacatttgtttgggctgtttgctattaattatgtgacctagtgtcaggaaattggtgtcaacctctggttaagaccttgattaaaagtagattgatttattctgtcagtagtttagaccttccccccctcttttaaacatttgtttatggatattgacacttaccaattcttttttcaaggtatgtggctatgatatagcatcccctaacgcaggtccgctcttcagagttccgatcactgcagttatagcagcaaagtaagtaacaggttactcacagcttactggtacatctaagattttaatgactattcatggagtcttgtggacttttaatgatcactaatacagaaccaggtaatggggattttgtcttagttctgctcccagctagcatttttaggtgtcatgtagtcagccatactgactcttgtgtgctctgagagtaactgatggcacctggcatctgccctacctctgcatcaaaactatttccaccacagtcactctgagctctgcattgcccagttcagaggataactcaggcttcgtctgacccgatcccactgcagtatttgacaatattacttcactcccctccattcctgccctttttgtctctgtcgtttttgggatttactctcttctcttaatgcttccacttttctagttatctactgtagaagcagaagttaagaaactcgtaacttcccatcttattcctctggaaaaatcagcagattatattacttcctgcttaaagtatatcagtggcacctccaaaggtcaagttcaagctccttaaaatagcaaacaatgctccctcacaattatagccctagccagtgtttcctgtcattccgtacaccaaattacacattttggccaactcactgattttggcacttgaggattctcaggatttgtgcatgtgcacagctgataacttggtttcaatttcctgtctcttcagttaatgaccaggtgcattcctggtcatccctgggtgaagggagtcccttctttctgcttcgtggcacattttacgtgcccctggacagactttagccaatatattgtaattttttatttaacttacactctttcactgtgagcccaccgaaggcacagagactactgttatacaggatgtataaaataaattatctagtggatgaaggtgagattgggattgtgagagtactggaaaccaagtggaaattctaaactaacagttctgttactctggtaaatattaagtatgcaatagatctcagcccatgagaaacacaggatgaaattgaggagaataaatttaaaaagtggtatacatgtggaaaaattgtgcaacagttaaattctcagccgtatattccctcgaagtccagtagtaatttagaccaggtaatgtgtaagaccttcaggagtcagctgccacgccatctccttcaggaagcttcccaggctccgtaactcttcttgtctatctggagcatcttatgttaaatgtctctgatgatgattctctccatgctagattgtctaggttaaagaatcatattttcttctttgttacgtttctagctcctaataacggcctcatgtagtaggcactcatttaaccgtttgtcctactgacaagaatttgtctctagcataaaatttgtttccgtggtgggtagttatgcatttgaactttatttcattgatttcttacaaaaatgctttgaaagtagtttgcctttctttactgttttacatcatgggagtgttttgaagctacaggaggagcttaatttaacacaagtctcatagctataataccagtgacataaaactttatcattgattttaatatctaggactcactgtagtttggaatctggtaattggaaaattctgtgaatgttgtagaatgcctttaacaaaaaagagaatgcttttttaatagtgtgtgtgaatgtatcttacaaatcataaaataggcaaaaagtagaatcatctatactctgctattcagaggttatctctgctaacctactgcaaaaattgaacaatatcgtacctactgttttgtaaccagcttctaagtccctgtgtttatttccaatgaattgttattttgcgtttatccaatgaaatctagagtatctgtggtcttataataaatatatacatttaattacttttattaattttcagagtaaatgaatcatcacattatgatctagcctttacagatgtacactttaaacctggtcaaattcgaaggcattttattgaggttcctgagggtgcaacatgggctggtaggtaaaattaaaatctgtgtgaccgcttatctctgtttacgttctaatgactatagctgtatgaggttcgtttatctgtaacatgtatttccctggtactaatatatgtatttgggtaccttagactttctgtaaagttcaaaacgtttttaagatctagtacaattttgcattggcccatacaggaaattaagccatcttaagatgtttttaatatttaaggtttgagcttagtttagaataatgccttacctggtaataattttttttttttttttttttttttttttgagacagagtctcactctgtcgccaggctggagtgcagtggcatgatctcggctcactgcaacctccacctccccagttcaaacgattctccttcctcagcctcccgagtagcttggactagcaggcgtgtgctaccacgccaggctattttttgtatttttagtagacacgaggtttcaccatgttggctaggatggtctcgatctcttgacctcgtgatacactcgcctcgtcctcccaaagtgctgggattacaggcatgagcaactgtgcccggcctaatttttaaaatactacaaatcagtttaaacaatgcagctgttgcttaaacctcaaactgttaaactctcagaattttagaaatagagctttaatctttgaagctctgtttatagaagattttcacttcagtgtctctgaaattttgagagtaaatgattgcctaacacaaagctcttgaattaacatgttatagtcctgtgagagtgctcatgtcattcttttttacaagagctgtgggtgtaccatattttccttcacaagttgtgtgtcctaaatttacaatttagcagtcagtatagaagggtatgtcagttgtcagagctcactcccattgatagaaggaagcaaatacgggcagtcaagaaagtgtcacccaatttaaattagtagccagcattgttgatacttcttggatttggcccctctgctaagcactttacagagattatcttgtctagtcccgtcagaaccctataaggtagataggtgtcattagtaaaaatggcttgtattttacttaggagtgtgttttttgtacttgtatgaaagtacagatatatttacatctgagactttattgaaaatgaaatattgaaatcacacatgtatgacctggtttgggaataactggttgtatttggttccccataccattttctggtcatctatctgtatgctgtccatctgtttgtcacctggtatcacaggaaataccagacttttcttgttttttgtaattaggtaaaggcaaaataatagcaaaagctgagagctaaagcagtgaattgaacagcacccaatatagcctgttaatttgcacactgggttataatggagctattgcagcagtgagaggcttctgaggataatcgggttgtactacactcattcattaagcatatttttctgtaccatctgtgccaggcccttttcagtgggctaaggtggtgagctacttagacaaggaccctgcttccagaggccttaagagcatctagtccaagatattgcagttaagagaactggattagggggaggcagcacagagtagcggcaaggccacgggctttggaaattgagaagtctgggtttggatccacactctgccatacactaatggttacctgggggcaggtttctaaattttctggacttctgtttcaactgtaaatatagttgttagtctgttgtaaggattagggattttatagtacttggtacatagcttgtcttcgttgggattacgctcacacttgacagtacttctagagggtggagtcagagttgctgtgttcagcattcctggggtcccattctcatagggcccctgggacttgtagagctccaggctctggtaaaatgtgcactggtaaattaaagaatacaaatctatggttaattaatactgaattgggtacttgtttagtgataaatggcactgatttatgattggtttaggttggtattgaaaataatttgtttttttaaataaaaattatcaaatgatctagaatgcaagtagttaagagaatttaacagtcttagttttatttcaaataattagaaatattgtcataacactagattttgtgttcttagcaactgactaggttctgagagctctctgcacacctggttttatgagccacggcattgcgccttgcttcagttcccttgaattagcttgggtgttctttagaaaagctgccaatctggcattgcggtgatcttggcttacctccagcgctggctcagagtaaagttaagcataagtagtcgtgccaggctttgtagacgcacacagtacacaagtagaccaagaagagagattaggaaaagttatcaatgaggaattgaggcatgataacaaatagaggtttccaaaaatataaccttccttactttatctggaattgactggttttcagctaaaacaaggagggattttaaaaggtacccgattaatgtaattgtgtatgcatctatggacagcttgctgtttccaggtgtttgcagcctcatggtggtggttcattttaataccagtttctttcgttcccatagaaaatcttctagtcttctacctttattaatattttgttgattctttgtttttatggaaatatgcagatttgagtgtacattttatttttgatccctattatgtccctacatgggaattattccctaagtgggcattattaaagccactttatgtcaattttaggtcttataagtttaaagctttgcttctttcttttattttagaagtgacagtgtgttcgtgttcttctgaggtgtcagcaaagtttgttctacatgcagtccagcttgtgaagcaaagagcatatcgaagccatgaattctataagttttgttctcttccagagaaaggaacactgactgaagcttttcctgtcctagtaagtttaattatagtttataatcctaacacaatttatttgcctttttggtatgggctaagactaagtatttgcatttgattttatagtttgtatttagcatgttgggattatatatttttttaatgccaaaaaaatgaagtagaaaaatagaaaatctaatcagggtacttgaaatcaagttggaggtaattatggctgtaattcttgaatagcatagtcaaagaaacatactagtctggtagattctcgtgccttgtagttaggaccctgatttagattattctttgttgtactatagattaatttctttaagacctgtttgcttgtcacttaacttattttactaatgctgtgttgttaagctatgaggctaatttgcattataggaaaactgctactgcttcatgtctaagttatctcagatgatggcagactgcattcttatctgtggtgttggaaatgatgactagtctttcttccatagaaggtgaaagtactgatgttcttccttcagtgcgctcctttgtgttttcagttggttctgggattttcccagtatctcttggtttctggttactttcatttgtgttcttccatggatcagtgttgcttcatctttttaaacttttaaatcactgattactagaaaacttactttaaaactcagtgctaagagcaggtgtttttttttccttttccttatctttattttttaatagggagaaagatgtaaatgaccataatgtcattttgttttggttgccaggtagctgtgagcccaaactcaattgtgcctattgagtatgccttacaaagttgaagtatctttattgtgtcgttatacttgattatttttcttttggtcctaattttttatttcgcttcgaaataataaaatcacatttgctttattatatgtgctttcagaagctgcctaggatcttttatgacaagaagcatagggttatgagtaaataactatgtatatttaaatacaccatatctctgcaaatgatttgtctaactcttacttagcatagctgttaaaatttttgagttttcttgctacaaacaggaaaagtttgaaaacatagaattgctctgaaacagctagtatttatattctgtaatttgagaaaaataagaaaagagatatattttatttacttttatttgcagggtggaaaagcaattgaattttgcattgctcgttggtgggcaagtctcagtgatgtcaacattgattataccatttctttccatgggatagtgtgtactgctcctcagttaaacattgtaagttccacaacattttcatgatttttaatgtcagttacttgtgttactggagagtaacttcattggttagatttaaactttaatgaggggaaattacctgtggttctgaagatagcagtaggctttgtgtgtgggtacttataaactttatattggacacatttattttaggtacaaaatattgcttatttttagtaaagtttgagaaagtaatttgagaaatcctttgtagcatgcatcggaaggaatcaaccgctttgatgttcagtcctccttgaaatacgaagatctggctccctgcataactttgaagaactgggtccaaacactgcggtatcattcaatgttttaggaactacagatattgaatatagattggggggatctcttacactcttaaaaaagggcctttttttttttaatccacctgcatgctagaggtgagaattttatccttgccagcagatctctgcaaggcagccccagtatcagcttctagcttcactgtcccacctgaccagcaaagtcaaggatggtggatagccgatcccagtcatgactagttaggatcaatggacattaacctttttatttcttgctgtaaaatagcaagttaacattctctctgatattattttgtgaatcctaatgcagtcatttttagaaactgcaataccattagaaactgtttattaaatggtagaaacttaagtactgtagcctgctgtttgtgcctcagcagctccccttacaaaagcagggcaccttgacctgtgttcacatactcactgtgttataaagatacctggtttcttttgtttaatctgaccttaactcatcggcatgaagcctagtcttaagtgtattaaaataaccaattagggacaatagtcagtgacacggtgatgtctaaagatatactgcttcctagaattatcaataaaaattaaaacatccagcttttgaagatatatccaacttatatcatcctgatgttttcttcctaaatctaaaaaattggagctaaatttagagtagattatgtttcactgacattttaaactatatttaaaacttactcttcagtgtcagttttctcctttataaaatctgtacattagcaacttccttcagaggactactaaaaatatgaaataacattccctcggccaggaggagggctgagtgtggcccctgccatctggtgagcagcaggggtctggggaggtctgtgctgcacacaacacagtactgtcaacagtttgcacaaggggtacaaatcagaacctgtcttgcaacacttttagtcaccctagtgttaggatttggttgtattgagagctgtttgttcacatttgaaaatgtttttgccatgaaaagattgcctttgtcatatttattgcaaaatctaaactgtatgtattgatatgattcaatcaaataattatgtaagttagtgattaaaatattgtagagtatactgaaaaggatagctctcaggaaggttcatctgcactttttgcaatatgttacagattttgttgcatatggttttatttgtctcattcaatgaactcttgaatcaaaccagttatgtagtttcctcattacagcccagtgagtgcaaaaacaaaacctttaggatcaagagatgttttgccaaataaccgtcaactttatgagatggtcctgacatataactttcatcaagtaagtgtttgcctagtaaagtgtacccttaggatgaacttttgtgttttatttatgattcatagaatcaaaaatggaaggacagtgtatatggtatatataaaaaacagaatcaagtgattaacagttaatttggaattactctttaggaaattataatttgtaattaaataccattcagttgtaaagtcacaaaatgtaattgagtggtgacctagccttaagccttagtttataaaatcactgatcactgtccattggtgccatctgacccaggggtgattagatggctcagaaataccatctgccttctggtgatggtgctgggcctgattgctttctgcgaagaaggcactggaacagggaaaggtcagagtagctcccaggtgggatgggtggcaaaagtaatggaggccagtgtaaatgctggaccaaagaattgttgtaagatcaatgagatttcaataaaactgttactgaaacacacatcaatttggttataatgttagggaaatggattggtttcagtgaattttcacatttcagttttataaagtaattagaggtcctgaagtatgtatatgttgctttattaatgaatacacatagccaggtgtgtatttttaaaagtttgtaagagagcagtgacttttataagtgctaaaatactgtgtgttctatattttcaaaattttttaccacaagtatttttaatgttttttaaatgaaaaagtctcatgtcaataacaatattaaaaatttgtatcagaaattatatgcaaatcatgccaagtaatcttttttgttttttaatagcccaagagtggggaagtaactccaagctgcccactactttgtgaactattatatgaatctgaatttgacagccaactgtggattatttttgaccagaacaaaagacagatgggttcaggcgatgcctatccacatcaggtataaaattgatggtgatttttagaattaacggaagctgtttcctgaactaacaaaatcctggtttcttgttatggtaatgttcatactttaaaaaaaacaaaaattatagctttgtgtttagtacttttgcaaactgtgagagcctgtttgttgtagtcggtgaagaacagatggtgtcaactatttcaccatgtagttgtgctgaattagagggggacaagggtgaaccttgcccacactggccagcataacttttggtgtgtggtgtttctccttcctatacactgattctacctatctgaaggtagaatcatcaaagcatgcatcaaagagatgcgagcctcttgaaatgatcctaagtctgagggggctaaagagagcactgcagcagtggccgcatgtcttcagttcatttgtacttttaaatttactacctcgttggacaactctgtaatgagcacttactacataccaggcactatgctttgtgctgttttattgaagggaaaaatcacataatttatagacattttatcccttagatattactgcaaagaaatgagatatttcctgtaatatgtataattttatgttgacaaatgaaaataatttatggagatttttttcaattagttgttaaaggaatggtatcgattttcctcaaagcaagtagcagtcacatctcattacagactggcctactgcagtgctattactttggttactttttaaatctcagaaaaagtggctgacacaggatacagcatctcttcctcttgaacctgttaagtggataatagatttgtatcccttgatctctattggtttcctgtttttttcctgtctgtaataaaggagtgacattttggttgtaatttgaagatcaactgggcatggtggcacatgcctgtgatcccgtctactcaggaagctgaggtgggaggatcgcttgagccctggagctctaggctatggtgcactatgattgcaccagttaacagccactgcacttcagcctgggcaacatagtgagtccccctctctaaaaggaaataaggattaccagtagtcataagttacacgtgtgtgtgtgtgtgtgtgtgtgtgtgtgtgtgtgtgtgtgtatttgtcctagatattctatggtgcctcaattttgctcatttttttggtagtgtttcttatatgtctctgagggacccatgaactagaaaatcactgcttttgtcattctcaagcagacactgagttttgctaaaagtgtgggagtattctgtcgttctggaaagaatgagggctttgaagtcagacctgactccagctctcttatactttactctgtgtgatgttaggcaagtcacttgatgtccctgatcctgtctgctcaccagcgtactagggactttatgtgttatatgaacgtctggatagttagtgccttgcactgtacctcacatattatgaacaagtctgtgaatggtaactttcactttatcctctttcagtgatttccgttgacttggttaaacttaacttttcccaaatgttgtttttctttttcagtattctttgaaactggagaaaggagattatacaattcgactacagattcgccatgagcaaatcagtgatttggaacgccttaaagaccttccatttattgtttctcatagattgtctaataccttgagcttagatattcatgaaaatcatagttttgcacttctagggaagaagaaatcaagcaatttgacattaccacccaaatataaccagccattctttgttacttccttacctgatgataagtaagtgataacattgcttatacttactgcccatcttatacactgtagtccttttaatgtcagtttatgacatctaggctaaatttagaggatgtagtcattttttttttggctgaagttatttcttcctttgatttttgaagtcttagctatgggaatgaattcagtgtggaattgttttcatgtttttccccttacttgtctttgtgaaactttctcttttgttgctttttttctctttgaattctcttgtttagaatacctaaaggggcaggacctggatgctatcttgcaggatccttaacattgtcaaagactgaactaggaaagaaagctgtaagtattagttttttaaacactgaaattacctattaaaaaatttcatttctttaaagataagaattaattccacatttcagaatggataaaagagaagatatactcttggggaaaaaaatttaatccttttttcccaggttactagtgaaagtcagttaatatttagttgtcttttaaaatgtatcctacttttgaaatatttaggcttctttttcacaagcctacagtactcaggccctgaacctgtcttacctcctacggctaatacacttgaacttcctgtgaaacatgtaaatacaaatcaaacttggcttaaatacatgtgatatttaagattagaacatgttatagaaatttaaccaataagattggttgtccatataagattatggacataggaataaatcagattatcttggggtgcttttaaaaagtagtcagaacaattaccctaaaacatgtttcttcacacttctacagacctatctcattggaatttcacatggttaagtaggaaaatatgagatgtttcttttggtattgccttttaatttcaaaatgatgctttttttagaaatatgtttctggttgttgtactttagacatatatgttacagttttataagtacctacctgtttttgttttttccttctatgttttcattacaaatttattatgagaatgatgtttatatagatctatcaccttttgtcataataatcattttagctcaatgccagtaaaagttgtcattcttaacagttttgcatttctctgtactattacttcttacagagctaagtaagcctgctacataaatgctgttatcaaaatgagtagttctcatacatcttaagaattatatttattttttgccactattgaaccaaaggccatttatttactgtcattgaagcataattggggaaacttgtgcttagaaagttgcctaccctgacatttcttgggtctcatttcagtttatactgtttatacatacgtactttagtataatttgaagtaaatcaatagttaatggtttgtaattaatacatgcactgatttaagaaaccctggtagttttttttgtagatttcatttcacaggaagcatagctgcttcagctattgggcgtcagctgtgaattttcgttcagatgacagatgacactttgaagagtctgcttacttgtgaagagtataacagaaaagcattattagtaaaagtgggcttttagcaattcagaaatagttactacttcccagttacattgttttaggagacaattgtgaaattaaattataaatatgtggtgttaactatggtagctatttatcaagggagaccttcctgggagaaagcagtaacttaaagctgttgagttcattataacttccatcacattgtttatgtaatcttttctcagtggtttagcgttttcttgttttttggtagttgggaaggtaactttcacttcactttgactttcacagtaactttgttgctttttataagaatgcataggcaatggggttgttgtggtaccctttaatcagactagaccatcaactaaatttactattttaagaaatgcttttataagtaatagattttgatctactaaatttttcaataagaagttgacatgtactcttagtaataacatatttgagtactttttcttatgtaaggaatgaaagtggcaatgttgctttctttaaaagcatgccatcttaatcacagacctgagccttctaagtggtgtaacacaggtggaacataaactgaaagacaattagacagaggttctgtctccatcctgtgtagattatgcatgttttcttacagaatgtcgttctaactcccaggggcagtctgcagcaaaacgacaaggaaaatttaaaaaggtactgattgtcagttcttaaaaaagatgtcttaaagccttatttgcatattaaacttttttctgtcactattataaaccttttttttaataagtctcccttagtttcctttctttgcattctaaagtatagtgctcttagctgtacttagaagcattgttgacatactgcttttctaaaggttttttttttttccccaccataaattcctggatgactcattttctctgtgtatacaaaaattttaatgctattcatttcttgctacagatatgataacaagtagcaatatttgaaatttttcatatttacaattttatagagagatggatgtgataatttttttttttttagccatataagctaaagcacttatttttaaagtctaaaagcacttttaaattgggtgatttgattaataaaatgttgcagctttttaaagcgaactttattccctgctcttgtatccattctggttctgaaagaagagaaacaataaagatcaatggatgtagcaggaacagcaaataaggactgttcactgacaattaaagcttatgctaagaacacagattttaagcccatcgctactaagtggtctgatcagcctctctgcagcatattaagcaatctttgatttactgctggggccagatttaactcagaaaagaaaatgtctgctataaatatattttagggccaggcgcagtgactcatgcctgtaatcccggcactttgggagggcaagttgggcagatcccttgagctcagcggtttgaaaccagcctgggcagcatggtgaaaccctgtctctacaaaaaaatgcaaaaattagccaggcgtggtagcacacacttatagtcccagctactctattggaggctgaggtggaaagatcgcttgagcctgggaggtggaggctgcagtaagctgagatcacaccactgcactccagtctgggtgacagagtgagaccctgtctcaaaacaaaacatacatacatacatatatatatatataaaagggaccacatatttaataagctttctggtgaagacgtgctacgtcattcaacattttcatgatttctttttaaacagaaagaattacagtgggaaaatcagtaatgtcctaatgtatacttgttaattagtagtgatatggaactggggaatcaccattctataacagcttaaattcctttattaaaatgtcttctgaaatgtccatattattacataatagtaaataatttgtccaaacaaaatacagatactaggaatcatctttctggagaaagatctaaagatcagtatttctcaactgggtgtcttgaccgtttgggggccacgtaatgggataaaaacagcattttttaaaaataggaaatgtcagttcatcagactcataaaattgtaatttcattttatgtattaatgtgtatatctttgggacattgtaaaaatagtttgcaagttactgctttagagaacaaggaataggtattctaggaatctattaaaaatagaaggcacttatcacgaaggccatagccaattatttttcttcttatttttgttgaccttttgcaagtttgggtagattttgtttgaattaggttgtatagttaggaaaacactgaatgaataggaaggcatttacttggtgattagtaaagcttcatttgaagaacttggcagctagagttatctctgctcgttcctttctgtcttcaatgcaagtacacaataaagctcttattttagaaataattagtattacagttttatagtcacattacaaagaaaaaaatacatgtataatttccggttgtttaagataaatagcattttgtatataattcttaatagattttttcctctgggtttcagtgacttgatttgaaaaggtatgtcaccctttttaaaattccttgtaaaatgcaataatatattttttgtttgtttgtatgtttttttaagagacagtctcactcaacactccaggctagagtacagtggcatgatcgtagctcactgttgcctccagctcctgggctcaagtgatcctcccacctcagcctccctagagtggctgggactacaggcgtgtgccactatgcctggctaatttttactttttatagagagaggtcttactacgtatgttgcccaaggtggtctaaaactcccggcctcggacgatcctcctggctcagcctcccaaaatgctgaaattacagacatgagccactgcacccagcctgaatattgtcacttttaacagatcataaatagcattcaaatatgatataaattttaaaaatagtttatgtgaagcttttaaatttttgagtattcagttactaacaattttaagaactaaagaaattgccattttgaaccacaatttaacttatagtgcgttgtgttgcccaaagagtagttattggtttggcaggtgagtttgactttctgaataacactgttcagtttgaacactgttgaaatacttcatgaatagctggaatgccttttttctaaacttaacattaaatatatactgtagagaaatcttcatagcatttctgctctgaagattcttcttgactgtctttttaaaccataatcaagatttctcaagaataaaggtacaaaattatttctattaaattggtactatgttaaccccttgagaattgtcataaaaatattaatatttattggcacaaagaagaaattattgtgatacagcaagtgaaaatagcgccatttttcttttgattagaaattaaaactaccaggtttataatttttactaataaaaaattccctgtcctgaaacatcttgtaggattacactaacatttataattgttaatttgatatatttaatatgtaaaatgctgattacaaaaccttgatttttgtttcactaagataattcatcataaactttctttgtctctttttttgcttttaatgatagtctaaggttactaggatatcttttttcccacttttgataggtctttgttagaattaattgtaaatcctaaattaattttaatagattgttcattttaaattcaattctcttttctcttctgtactaaaacaatagcaaatacctctgagtctgaggaggaagtgcctcacaacacataggctgcctgcctaagagcagcatacctctctccctgatatggtgaggaggtgtgggaagctcagggagaaagactggagaccactcttctagcacactgggtggcagagaagctcaattccatggagaatggagctatattaacagaaagtaaatattggaggccacttagcccctttaattcctagatgtgttgtctttgctgtacagatgacactgatgcagtctgtttccataagaacttggtggtagaagatcagctcagattttgtgcttaccttggctttgctcagggcagtgcctacccagagagtgaacctcaagaaggagaggagcaggacaggcagctgggtcctgaaagagctagcccaagcagtagacctgtttccttttcccagtctcatgtttcacgtaaggcctttgtttacaggttctggccccctgacctcagagggagaatgacagccagtggctacaaatggatttatatggttatctgacatcaaagtggttttctgtgctttaaatgagtcagtatggagataggattattattttgtgttggaatactattagaactacaaccatagttcctgttgtttactgttacatcattttataccccgaaattgtgttggtgaaaatatttaaaatgggaatatttgtgtcgtatatgctcctaaaaatcctatttgcgggaggtgaggacttgcagtattatttttttactcaaccagagtaaagctttttcagtgaatgtctttttgggaacatttgtttcagttttacaaactttgttaattaaaatgaatatagtattttaatttagcaccattttaaatgcaaacctgaagatagaatttgaggaactgacttaataaataacgacttaattaaggacacccagttactgtgccaaaaacaaatctagcaggtatagcatgtgatttcatttcccaaataatgctttacctttcacaagtcaagacttatctgtgaataaaataaatacagttactctccatttctctgctgctgtcttcaaagcaaaacttctcaaaagaatcacagacatgttgacttccattctcttttcatctctgtctcctccagcctggactgctccactgtcccctgacactgttcttgtccgggggggtcagtaggctctgtgctgccaggttttcagttccttccttcttcgtcgtacactgcctctcagctaaatgggcagttgatcattttctctttcttcttggtggtttttcctcaaggcttccgtgatcccaggtgctttttgctttccttttctcactcacagagctgctttttccattcaccatccctaactgaccttattcatccacatatttttcaacattgtcagcaacacattggttctacctttaaagaagatctcaaatctattcattttctcccatttctgcgacccatttttagtctaaggcagtgtagggtttcctaggtttgtttcctaacttgttgtcttcttgcctccacctttaccctctataatctattttccaaatagaatacaaaccaaaattttaatccatacaggaaccagagtcattaaacaaaaagcagaaatctttaatcatgtcactgtcttttgtaaaactcttctggtatgcttcttagtgcacttggaatacaatatatagtattttttcttttcttttttaaaccatattctgtcaagccctacttaagttggctgctgcctgctttctcagaagatacagctgtgcttgctttatacccagctcaggtctttacacttgctcatctgctccttgttcattgagggtcgtttgcgtaagatattacctcttcagagtggctttctataaccactttgtgtccatcggctccccctcgttacctgacagtcattctatccttttctgttttgttttcttcctatcagatgtcagcatctggtctgttctttacctattctagcattacctggcacatcgcggggactcagtaagtcctgttggttggactcagtaagtcctgttggttgaatgaaggcataagcgtccccttaaatttacttagagaatcttttcttagtttgaacttatttcatccccttctcagatttaaaatgtgaaaggtcagtgtacttttgtcatctgtctgccaagtaaagccaagaataccaaatatactcaaatggagaaaagtatgttcttatctcttttattttaaaggagatatttgaagtatcagtactcagcatcagtttgtgagaaaattgctgtgaccagagattggaatttttggtgtattgtgacccttagaatctagaatacagtgtagtacaacttaggtgcagcccatgttacatgacatgtagctgttgaagatgattttgatgtatgtaaaattaagcatattaatctaagaatctctctccacattcgtaggatgtaatccctgttcattactacttaatacctccaccaacaaagactaagaatggcagcaaagataaggaaaaagattcagaaaaagagaaagatttaaaagaagagtttactgaagcattacgagatcttaaaattcagtggatgacaaagtaggtttttaaatgtattttaattctttaaatgtttagttctattttcccaactataacaatattgtgtatatatacatagaccgtatttaaaattattaacagcagttggtaggattataggtgcttttaaattttcctctttttatataaatgtgtaatttatttaaattataaatatataattttgtgattaaatgttttaatttttattttaatcactctaatttgttcttggaagataattttattggaaagtataaaaaagaaaaatcacttttgcccacaattcataaatagtcattgtcctcttattattatttttttcctctgtgtttgtacatgtagcagtgtgaataaaattagtttccatttttcagttacttttttattatgatttaacagccgtataaaatactatttttaatgtctgtgttgtatatggttctatggatgcaacataatctatttaaacgttttattttgcatatatatgtttatagcttttcttcatgatgctgcgataaacatttttatacataaaggtgattttttaaaatttccatcatattgcatcttaaaagtaaaaatcgtcttgctatgttttgccaaattgctttctgagatgagtataataatttacactccatctagctgtgtatgtgtgctactacacaatgcaaaaaccagccattactgctgtcttaaattacgtctctagttattattaaaggagagctttttagatgttatcattcgttattagtatagcttctgacagttgagcatattcttcacctttttttctattcagacattaggtgtttctggtcgattaaaactttttacataaaagatattaatgcttttctgtacttgccacagattttactctagtgtactctttgactttgggcttgctttttacttgaaatttattttatgtagtcaagtcagttgctttttccatctgttatgcaatatttcttttactgctgatattctatgggaatcctcttcagctgattatgtatgcatccttgcagttatatggttttagagggaatagaagtcatcatgatgtgaaaatatttcccagagattgaaccattgtaatgtcagttcacttgcaaatatacctttcccacttaaaactaaattgtatctccactggaagtcaaagtcttcaggtctgtctctgcctgattttaggatgtcataaacagttgacaatataatataaattcttcaaaagtaaaattgcagagattgtcttctggcatgacagcctgaggagacccatgatgctggtccccagtaaaactagtgaaaattatttaaaaacaaaacaaaacaactttttaaagcctctggaaatggtccaaaggacatagagcaaatgaagaagcatctattcaaaaatacctacaagaattggataagaaaagcaagagtctgtgatatttgaaccaagaccactgcctccctttcctctcccagttaatgagccagaaattttacttcagatcttgccttcaagagctccagctcctgggggagggaaggctttcctccttggaggaggaggacgtcatcatttctcatcctgacctactgccagttgcagcggctcagttccagctgagtgctctcaagaggtgggggctctcttgtaaagtactgttgggaacactggggccccaatgcccaggaggctgtggttccataccacacgaggcaagctgagaagaccacaggagagtgctaagctccttaagtgggggtgtcactcaaagaaaaacatgccattcttccactccctgttccagagcttgggcttagtgattttgccagtgtggcctaaggagttcataaaactgatagctcctaatttcttgctgaaggaattgacttcatttgcaacagaagatggagaagtccgtgtgccttaagggctctctcaaaaacagtggagaaaaaaggaatgaaaaaaatgaacagagcagagcctcagagaaatgtgggacaccattagtgcaccaaagtccatggaacaggagtaccaggagaacagagagaaagcaaaaatatattcagtgaaataatggctggaaacaccccatatttattgaaagacattaacctacatatccagggaactcaatgaactcaaagtaaatgcaaagaaatccacaaatagacacagcatgttaaaaatactgaaagtcaaagataaggagaagatcttgagaggagcaagacaaaaactcctcatcacttacaaggaaatgctagtaaggttaacaactgacttctgagcagaaacattagaggtcagaaagcagtgggataatatattcagagtgctcaaaaatctcaaccaataatcctatatccagcaaaactgtcctttaaaaatgaaaatgaaataattcccaggtaaacaaaaacagagaatttgttgctagcaaacccaccttataagaagtactaaaagaagttattcagcctgaaagcaggtgatctctggcagtaatttgaatccacattggtgagagtggggaaagaaacactggtaaagttaattattatggaattataaaagacagcataaagttctcatttttttcctgttaactaatttaaaaagcagttctgtaaatattgtgtatatattaggcctatgtaatatttaaatgtaatattctgtaatatgtatttgcttatagcacaaaggagcaaaactgtattgggctaaaaaaatgactgcagatagtaattattataacagttaattaatggtgtattacagtaatagatacaacagatagaatactactacagaaggaaggagaggggaatagagctataaagggataacatttctgtatctcactgaaattaagctaggaaaaatctgaagctgattcttataagttaagatgtatatggtaagccttagagcaaccactaaaaaaaaactaaaaatgaacttgaaaaaaatcattaaataaatttaaatgttcatttaaaaatattcacttaatacaaaagaaagctgtataggaggaacagtggaacaaaaaaacaggatacatcaaaaacaaaaaataaaatcgaagacctaagtccaaatatatcaataatttaaagtttacaggaaattaagagaatcccatttacagtaacattgaaaaaaataaaatgtgtaggaacatgtttaacaaaagagatgtaagaattatacgtcaaaactacaaaacaattgttgaaagaaatttaaaagacctgagtaaatggaaaaggtattctttgtctgtggaccagaagacttaatatcattacactattcttcatattgatcgaatgattcagttgaatccccatcaggatccttttatagaaattaacaagctgattctaaaagtcatatgtgattccctgagactcagaatagccagacagtcttgaaaatgaagagcaaagtagggctcacacttcctgattccaaaacttaaatagaaagcaacagtaaacaagacagtgttatactggcacaagggtaagacatatatagatcagtggaatagaattaagagtccagaaataaaaccatgtgactatggtcagctaatttttagttttggcaagggtgctgatgcaaagaccatttaatgaggaaaggatagtatttgcagcaaagggtgctgggactggatagccatatagaaaaagaatgaagttggacccttgcctcacatcatatatacaagttaactcaaaatgtatcaaagagctgaaactacaaaactcaatgagacgtagtggtaaactttcatgaccttacatttggcaaaagatttttaaagataccaaaagcataagtaacataagaaaaaaaatagataatttggacttaatcaagattaaaagcttttgtgcttttagcatagcatcaagaaagtgaaaagaacggcctatttgcaagttacatatttttaaggagcttgtatgcaaaatatataaagaacgctaaccttttttttttttttttttttgagacagggtctctctctgtcacccaggctggactgcagtggcacgatcatagctcactgcagccttgaacccctgggctcaagggatcttcccacttcagcctcccaagtagctaggactacaagtgcacgccaccacccccagcttatttttttaagggatgggatctcactatgttgcccaggctagtctggaacccccggcctcaattaatcctcctgcttcagcttcccatagtgttgggattacaggcatgagccacctccacacccagcccccagaatatataaataattcctacaatttcataatacaaaggcaaatggctcaattttttaaatgggtgagtaatctgaatagatatttctataaagatgtacaaatgaccagtaagtgcatgaaaaaatgctcaaaatcgttagtcttcagggaaatgcacatcaaaatcacaatgaaatacaacttcacacttactaggatgactggaatcataaagtcagatgatgagttttggcaagtatgtggacaaagcagaatcctcagacactgatggtaagaatacaaaaatgatgcagactttttggaaaacaatcttgactgctcttcaaatgattaaacttagtttccatatggcccagcagttccactcccaggtatatacccaagaaaaataaaaacctgtattcacacaaaaacatgttgatgacagtttatagcagcattattcataatggccaaaaggtggaatgtccatcagctgatgaatggacaaacaaaatgtggtgtatccatacagcggattccttttcagccatgaatgggattaatacatgctccaacatgaatgcaccttgaaaatagtatgttaagtggtagtagccagtcacaaaaagaccatgtattatatgattctattcatattaaatgtccagaatgaggaaatctatagagacagaaagtagattagtggttgcttagtgctggggaggctggggagatctgatagcaaaagggtatggcggtttctttttgtattgatgaaaaatgttttaaagttgactgttgtgatagttacatatatctgttactatgctagaaagcattgaaattcacacttaaaatgggaaaattgtatggagaaaaaattgaaaaggttgtttacctaataggtgttttagaagaaaacagcaaaaaattattagcattccctagcaaaactttaaaaaccttagaacattttttggaaaaaaaaatttataattaaggttcagtagttttaaaatgtaaaacgaaagtgttgattttgcccttggataattgttagcgaaaagagaaaaacaggacttaattttttttgtactaagaattagtgtaaattttgttgtctacaagttaaatttattttcatagaaagttagttatagtatcaaaatcccggtcaaccttatttttatactactgtgcagttttgttaatatattaagtgactttaatgtaagttacccacttctggtgctagtttgtatgttaatttgtttttatcctgatacatataatcaggtagaattgggaattttattcagcctccgcatcggggaacatagaataactctttattgactcaagactggaattttcagaaaagtttaaatttttattttttctagaattttcagaaaagtttaatagatctgagacatttttaaatcttttaatctttctagctatttgtgaatatgcttttcttccttttaaataaatataatagctggtatgtaagaaagctattgatgcatatttttatttggatatcttattgaactcttaattggaataattttcagtttgatttatttatttatttatttatttattttttaattaattaattaatttattttttgagatggagtctcactctgtcacccggctggagtgcagtggtttgatctcggctcactgcaacctccgcctcccaggttcaagtgattctcctgcctcagcctcccgagtatctgggactacaggcatgtgccaccacccccagctaatttttgtagttttagtagagacggggtttcaccatgttggccaggatggtcttgatctcttgcccttgtgatccgcctgccttggcctcccaaagtgctgggattacaggggtgagccaccatgcccagcccagtttgatttatttttgttttctagttaatcatttatactacttgccaataatgataatccttgtcaatgactatacttatatttcaaattaatgtcttattttattggcttaaacttccaaacaatgttaaataatagagaagacaaatactctttttaaaagaaaaaagtaaatatttctctccttcttacatacataggctggattctagtgacatttataacgaattgaaagaaacatatcctaattatcttcctctgtacgttgcacgacttcatcaattggatgctgaaaaggttagacatgttcattctaatatatcttattttgtttgtaattatataagtttgtgttttgaggaaaagtgcattatctttctcttctgttcttgctaactaaaacatgttttctcaaattgaatgttgtgttaagctgttttcatgaaggttattataagacctagccactactgtgagtttagtttaggattcttgctcatgcttggtcaatgagattagtaatagagaagataccttaacgattgttttcatgaccttaacctaaagggcaaggggcagaacgtagtaatcctggccagatggaaatctgaacgccttcactgaaagaattcctactttgcattaactttgttaatgattctcatttgtgagagttggccatagttctagtctgtcatgacatggaccagttctcattattcatcaaagcagtgggaaagtgctgtcctaatcagttgaaaatcatcaagggtttagagtgaaccagagggtatttaaaggagatttcttaaaagactttaacaagagagaagcaaattgttgggaacatcatggtaatcacagttagactgttgattataatgtttactctcatctttgtgtttttcatgatggatcagaaagaaatggtttcatcagctagggctttctttttttttcctgtgttcaggtagtgtgcaactagagtaatgacaatagccaatcacatttctagaatcttaagaaatacagaaaaggagttacctttgttaaaaaaaaaactttacatttttatgaagtttatattttgcttactctcaccattgtactccagcagggaatgtaaataaggtatttttattatacatctgagctcaagttttatagagataccagcaattagaaaaatcacagtaggagatagcagagagcccctgggctacaagtcaattacatagtttactcacactgcagttgtaggtctcatggttgagacagcagaagtgaaattgctttcgtatactgattgatatacctattttttattatttcttttttcctctccaggaacgaatgaaaagacttaatgaaattgttgatgcggcaaatgctgttatttctcatatagatcaaacagccctagcagtttatattgcaatgaagactgatcccaggcctgatgcagctactataaaaaagtacctaaccagtaaataatctttcttgcatctcatttcctagttaacttgtttaaaaagtagggactaatattatagaggatattgcttttctgatgtttgttatatccttataatgggaattatcactatttggatactcccctccttagaaattttaaaataattttgtccaatctttttaagagtaagcccaagaaaagtagtttgccttctctactgttaagtgctgtcaaggtagagggatttgaatatctgtgatcaagcagtccaaccacttgagggtttatgtgaattggaccatatcaggaagacaaaaattaacaatctataaaataatttttaaaatgtttattgtccagtaacatgaaaaacctaatatttggtttgtaataattacatgacaaacctaatacgtggtttgtagtgaaataaatgataataaaattaggttaaaactatctggcaacttttatgaaactggttttatagtattagggagaataagaggagagaatttatagttttgcctttataaaacctaatgctgtgtgtaaatagagaagcttccctgggtttatgagtggttggtatggttccttccatgcaagtgtgatttccgtatgttggtgtaattaatggtccagtgactctgaaccaagctgccatttggtcactttcacccttccatgaactcttaaaccatcacctcatggtagctctcccagtgtcagttacttgtttatcacttttgtttatttttgacttacaggatcattaactaggtagaaatatcctgattcttttgtggttattataactaataaaccaaaactattcaggctgcctgaaaatactaaattttccttaaaaattttctcagtttcagtcagtatttttttctacataaaatacttggattccaaactgctagaattctttccattatatcatttatattgatactataggatcttatgaatcttacaagcaataattttcaagtgggatagaatatatttaaaattgcttctttggccactattattaccttttcatatttttcaaaagaatagtctcaaaacattgccattttgttgttgttgttaataataacagaaaatacagccaccatttattaagtgccgattatgtataagggactattgagggcattttaaatacattgttttatttaaatttagtcttccaaacaacatggaaggcaggggcctttgtatcccccttttaaggaagagaaaactgaagttcagagagtttagatgacttggcccaggtgccactgctaggaagttggaaagcacatagtcaaatcaggatctgcctccacagccaatgccctttcttttctctgtatattcttctcccttcttgagaaggttaacataactcagtattatctcacagaaaaaggagcatcgtctgcctcccacccatcctcattgtgttcctttctgtctcagggtgatcattgttaatcttattgcaagaggaggctggccttggtcactttaaaactgtcttccacagatcaccagtgataaccagttgctaaaaagaatggcccattttgagtcttctttgagctctctgcagcccccgacattaactatcccatatactttctagcttttgttattttttacattttgtgaaaataatatgattttctcaaactcgggtgttacatgaaataacacatatggttttctcagttttaccatccacagaggaaactcaatctcagcttacagtgagccataaactaatacgatattagttttgttttcttattggtctttttttatcactgtttttaatctctttttttttttttttttttttttttttagtttctactctttggagattactagacattgactatcatggttattgaaataagctgggataaaactagaaaagaagccataaaactttgtaaaaacgctaagagtggagctgctttaagtttttagcgacactgggtcaacttgtttatccttgtaattaaagaatttctatttctctccaggcctttgctttggcctgactgaaatagactctgaccaggttgtgtttggacagaagacagtattcagagttgaaatattatacaagatgctatcaggaaatacttagcatttcttacagatgtcatctatgggcaagtagcagccaacttaagcattaatttctcatttccatgcaaaattgctttctcttaaatcactaacatcaaaaattgtaaaatgccattttctaatcttaaaagtgatattaacttttagttaatatcatgttttagttaaatttaaactgcacttatttaggcattaaaatactgattccaattaagttgcttcctaaaatgtagctattatcttgatggatacctaactagatttgatttcaaggtccttattgagcaaatacttcatgtaaggcatcactgacaaggacttaaaacatgagcaagatagtctctactcttaggaaacttatcatctaatatagaagatgaaattgccagataggaaattattaagagataatgaaatacaagtatttttaaataaatatttcaaattgtaaaagcctgtagaaagaaaagctgactttcacctgagtggaaaaagcctcatgtactataaaggtattcagtctcagccagtcagtacaaaacctaaggagaggaaaggaatactccagatatgtagaatttagattacgtgataagaggatgctaaaatagaaagggatcttacagctaatttaacccaggtctgacaaatgcagattacctgtgtcacccccaggttgccttctgatttctgcatcattccagcccttctctgggcagccaggatccatcaggcagcatttgccgagtctgccctgcagactctggccgagcgacggatgaaaggagtgctcagacacaggtatccagtgaaagagtgggctaggggactgccagcactaagggccaaagagagttagcagtccccctgagccagcgacgctcacatttatttagtagagatttaatgacaaaggcttggagcaaacacaatttgtgggtaataaacattgtcgacccccaagtagagagcagtcctgcacatgaatgatcaaaggttggtttttggagacaggagtagacaaatttatctagcgcaaatgatcaaaggttggtttttggagacaggagtaaacaaatttatctagataagttcctttacattcccttgttatctgccttttgctccctggctccagataagagaatttggctgccttcagccagatcctctttcaaagcttttgcaaaacctcccagccttccaagaaggtttgcatctttccctctaacttttacctaccaccctgaccaatctcctacatctccccattttctgtttttttgcatcaggttttgttgattgaagagtacagatgtgtgcagcaactggtttgtctggcgtagtggttactgcttgtattccagctttgcatcctagaattagtaaataacataagacaaaatgagtataatcagtaacattcttttccaatcaaggagtgacatgtagtgtttcttggcacctcagtccaatgtgtgctgttactaaggaaccccactgagggtatgttacccccttccagccaagcagttactttattggaggctgggaaggtggtgtctgcccaggtaacagggcagaagaaaggcaaatctaaatgatgatcccaatagcgtgtagcaggtatgggttgcaggcagagtgagagaataagaagggttaatacccaaaagagttgcagtgtacaacggaaagcatagcaaggaacaaattatctggagtgaatggtgtctatgtccagagcaggattcattcagccttctgagttttcttcagcatctcccaggtaatgtctggggtttgtgtcgtctgaagaagctgcatcatccagggctatgggttccacagggtcattttcttcatttctggtaccgggttgggtcctagccacgctatggtatggtttgatgcctcgtgctggaatccaaagaggacctgagggggtgtgaacacaagcatgtcttcttcccagtgttaacaattcagttgaaccgcaccatacattactgtttatatctttccataaaactgcaggtttatgtcttgagaggttttagcaaaatgctcttctatagctgattgaaatttatcgtttagattttaaaaagtaagggtaaataaggcttctgccagtagtgttgcagggtccttactcatattcacttttttgttgttttctgagcatatttttaagggtggattggacacgttctactgtggcctgtccttgggggttgtgagggatgcctatggattgttggatgttccacatgtgacaaaattgctgaaattttgagctggcataagctggaccaatatcagttttaatttttgtgggccgctccataaatgcaaaagttaaaagaagatgtttaataacatattgagcagactttccaggaagagcatgtatgctaattaggtgagaattggtatcaacggatgcatgtacatatcctagttttccaaatttagggatgtgtgtaacatctgtttgccataactgattaggttctagttctctagggttaacacctgttgaaggaggggacatgcctgtgagctggcaatttgggcattgcaggataatttgtttagtctttgggtaagttgaaatcgtttagataaatttctccaattttggtggaaacattgatgcgaatgggtggcttggtcaagcagtgatgtcataacctgcaggtctgcttgatcattgccataagctagggggccaggcagtgagctgtgggcccaaatgtatgtaataaaaataggatgtgtacattgatccaccgattgctgaaatcaaagaaaaactgcacacagggtgggcttgagagtggacttaataagggctgtttcaaggttctgcaataaataaacagagtaagcagagtcactaaccatattgattggctgagcaggaaaggtctctagggccagtattaaggctccaacctcagctttcttgagtgttagtaaatccagaacaagtgagggaattgtgcagtctccaccaaataactacttttccatttttaccagagccgtcaataaaaagcattaaagaattaggtattgtgggtggggggggtgtggcggtgaaccacttttgtaggcataactacaggagtactagataataactgaagtagtttatcggcaggaagggcatgttctatatggcctgtgtaatcagagagtgctatttgcaggtctagagataaaggcaagactgctttgaattgctttttacttaaaggacttccgatgacatcatggtcataacctagaaactgattgcatcatctgcggcctaaatagatgattttactaactagctgggtacagggagatagagttttagttctggtatgtgagcaaaaaactcattttaggaagcatagccctggggacatctgtcctattaatcctgttggggaatgcttagtaggaaaaacaaacaattgaactgaatattgaatatcgtgggtctgtgcaatcctgttgcctctgaaaaatagcatgctctatttcctcaatttccctttttgctgcaggagttaaatacctgggagagtctagggctgtattgccctttaggatagaaacaggttttgtaatgtatcagttatgcccaaggtggggtgaagccagttaatatctcctagtaatttctgataatcatttaatgtgtgtaagttgctagtatttaactttttaaggtcttactgaccggtaagttagaatgtatccaagatatttctaaggagaagacaattgtactttttcaggtgctatgattaaacctcttaactgtgtattctttacgacagaggcatatagacttacaagtcctggctccgttggagctgctagtaaaatatcatccataaaatgaataatcttgcaattaggaaagtcttttctaatggggagcaaagcctgatttacatgatactgacacagtattccttgagggagtactttccaatgaaattggcgagctggcctttattgataactggtattttaaacacaaatttttctctgtcctgttctgcaaggggaatagtataaaagcagtcatttaagtcaataagactataggtcaaactacaggaattgccgctggggaagggaggccctgttgtaggggcctcataggttgcaaattagcattgatagcccataagtcatgcaaaagtctccatttgccagactttttgggaatgaggaaaatgggcaaattccaagggctgtttgacagttgtatatggctggcttttaattgttcctcagctaattcatgggctctttgtaatttctctccctttaaaggtcactgttctacctaaataagattttgagagagcctcatcaggggtaggggagaaataacagtggccattattagaaagagatctgcagagtgacctcaaccctcttgtaaatgggctagcggctccgttttctttaatgcttttccttatctctttataagcgttaaaagtaacgggttcatacacctgattgtgttgtcaattttgcgttaccaggcaggccaagagctccccttctaatgccgcttgcctaagacagggtcccatagctgtagcatattccttgtcttttctccaatttattggaggacggggctcaggcaaaacctccgtttcctctttgttatctttgcccggtaacagcggggctgagggagaagggggaggaaccatgggttatgggaaacaacagtttgcattaggtcccttaattgagcctgcgaaaccgagcctccactagctttaagcagctgtttcattacttttatatactgttgctgttgagctgataactgttgtcccatgatgaaaccctagcctgaacaattccctcgaacttggaaatcccaagcgggcaccagtgacttactgactgcgcagtctcttcaccttcattttcgagggttccattgtgatccattgcagcgttcctctcatggggcaccacctgccaagtctgtccctcagactatggccgagtgacagatgaaaggaaaggagtactcagacacaggtatccagtgaaacagcaggctagggactgccggcactaggggccgaagagagttagcagtccccctaagccagtgatgctcgcatttatttagtacagatttaatgacaaaagcttggagcaaacacaatttgtgggtaacaaacattgtcgaccccccaaatagaaagcagtcctgcttgtgaatgatcagaagttgggttttggggacaggaggaaaccaatttatctagataagtttctttacattccattgttatctgccgtttgctctcaggctccggataagagaatttgactgccttcagccaaatcctctttcgaagcttttgcaaaacctcgcggccttccaagaaggtttgcatctttccctctaacttttacccaccaccctgaccaatctacaagtatcagcctgggtgtggaaacctgccttgtcaacccattgctgttccaagcccctttctccttcacaaaatcaggatagtagttgtgcccgacaccttggattgttggaaggcataagcaaaggactgctgagaagacatttaaggatggcacctggcatctaagaggagggggaaggagggtggatcaggcaatggcaagccatgcagatgccccacagcttggaagtcccaaaagtctacttgtaaatccttttcttcttaattccagtgtaaacaagcagtacccagaaacatctctacaaaaaggcagtgaaagttggttcttcaagctttgaggcactgtgctgagaagcactgagggatcttttaggcatagtttcatttacgttgcaaatgtattgggattggtaattgccctctttgatgaactctgccagtgtgaaggaatttctctactacccacattgcctccctgcccactttcaaggtacaggatcaaatgggctttgaacctctgagaataccccggtcttgggcaatgtttcagcagcggcattttctatggtacttagcgttcatgttccctgccatgcggcctcttagattaacaggactccttggtgcgcaggattaatgtgggtgagcccttgagccttcaagttgttgggttgatggctgtctttcctactgcggatccttgttgatggtacagtcccggcagttttcacatgctacacatttcactctgagtctttcagagtcactcttagctgttagtttgttccacagctaagtgcctcaatcatcatcattttctcagtacttttagtcctcattgttttcacgtgtatctgacataagttggacagaatgcctcaaataagcacacattctagagactaacacttttccctggagtgtaggtggtggttgtatttcattcagcaatgatttattgagtttccattctgtgccgggcattgtcctaggcacatggaatgcattgaagaaaacaaagatgtctgccctggatcaaggcaatgtgccgtagtgattaagagcacagattacagatttatactgctaagcttagaatcctggatctgccacttcctaactggcggaccttgaacaaattgcatagtctctttgggccacagtttcttcctttgcaacatggcagtaattaatagtctcttactcagaattgttttgaatgtgaatgaattaacatgttaaaatgctgagacagttgctggcacattcagagtaaagcattacatttatttgtcctagtcatgaactgaaagttttaagacataacctctgggtatacacatagacaaatgtgtaatgattactatttataagaaaactgaaaactcaaaagtcatttacctgattaagagttatatagctaaaaaaatttagaatagtgattaacctttcaactctgttgcttctggcattccgtttcaaccaggtgcagctaccctaactcatttaatctatatgtgtaatatagtagctcatttgatgtttattaataaggcatcatatttgatgtacaatacaattgtacgtacctggatatacagtatttctgcattataaatcttaggcaaaagaatacatgaatttaaattcagataagaatttacttttaaagacattttactgatatctgaaatattttttaatttgctgtacagtgacatggacaaacaaaaatccaccctcgtagatgccctttgtaggaaaggttgtgccctggcagaccatcttcttcacacccaggctcaagacggagccatttccactgatgcagaaggaaaggaggaggaaggagaaagtcctttggattctctggcagaaacattttgggaaactactaaatggactgatctctttgacaataaggtaacgtttctgcttcttgtttcagcaaagttcttggggttacctcacagacctctcttgtgccccattgctggttaaaagaggaagaagataaatggaaagaatctacactgggctctgaatatgacatgtttagcctagtacttcatgtttgtctcacctttttttaaaaaacattattttatggtactgcaaactggctgttaaaccacaataattttaaaaacagtttgagaatatgtgtagtaggcttttagttaaaccagttatgtatgtagctaaattaagaaagtcttctagaaaatgccttcaggcccacccttctctagttatatgctaatttgttggtggtaggagattgggggcaggttgaggagacatactggttagttgttacttattttcctcaaaactcttgaatttctaagtaattatcatcttgatttgtagctaatcagttttaaaacccaattcataaaagcatcgttgatgaacttttttggattttggttacaaaaacattttaaatctcttttagctctctactataattcttgcaatagcgtttatacaagttattaatcttcttttcctgtggaaataaaataaagtaaatggagtcagtaggattcccctcgcgtatcacagaccatcattttgttttagtagacaggtgcttgttctcagaattaactggtaatttgcagtaaagaaccctggaagtgggaagaaaattcttatatggttcagatttttccaacacagtacagtggtgcatttaaagaaggtactcagttactcagttatatttgggaaactgaaggagccagtattgcagcagaggtcaggaatttgaatctgaaattagagcccttgagtttggctcctgcctctaccacttttatgtatgaccttaggcaacttacaaaattttgataccttagtttcttatctacacgacctgccttaggctgtgatgaatgagtattaagtacatgcaaagtccccaacaatatttgctgttattgcaaacaattattgaaggcctatgtgccagacactacttactactggaaacataaagatgaataagaacctgctttctgtctttgaggaatgtaacagagattgacaaacacttgatgaacatataatgaaattgttatagatcattctatttttgcaatactactactatattaggggctatgcattctattacctgtttactgtgtttactgtgtccatggcaacaattgttaaatactttagttgcctttacaatacaaatcagtgtcaggattttctttgagtacattctccacattccaaagtagagaccaaaaatatatataaatgattataagtatatttgacagatgcagtaattacaggtaaaaacttgtaccaaagaaaccatgtttatataatctaatacttgtttttttacttctatcctcatttgcaattttggcattttttatttctatcctgatttgcatctttgtaattatttatgttagctctggtttcttgtgcatgaagaggtatttttaagtggatttccacggctaataatttctcatattagttttcttcccaaaaaacagatggttcattctgtggaatactcagctcttttgaagacaccaactttctttttcaaagtttttaaaaatgtactctatgtaccatattcatttcaaaagctacacttctgttaaagccttaattttattgttaaagctaatgccttaaaatgtaaattattttataaaaaagctttatcatgttttacattgtaggttttgacatttgcatataaacatgcattagtaaataaaatgtatgggagaggccttaaatttgcaactaaacttgtggaagaaaaaccaacaaaagaaaactggaaaaattgtattcaagtaagtgatatttaaaatgtcactgttaagcatcactttgatattgcatagtgacaagataactagaaaggattaggactgtgatatagcaatactggttttattgtgaccagttattacagtaattagcgtaatatgaactatagaataaatatatgagagacagtcaataagctatttaaattttaaaaacacttttcactgctatccaaaaaactgatactagcctcaaatgttttcaacaagggcaaatgcattttgaattttgtaaccgtagaagccagtttttctttatgaaggaaacaaatccttttaaaggcatgttgcctcaactctaaaatggttcaacttctggagtttatatttgattttattcttcatttgagatggtaggcatttttaaaattatcttaccatatacaatattatgtgcagagaaattttatagttgaggtttctgcacaagttagttgtcaagtaaaaaaatttagctgatttctacagaagttactttagtctgacctcgtctttgaacatgcttaattggtttatgcctaaaggatacgtgaaggcaggggagtttggtggtgccagattcagctaaagggcaagtccaggttaattatactttatatgtaaggtaccctttggatgtaaaactgatcagtaggttcctctgaaaatgtttgataattagagtaagctatattcatatttactcttagagctttttgtttaccttcaccagtcagtccaaattgtaagacattttaaattagctcctccagatctttgactagattaagagaactctttctggagccaggtgttgatatgtctaatgtggttctcatcatgtggaatctgatccgtgagcacttaggtttgtaaagccagtgatccctgccgacgttcacatcagggagtgtttcttaacttgtctgccctccactctgcccccccgctgcctgttctccacacagcagctggaaaagatgccttttgacacctgctgatgaatctccatcacatttggaataaaatccaaactctccccagtggtccataaggcccctgcctacctctccagacttatttcatatcacacttgcccatacaaactctgcttctgccacaccagcatctctgcttagcacaaacagccacaccttttcctaccaaaggaccttagcactaactactctggctggatggaatgtctttcccagattttcgcacagatttcttgtcattcaaactcaactggagtatcacctccatagagatcctttcttaaccatctaactccccagttagtttatattgtgtcaaatattatttctactgtacacctgataaatatcttattacttgtttattcatttattaatttgcttattatttgcttttcctgaaagtgggaggtgaatttgttcagtgctgttttcccagtgtttgacatgatagttactcagaaaaaatgaatgaaaggaacttaggttggtaggaaggaaaggaacaagtaagttggaaggaagaagggaggaacacaggttaataggaaagagggaaaaggacagttggtagggataatgatgagaacaataggttggttggtaggaaagttggttgatagtaagaaaagttggttggtgggaaggaggatcaatgggtgggtgacggttggtggaaggaaggttctatatgctactaccttactgttactatttaatacagaatttattctaaatactgagcttaaaaatctgtcacttcctttataataatatattattgtattttgttgtagctgatgaagttacttggatggacccattgtgcatcttttactgaaaactggctccccatcatgtatcctcccgattattgcgtattctaaaataggaaacaagactttaaattttaaaaaaggaagttttatagtgaatggatataaaaacaaatttgtggcatttttagtctaatgcatgttttcatccactatccagtactgattattaaaatgacatgtatttatcagagaattcactgacgtgtggcttaatacatgtaaatctagacctctgacatcatggtgttttcttaatgcctcacattgctggcacggggatgtgccctgcctgccagcacctaggacttcgagttgggttgcagcttatgacatgcatgataggttttggaaggtaacttttaactgcaaacctataaagtactattttttattttataaatgaacagggttttaacgtgctcaactttaatttttttcaattgtatgaaggccttaaaaaagctacattaagcgtagctaaaattatttattggactaaaaactaacagaacttcatttccagaattttttttttttttttttggcaaatgtttacattcaattaaggggaaaaagtagaaccagcacaaatgagtggcagttgctggagcataactgcttcaataaatcttcatcttggggtaattacaggcaagtcattttcacatcctcttgaggttcagagcatcagaatgaactctatgaatacatgtgtaagtgccagacagctgaatctttatcaggtattgtaaagatacacatatgatatgtttattaaaattgaaataatgtaaaacacatgaataaatttgcaaaaccaagatcacagtacaccatatgcactctggtaccttaatttttttttataaataataaaagtgaatattgaagcttcttaaagttggtcttaatttttcataaataaaatttggggttataacagaaataatacattaaatacatagacaaaaaaagttaaacataagataatctattttacagtgtttcttataggcttacaattatttgaatgtatttccagttcttgtatgattaacttttgtgcatatctaactttttattatttttatctttggctactgcacgtgcatctctcgtcattcctccaccaaataaacagacaaaagtagtattgaaaagtttacagtcccttatctaatggcaaattgtgtgtatgtatgatttttttatcttgttctcttaagatttactgctgcttaaaattactaccagtaatccttagtcactcccaactgtttctgctgtatctcatgaagtgttagagcatttatgagaaacataaatacatgtataagcatattggtcacaccttctgggccagctagagtccaaagtctatccatgaaagctacatgcatgttctctctcacacactcatggactttcacctgcacacacatacaggtccccatttgtataggtttagtccagtaagagaatggagaagctcagtaaaggtaggatgacttcccaaggttatacggctgatcaactgttggaaattaattacagaccttgctttacaacccaggttttgctatttcaggtaagtactacctacagcaggaatcagtaacgtttggccctttaacccaaactggactgctgcctgtttttgtaaataaagttttattggaacagagccatgcctattcatttgtgactcctgtaactggaggcagttatacaaagctgccatgttagctcctgtttcctgtctggttcattctgcatttctgtggtgacaagtggacccaagtaagctctagaagatgttctcagtaaaatcattactgtttctatgtgattacattaaaaataatacaaacagtaggatggtacttcaaaaagtcaagcagttttcctgtttctggtcacagtagccaatgtttgcacacccactgaaaacaattgaaaaaactaggtaaaaataactttttaaagaaccattagagacagtacagggtatgtgctcaatactggttctgtggcccctttccaataataagaggcagttctcaattgttactgggaggagttttgccatctcatgggatttctttccttcctcatgttagcatgctttctgggagaacttctctttaccccagaagagccccacctgcttctcttcttaggcaccacaaatctcaaaccctttctccctccacccccagctctaatgaaatgtgcagggactggatgactggaagccccagcctgggtctctgctgtctaatcctggctcaagtactgacaagtcaaatcacttgacccccatgaatctccttaagaaaatcgtggtgttgaatcagtgtgtctattccaactaaaaaaattatttcatttgaattaactgagtctttgcctccactgtgtttcgttctccgtcctcccaacaacccagcattcagaatacatgtgtctttgtctttccctttaggatctaagtcagagaagccttcatagggagatagataatagggattcttgctatctcccctaaaggggaaggggaggaaaccttgaatggagagaattttttgaggaataaagaagtgagaaactgaatttcaagagtctcagtctgaacatagcaaaccaaggggtgaagaatttatcagtagtcatgggtggtaaactgaaaaagggaagctgactaagtaaaatcccggaaaccagaagaggaagatgtaagtgacgctctaacatgaagggtttttgggcatcccaatcagcagaatttctacctgccttctgataccctgagacagccaggtcaggatgtgatggtgcagtacctgctagcactttgctgcagaatgcctctgcactcagttctgcaaatgtactgt

SEQ ID NO: 12210 - DNA, 161607 bp, Human
  misc_feature (1)...(161607): n = A,T,C or G
aagtgattctcttgcctcaacctcccgggtagctgggattacaggcacactccaccacgcccggctgatttttgtgtttttagtagagacgtggtttcaccatgttggccaggctggtctcgaactcctgacctcaggtgacttgcctgcccgcggcctcccaaagtgctgcaattacaggtgtgagccaccatgcccggtccatgtcctgcttcttttaaaacaaccaaaaatagtccagcctaggaaagggagtctttcctgattttggcaaagttaaaccaggccataggtaacacacagcataaggcaggcgttgggagtgggccccagtcgacagggtgccaggactgtgggctaagcagggctggggacatgggaggcctcagtgcctgggctatgggaagtggttgggaccctgagcctgaggtcagtaacatcccaactcctgacaggcaagaaagggcacctgaggctcccaaggggagtccaccatgggggtgggggagaccgctggagtccataggtccctgtgagggacggcgaaggcgggcctgtcacctctaaaagagctgtgcctgtggcgcagacgggggtgccactgtggcctggtgagtgtggctgtagaacaagcatctgttgggctaatggagccagagacatggtccaatgtctctgatgtccagatagacttccagcagccaggtcggactatctggggttctggaacgttccatgggtgaagctgtaggaggagatgctggacttcctgcctccactcacatgagtcactggagcaatacaagaaggcagactggccttggctactcacactggtctcagctctggggtagggctctttataagccttcttgagaagtgaaaaatgcaaagtcctttctgtcccctcaccactgacttgcaaactccagcgaaggcctcacccctcagctggcccagagcctcccagaagccctcccttcgcttcccacctcgccaggcccagccaggctgggtgctgccttggtgggcctaggtgaatcactgacacaccactgatgcctttggggcagaaggcagaggcctcgggagaaatgcgcaggccccagcggcctggtggagggtgcagggggcgcaggggcagccaggaccgccgaggacgctgggggcacgtggcaaactggctaccctgtccacccgtgagcaagacaccactccgggggcgtgggagggtccaagggagggagaaaggaaagtgccaccaaactaatgtggagccctgccctctgcatgcgaaaagggctccacggcctgagtcaccctcagccccacctgcgtgtgcgcgagggtgcgtggcctggtacgcgtgcgcacggtgttggtgagcgtgtgtgtgcgtgtccgcttgaggggaatgtgaccgtcgtgtatgcgtccgcgacagtgcggggggccgcatatcggacccgtgcgtgtgcgtaggggtcgcgtgtggccatgggcacacgggcgtgcacgcacgggggctgcgtatgctatgctggcgtggggggtgcgggcgaggtggccgcggggaggagcggcgccggcacctatcggcccccacgcggcctgcgtggctttttgacccggaaaggcggggacgcggggacgcggggacgcgcggcggcgggggcgcggcggcggcggcgcagagcgaggaggcccgcggggcgcgcggcggggacaggagggaggcggggggcgcccggggccgtccccgccccgcgccgcggcgccgccgttgctaaggccgggcgggcggccgccgggcgctagggcccttagcaacgggtcgcgggcgcgcgcggggggccggcgggcgcgtggggccggcggcgcttgcgggctcctgccgctcccacgcgcgcgggcggcgggggcggggcggcgggcgcgccggggatttccagcgcgcgagaggaagtgcctgcgcggggctgcgtgagggagcgagggagcgagggagcgcggcgcggccgccgcgtgcgcgagccggggttgcagcccagccgggactttccagccggcggcagccgcggcggccgccggctcttccccgccccccgtcatggggcagcccggggagcagaacgctgcggaccgcggcggaggacgcgcccggcgcccctgagccggccgagcggcgacggaccgcgaggtaaggggccgcggcgggcgggcgggcatccggcgcgcggccgggcgcctccatcccggtcgcctccatcccgcgccctgggcggcggggcccgggggcctcggggctgcccggcgcgggcccggcgcggcgcaggcccggcccgtcccagcggcgacggcggggcgcggcttcagcctggccccgcgccccagccgggctgcctcccgcctccggacgcctcaacttcggcaaactttgtcccggaggccgggctcggggcccgagggggccggggcgcccgcacctttttcaggaaacggggcgcgcaggcttcgctacggccgtgacccccgctggcgttgaggacccggcaccccgcggggccgcgggtttcacgcggggggacgggcggctcaggggctgcgtggccgagcgcgctgcccgggccggccgggggggcccgggcgttattggaaagttggtcctgagtcattccgcctcagaggcgcctccgaccgcttggcgggcggcgcgggggtccgggtatgggcagagggcgcgaatccccctcgcgcggccgccgagggccggcgactcccggggcaccgggcggctcctggccgcgggctctgcgtcttccccgcgggcgccaggcggctctcggcgggctggccggttccacgccgccagccagccccgtgtggggacttcggtctagtatttggacccgaggagataattctgtgtggaaaattctctcccttcggttggaaacagtaacaaactggaaacggatgaggtgttatggacgtgcttggaaatgcaagaaaccttcagattacgagccgttgacgggaccagttgtatttcacgtttttcgaattaagctcagaatcagttttcagaatgacatgtgatgcgtggtgcgtggtgtgtgtgcctgtgtgtgtgtgtgtatggatataattcattcatttttgtggcgtcagaaaggttatgtcgagcgttgtagcggcttcttaatttacattcacggcatacaactgaagaggagccattatttattttttttcctagcatttgctgcgactacacactgccggagcgtttggaaatgttgtttgctgttaccctgtatttgtctataaaattcttactgtagggaatggccaagtggaccatcagttcgtcctgagatcttctcatgtctctcacgtctttgaaaatggcctgtgaacagactgcatcatatgtaggatgtctggcaaaatagtgtacagcgttcttttctcaaatgagaggaaatgtgtaccttttcgccgcgttgtgacaatgtaaatgttaagaattagtctaaagatgaaaattctttggccaaaacaagataagccttatcgatatgaaaactggaaaacatcacatgggactggaaatcctgtgagtgggtgctcatgacggaaaccctgacagaccttggattccagcatcgctggtgaaaatcagaccttatcatggataagggttaagatgtaaggtgtctcacccagacgccatctgttccagctgtcaatgcagaagccaggaaaggagagagagctggccagggagaattccagcttttttttttttttgagacattcatgtgaatttctctgcgaggggaaagaagaccaattattttccttggatgctgtcccttcttttggaattaataagatggcttcactcagtgagaggctgtaaagacatttcactggaaacaggcagtaacagtggccagttgtttctgttaataccatcaaaatatccctactcttgtttgtgccttgaagaaagtccttcatttaactgagacatctgagcctgcgttgcggattctgattctctaaatactcctgcaagaatccctttaatttttcactgtgcaactcaagaaggacctttctagggtattgtcaggatacgtatgctaatgatattgtcaggttaggtgagaatgattgatcactcccttaaaatccttttttatgatgttaaagctgtactttaagaaagataaaactgccactgtggcgttgcaagtctgagctagctcaagcaaacaaaggaaattgcgttaaatttgcccaactctattttctcatcttcatatagcaagactctccaaacagcaagtgatctaacctatcaagtattatgcaatagctgaatttccttgcaatggtcagtttaaagaactgttaacttagcagaggcgacgtctcgtggccaaggcccttagggtccactccatggaatcaggaccccttgctgctgctttgcgagtgttcatggaggaagaaaaatcacttggtgttctttttttgcatggaagagtcataataactgacttcagatacagagaaagtgggaagagtgagaaagaaggaggtgaggccagaggatttggaaggctaccagagagaggcagccgaggcctgattgtggaaatgatgcttagacttgctttcagcaggagtgatgaagccagaatgagggaggcccagacgcccgggagaggtacaggggataggtgccatgtggtttgcaccaccgcagcaggctttgggtcccaaagacgcgaatggaaatagaagaaaatgcagttttaaatagaaaagaaaaaaaaaaccgagaaaatgttatgtgtgcttgtgtaaaatttattattcataattaaaatacaaaatggctttctcatttgagaaagcctttattgactaagttctgcacaacactattccaggaaagggggtggggagacagaccaccctagggagaaggcagagttttttactattaagcataataccttttttttttttctttcggtgaagcttattgtcggcctgtacagatgacttggagtaggctggcaggtagtgggatgtcataaatgttgatgcctgttggtttctatcaactttaggaatcaggttggaatcgatgctgcattctgtattcctcgagataagtggattgttaattgggacttgggagtctttttctcatttaattaatattcagttaatgtgccctgagttctcataatgttctggttaccgtgctgggaagagtgagacacagcacccatctgctagggtgtgatttgcagggatataggccatcttggcccctgtgcacagtgaagggacatgccagaaaccagcagatacttgactgagacagaccaggacaggagcttgtggcaggaaggataaggaaaaatgcaaatctaccatcctgccctcagggtgctaacccttcgggggagaatactttctcccaccaggaagaaaccagaaagtaaaaatgtaggatgaaatgaattagtggattgtgtagaattctggaagcgtggtgggaatccaccataagggaaagagaaagtcttctgggaagcggcgttgagttgaggcccagtgtcaggaaagctctggtatagtggggccatctggtccctcttacaggccccctcccactttgttttggtaagatgggatctgacggcttgccatcctgtcactccttgccagtagatgcagtgctggccatgctgctggtcattgggtttccagttgggaagttgcatgtgctggcctttggctcttgccaggcagggccttttgtgactgggagctcatgtgggtcatgcatactgtactgtgaagggcatggtctgtggaggggaacagagcagcaggccctaacctgggtggcaccactttgctgtccctaccatttttcattgcaggttgaaagtctccaaagtggcaggggaaggggtgtaaatgttaaaaagccccttcctagcctggcatgcgcacctgtggtcccagttactccagaggatgaagtgggaggatcattctagtctgggtaacacagtgagatccctggctctaaaataaatttatttatttattttattttatttgaaacaggggctcactctgttgcccacgctggagtgcagtggcccgatctcggcttgctgcaacctccgcctcctgggttcaaatgagtctcctacctcagcctcccgagtagctgggattacaggcgcctgccaccacgcttggctattttttttttttttttttgagacagagtctcactctgtcacccagactgaagtgcagtggcgcgatctcagctcactgcaacctccacctcctggattcaggtgattctcctgcctcagcctcctgagtagctggggaccacaggtgtgtgccaacatacctggctaatttttgtatttttagtagagatggggtttcaccatcttggccaggctggtctcaaactccagacgtcaagtgatccacctgcctcggcctcccaaagtgctgggattacaggtgtgagccactgtgcccagccttcccagctgatttttgtattttttagtagagacagggtttcgccatgttggccagactggtcttgaactcctgacctcaggtgatccacctcagcctcccaaagtgctgggactacaggtgtgtagtcccaccacactcggcctatttgttttttttgagatggagtcttgctctgttgcccaggctggagtgcagtggtgcaatcttggctcactgcagcctctgcctcctgggctcaagcaatgctcctgccttagcctcctaagtagctgggactacaggtgcttgcccccattcccagctaattttgtatttttagtagagagcgggtttcaccctgttggccaagctggtctcaaactcctgacctcaagtgatccacccatctcagcctcccaaagtgctgggattacaggcgtgagccaccgcaccctgtcttggctctaaaatttaaaaaaagtcctttccccaacctactcctctgtcatccatgtttaaatgacctaagtctccttaattcttaagatctgaaaaattgggggccctacatttcatttcacaatttacttttttactacgatttgttccatgctgatttcgagcattaaaaaaaaaaaaaattaaatggaggctatttggtggtaacttctcatgaggccattctaccaagaaagatatggcgacctgctgcttcgacattctgatttcctttccagctgaaacactgattctgtggcagaacccaaaagcgtatttattggaaacttgatttctttaagtggaaagaaaagctaaattgattaaccaagtggggtaatataatctgtaaggcaacagtagcatcaaagtggtgaaatgtgaatctccaggagtcatgagaattgtaatgaaggtttcctgagattaattttgtgttctggaaggttaatgcccgttaggaggcctgcgtacacaaggtaatgaggtgctcgttaggccttccctccttccaccaagggccaggcacatggtaagctctgggtcagtgtttgtgtccagattctgcaagccggggagacaggagggatgtgccagatgcccacagtggttccatgtgtttggaatgtgtgtcggcacttgggtgtgccttgtagctgcctcctttaacggtgtgttcctggaggtcaggcttccatcctcccgttctgataatgcttagctccaggatttgttgcattatgggggttctttgatggaaagtttcatttgacaatgtaattttcttggatgcttttaatgacttaaaagctggaagaacaggaaaactagttctcttgagctctttcatgtccagtaattcccagaaattataactttatgctggaaattaaacctgctatttgaaaccttattacagggtgaattaagagtttaggtttcagaggcttttctgtgtgactttccccttagtgggagggggtttggtatgcccattaagttttatcttaaaatttaatgtgaattttacattgtactcagtaacgtggctgattgttttaatataaacttacttcgttccctaaatctttcaaaactgttgattctccaaaagatgtattgtgtttctggaatcccactgtgtatccctggagctgtccaccccacagctggagaagtgtggcatggtggagggtaccaactttgaggatctgaattccagtctgccctctgtatttagtggtagaatgaccttgggcaggctgcttggccccgctgaattgatgtccctatctataaaatggggctactagcaccagggacatcacttgcttattatgagtaagatggatgggaaagcattgtgcaaatgttaattttcatagtattaggggattgagatgtaacagagtaagaatgttaagatcttacaatgtaaatatcagatcttgttagttagggaccacagaagttttctagttgaggtctcttattttatgtgggaggcagctgaggctctcagtgtttaggtaagtaattctcccaaggcaaataatgacaaagcaagggctcttcacgcaggataggtttttccctgcatttttcctgttcccaacgtttgctcctgggaagatgcttggcctttttttttttttttttttttttttttgaggtggagttttgctcttgcccaggctggagtgcagtggcacgatctcgactcactgcaacctccgccccctgggttcaagctattctcctgccccagcctcctgagtagctgggattacaggcacccgccacctcgcctggctaatttttgtatttttagtagaaacagggtttcaccacgttggccaggctggtcttgaactcctgacttcaggtgatctgcccgcctcggcctcccaaagtgctgggattacaggcgtgaggtactgggcccctctgatgcttggcttctgattccagctagggtcaattgagaattattgaatcacccacactttctttgagaactttctaagtgctaggggctatgctcgttgctaaagctaaaaagtcagataggatgccgtctgatctctgttttcaaggagcttccatgtgatgaatgagccagaagaataatttcattatggcaccatgtagtaggtgccacaacagtggaacagaggctctggtgcattgtggaggcgctgtgcagtttcaacctgggttaggaggaggcgtttcccaaggaggtaactcttagggaagctagcagcaggagtggggaagcctgggctggcagggagtcgcctggcagagggcccgtgagtcggaaggggttctcctgtggctgtccttcaggggagagggtacaggaaaaggcacccggccacttctgggtgctgcctttgtgacagcctaacttctgaggcaggaattctccccattttgcagatgaggaaaaggaagagcaacaggcctgttggaccccagagttcatggtttcaccacagctgaattacagtgcagttttagattttcttcagattctaaacttcttagttttgctttcagagtagacttagttttgctgctgtagagtgctttttaaacaaattgtgtatttttcatgcagcctttcccttccatccaacatctgttttgcctatatggctgatactctaggccgcactccgttccatctctggcgtaagttcctttcttacagcagcctcctcggattcactctcctttgacacatttggatgggaggttctttacgcagtggctcagatgcttcttacagcttgctgagtaacagtccctaacctgatttgctaatgtgttttctttctcctttctctcttaatttacatttaaactggtagtctagtaataatgatagtatttagtcattgtgtcttacagggttttacaaacattagcttgttagtgatgaacaagtccccaaggcctggtcactctgcagagagcataatggttgcaggctagtacctattcatcttgaatttaattataactgcagattgcctgtggaaatatgagttaaaggcatggaagcccttaccactgttagcagggaaatgatgtttggctattttggagaatactttagctcttctgtgagaaccactgtcaaggttttgaacgtgcaaccaggaggggtcagtggtggctgagcagagatgtaggggcttgtttcatggccatttgtacctgctccaggaagggctgtgaataacggaatgcagccagacactgaggccactaggtcaggtccttgggatgacagagggtagatttctttgttcttagacctaagttggcccttgttgggtggaggtggtggcgtgagagccttccctgccttctccaggttgaaggatatttctgtgcatctgggataggtctctagggttgagacgacaagcttctcaagggttggctcacttcattctttctatttctgcagtctggtctatgatgtacacagtaaaaaggagatcagtttatgtatggaaggaattagacctgctttgaattctggtctgtccttcagctaactatgctgttaaattactcttcctttctaagcctcagttttctcatctatgcaaaggtaactgtagagttcacagtcacgtggaaaagcctctgaaacctaaattctccctctggagatggatggtggtgatggtcgcacaacattatgaatgtatttaataccactggactatacacttaaaatgattacaatgataaattttatgtgtaatttaccataataaaaaagtaattgtgagacttaaaagtgagcctgggctgggtgcggaggttcatgcttgtaatcccagcacattgggaagccgaggtgggtggatcacctgaggtcatgagttcgagaccagcctgaacagcatagtgaaaacccatctcacctaaaaatacaaaattagccgggcgtggtggcacatgcctgtaattccagctacttgggatgttgaagcaggataattgcttgaacccgggaggcagaggttgcagtgagccaagatcgtgccattgcactccaccctgggcaacaagagtaaaactgtctaaaaaaaaaacgagcctgtgccaggtgcagtggctcatacctatagtcccagcactttgagaggatgaggcggggggatcgcttgaatccaggagttctcaaccaacctgggcaacatagtgttataagaccttgtctctacaaaaaatttaaaaattagctgggtctggtggcgtgctcctgtagtcccatctaactactcaggaggctgatgcgggaggagtgcttgagcccaggaggtcgaggctacagtgaggtgttactgtgtcaccatacttccgcactttagcctgggtgactcagtgagatcctgtctcaaaacaagaacaagaaaaatcagagcatgtgagagaatataagaacctaatatttcagaagtgatcatttctcttcccctttcctttcctgagtggtttgataaagggaatgacttattagcaatgtggatgacaggctgtcttggaagtatggcctgtccctggaagaaataccggtgggagtagaaggacattattggactgcaaataaattatttataaaaagggtaaaatgtctagaaactgaaatcacagtatatttgcacaaaaggaacatctatagatatctccctttttaaaaagcaattttaacatatgaatttttatatatttaaattcgtattttagcacttttttttctgttatttagcaataataatattcttcaatttgggctgggcgtggtggctcacgcctgtaatcccaacactttgggtggctgaggtgggcgaatcacttgaggtcaggagttcgagaccagcctggccaacatggtaaaaccccatctctactaaaccaaaaaaaaaaaaaaaaaattagctgggtgtggtggcacatgcctgtagtcccagcaacctgggaggctgaggcaggagaatcgcttgaattcgggaggtggaggttgcagtgagccgagatggcgctactgcactgcagcctgggtgacagtgagactgtctcaaacaacaacaaaaacaacaacaacacttcgatttattcaggcctctgttcacattttacctcttcaaaggggtcttctgaacaccctaattaaacagcccatgctgttgctgtggtcacttgccttgctttttttttttttccatagcagaaaatggttttcctttcctttttcttttttttttttttgagatggagtctcccagtcacccaggctggagtgcagtggtgtgatcttggctcactgcaacctatgcgtcccaggttcaagccattctcatgcctcagcctcccgagtagctgggattacaggtatgcaccaccccacctggctaatttttgtatttttttagtagagacagggtttcaccattgttgaccaggctggtctcgaactcctgtgctcaagggatctgcccgcctcagcctcccaaagtgctgggattacaggtgtgagcccccacacccggcctgcagagaatgtatttctattaccttaacctgtgtactaggagtgtgcctggcatatggtaggttctcaagtatttgcataaatgaaccagtatattatagcccaatgttttattgaggcaaaattcacataacatacaattaagcattttaagtgtgcagctcagccgtatttagtgtattcacaatgttctgcaaccaccagctctctctagtttaaaaatcaggccaggcatggtagcccgcacctgtaatttcagcattttgggaggctggggtgggaggatcacttgagtccagtagtttgagaccagcctgggcaacagaggaagactccatctcaacaaaaataaagaattagcttggttgggtgtggtgtctcacgcctgtaatcccagcactttgggaggctgaggcgggcggatcatgaggtcaagagatcaagaccatcctggccaacatggtgaaaccccgtctctactaaaaatagaaaaattagctgggcgtggtggcgcatgcctctagtcccagctactcaggaggctgaggcaggagaatcacttgagcccaggaggcaaaagttgcagtgagctgagatcacgccactgcactccagtctgggagacagagcaagactccatctcaaaacaaaacaaaacaaaacaaaactgggcacagtggcttgagcctgtatgtagtcccacctactccagaggctgaggcaggaggatcgcttgagcccaggaattcgaggctgcagtgacctatgatcacaccactgcactccagcctgaaggacagatggagaacctatctcttaaaaaagaaaaacaacttttcatccccctttacccattaagtaatcactcccattccccaatcctcccatcccttgataacctctaatctgcttttggtctctgtggatttgcctattttagatatagcatctaggaatcatataacttgttttttgtatctggctgctttcacttagcatgatgtttttgaggtacatccaaattgtagcatgtgccagtatttgttcctttttattgctgaatcataatccattgtatgtacatacatgccacaatctgtctattcatttgttcatgggcatttggattattttcactgactattaagaataatgctgctataaacatttgtgtacaagtttctgtgtaggtatgtttttatttcacttgggtatatacctaggagtggaattgctggtcatacggtaatatcgtgtttaacttattcccaccagcagtgttccaatttcaggacatctttgctaaatttattttgttttgttttgtttctttttcatgtcatatgggtaatgtgccgacgtcataacaaggtttcagagtggcacctctcacaccttcatttgaatacccaatcacacttatgaactacaaaaggatatatgtgtgtgtgtgtgtgtgtgtgtgtgtgtggtatgtgtatatgtatgtatatatttttgtttaaagctattctagttaaagtggtatctcgtggtttgggtttgtattttcttgatgagcaaagatattgaatgtcttttcatgtgactcttggccatttgtgtatttttggagggaagacaatgtttgttgagttctttatatattctgaatgttaaactttttttttttcttcttttttttgagaccgagtctccttctgttgcccaggctggagtgcagtggtgcagtggcatgatcttggctcactgcaatctccgcctcctgggttccagcaattctcatgcctcagtctcctgagtaactgggactacaggcacacgccaccatgcctggctaatttttgtatttttagtagagatggggttttgccatgttgcacaggctggtctagaacccctggcctcaagtgatccacccacctcagcctcccaaagtgttgggattataggtgtgagccactgcactcagcctcttctgagttttattgttttagtttttacctttaggtttttgatccatttcagttaattcttgtatatggaatgagataggagtcccaattcattctttgtatgttcttatttagttttcccagcaccatttattgaaaacactattctttccctattgaatcgtcttggcacccttgttaaaaataaattggccatagatgtttgcatttatttctggactctcagttctattctgttgctctgtaagtctgttacatcagtaccacactatattagtctgttctcatgctgctaataaagacatacctgagacagggtaatttataaagaaaaagaggtttaatggactcattgtttcacatggctggggaggcctcacaatcatggtgaaaggcaaagaaggaggaaaggtatgtctcacatggcagcaggcaagagagtctgtgcaggggaactgtgctttataaaaccatcagatcttgtgagacttactatcatgagaacagcacccccacgattcagttacctccccctgggttccttcccataacatgtggggattatatgagctacaattcaatatgagatttggatggggacacagccaaaccatatcacacactgttttgattactgaagctttgtagtaagttttgaagtagtaagtttgggaagtatgagtctcccaactttttcattttctatattgttttgactatttggggccagttgcaactttatatgaatttgaatatcacctttttcatttctgcaaaaaaggtcattggaattttaatagggaggggattgattctgtagattgctttggggggttgcaatcttaacagtattgtcctccaatccatgaacgtgagatgtcttttcttttcttttttttttttttttcgagagggagtctcgctctgttccccaggctggagtgtagtggcacagtctcggctcactgcaacctccgcctcccgggttcatgccattctcctgcctcagcctcccgagtagctgggactacaggcacctgccaccatgcctggctaattttttgtattttttgtagagacggggtttaactgtgttagccaggatggtttcaatctcctgatctcgtgatccacccacctcggcctcccaaagtgctgggattacaggtatgagccaccgcgcccagctgaacttgggatgtcttttcattcaattatgtctcctttaatttctttaagcaatattttgtagtgttagtgtacaaatcattcatctctttggataaatttatttctgggtgctttatttttgtgggttctattgtaaatgaaattattttcttacctttctttttgtattgctcattgctggtatatagaaacaactgatttttgtatgttggtcttatgccctacaaccttgttgaatttattacctctagtagttattttgtgggttctgtgggatttctttatacagaatcatgtcacctgcatatataatttacctcttctttctaatttgaatgccttttatttctttttcttgcctaattgctctggctaagacatttagtaaaattttgaataggagtgatgaaagtgagcatcctcatattgttcctgatcttaggggaagcttttcaccattgattatgaagttagctgtgttttctttctttcctttttttttttgtttttgacacagggtcttgctctgtcacccatgctggagtgcagtagtgcaatcatggctgacttcaacctctgcctcccaggctcaagcgatcctctcacctcagcctcctgagtaggtgggaccaaaggcacatgccacaatgccctgctgtttttttttattttttatttttggtagagatgggtttcgccatgttgcccaggctagtcccaaactcctgagcagtcagcccaccttggcctcccaaagtgctgggattacaggtgcgagccactgtgcctggactttttttttttttttttttttttttttatcagaccaggtctcactcttttgcccaggctggagtacagtgatgtgatcatagctcactgcagtcttgaactcccaggctcaagcagtgctccttctttagcctccccggtagctgggactactataggtgcaagctgccacaccctgctaattttttaatttttgtggagacagggtcttgctgtgttgcccaggttggtctcaaattcctcaccttgagcagttctcctgccttagcctcccaggtagctgggattacaggtgtgcaccaatatgcccagttaattgattttttttttttttttttttttagtgatggggtcttgctgtgttgcctaggctgatctcaaactcctggcctcaagcagacctcctgcctcagactcccaaaatgctgggattacaggtgtgaaccactgtgcctggccactgactttttttttttaatggaaggttgttgagttttgtcaaatgctttttgtgcatcttctgagatgatcatatttttttcattgttctagtaatgtagtgtattgtattgattttgttttgtatgttgaatcacccttgcattcctgggataaatctcactttgtcatggtatataatccttttaatgtgttgttagattgagtttgctactattttgttgaagatttttgtgtctatgttcattaggaatattagtctgtagttttcttttttttttcatttttgagacaaagtcttcctttgtcacccaggctggagtgcagtggtgcgatctcgggtcactgcaacctcagcctccccagtagctgggattacaggcatgcaccatcatgcctggctaatttttgtatttttagtagcgacagggttttgccatgttggccaggctggtctcgaacacgtggtctcatgtgatccacctgccttggcctcccaaaatgctgggatttacaggcatgagccactgcaccctgcctgtagttttctttccttgtgatatttttgacttcggtatctgggaaccaatctttttttgagacagggtcttactctgttgcccaggttggagtgtagtggtacgatcttggctcactgcagccttggcctcctgtgctcaagtggtcctcccacccagctgcctgagtagctggtactacaggcacttgccaccacacccagcaagttttgttcattttttttgtacagatgaggtctcactgtgttgcccaggctggtcttcgactccaggcctcaagtgatcctcttgcctcagcctcccaaagtgctgggattacaggtgtgagccactgctcccagcccccagttgtattttgactgtgcatcatgtttcttcagaattttgaaacctgccctctcctaattgagaaaattctaagagggtttccaagcagacaaccctaacatctctggctgggatgatgatgattgtaccatgtacttcccctcttctcaacacagacacattcatgttgtagtgccagctgtaagcataggagttgcacttaatggcttacagctggggaaaatcatggctgatagcacaccaccagtgcaggatcagggaagggaactctattcctgatgccaggacaggaaagagatgtgcttccttcatttcatgaaaaagccacagattgttccggataatggttgctgaataagaaaccaccctaaacatcagtgatttaaaacagtaatctactactacatctcatggttctgtgggctgatcaagcagggctcagctgggtgattcttctgctccatgtggccttgatggaggtaatttattggtattcatctgttggctggtccagtcatgagggtccaagagggccgtacacacatgcttggatggttggaaggccaggctcaggggatcctccctctccttgtgctctcaggtcctctgcagatggcctttctcctaaggtggttgtgcttcttacatgacaactcagaactcttagagtgagtgttctaggagaggaagtggaagctgccagtctctctctctttcttcttttttttcttttgagatagagtctcactcttttgcccaggctgagtacagtggtaccatcatagctcactgcagcctcaaacgcctgggcagaagtgatcctcccagcccagcctcccaagcagctgggactacaggtgcatgccaccttgcatggctaatttcttagtttttaactttttgtagagacaaggtcttaactacgttgcccaggctggtcttgaactcctgggttcaaacgatcctcccaccttggcctcccaaagtgttgggattacaggcgtgagctactgtgcccagtctggagctgccagtatcttaagcctgggcttggatatcagtgtagcattattcctgccatgttctaaaaagacacagagtcctcctatatttgaggagaggggacatggaccctaactcttgatgaaaggagggtcgaagaatttgtgactgtccttgatctggtatacgcatggtggctagattccatagtgctctcagtaatatatgttagatacccatttgaaaactgttgtggattaaaatggaaatgccaactgttgtgtgttactcattttcagtgagtacattctgtgttctgaatcaataatttctaaaaaacttttggagtatacctattcataaaataattacctctataaaatgtatgtcttatcagcagccatccttgatcatgtgtttgtcaagtttttcaagtacagctttgggtccatacgttttttcttcctattactagttcattttaaaaatttgttgaaaccctcccttttattttaaataatattgtggggttttaatatttctctctgttcttaaaaaaagcttcattgagaaaatataagtaagcctatatatcctaaagttcctttcctttactctagatcattctagtaaatcccctagagacagttctggctgtttatatataaaagtgtggtataatttgacagtgtgtgcagaggtgtgtatggatgtgctctcacatagaaaccctgcctccccagcctgtctcagctgattgttgcaacactgagccgagcaaacatgatgaggtcacagagaagtgagggagtggttttaaataatgaaacaggaaatctctgtctttggctccagtggtgccccagtgttttgggattaatgagggaagagctatgtctgcctgtgttccatgagtgccccttgcttgtacctctatggagaaccccaacaaccctggctggaaagccacctaatcctgtgtttcccaagcataacctccctttgttcccaagtaagtctttcctagacacctgaacttctgtgcaacataggcatgaatgaggagagtgagctactgtggtgttatatatatacacacacatatatacatgatatgtatgcatgatatgtatatatgtgtgtgtgtgtgtgtgtgtgcatagttttcatccattgtttctgactcataagtcccatagcccttgttacagtcttttgttgtaatgttgggtgtcttgcctcctttcagctgcccaaggcaggactctaatctgactgtgagtcagaagacccttattccagagagggccctgcctcattccctagaggcaggaatgctgcacagagaggccaagataagtccgaacagacaggccttgctgggtttagatcatggttttttgtccagaaacatttctagatgattgtaagtcatgcctgtgtaatgaagccaccataaaaactcaaggacaggccgggcatggttgctcacgcctgtaatcccagcactttgggaggctgaggcgggcggatcacctgaggtcaggagtttgagaccagcctggtcaacatggtgaaaccccatctctactaaaaatacaaaaattagccgggtgtggtgtcgggtgcctgtaatcccagctacttgggaggctgaggcaggagaattgcttgaacccgggaggtggaggttgcagtgagccgagttgcaccattgcattcccacctgggtgacacagcaagactgtctcaaaaacaaacaaacaaacactcaaggacagcgttcaagagcttccaaatggcggaacacgtggaggtttctgaggatggcccgagggagggcatggaggctcccgcctggcctcatacctcgccctttgcgtcccttcatctgtgtcttctgcagtatcctctacgatataccggtaactgtaagtacatatttccctgagtcctgtgagccactctggcaaattaatcgaatccaaagagggcttgtgggaaccccaacttgaagctggtgggtcagaagttctagaggcctggacttgcgactagtgtctgaagtggggatggggggtggacagccttggcgactgaaccgccaacagctttgttcacgcaattcttctgcattggcgattgttgtcaggttgtgagagcaggggaaaaacacaggttgagagagtttttccccaaacagcccctggtcgatgccccggaatgactggctgctgcatggaattgcagaggcctgagtgcctctgcttctaccgtgattcctgaggccaagacctctggtctgcatggtctgaagtctcttacgaaggtaaaatgttatgtatatattttgaataagggtacctgttcctcattctgtccttttgaattccaaaagtgtgttggcctgtgagatagcataagggacagaatcattgctctcgtgagcctttgggcttgcttccttaggcactacgtactttctcattccccattgccttcaggattctttctgtcagaatgtagtggctgtggcctgggggtgaccagcataggggccaaagaagggtaatgagtcttgaggcctacagagggtagtaggcaaggcgggagggcaagggccagggggcagcatcattcacacagttgaaaacgtgcccttggcctgtctcctctctgtgttctgcatcttagaaaatagatattgtcttgtgttaagatgaatcaatatagttacccctttttatattgtcttaagcttcttaggaactgctttgtattttagtcactcaggcttggagtgaaacatgtaatgtgtagttcaacctgaaaaaattggtctgagaggcgtcttcatagagtccccaattctatatatgatgaggtctcatcaagctttgacattctgctcttttacgtgtaacactactaatgtaaatgtttctggattgtaaagaatggtgggaagcgtagagattatctgttggtaagccagaggcaggaggaagaggaggaggaggaggagatagtggcgtccctcctgcagaaaccccgcagtggaaggacaagattgcaggaggagttagagaccagtggtctagtccccatctgtctttgtgaccttaggcaaatcattgaatctctttgaaagccttgtctccttgcatggcatatggagattatagttgctgtgaaaataaaataatcagcttttaaaaatccataaaaatgaaaaatggtatttaaggttgaaggcacttgtatttctttttctttcttttttttttttttgagatgtagttttgctcttgtcacccaggctggaggtgcagtggcgtgatcttggctcaccgcaacctccgccacccaggttcaagcgattctcccgcctcagcttcccgagtagctgggattacaggtttgcaccaccacgcctggctaagtttgtatttttagtagagacagggtttcaccatgttggtcaggctggtctccaactcctgacctcaggtgatctacctgcctcggcctctcagagtgctgggattacaggtgtgagccaccacgcccagcctaggcactcgtatttcttagtcgggaaagagaggacaggatatgtccaccacacattcaccagttcagcatgtattaactactgtgtgcctgactaagcttaggtactcagtgtattttcatgtaaagaaaaacaacatttaaaacatttaagtgagcactgaccaaatctagcttagttcagaaaaccctttttttttttttgagactgggtcttgctctgttgcccaggttggagtgcagtggtgcgatcacagctcactgtagcctcgacctctcagtctcaagtgatcctcactttctaagtttccaacattttttgggccaggtacggtagctcacacctgcaatcccagcactttgggaggcaaaggtgagcagattgcttgagttcaggagtttgagaccagcctgggctttatggagacctcatctctataaaacaaatataaaaactagccaggtgtggtggcgtgtgccattagttccagctcctcaggaggctgaggtaggaggacagcttgaatctgggaggcagaggttgtggtgagctgagatcgcaccactgcactccagtctgggcgacagagcgagaccctgtctcaaaaacaaaattttttttgtagagatggggcctctatgttgcccaggctggtctcaaattcctaggttcaggtgatcctcctgattcggcctcccaaatggccgggattataggcatgaccactgtacccggcctcagcagacctttgtaaagcacttcatgggtgccagtcctgctgttacagtgctaggtaaatgcataaaaatgctccatgaggcattctgtgttctcaggaaattcagactgccagtttcagtctggaacgtgacactttatgaaggaggcaatagaacaaaaaaaggacaaattacaggattagtaattatcaaaagctaataccgaggtcagaataggactcttgttcagtttacatgaggaatttaaccaaacgagcttctgcagagaaccagcattagggtggtgaccaggctggggtacatacatgtcatatcagaagtgacctgagactgggtgtgagaagcagtggctgatttggactactgaaagcagaattaagagtctggtggcattggggggagattagtgctgtggaagtcctgctcagagtctttctcatgatgggtacatttgggaggagcttagcagacatcagaggacctgcagagagttgacacagcgggaggaaccagctgcactaccactcatgttcttttccatcttagcatctcgtgagcataattcagaatacacagtttgattaagtatgtgcagattccattcagttcatgaattcattcccacagtgtagcctagcccaagtgttagcacttctttacttgtttttgttgttgttgttgtttgtttttttgagacggagtttcactctgtcgcccaggctggagtgcaatggtgcgatctctgctcgctgcaacctccgtctcccagattcaggcagttcttctgccccagcctcctgtgtagctgggactacaggcacatgccaccatacctggctaatttttgtatttttagtagagatggggtttcaccatgttggtcaggctggtcttgaactcttgccctcaaaggacctgcgtgccttggcatctcaagtgctggaattacaggctgagccactgctcttggccaagcacttcttttctcatagtcttctgctaagtatttccttctgtcagctgccaggcagcaatagttttcacatttgtttgtggttgtcctctagaacttggcctttagtgtggtatgtgtaggattttgttgattccaagggagggtgaaaaatgctgtgatccccagaacctgggatggctggggtatgttgtctctgaggaatttaataacattttgtggtcattgctggaatcttcctagactcctttgatggaaagtagggactccaaggggaactcctgactgggcttgcgggctgccttctcagagccctactttattagtgatttatttctcttaatgggctattagaaatgaccacaaaaactgaggcccccacccatacaatttctatcagttaagaccctggaaattcagatttagagggaatttttaaagaactcctgggagtgctgatgccctgctggactgggagcctctggtccagtggaagcagcacattccctccaggagccccagtgctttaggaatgcagtttcccaggccctgcctcagacctgccgactcacagtcagctctcagagaggctgttaggtgatcattgcgttcatttaagtgtgagaagcaccgtgcaggctttgggtgagagagtcggggttcataccttgcctctcttctttcccagctgcatgaacttgaccaagttatttggcctttctgaaccaggaccgtagcacataaagtgagtgcgatggtgcaggccccagttcctcagccacagtgctgaaaccccagagcctctgaaaatggaatgttttttcatagatttggtgccacttggcctgaacttatgtgaggctatttataatctctattccacttaatatgaatatttcattattttaccacagatggttaattaacatgtttcctgttcttttccttttttttttttttttttttgagaagactcttgctctgttgcccaggctagaatcagtggtgtgatcaaagctctctgcagccttgaacttctgatctcaagagatcttcccacctcagcctctcaagtagcgaggactacaggcttgtgccgccacacccagctgattttttaatttaaattttgtaaagaaagggttctggccgggcgcggtggctcacacctgtaatcccagcactttgggaggccaaggcgggcggatcacgaggtcaggagatcgagaccacggtgaaaccccgtctctactaaaaatacaaaaaattagccgggcgcagtggcgggcgcctgtagtcccagctactcgggaggccgaggcaggagaatggcgtaaacccggaaggcggagcttgcagtgagcggagatcgcgccacggcactcccgcctgggcgacagaacgagactccgtgtcttctcactttgttacctaggctagtctcagactcctagactcaagtgatcctcccacctcggcctcccaaagtgctgggattacagtcaagagccaccacacccggtgaattaatgtgttttcttatggttactgcctcagacttccctggagtgttatataatatataatatataaaatatgcgtacaatatttcctttctaaaattcaaaaaattctgaactctgaaacacatctggcctcggttttggataaggattgtggtgctatagatacccagcttataggtgggtcagtatatgccatgttagtgtgttggtatgtgtagaaaactcttggcagttagcaggcacccaacaaatgcagctatttttgtttgtttgttttgagacagtgtctcactctgtcacccaggctgaggtgcagtagtacaatcacagctcactgcagcctcgatttcctgggttcaagtgatccgcccatgtcagcttcccaagtagctgggaccacgagtatgagccaccacacctgcttaatttaaaaaaaatttttaattaaaaaaattttttttggtctgctgcagtggctcacatctgtaatcccagcgctttgggaggccgaggcgggcagatcacaaggtcaggagatggagaccatcctggctaacacagtgaaaccccgtctactaaaaatacaaaaaattagccgggcgtggtggcgggcgcctgtagtcccagctactcaggaggctgaggcaggagaatggcgtgaacccgggaggcggagcttgcagtgagccgagatcatgccactgcactccagcctgggcgacagagcgagactccatctcaaaaaaaaaaaaaaattttttttttttgagacggagtctcactatgttgcccattctggtcttgaactcctagtggtcgtcccaccttggcctcccaaagtgctgggattgcaggcatgagccattgcacctggactcattttttttttttttttttgagatggagtctttttctgtcgcccaggctggaggtgcagtggcgtgatcttggctcactgcaacctccgcctcccgggttcacgccattctcctgcctcagcctcccgagtagttgggactgcaggcgcccgccaccatgcctggctaattttttgtatttttagtagagatggggtttcactatgttagccaggatggtctcaatctcctgacctcgtgatctgcccgcctcggcctcccaaagtgctgggattacaggcgtgagccaccacgcccagccaactgtttaaagacatttcaagccaagagcagaagttgtgttagaaggtggctgtattagtccaatttcacgctgctatgaaaaaatacctgaggctgggcgcggtggctcacgcctgtaatcccagcactttgggaggtcgaggtgggaggatcatgaggtcaggagttcaagaccagcctggccaagatggtgaaactccatctctactaaaaatacaaaaaaattagccgggtgtgtggcgggcgcctgtaatcccagctactcaggaggctgaggcaggagaattgcttgaacttgggaggcggaagtttcagtgagccgagatcgtgccactgcactctagcctgggcaaccgagcaagactctgtctcaaaaaaaagaaatactcgagactgagtaatttattaatataaagaaaagaggtttaattgactcacagttcagcatggctggggaggcctcaggaaacttacaatcatggtggaaggggaagcaaacacatccttcacatggtggcagcaaggagaagtgcagagcaaagggggaaaagccccttgtaaaaccatcagatctcgtgagaactcactgtcacaagaacaggatggtggaaactgcccccatgattcaattacctccccccaggtccctcccatgacacatggagattatgggaactacaattcaaaatgagatttgggtagagacacagccctatcagtggcttacgctcctggcttggcctcctggcaggctttttatagagggagtgggatccttgctggttatgaaggacttgtgttccttagagttacagtcttggaatgtcagccctcagcttcttgtttttcttttcacccagatggtgcacataaggaggcagcgtgaggtggggtggtggctaagggcgtgagtgctggtggcaggctgcctggtctgagtgaccctgggtcttgggcagttaccttccgtgtgtctcagttcttttacctagaaataaggataatggtacttaccccctggagtgtgagatggaaagcatttagcataggtaagctcagtaaaatttagcagttttagttatctaggactataatggaggttaagttggccagaagtataattttttttttttttttaagagacagggtctcgctctgttgctttggctggactcaagctcctgggctcaactgatcctcctgcttcagcctcctgagtagctgggtgtgcaccctgcacccagccagaagtggaatatcttgttggggctgggcttagagctggagctggtggccggctctgctcgcttacagaattctgtacggtttctgatttctctcagcccatctgtccttcacttgcaagcatctgatgactgctgcatgtaccataaaaacatgcaaatatataattcttggctttgaggaggtgaccctatgaaattgacttaaaaaagttgggctggatatagtggctggcgcctgtaatcccagcactttgagaggctcaggccggagggtcgcttgagcccaggagtttgataccctgtctgagagagaattagctgggcatgttagtgtgcgcctgtggtcccagctactcaggaggcggggcgagagggatccttccaggctgagatgtgagggttctttgagcccaggaggtccatactgcagtgagccatgattgggccactgcattctagcctcagtgacagagtgagactgtttaaaaaaaaaaacaaaaaaaacttcagaggagtcatatgattgacttgtgtgtgtctacgcagactcccttttctctgtagagacttacaatcttcagttctctggagcgttcttcagattcccttgctccatgactgaccttggctaggaaaataattgggccgtttttggtgcacagcagatgaaaattatcagtatgtccctagctttccactgtgaggccgccgtagcaacagaggacagtggatgtgtgacttgtaccctttcagagggccaagaacgcaatatcctaaagcagccttttctttttttattttttgagtcagggtctcactctgttgcccaggctggaatgtaatggcatgatctcagctcacaggagcatcaacctcctgggctcaagtgatcctcccacctcagcctcccaagtagctggaactacaggtgcaagccaccacactggataatttttgtattttttgtagcgacagggttttgctatatcgcccaggctggtcttgaactcctggcctcaagtaatcatcctgccccagcatcccaaagtgctgggactacaggcatgagacatcacacctaaccctgttcttgatacctggtttttgtggtcctttttttctaaaattcatatgaattttgagttctgctgtatgatatgtaatatatatgttctaatattacaaacttctaaaaatctttctgtgcaccaaaattgatcctccaggacagaaaaaatgccagtggttcttgtctataccaccatattttgaggaacacaaggaaagattttgaccttccctggacgtagaagaatttgtattgtgattgacacatctttaatgccttaattacttgccttcagttttctttccttttggtgcttaagggagtatttgttctccatgcatatttggtaccctttggtttagataatttagataattagcaactagttttggtctcattatcagacattttactctggacaccccatcaccagtcccatcatgggggagtttggaggccaggagattcactggatgcttcttttctagtgtgtgctcttcttagatgggaaggaaaaaggtaaaacctcaaaaactctgtggtaaactgatgtgggaatctgatactaaaaatgtcccaagtgatttaaagtgtgtaagaattactcacttttctgtggagagcgatgtgcataaagacagtgacaagtggaagaagatatccagatgagaccctcactgccctcggtgagtggattgcaggatgctgggagcccccttgcgtagagactcaccgctggactccaagccctctgtggcttctgctgtggctgagtcatcgctgcccaagactactgttgggttctcctccctgctggtgagcagtgaggcaccagggagcccctgcctgcagccagctcggtgattccatgcagttttacatagggaaagaatgctctacctggctacgttttcctgtgtcctgttgaaatgaagaggttagtcatgcattccctcagctagagcgtgaggcagtccttccgaagattgtccaatttagacccagactcttcaaaggaaatgtcagcatgttttgatgtcatggttcaaaacctcactgggatggtttgtgtgagtacatacctgttttacttttagtttcactagaggatgtcatttggactagttgtttttaagtgaacatttcaaacttaactaaatttgattcctgtttccttggttgtagttacatggaaagaccactgggtctgggacagtggttctcatccagagatggagttggtggggtgggggtggggtgcagtttcgtaccctagggggcattttgcagtgtctggaaaccttcagaagtggggtgggggatgccactggcattggtaagtagaacgagggatgctgtgaacaccctgcagtgctcagcatatccctacagcaaagagttttcgggttcaaaatgttagttgcgccaaggttgagaaaccgtggcttggaaattgttcattcaccatactcttcttgatttctagtgaatgtatgactgttaagattttatgttttcataaggtgaggtactttctacagaaattcagtctctttagtcattaaacagcagagggcacttggaggctagagtgcccagaagtccatcaagccagtctggataaacccttcccaacatgccataatttacatcaaaactttggttagcagaatgggaatttttgagtagataccattagaaaaataaaataattttccagctgtggttcccaagttccccaaacttatgtctttagtccaagctgccccttgagcttcagcttcggacctgcatatttatttaacagctattgagtccttggtatgtgccgggcaccctcctgtgtaccagggcatggcaggaaatgatatgggcagctccctgtagtcatgaggcctgtgttctaaggcagaccttgaagacagggaagtccatgtgctgattccagaagaatagagggggcctggcagggctggggggaggtcaagagtggagtgcttcatacagctggtctcagaggggctcattgtcccggacctgcaggacaaggaggcgttttgtccacaaaccttgagagtgagtgaatggggcatgactggggccactgggtgttattgcttgaatgacacctaacctgtctctagtgaagctcttgattcctccctacccccatccagatgctagaagactggggagcatttcttggtccctcttctctcacaatctgtcgttggtgctcacttctgcaccctgttttcccacgtccctggtccccagcccaggcaagccttctgctgatgccggtggccccaacttgtctatccacttcaccccagttttctccaggcctttctccatgctgctgtcagagagatctaaacataggtggcctcctgcccttccctgaaaaccctttacggcctctgactgcattcagtgcaccctgcattcctcctgataaggtcttgcgtctccctgctgccccagcttcagccccaggagcctgcctgcccaggaggccatcattgttccccctggacactgcctgtcctgcctgctgccttgtcctcctttctccaggggcctggggcctcagtctctccatgcctgcacctggagtcctgttgcctgtgtcctacagtttcctcctcagccatccccacagggctgtgtccctttctactagccatgtttattttcttgtggagatggggtcttgctatgctgcccaggccggtcttggtctcctggcctcaagcagtcctcttgctttggccatctttagatgataactcactcacctgtgctgcctttcacttggaggatgggtggatgattcacagggacctgccctccttcccgcagagttggggtttttgtgtaggggatttttctgtcagttattttttcctcacctttcagagtattaaaagaactaagccattagtggtgaggcatgagggcagcgaccacagctccaggggagctctcttatccctacagctggcaaatgttccaccctgtttttatggcacacagaaaggtaggcgcatagtgatgttgttagtaagcttttgaagtagagcatggtgagttagttggcctttttacgaaaaaggaaatggaaaactagcaccatggccttggcataattactccaacatgcaaatcagtactggaaggaagttgaggcagcatacctctatgctccactagtccttaagacacgtctgaaagaaatgaaattttattttgttagaggtgaaggaatgcatggatggaatgcatggtccaggtgtttataactgtgcatttatttggcggttgttttggatggacaggaagtgggaggggagggcacagagagtcactttggccacgtccctggtttgccacaggctgatactggagcattcctaagtttcgcaatggagatgggtgtgaaagaagaacacactaggccaggtgcggtggctcacacctgtaatcccagcactttgggaggctgagacaggcgaatcacctgaggtcaggagtttgagactagcctggccaagatggtgaaaccccacctttactacaaatacaaaaattagccgggtgtggtggcacatgcctgtaatcttagctactcaggaggctgaggcaggagaattgcttgaacccaggaggcagaggttgaagtgagccgagattgtgccactgcactccagcctgggcaacagagcgagactccatctcaaaaaaaaaaaaaaagaaaagaagaaccatactagtcaggtgctagagggcttccaaggcagcctccaagggaaggaaatgtctgagaagttatttaagaggatttgttggaacagaaaaacttccaaattggtctagaaggtggaccctagctatagacgcattttacaggacataatgtaaatattaaaggcacattttcagtatttggggaaaatatgtcctctgagtcgaatgaccaatggctgtttctagaaaaattttagttgtagttttaatttgattgtcttgagcatggtgatagattgactttttttttttttaagacagtcttacgctgttgcccaggctgcagtgcagtggcacgatctcagctcactgcagcctccacctcttgggttcaagtgattctcctgcctcagcctcccgagcagctgggattacaggtgcgcgccatcacacccagctaatatttatttatttatttattttgagatggcgtctcgctctgtcacccaggctggagtgcagtggcgcgatccctgcttactgcagcttctgcctcccaggttcgagagattctcctgcctcagcctcccaagtagctgggactacaggtgcgtgccactacacgcggctaattttttgtatttttagtaaagactgggtttcactgtgttagccaggatggtcttaatctcctgacctcgtgatctgcctgccttggcctctcaaagtgctgggattacaggcatgagccactgtgcctggccgcacccggctaatttttgtatttttagtagagacggggtttcaccagttggccaggctggtctgaaactcctcacctcaggtgatctgcctgcttcagcctcccaaagtgctgagattacaggcgtgagccaccgcgcctggcctagagtgactttcttaaagctctgtgtctcctggaaatggaatgtatcccaaatgaggattatttttaagctttataataaaatctttcacagcatagacttttttttttttttttttttgagacggagtcttgctctgttgcccaggctggagttcaggggcgcaatctcggctcactgcaagcgccgcctcccaggttcatgctattctcctgtctgtctcctgagtagctgggaccacaggcgctcgccaccacacccggctaattttttgtatttttagtagagatggggtttcaccatgttagccaggatggtctcaatctcctgacctcgtgatctgcccgcctcggcctcctaaagtgctgggattacaggcatgagccaccgcgcttggcccacagcatagacttttaaagaccatgtaggcaagaacagatctttaaagggaaacctcagtttggcttttgaaagttcatctgattgaagttaaactgatgaaacatactccatccatgcattaccaaaaacgttggagcacggcatggcagtagtatctaaaacagattggcaaactatgggtctaagaatagtttttatgtgtttaaaggattgtaaaaataagcaaagaagaatatgtgacccatgaaacataaaatagttactgtctggctctttatgggaaaaaagtttgccaactcttggcttaaagggtcaagaatgctttaccaaaaaacaaacaaccccctcccccctacaactgtaatgtttgagcaggagttttacaagataaagaattttgatcttgaggggatttgggtgaggatggggcggtgcagtgggagagagagtatagatactgttcatcacacccagtgcagtcggctctggtgggaacatagggtgacctcagtgtgtggtgaggacagtgatcatggccccttttacaagttgaagcttagttctggagtggtggaccatcagaagcttttaagtaggagaatgtcaatgtcataaattagagttaattgtgagaaattgaaataagtattccatttttttctgagatgtgctctcctgaacttataaagtagttcttcagaagtgtttgcagtgttcacaagacactggctctgtggtatttgacatgcagatgggcccagaattcctgacttaaggctaaagatttatcttgagcttatcatgatgtgggcttatgattgttttgatcagcagctgacatctgtgaagcctcagtgatcctataaattgaggaacctgagagaatcaagagaaagacaacaattcttgctgatgtcagtaactgtatttcacctgttaaacttctgcatggaggaggtcagtgttgtctgctgtgtcagcatcagcctacctgggtgtggacgtattctttgggagatgaaacgtagaaaaggtaccccgagtccattacacattctggattcccagaaataagacatctctgagggcagaacctttacagtcacttacatcaagaaggaattcttcaggagaaagctcggtaaaggtatcttaactttgtatgtatacccagagaaaacacataaagataaaaataaaataattttcctcattatccccacaccattagcatcttggtgtatagtctttgcatcttttttcagtatgtatgcacttagatcatcttgtaggacgccagtcccatgcattatacactttgtatctcacagtggagtggaggacagcctgatccttaaggggatgccgaattgctgcatccccatgatttttgctgctttgattcttctcatgagccccgttgctgctgtctgtattagcgtccttctgagcaaacaatgggtacctttttttttttttttcttaagagagagtcttgctatgttgcctcaggcgggagtgcagtggctattcacaggtgctgtcgtactgccctggatgatagtacactgcagccatgaagtcctgggcttaagcagttttcgcctcagcctcctgagtagctgggacattaggcccgtgccgccatgcctggctcttgaccattcccacaagccacacctacaaggagctcaaggagctgtttgcgctgtaggcggtttttttttttttttttttttttttggtttttgtttgtttttgtgcagaggtcagatctcttgtctcatagtgcaaaggcgatgaaggccttcattacagtctctcaatttgactctcagtttgatcggaagttgctaagatgggctgacattgtgaggaggatactgctacagcagtagtgtgtgtgtgtgtgtgtgtgtgtgtgtgtgtgtttgtacagactgtctcactctgccacccaggctggagtgcagtggtgcagtcataacttactgtaaccttgaactcgtgggctcaagtgatcctcctgcctcagcctcccgagtagctaggactgtaggcttgtgccaccatgcctggcccttttttttttttttttttttttttttttttgtacagacagggtcttgctgtgttgctaaggctggtctcaaactcctggcctcaagtggtcttcctgcttcagcctcccaaaacactggtattacaggagtgagccagagcacctggcctgaagctatatattattgttaactgcagtcatccgacagtgctatagaacactagactctgttcctgtctagctctctccccatttttcccatcctcctacccttcctaacctctagtatcctgtgtttacttttgacttctgtgagatcaactttttttagcttccacatgtattagtgagaacatgtggtgtttaactttctgtttttggcttatctcacttaatatagtgtcctccacttctatccatgttgctgtgaacgacaggatttcattcatttttatggctaaatagtagtccattttgtatagataccacattttcttcatctgttgttggacacctagattgattccctgtttggctattgtgaatagtgctacggtaaatatggggtatagatgtctctttgatgtcatgatttcctttcctttggataaattcccagtagtgggattgctggatcatatggtagttctatttgtagcttttgaggaaattccatactgctctccatagtggctgtactagtttacattcctaccaatagtgtgtaagagttgccttttctcaggccgggcgtggtggctcacgcctgtaatcccagcactttgggaggccgaggggggcggatcacgaggtcaggagatcgagaccatcttggctaacacggtgaaaccctgtctttactaaaaatacgaaaaattagccgggcacggtggcgggcgcctgtaatcccagctactcaggaggctgaggcaggagaatggcgtgaacccaggaggcggagcttgcagtgagccgagatagcgccactgcagtccggcctgggcgaaagagcgagactccgtctcaaaaaaaaaaaagttgccttttctctgcatcctggacagtatttgttattatttatttgtttatttatttagttttgaggtggagtctcgctctgtcgccaggttggagtgcaatggcacaatctcggctcaccacaatctccgcctcccaggttcaagcaattttcctgcctcagcctcccgagtagctgggattataggcatgtgccaccacgcctggctaattttgtatttttagtagagacggggtttctccatgttgatcaggctggtctcgaactcctgacctcagataatccgcccgcctcagcctcccaaagtgctgggattacaggtttgagccactgtgcctggcctgtatttttgataatagccattctaactggggtgagatgatacctcattgtggttttgttttgcatttccttgatgattagtgatactgagcattttttatgtatttggccatttgtatgtcttttgagaaatgtctgttcaggtaatccccctgccccggcttttttcttttcttttcttttcttttttttttgagacggagtctcactctgtcacccaggctggagtgcagtggtgtgatcttggctcactgcaaacctcccacctccaaaggttcaagtgattctcctgcctcaacctcttgagtagctgggactacaggcgcacaccaccacgacctgctaatttttgtatttttaatagagatgggagtttgccatgttggccaggctggtcttgaactcctgacctcagttgatccacccgcctcggcctcccaaagtgccaggattacaggcgtgagccacccacctggccaatttgcccattttttaattggattttttttttttgctgttgagatgtgtgagttccttgtatatcaatcccctgttggatgaatagttcgcaaatactttctcccattctgtaggttggcttttcattctattgtttcctttgttttgctgaagctttttagcttgatataatcccattcatttatgtttgcttttgttgtccgtgcttttcagttactcatcaaatcttttcccagaccaatgtgatgaagcatttcccctatgttttgtagtagttttatcatttgggtcttatatttaggtctttgattcatttttagttcatttttgtataggatgagaggtggaggtctagtttctattttcactcttctgcatatggatatttaattttcacagcaccatttgttgaagagactgtcctttccccaatgaatgttcttggcgcctttgtcaaaaatcagttggctgtagatatgcaggttaattcctgggttttctattcttttccattggtctgtgtatctgtttttatagacacataccagttgttttatagaccagtaccatgtcgttttgcttactacagctttgtagtatattttaaggtttggtagtgtgatacctccagctctgttcttcttgctcagcattgctttggctatttggggtcttttgcagtttcatacaaattttaggatattttttctatttctgtgaacaatgtcattggtattttgatggagattgctcttttaattatcttgatttctttttttcccccccaagacagggtctcacttcgttatctaggctggagtgcagtggcatgatacagctcagtgcagccttgacctcctggacttaggtgatcctcccacctcagcctcctgaatagctgggactgcaggcacatgccaccacatctggctaattttttgtacttttttttgtagagacggggttttgccatgttgcccaggctggtctcgagctcctgagctcaagcggtccacccacctcagcctcccaaagtgctgggattacaggcatacaccactgcacctggcctcttttcaatttcttgatggtgttctttgatgtacaaaagtttttaactttaaatgaagtccagtttatctactttttctttggcttattgtgcttttggtatccttttcttttcttttctttctttttctgagacagaatctcgcactgttggccaggctgtagtgcagtggcacaatcgtggctcactgtagcctcgacctctagagctcaagggagcctactgccttagcctcctgagtagctagggctacaggcggtaccattatgcctggttaattttttaaattattttttgtagagacagagttttactatgttgcccgggctggtctcaaactgctgggctcaagcagttctcctgcttcagcctcctaaagtgttgggattacagatgtgagccactgttcctggcttggagtcatttctaagaaaccattgcctaatccaaggtcgtgaagatttacatctttcttctaagaattatatagttttagttcttttctgctgtgatcatgtgtgtatgtgttggttttttatttttatttttttgagactgggtcttgctgtattgccaggctggagtgcagtgcttatccatagccatgatcatagtgtactgcagccttgaacacttgggctcaagtgatctttctgccttagcttcccaggtagttaggactacagtgcataccactgtgcctggcttattgtgtgatctattttgagtcaatttttgtggtgtgagataggggtccagtttcattcttttacatgtgtatatttacattttgtagttcatttgttgaagggactacttgtattagtctgttctcatactgctataaagaaattccccagactgggtagtttttaaaggaaagaggtttaattgattcacagttctacatgtctggggaggcctcaggaaacttacaatcaaggcagacggggaagcaggcacgtcttacatggcagcaggcaagaaggagcgtgtgtgagtgcaggaaaaactaccatttataaaaccatcagatctggtgataattcactcactgtcatgagaacagcctggggacaccaccactataatccaatcacttccttcccttgacacatggggattacaattcgagatgagatttgggtggacacagagccaaaccgtattactattctttctccattgaatggtcttggtgcccttatcaaaaatgtattttccataaaaaaacaccaattgaccataaatataagggcttatttctggactctaaattctatttttttttttttaagaaacagggtctcactctgttgcccaggcaggagtgtagtgatgccatctcagttctcttcaacctccgcctcctgggctcaggtgatcctctcacctcagccccccaagtagctgggactacgagcacatgccaccaccctcggctaatttttgtattttttgtagagatggggttttaccatgttggccaggctggtctcgaactcctgagctcaagcagtccaccctcctcagcctcccaaagtgctacgattacatgcattagctaccatacaccgattgtacaggccacaggctagccccacacaccagattttgaagattaagtgtggtttaaaaaaatgcaaaatatcctgttaataatttttgataatattacatgttgaaatgataaagtttaatgttgtgttaaataatacacagtaaattttactgacttctttttactctttaattgtagctgctaggagatttaaaattatttttgtgattctcgtatttctgttggaccagaggtattttttaatagcatgacattctgttacatggttgattatataatgatcatatgattgtggcagtttcttgattcgattctctgttgttggacacttaggttgtttccagtcttctctgttttccacggtgctgtgatgactgacactgtggatgggtagtcatgcactcctgtgcccgctgccaggaaagagctcataaggaggacctgggaagcatttgctgcacttctgaatctagcgcatgcagactcgaccctgtgggtcgagctttggtgagaagtggttggatttggaacgtatcttgaagacgaagctgactgtctttgctgatggattggatgtatggcatgtgaggaagggggtcctttatgatctaaggaattggatggtgccatttcctgagccaggcattgccagaggcagatcagagaggaacgggtaccaagggctcagtgttggacctgttaggtttgagatgcctttttgatgctcaagtggagatgttgagttggttattggatatacaggtctgggggaattacagggaaaggggtgctggagatatatttgagaattatgaaaagctgtttgagcatcaagcaggatgggtgagacttgaccactggattttgcaacttgaaggtctttggggacttggacaagactggtgtcaggaggcatgacaagtggaagttttcaggggagaatgggatgtgtgtgttaacagcttcttgaaagagttttctctaaagtagaatgatgggggagtgggggtgctggggacacattagcacttaccgtgctctggaaggcagggtgttcaggagggaggttgacagaggagggcctgggatccagtgccagagtagagggtggaccttgcccatgggatctggagggagggcagagtagacaggcaggccttcctttcagcagtgggaggaggagaaaataccagcttgcccctttccaaaagctgagagtaagggtgacaagggggaaagaggtattataggtatgctatggagttaaaggtaaagtttgcatgaatttcgaatacaaaatgtaatacttcatatccattgagttgcttcaaagtgcttatcctcagggttctctctcctgtgcctttgggggtactttggtgaaaaagtttgagaagccacttcattattgtagtctattgttacgttgttaagtctcacccaagtgagtatttaaccttaaagagtttgagattcacttgcctattttgttatccataatagagcttttgcagctgctccaaatatccctccatttgtgcatcttaatagttgtttggcaatcaccttattctgcactgggaaggctggagaggggtggggagctgcggggtgtctggaggcagtatggcgagctcgagattcccaccctttcagagatgaggtggtggaggcaggcagggcctactaggcttctgaagcaacactcgccagggacattttagtgaccttttccccgtgttctcaaaacactttacaaatacaccatttgtctttaattctggcagggtggtttgggtgagctgggggtagtgctgttagccaaccttttacaatatttaacaatcagtagagattaaaagctgtttggcctctttcccattgatcacatagcctttttctttttgtacaattttagtatgattaaccctcccacccccattaaagttcttcagccttcttagtagaaagctctgtgaagtttgattcacccacggaagttacttcatggagtggaagcatttgagaaatcagatcttggctttcttcttgtggacagatcaggtggctgaggcctggagggagcttgatttgagatgagtagtttgtatgcctgactaagtcaagtagccacttgcttcccttcacacttaatcaaatcctaactctctaactgaaactttgtaccatttgaccagtacctctcctttccccattcccccgctcccagcctccgtaaccactgttctactctacgcttcttcaccttctactttcttagattccacatataaataagaccatgtggtatccgtcacatatttcacttagcataatgccctccaggctcttctgtggccatggatgataatcatgtattgtatatttcaaaattgctaaagagtagatcttaaatgttttcatcacaagaaaaggaacttggtgaggtgatggatagattaactagtttgatttaatcatttcacaatgtatacatagatcaaaacatcccattgtatcttataaataaatacaattttttttgtcaattaaattttttaaaaattacaagaggctgaggtgaggttacagtgagctgtgatcatgccactgcactccagcctgggtgacggagcaagactctgtctctaaaaaaaaaaaaagtgaagttaaaaattaattaatttaaaaaaatcccaactcttccatcaccccagccctgcatccttctcccttcccccaagaccccctcccctgccactatgctctgattcctagagcggtgtgtccctgtcctgccactcttgctgtgcctgtggctgtccctgttccttgggtagcttccctgttactcctcaggggcttccctggccaccctctgctcgggcccttcctgagtgttacatcagcacctttcttgcccgcacccaccaccagccacagcttgtgtttgccgtgtgagccggagcacttgtttgtcacctcacggtcttcccctccatgagggcaggcacggcagtcttgctttcattcttgctttcatgcagtctacccagctgtgggcgagatgtgtgcacatcgctcagcatgtttgtagaatgaacacatgtataaactagacttgaatggagattattgttctctcctggccattaaaggtgcttcttcctgctgctcatttacatctcaggtgttaccatctctggccagtgcctgccctgttgttgtcatctaacagtcatgggaccacacctttgtgactctcagggccagaggtgtttgggaatgtggaatttttgagatttttagaacagaaatagtgaaagtaccgtatagtataggacatcctaggcagcaccatataatcaagcacattaagatttttgcagcaaaaagtatatgaatattcacactaagtgggacagtgagactatgaatagcttcacatcagatcagggcataccgccaagtgagttatgaacatgctttcagttttcagagagctttttggattttcaaattgcagagaagggattatggacctgtcttagtgagcatctgcttgtcacgcattatgcagcgtgctgaaatacaaaggaagaaaacatcacgcctgccctcccgtgtagggggtgggtggtcaccacatgcgggtggtgagcccatgctgggagggcactcccggcaggtcctgttgttctccctgtcatctccccctttcctttgcgagcgtcctctacaggtgcggtttcaggtgagccacatggggggctggcagaaggggcactgcattgtgacgcagggtcaaatgtgtccctctcagagtgtaggaggtaaccgttctggatcgcctggatcctgcccttgggtctggctgcccgggtccaaggaggaaagggccgactccaggtgatgctgcagaccaggagcgctgccctcacttcctaaccttctgcacttgggtgccggggccccctctctgcagtcacacactctgccctcttagctgggcctagagctttaaacattaactggattcaacatacgtttttctgactttttaaatataatgagtatagttttattttaatgtttttcagatgcattttgatgtaggtaggtacctttacattttaaaaatttatttgctttctgaaatgggaccagcatatatatatatatatatatatatatatatatatatatatatttgtttttttttttttttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggtgcaatcacagcgcactgcagtgcagcctcaatctcctgggctcaagcgatcccccacctcagcctcttgagtagctggggttataggcacccaccaccacacttggctaagttttaaaaaatttttttatagagacagggtctcactatgttgactaggctggtcttgaactcctgggttcaagcagatcctcctggctcagcctcccaaagtgctgagattacaggcatgaaccaccacaccctcctggtacctgcattttgaaaatgtttcattgccaagcctgcagggaagtctgccctttttttattagaaaatgaagagctaattctgaaatatgcctactaaatatgcatatctcaagcactttaaaaggatgtagggtgaaatagtctgttcctgaagcaaatatcactgtgtgttcattccattatttccgtagcttttctgtggcttttgataagttgtgtagaatgtattaagtctcatctgaaaatgtatattaaagattgttcttttaatttaaaatgatttgtccaaggtacttgacttaatgattcaagatttaatgagccgtgacacttttagtaacaccgtctcaatctttcagattttataaaagatattaaagttttcagaaagttgagaatggtcttttgtaatgtattttaagatagttaagaatagagtttatataattaagattaggatttgtattgcaaaaactcccttcaagacgcattttgggcctttatgagcgagtaatcatgacaggacagagtggcttcacccacagttttgtggttaatatttgcaagtcgtttatttaacaaggttgaaaagaggcttcctggtgtcttttataattatccttttctggggaccaacttataaagtaaaaaatacctggtggcattatctttgcttcagatgtattatgtttatggaattggaaatgtttgatttcttagtgtgtgtgtatcagtggattatgtagtttaaaatgtttgcatctgtattgcatgcataaacatgtccgtttccaagtgtggcctttaaatactcagggttttgtggccgggcacggtggctcacgcctgtaatcccagcactttgggagcccgaggcaggcagatcatgaggtcgggagttcgagaccagcctggccaatatggtgaaacccagtctctactaaaaatataaaaattagccgggtgtggtggcgtgtgcctgtaatcctagctattcgagaggctgagacaaaagaattgcttgaaccctggaggcggaggttgcagtgagccaagattgtgccactgcactccagcctggatgacagagtgagactccatctcaaataaaataaaatacaataaaataaaagactgagggttttttaaaaggtcataatagaaaaattttatgtgttttaattgtttaaatgttttcttcgggattaaaaaaacctgaatgtattctgggaaaatgttaaatggatgcaacactataagattttccacagaaatatgttattcaccgtgaagcacaatgggaaggctccattagcactttagatggtatcataactttggaaaaaccatttcaccatgcgagtatttacaaaaactgaagctgtccctgtcaggttttgacagagcttagctatataggtagtaagtgacgcagtgccaaaaccagtcttaaattacctatgttgtcaatatgcagattttctctatttagtatttaagctatgaatttaccaatctgagtaacttgaaatgcagtatcataaaaagaatcagatctaccaaactgaaaatgtgtgcgtatctaaagtagtttcttttcttgattttggttaagttaacaggagtatcttcacatctgtaatttctggtaacttaatgagaacacactgaacttttgggtcacaataaattttcccattatgtaaaatattttacacaccggttgactcattgtgaattgtgagtcgacatgattctcttcctgcggaaaacagaaacacatgctggccgggcgctgtggcttatgcctgtaatcccagcactttgggaggtgaaggcgggtggatcacctgaggtcaggagttcgagacccagcctgaccaacatggagaaaccctgtctctactaaaaatacaaaattagccgggcatggtggcacatgcctgtaattccagctactggggaggctgaggcaggagagttgcttgaacccgggaggcagaggttgcggtgagccgagatcacgccattgcactccagcctaggcaacaagagtgaaactccatctcaaaaaaaaaaaaaagaaacacatgttattgtaatgatgatttgagccaattacaggattgtgcttatgttaccacattgactaggtgctttctgtgagttgggttgttgaagagtttgaggtagacagatggcagtgggtgggaatgagcggggagcttttgttaggtttagggaatgtggtctttccaccatcatttagttgtttattttatgcataggcttattttcgttcttgtgagcattatgttgagttaatgtgttttctttgacctcaaaccttctgaaatgtttctgggtcttaaagattcaggtattatttatttcatagtagacagaatcaagtaaatgaatactttcttgggggagagtgttgataagttccatagcgacacctctccctcatgattaaaagtgctacatttgcacaaatatgtgacttatattttatattaaaattaagatcaacttttttcttgagaagttgttgaacttttagatttgggagagggggagttctcacaggaattatgaattgttttgactagtgagaagcttatttaacatttttggaaggagtaccccaaaagtaatgcatcttttggcatagtggaaacttgcagtaacgttttcttgttgttttttaattgattgggtgacctgcatctcattaagtggtgtctattggatgtttggcctttggcttgattgtgtccgcttttaaaaaataactttattgaaatcgtcacattccatacaattacctatttaaagtgtccatgtctgtggtttttagtatattcacagagttgtgcagccattgcctactttggacattctatggaaatgcggttgacaggatgtgttttctgtgtgcagcctcagcctctgtcactaagcaccatattttcattcatattgtgcatgtatgcatcggttgttccttgttaatgtcgaatattattccattgtgtggatgttccacattttatgtatttgttagtccattgatagacgtttgggttgtttctactttttggctgttgtgtgatagcgctgctgtgaacattcatgtacaggtttttgtgtggacatgtcatttctcttgggaatatacctaggttgtttgtatctgcttttgctgcttcttttacctacagttcagattcccatttatgtttgtacagacagtttgctacttgtgactggggcttgtttgacctttgttgctgacctagcgacttcttgtgtcatgtttaaagcccctgagaccctctgttgcctagagaaacaggcagaattgcagtctctttccttcctaagaccagatcacatctggtggtcatgaaatggtcttatcctgtatagatttttggtaaataagtatgtatctaagccaaataaattttgtgtgtattttatattatttttcttctctctgcttcctcttggggacatcctttgttctgtggccccagtggcacctagagtgaatatgaatgatttgtctatgttttcccttcaggcggaatgccgattacttggattttttcttgttaattttggtgactgagttgcctgtttttgaagtgaaaaatacctgcagatagtagggttgccctttagcattttaagtgtctaaatgagacctattgggatgtttccatagtttgcatcaaattcatgtaaatgcgcgttaatgatgttagctagtctgcctgagctaaattactaatttcattactactatttaataaaggggcaggatttgccatggtcattctagttaatggtaagagccctgtaggtctctcatcatatatctaagctgaattaaggttgaaaatattactgagtgccttgtggctctatttggtaacagtcatgccttacattttgagacagctaatccttttacacaccaggtgactcatgtgaattgtgagtagacacgattctcttcctgcagaaagagaatgcattcagtcagttgaaaatcaacatcatgtggtttgtaggataggtcttactcctttcttagacaaggaatctgggatccagaaggagtgagcggttggttaggaggagtcagtgccagagggaggcagcatgccctttctgctctgcccacgctgtgaggacaccgggccgtgccttcgccaggaggaggtcatgccaagtccaaagcgtcaggccgctcagagccaagcagctttgctggagcacccactggtgcacttggaaagtgatttctcctgttaaagcctcgctgccacctcaactgtaaactggagacagtaggaagccaccttcacaggcctgcggggacctggcacccgtgcaccaaaccttgctgcccttaatcagatggtcgaattgagaggcagttggaagggtcctgtggtgtgctccttctgggaccttctgccaccccttggaggcaggttgcgcccctgcccgtctcttcccaccagtggacactcccttcagccctgggccagctgtggggccctcctctgtaggcgctggctgttccaggaggcacaagagtgttggtgtgggaccttcccactgctcgagatcccccacggagagcccactcaggctacgcttgggcttctggccgtgtgggtcagcgtcacaggacggacagatcaatgggggaagagtcatcctgcagcgctgccaccactggaggctggtgagagtggcgctgccacagagaacaagccttgatccctgacttgaaagtcagagttcttctggaacttctgtggggagtgcccagagtggcacctaaatacgtctagaggcgcttgatgaaagttcctctgaggcttttaaactgcttgagtgagtctctctgaagcacggtgatggcaaaaggaaaccacctcacgctacctctttgtgccttctcttctctcctcatctcctgtaggccgtaggtgttccctgtcaggaatttacgcggaggcatgtctgctgtggccaaatgtgttcattcattcatatctcacagtaagagggaaggatgggggaggaagactgctgtatttccttaaaagtttttctgtaactcgaatccctcccacccccgtgaggtaacaacgtcttttccagttggtgtcagtgaactctgttttgggtatctacaaaagcagaaggggaggttaggatgtggctggaggaggctggttcctgggtgtaaatcctggctcttctgcttgaactgactgtgcctcagcatcctcgtctgtctggtggagccgcctcacagaggaacaagtgagttgtgcgtgtggagcaggtggctgacatgtggtgagtcctccaggaatgtggcagcagaaggaacacgttgagcaccgcagataccaccctgaccgccactgcagggcttctgtgcgggggcagctgcagagccgccgcttcaggacagcatgggagctgctggaggtcgggggagctcagggaaagggccttgctgccaggggtgggaagggagtcagtgaagacgtcctggaggagaagattccagagcctgagatgtgaagtaggttaggtagccagagacaaggcaaagaagggccattttcatcagagaacagcataacattggcagaggtctgacatgtcatttcctgttactagaattggggagtgaccagtagattctttaatttgtttattcattcgtgcagtccttcacctcacacctgttcagggtccggctgggctctggacatagggtggaagaaaaccatctgagcagaggccgcgtggactgtcacctctgtcaggggtgccagggctgccaaaggacagctgttacttatgggtggcggcgtggtgaggtcgcacaacacagagctgccctgctgtgtccatgccctggtgcctccccgtggtcaccatgtgccttgggcaaatggaggcctcaggtcccagacataggctctgtcagtggtggtggcggtggctgtacctgctccgggctgctgtgagggagggacgggctccggccacaggcgtgcaaggtccccttgcagaggacctcccgcacctgctgaggaatgtgtacagccatctggagggtgttctccccctggccctccctgtagtccagctgagtccacgtccttcagccccttttcaatgttcctttctcacagaaccttgtcctggaggtgcactcgggcccgggttcttcctcctgtgcggtgccaagccctcctccaccacgcatgatggtgtgttttccatgactcttcctcctagagcaccggtgcccgccctgacggcggttccccacagtcagattgagtatcccttatctgaaatgcttgggactagaagtgtttcagattctgatcttttcggattttggcatatttgaatatgcataattggatatcttggggatgagacttaagtgtaaacacaaaattcttttcatatacaccttatacacatagcctgaaggtaattttatgcaatattcttaaatattttgtgcatgaaacagagttttgactgtgacccgtcacgtgaggtcagttggggaattttcctcttgtggtggtatgttggtactcagaaagtttcggattttggagcagtttggatttttggattagggatgctccatttgaatattctttttatatacagcacatggtcagtgctcactaaacttagtattgcatgaatgaatgaaaaccaaaggtcatttactaagcgtgctactatttcagaagcctctttttcctgatttggttctatggtcagtggtttaatatttcaagtgctctgaccacgtaatggttgttaccacactgtgaaggtggctgggtgttcagtgattgctgcccacagaggacctggaagtgcttgctgtacttggttttctggaatggaaatcatggctcattcccaggagcccctcagcaggggctttgagtctggtgctaagcagcagatgtgcagattcccgcagggcgtacctgagcccggagagggggcgtcgtagcgcacagcgcactcgtttccgcattcccaccccgcacggccagttgtcacagccatcctccagtaaaaaacacaaaccagtcaacctctaggagacaggtaggaaatctagaagaagcctcaggtgttcacagcattttttaaagattctttaaaaatcttcgtgattggaaagactgcttcctgtgccagagagtctctctccagcgcttttgcttctgaggttggtagctttcagaaagactgcaatgcagcggttaccaaagtccttgttaatatggaaacaactcgtggtgaagccttttgctccccttcacaactgctgactgttgcctgcagtcggaaggaggagataatgaaggtaatactcctccggacctggcagtttagtgattagaacgtacgcgattctgtgaatgctgtggctggcacagcatgtcctgcagcagctctgtcaacttactgatgcagtgggcttcctgggaacgtgaagctgaagatgtctttgcagtttgtgcacgataattttgttttcatctctgtgttcagatggtggattataagaaggtaagggactttacagatcatgcatatatgtattttaaatgtttatgaatatccctaatcaaggtaaagaattatgattgaatagacctcttttgaacctaagaaataaaactttatttcttgttaatgacccttttgacgtttgaagacttatcttatttagtcttgacaaatgccctatataagtgaattattgaagatgttctttgaagagatctgctttttctttgatttgctaaacgtagttggtttcagaggtgtagatacgcatagaatatattcatttctttaacttaagcaatgacagttacattaatctggatggaacttttcgtcttaaaaaatctcagccactggctgtagatgatgaattctaatctccttagttcttattttgcctttagaagagcattttcagatgtgtggagctctgtgtttatccgtggggtgagctgggtgctacctccagctgctgctcttcgtttatcttagagggaggccaagagtcagagcggagatttattttgcaatgaattagtggccccaaacggtattaaatgcattatgggtggtaatttatatgtccaatgccaagaaatataatgttggggttaccatggcaactgcttgcattctgaaaagcttgtgaatgggttctgaaccttctggcattggaagtgagcttttccagctgagggcctgcattcgtgattagtgtaaataaattcagctttccatatgaagcacatcctttctctttgtttaccagagtagtccattgagctcagttctttctctggtgatgtctgccttggtctcttggttcctggcaacagaatatggttgagacatagttttcaacttcaggctgaggaactagcctgtgtgtgtgtgatgacctgccacctcagtccatgcactgtgtagaaggggctggctcatctgtacctcctgagggctggcaatgcatgatgtctccaaaagcacagttgcagccgcatgtgctggtgggctcctggcacagctttctatccatctgaagggcttgtttccggtaacacttgctagggctcttcctgggaggcagccctgcctgtttccagggtatcatggggattggttttggggagggaggcccaagttagaaagacccatgtttaaaatgtcaagcttgtgaaaatgataaacgagggcctattgtcttcattgccgaagatctgtttgctgtttgttagaaatatatgtagcataggccggggatggtggctcacacctgtaatcccagcactttgggagacgaaggcaggaggatcgcttgagcccaggaatctaagaccagcctgggcaaaatagcaagacctcatgtctacagaaagataaaataaaataaataaataaataaaactagtttcccttgtgcatttaaaacaatgttgacatcttgatggccagagactgaaatgtctgtgtgtgatttcaggggcctgaggtcggaaggttggagcctggtggttgctgccgaggcggcagctcctagagggcctggccagacactgggagaatgttttcatgctctgtagaattcattctctttgttaataagcattgagattatagaatttaaatgttgagcttgaggatagactggccttgaggcacacagcgggcatgctgctgtggctcacctgtaggcctcagttaagaatctttgtctaatccaatccctttattttacagatgaggaaaatgaggcccaaagaagtgatgccacttggttaaggtcccagagcaggtcagaatcagacctaggatcagaaacctggctcctggctcctggctccctactcttctaaggatcgctgtcctgacagaagaggtttgctctcagttaattgatgttgttgttgttttgctttccttttgtcagaaagaggcctgtaataacaacaggcatctaatttagactctgtaatttagaattttaaaaattcttgtcttcccttcttctggttatttatagaatttctactcagtgtgctggagtcacccataggaggggcaaagggcatgacctctgcccttaacgctgtgtgctgtgatgagagatgggtgcatagccgagcctgcaaactggaatgttgggataaattctggcttgacatctccatttctgccaggctgtggtattctgtgttcttacagagaagctgcagtgcccagcagttacccaggggtgaatctgaatcaccacctgttaaatcaaggtcatgatactgtatttactaaggcaggacaacatagtaatttaggctcaacttacaagttgcaacttattacaagtaataagaggttcggcttacaaggtttgaaatacaaattgatttttttagccagattccattgaaccctggtttttaattttccaatcttgaaagaagactgagattttactgtataactcacttagggtgacattgtgttttcctaagtattctcagtgatttctcccattctccctattcttctcacatgggactttgacagagagctgcacctgggctgggtgtgtggcctccctcacccagcagtatggcccaatggtgctatgtgactgctgagttaggtccttaaaagggtgcagtttttgcctggatgttctttttggggtacttgtttgccatccctatggtgaggaaacccatgtcgcccacacaggaggaccacacagtgagcagggcattgacataacaaggtgacttctgttttctgagtaacttccaccacagtggtgaaactgtgtccccaagctcagcaggcggaggtaaaacatttttcaaagaaaagggtaagataggctcttggtttaccacatggtgaagagaggcctctggctcttccaaactgttgcagatagagcgtggagtgctgggacttcggtcaggccaggtcctgccgcctcactgtccagctctcctgagtgctcctggtctgccttgctctctgcccagtgctgcctgctgcccgctgcccttatgtggagtgaccttctgtctcccagccccagccatgggtcccgttgcccagaatacaagagcctttcttggcttagaactttaattcaaaaccctcagttcttagagggtttgttttccctttttttttggcctgggattttgagaatatctaatagtgctgggcagttttatcattcatcatcatgggtagtttggtttattacaacttgcagcttcatatcttgtaaaacaaattcatttcttgctttcagatttgcttatctaaaagttttgttcataatagtaacttagcacaaggcttctaatatatgagttgatgaaaagcacctcctgtatcacctttaataaggataattttgaagtgtaatttaatgcctggaagccagttggtactgaggtttaattttgtacttgggaaagaagtgtgagaagaaaagtatccttttttccttaaatttatttttcttagttgacatataaaattgtatatatatttatcatgtacaacatgatattttgaagtatatatattatggaatggttaagtctagcaaattagcaagtgtaaagataaactcacagttatctttttttgtggtgagaacactttacattttttctttcttttaaacataaaatctttcagaaaagacgtctactttctcagcatttttcaagaagaaaagtatctttttaacaaatacattttctaagccctggtctgcaacccactccattcagttaatatttatcaagcactggccgggcgtggtggctcacacctgtaatcccagcactttgggaggccgaggcaggtggatcacctgaggtcaggagttcgagaccagcctggtcaacatggtaaaaccccgtctctactaaaaatacaaatatgagccgggcatggtggcaggcacctgtaatcccagctacttgggaggctgaggcagaattgcttgaacccgggaggtggaggttgcagtgagccaagattatgtcattgcattccagcctgggcaataagagtgaaactctgtcctcccaccaaaaaatatatatatttatcaagcactacctacacacacacccactctctcttatacacacacaaacacactaatagacatagcagtaatatatattaagcatgaatacagcaagaagtttggtaccctagaattagaacgggtttttttttcgtatataatctacaaaatgagatgttgaattgatgtttaatactaagctacttcttaagcatttgatttttcttactgcatttacctatgtttataattttaaaatctgagaattatagaaaatacgtaatttctacttatctttcagattatagcttaaatgtcctctcctggggtgggggaggtccccatatccacataaatgggtgtgacctccatgtgcactgtgcacttccctttggtacttttcgtctcacacacatgcacaccctgcacagacacacacactcttattgctggtgttctgtcttcttgcctgtggactgtcagctctgtgaaggggaggcttctgtctttcttgtccctctcccttctgtggcactcagtacatgttgggtgaatgaatgaatactggacacagacgctttccttgaaggtggttggatgatctaccctttccttataggactttttcagatgttttcaaattcaaccaagaaatcttttttttctattactaagttactgtttttccaaattattgaatatttctattttctcctgcctttaaggagtaggaaacaactaagaacagatgatgtctcatgttgcgaatggatccttccttcctttgcttttccctcaagttctttctcatgcaagcgaacacccatattgtgaggggtagcaaatttaaatgagtcctttgcattcgagtatagagatgactgaggagaatgaggtagtttggaaacactagaaaaatctgcctcagtgcttttgatattttaatttataggcaattcttttaagtttcatttttctcaagacaaatgccagactgtggaaagggtgctgtcatttaaaaatattcgggcatgtggccgggtgcggtggctcacgcttgtaatcccagctctttgggaggtcgaggcgggtggatcacgaggtcaggaattcgagaccagcctggccaacactgtgaaaccccatctctactaaaaatacaaaaattagctgggtgtggtggcacctgtaatcccagctactcaggaggctgaggcaggagaatggcttgaacccgggaggcggaggttgcagtgagccaagattgcgccactgcactccagcctgggcaacaaagctagactttgtctcggggggaaaaaaaaagaatatttgggcgtgcatactgcccaaagcgatttacagactctctgctattcctagcagattaccgaggaccttcttcacagaactagaaaaacactgctttaaaattcatatggaaccaaaaaagagcccaaatagacaaggcagtcctaagcaaaagaacaaagctggaggcattctgttacgcaacttcagactatactacatggctacagcaacctaacagcatggtacgggtacaaaagcagacacgaatggaacaaaagagagagcccagaaataaggctgcacacctacaaccatctcatcttcgacaaagctgacaaaagcagtggggaaaggactccctattcaatcagcggtgctgggacgactggctagccacatgcagaagattgaaattggaccccttccggctgggcgcggtggctcacgcttgtaatcccagcactttgggaggccgaggtgggtggatcatgaggtcaggagatcgagaccacagtgaaaccccgtctctactaaaaatacaaaaaaattagccgggcgtggtggcgggcgcctgtagtcccagctactcggagaggctgaggcaggagaatggcgtgaacccgggaggcggagcttgcagtgagccgagactgcgccactgcactccagcctgggtgacagagcgagactccgtctcaaaaaaaaaaaaaaaaaaaaaaaggaaattggaccccttccctacaccatgcacaaaaatcaacaaaagatggattaaagactgaaatgtaaaacccaaaactataaaaaccctgcaagacaacctaggcaataccattctggacacaggaactgacaaaggtttcatgaagaaaacacaaaaagcaattgcaacaaaagcaaaaattgacaaatgggatctaattaaacttaagagcttctatacagcaaaagaaattatcgacagagtaaacatacatcttacagcatgggagaaaatatttgtaaattatgcatctgacaaaggtctaatatccagcatctataaggaacttaagaaacttaagaactacaagaaaaaaaacaaccccattaaaaagtgggcaaagggcatgcacagttagttttccaaagaagatgcacatgcagccaacaggcatatgaaaaacagcccaaatcactgaccattagagaaatgcaaatcaaaaccacagtgagatagcatctcacaccagtcagaataactattattaaaaagtcaaaaataagatgcttattttgagggtatggagaaaagggaatcctaatacactgttggtggagtgtaaactagttcaaccattgtggaaagcaatatggtgattcctcagctaaaaatagaactaccatttgacccagcaatcccattactggttatatatactcaaaggaatataaattgttctaccataaagatatgtacacatgtgtgttcactgcagcactattcacaatagcaaagacatggaatccactgaaatgcctgtcagtggcagattggataaagaaaatttggtacatttatatcatggggtacgatgtaactgtaagaaagaatgagatcctcctgtcttttgcaagaacgtggttgggagctggaggccattatcctcagcaaacgaatgcaggaacataaaaccaagtaccgaatgttctcacttataagtgggagctaagtgatgagaacacatggacacaaagaagggaacaaccgacagtagggcctacttgagggtggaaggtgggaagagggagaggatcagaaaaaataaccattgggttctaggcttcgtacctgggttacaaagtaatctgtacatcaaaccctggtgacaggagtttacctgtataacaaacctgcacatgtacttctgaacctaaaataaaagtaaaaaaaaataatttgggcacgatgactcatgcctggaatactagcatgttggcgggaggatcgcttgaggccaggagtttgaggttacactgagctgtgattgtgccactgcactccatcgtgggtgacagaacaagaccctgtctctaaaatatttatctacatgatatatacatttggtgggtgctttggtcccaactgtctgtgaccatctggggcagagccagtgccgtgtgcaaggtgtactgcctgcacacagcacaggaggctggggctggccagggcctgtgcacctgctcctctgtgcctggcttgtggatgcccctcactcgctgagtcttttctgaagtcatttagcagcactgccactgctctaacctacatttaaagatttattttcataattttctggcagaaaattttattaatgtagccattttatttgtataatgattgttgagaatagaatattttatgttcaagatattgattaatttttggagaaactaagaaatttgatgttgcataacaaatctctatttaaattcacggtgtaaactgcagtgaatcattagtgtattaggtaaaagccaacattgcagaatatagtttatttgaaaggccgcttagatgaaaattctagggtgatctggaaatgttttacacttttgtatatgtgatcattggatgctacttaggagagtttgtactagtgtgtctagcagttgtagcaaggtgaggtgggtggccacatttgattatgaagtaaatttattctagagagtttatatagcatgaagaatattacaatcaaagaagtgttacactacatatcttaaacttttaacatgactcttatctagctataaaaatatgtctgacattttgtgttttaggaatgaagtaagtatgcagtggtaatgaatgtttgatcatgatttcaggtgagtaagacgtcagggaaacctatcacagttccataagcaaaaatgaaaaaaactcactgaggtatattgctacaaaatggcttctttcccccaagaatagctgtaactgtgacagagtagcgcagcacagtccttccattctccccttgctctttcctcctcctcatccagatgcatttggatgatactgttcaaaagtaagataaataattgtactcaattttcatattagagtagctagaaattaagcaagtaatttgtgtgtgtgtgtgtgtgtgtgtgttttttttgggggggggtgaaggtcttgctctgttgcccaggctggactgcagtggtataatgacagctcgctatagcctcaacctcctggacttaagccatcctcccgcctcagcctcccgagtagctgggaccacaggtgcatgccaccacacctggctaatgttcacattttttatagacatggggtctcactatgttgcccaggctggtcttgaactcctggcctcaagtgatccttccaccttgaccttccaaagtcaaagtgctgggattacaggtgtgagccaccgtgcctggcctccaaacaataatttaaatgatgtgataaattttattttagcctagccgagatcttaaaatctattttgaagtcaggcactagccttatttggttcagctaaaggtgctccctggtgcatcaggttgtgaatgtcatatatgagtcctaagggagtaaacaaactctggctgtgtcagtgctgaaattcaaaacagtaaaaaaaaaaaagatacttggttttaaaatggggtggatgcatctattgggctttattgatattttggaaattttgagatatgtattttgcctcttgctaaggaattagataatcgtgcagggtttgaattgacagttgtcaaagtcagcaaaaatactatggtcaaattgctgggtctttgagacctaggttttagtcctgttagctctgactttgggcaagttgtttgatgtaattgttttagttcctcaacaatccagaccctggccagcagagttggagcattgaatgatctttctaagataatttgagcgtacaaatggcaaatctgatttaacagcataactgttgattcttacggcacaagtcagtgagcctgtctttgttgaggtagtcgcggtgtgataacagacatagtagttaagaacactgactcgaggtagaccgctgtgccgcttagtaacgtatcgtgttgtgaagctgctgaatcttcgtactctagtttcctcatctctataacaggcaaatttgtaattgtgacaaataataactacaagaagtaaattaataactaagaccaaatgcatactgtgtggccagcaccattgtaagtgctgaggatacaaacctgaacaagacacattgctgtcttcagaaagctcacagtcagatgggagagagagaaggaagcaaggcaagtacaggcttgtaagtgttgtgatgggtgtccttacaggaccaggatttcaggaggtaaggtcagtttccctgggaagggagagttagagaaaagatgctcgcagtttaattcaacaaacaagtggtacctgctgggtgtgcctgccgtcctgctaggcattgagactacaggataaatttagcatgatccctgctctaaaggagcttaaagtttagtggaaaaccatgagtctagtgataaatagtagttgtcaagatacttgaatggagtcttgcagatgaagtgtttgacaggcagtggaagaacaaaaacacagaaggagacagtcgttgcggctggagcagagtttgcaagtccactcctggtgagggaggggatgctgagccagcagggcagggtctactcacacccagaggctggctcggaagcagcagatgtaaagggaagtgtgtattggagggggtatgttgtgaatttgatgacgtctgattgttacattgaattccatgagttctagacaatttcttcatgataattacccccttaaatttcataatcttcattcccccactaaatttaataccataacatttttaatttaaaaaacaccttttttgtcggtacttttgaaaacattttcctgcacctgtgccttctatgaaatgaacgctgtagagaatctgtggaaatcggctcatggtagaagctttccctgtcatatggatgagtccttttgcttgcccagtgccctcctggcatattgatgaggtaggattgggagttcggaacgcctacaaaatgagcaggctaatttcgaacggatgctaatcctgcaaaaccaagagagatgcttattggttgatttgcccttttttttttttttttttttttttttttgaaacagtctcactctgtcacccaggctgtagtgcagtggcgcgatcttcgctcactgcaacctctgcctcctgggctcaagcgattctcctgcctcagccttctgagtagctgggactacaggtgcacgctaccacttctggctgattttttgtatttttagtagagacggggtttcaccttgtgggcctgactggtctcaaactcctcacctcaagtgatccgcccatcttggcctcccaaagtgctgggattacaggcgtgagccactgtgcccagccattatttgcttttagttgaatttgtgtgtttggagactgagcacttactttcaacagtgaagaaattgacttggcagcagttgctgcaggtggctgttttcggtctacctcatactgtcagtgtgtcgcccagatactatataattactcagttattttgcagtcacaacatctttgtgtgtttgtatttatttagtaattagaagaaagtttttatgttctcatagtatcttcctgtctacacagtgcatttgtttactaatttatatccatttgatacacatctaatgattgcctctgatgggtatatgtgggaacatgtacattccctactgttagctgcaaatagtgagaagtagttagagcataatgtttcacatcgaagtaatctctttttcaaagacatctctgagaatgaaaacattaagtttggcagttccgacaaactcttatagtgataaggtattagtctaattctacttagtaagaaagttattcccggagacttccatttccactatgatggaattagaggtgatttacgccccccaacccaggactagggtaaggcaagtgaggcacttgcctcagtgcagaatttaaagggacacccaaaatctcagtaatcgagattattaatattttaatgcagtgctttaaaaaaatcaaatttgatgcaaaaaaaatccatgatgaaaaacaaaattattttttactttttaagacagggtcttgctctattgcccaggctggagtgcagtggagcaatcatagctcactacagctatggtaatacagatgggtgggctcaagtgatcctccagcctcagcctcctaagtagctgagactacaggcacatgccaccacgtctggataattttttatttttttttgtagagtggtgtctcactgtgttgcccatactgatctcaaactctgagctcaagcagtcctcccgtcttagcctcccaaagtgctgagattattggagtgagccaccacgcctggcccaaaacccaaatttgaaagacaggatcagtattaatgatttttctttttgtctcaagctccagcatggcttggcaagacaccattatcgatattatatataaaactttggtattttgtacctcgtggattttttcattaattttgattttatctctattactgagtttttttgacactcaattaagatttgtgcctaaggcaagtacctcacttggcttgccctagtcccaaattgacttctatcttaaacaacttgaaaaccagacaaaatatatgaagtaatagttttcatacatttgacagaaggctggttaggaccatgttccttgaaataaggggaacaaacaaaacaagccctgcagtattccagcttataccccacagcatgagactgcacttttttctataaagggctgtatagtaaccattgtaggttttgggggccggatgctgttaatgtcacaactactctgctatgctctgtgcctgctttcatcctaagtatgtaagtgaatggacgtggacgcattacaataaaacctttctgacacaaacagccttagtttgtctcgagaggcagtttccatgtttcagggcaggaagagagaagtcaaacagaacccactggcttcactaaagtgatgatacaggagaaattggggaggacaagacagctagaatttgtggaggaaaacataggagaggagggagcaggttagagagagagctctagagatctgcagaagggcccccttgaggcgttggctgcatcctggtctgcacgtggccaagaggaagcacctcaaggctgggaggagaaccaccaaaaaggagaaggccaagcacttcttggacatcagttgcacagggctgggaatagtttgtgttcccaccacccagggtggtctcaggtagatcctttgaagggttgccttttcatctttgttagcgtgggttcagagcagctttttcatctatggtgtcaggacgattcctcagaagggctgccttagcagtggggctgagttatccatagaccaatgggctgctcccgacttgccctaactgattacagatagcttgattacattatcagaaccaaagccccgactatatttaaaaaggatgtaataaaactagcacccaaaaatgtaaaaagaaattgtgtctagcatctaataaataattaccaggtatgcagagaagcaaggaaatgtgatattaaccaggaagaaaatcaagagaaacagaacccagaaagacaagggatgatgcaattagcacacaaacattaaaataacttataaatatgttgcacactcaacataaaacgtagagaaaaacataagcatactgagtgaaatgaaagactcaaaaaagattgaaataaaacttccagagatgaaaatagaatatatacaatatataaaatgccgggcgcagtggctcacacctataatcccaattctttgggaggctgaggtgggcagatcatttgaggtctggagttgaagagtagcctggccaacatggcgaaacctcgtctctactgaaaatacaaaaattagccgggcgtggtgcaggcgcctgtaatcccagctactcgggagactgaggcaggaggatcacttgaacccgggaggtggaggttgcagtgagccgagatcacaccactgcactccagcctggcgacagagcaagactctgtctcaaaaataaataaatagataaaaataatatatattttatttatataataaaatatataataaaataaatttatatatagtaaaataatatatacacatgtatatgtatatataatgcagtagagggatcacaacaggttattacgacagaagaaaagagttcatgagcctgaagacgtagcagtagaagctttccaaagcacagcacagagaatccagactgcgcgagatcacagagcatcagcagcctgtgggacaaagtcagctgacttaagatatgtataacctagttccagaaggagaagaggagggaatggaaaaaatatttggagaaataatggctggaaattttccaaatttgatgaaaaatgcaaactatgaagctcaaaaactccaaacagagcaaatataaagaaatccaaggtacctcataatcagattgccagaaaaccagtgatcaagatcaaaagctttcaaagcagccagaagaaaagacacattacagaggaatacagttgctaataacagcgattcctggtcacatcttgtgtgaaccagaagacaacagagcaacatattcaaagtactgaaagaaaaaaacctgttagagttctgtatctggcaaaaatgtctttcaaaaatgaaggataaatttttatttatttcagaagtaaagaaatttttaggccaggcatggtagctcacacctgtaatcccagcactttgggaggccgaggtgggcgaatcacctgaggtcgggagtttgagactagcctggccaacatggtgaaacctcgtctctactaaaaaaaattagctgggtgtggtggcaggtgcctgtaatcccagctactcaggaggccgagacaggagaattgcttgaacccgggaggcagaggttgcagtgagccgagatcgtgccactgcactctagcctgggcgacagagggagactccatctcaaaaaaaaaaacccaaaaacaaaaataaatttttaggccaatagacatcagaatttattgccagcagaatggcactaaaggagtattaaaggaaattcagatagaaagaaaataatatttgatgggaaaaatttttatttatatatattttggagacaggatctcactctagtgtccaggctggagtgcagtgggtgtgatctcggctcactgcaatctctgtctcccgggctcaagcagtcctcctgcctcagcctccctagtagctgggactataagcgtgtgccaccatacccagctaatttttgtattttttgtagaaacggagtctcactgtgttctccaggctggtctcgaactcctgatttcaagcaatccacccatctcagcctcccaaagtgctgggattacaggcgtgagacactgcactcaggcttaaatagtcagtttccatctggggccaggcatggtgtctcacacctgtaatcgcagcactttgggcaggaggagagggcagattgcttgagcttgggagtttgaggctacagtgagctatgatcacaccactgtactccagcctgggtgacagagtgagaccctgtgtttctaaaaggaaaaaaaaaagtggtaaaattgacaaagctccagtgaaactgataaggaagaaaaaacagatataaataatgaaatgaaatgaaaaaggtgaaaacactatggattcagtagactgttaagatatcataaaaggatattagaattagcatcacgctatatacatttgaaaatttagataaaatagacaaatttctttcaaaatgtaacttaactaaaagtaactgaagaaatagaaaaccttaaccagtcctatgactattaaaaatgtttagatttaaacaaatgtatgattgagggaatgctgggaatgtgtgtaaacacatacatatgttgtcatgtgttaccttaattgacctatacagttcttgagtacaagattaaaacctgtttctgagtatgtgattgtatcaatgagggctctttctgatgtaaattttgagaaattcaaccttagttgttttaagtaagtaaaaagaaggtttattgatcatctgattgaaaaacctaaggcagggctagctatagatggttcacttgggccagtttcttccccagcatcctccttcatgtgttcaggttctttgggaaagagggagaatctctataagtcccatagtgggaagaggagacccattaatcctgacctgggttgtgtgttcagagatgagccaactctgggcaggaaaataagatgctctgaatgaccaggtgcaaatcacaggctttacctgggcccaggtgttggagtcagcgcccctggaagctgtggactgagctgggaatttatacctgacaaggatcagggtgcaggaaccatggggaaggtgaacaaatatttggctacaaaattaaatctccattgcagtaattgccagatgtaaaatttcatgaattctttattcaaaattatgatgaaattctataataaagaattcttagttggccaggtgtggtggctcatgcctgtaatcccagcactttgggaggctgaggcgggagggttgcttgaggccaggagtttgagaccagcctgggcaacatagtgagactcccacctctaaaaaaaaaaaaaaatgttgtttttgttttgttttttttgagacggagtctcgcactgttgcccagactggagtgcagtggtgcaattttggctcactgcaagccctgcctcctgggttcacaccattctcctgcctcagcctcctgagtagctgggactacaggtggctgccagcacgccggctaattttttgtatttttagtagagacagggtttcactgtgttaactaggatggacttaatctcctgacctcgtgatccacccacctcggcctcccaaagtgctggaattacaggcgtgagccaccatgcccggccctaaaaattttttgtttttttttttgagatggagtctcactttgttgcccaggctggagtacagtggtgcaatcttggctcactgcaagctctgcctcccgggttcaagtggttctcctgcctcagcctcccggttagttgggattacaggcgcacgccactagctctggctaatttttttatttttagtagagatggggtttcaccatgttggtcaggctggtctcgaactcctgacctcaggtgatctgcccacctcagtcttccaaagtgctgagattacaggcatgagcaccgtgcccagcctaaaaataaaaaaaaaattttttttttttttcaagacggagtctccctctgtcacccaggctggagtgcagtggcgccatctcggctcactgcaagctctgcctcgcaggttcatgccattctcctgcctcagcctcccgagtagctgggactacaggcacctgccaccatgcgtggctaatttttttgtatttttagtagagacagggtttcaccgtgttagccaggatggtcttgatctcctgacctcgtgatctgcccgcctcggcctcccaaagtgctgggattacaggtgtgagccactgcgcccagccaaaaaaagttttgaatttgctgggtgtggtggcacatgcttgtaatcccagctactggggaggctgaggtgggaggatctcttgagcccaggagtttcaaggctgtagtaagtcatgatcatgccactgcactctagcctgggtgacagaggtcgaccgtgtctcaaaaaaaaaaaaaaaaaaaaaaaaaaaatactattataccgctgttcagttagcaggaattaaaaagtttggcaattgttgttgaaaaagttaagcaacagaaactctctcatacccttctgatgggagtgcacattacagctgctttgggaaatagtttggctttagagtataagctagcaatcatacttctaggtatgtacaccagagaaacacatgcctaaagtgattgagatagctgtaccagaaaaatcttaagtcgtgtttatatttgctccaaagcagagaccaccctcggggatgagaatggataactaaattatggtatatttactgagtagaatattacacagcaatgaaaataaactacagacacagcaacaacaaaaaaggcaaagaaaaaagcaagacaagaatatatgtagtatgattttgttattttcatctgcttctggtttttatataagttatgtttggtagggctgcacacctaggtgataaatctctaaagaaaagtttggaaatgataaaccataaaagttaaagcacagtagctcatgcctgtaatcccagcactttgggaggctgagatgggaggatcacttgagcccaggagttccagaccagtctaggcaacacagggagatccagcttcttaaaaaaaaaaaaaaaaaaaaaaaaaaaattttccggacacggtggcatcctcctgtggtcccagctacttgggaggctaagatgggagaattgcctgagtttgggaggtcgaggctgccgtgagttgtggttgcaccactgcactccagcctgggtgacagagcaagatgctgcgtcaacaaatcaaacaaaatcattttgttaaagctagtacttacttacgtatgtggtggaagggttttggggtcagatagaggcacccagcctttctggagttctggcaatgctccatcccttggtggtagttggactggtatttatgtaataacttcatgaaacggtatacatatgttttctatgcttttctataagtaagtaatacctcatagtaaaagcagttttaaaataatcagattttatagtgcatgttccattaaaaaaatgtggaaaatccccaaagcacatgcatatacagtagttaatcatgttttatcttaaatttattcatattatagaaatttaccttttgaaatttcatttttatttatttgagatggagtctcgctctgtcgcccagactggagtgcagtggtgtgcatgatctcagctcactgcagcctccgcctcctgggttcaaactattctcctgccttagcctcccaagtagctgggattacaggtgtgtgccaccacgcccagctaattcttgtatttttggtagagatggcgttttaccatattggcccggctggtctcgaactcctgacctcaggcaatccaccctcctcgacctcccaaagtgctgggattacaacatgagccactgcgcctggccttgaaatttcatttttaaaagctctaaaaattttccaggtgagaattgaccaactattattattttctgggtaagggactccactacagtaattaaagaaggataaggttggcgttgctttgctcctttttttattgaagtccttccttcctgatcaagcttccatatatctccttaaaacatatgacacacaggtatgccactaaaaaacttaatttgtgtagatttctttcttcagctgttactttttcatcttgcataaaaatcaagtaattaaattttaaaacatcctgaacatattcatttttggctttagcaatttcattcttcagcagatgtatttgactttctatatacatggcactttggtttggtttgtgtctgaccttatttttatttttcattttttttcaaaccagtattaaactgaaaataatagacgtcatacctcatggcccaggaatgagtgaataagttggaaaaccaagagtagtggcctgcatctctttgtccaaggcctactttccaaaatctctcggccctacccttccctagaaggttccccactgcaaggaaggcacaggcagcctgggggtgtgacctgcctcatggagtattgcattttttgatacaagaactatttgctccttaacatctttctctaggagtttgaaagaaaagaaattactctgtgtttcagtctctaacttgtgattgagtggctgaggtgggaggatctcttgagcccaagagttcgataccagcctgggcaacacagtgaaactctgtctaaaaaaataaaataattaactgggggtggtggtgtgtgcctgtagtcccagctacatgggaggctgaggcaggcggatcacttgagcccaggagttccaggctgcagtgagctaggatcatgccactgctgcccaggctggccatagaccaagaccctgtccctttaaaacataataataatctttcatatgttagaatgttaaaaataagtataagaagtttgaaatgtttgcatccaaagtgagatttaatacatagctatttttgataaattgaaaagtgtcaagaaaactgctgtttaaatttcatttataatcatgatctcataatagtaccattcaattttctccaatagtctctggtatttttagtttgtttgaagcagcgtccaaataattgcagttaactgataggtctgttaagtctcttaatcaatagaatacttttccccatcccttttttccttgcattttatttgttggaaaatccaggctgattgttcagtagtcagaagttccctcattctggcctttgctgtttccactggacatgttcttctgcctgtgggtggatatagaggctcgatcgctttctggctcagcctttcagcacaggtacttcagaggtgcgtgatgccctcaccaggaggcacacatctgcactgatgtgagatccagtgttgttgttgttgttttttccttttgtcttttttatttaaaaatcatggggtcttgctatgttgcccaggctggttttgaactcctggcctcaagcagtcctcccacctccgcctcccaaagtatgctgcaagcttaagccatggcgcctggcagatctagtgttttttgaaatctcatgttttattctaacaattgatcgaaacattataatctgcttctcaatatggccatgttttatgcttttcacgtcttcaaatacagttgacactccaggaagatgaaccttatcacatttgcaacttctgccccttatacagccccggggctccagccccatgtggcaggcgtgacctaggggaagcctccatctggagaagtgctgcctgcacttggttgcatatcgagtggactgagcccttggctcctctcgctgcttcctgtccagatggcaggactctggtcgtgggccaaaagaggcacagtgtctttgcatataataaggattgaatgaatactttttaaaaatcctaactcttatgaaccaagggatactgacaatgctgggccccaaataactattgttttctcaaaggctttaagaccatgtgttatactgtgatttaatcaggttctttcctaggagtctgcctgagtcacttggtctgtgtgtctctccctccctgtcctaagggggcttttcatgtgtgactgtgttctgcctgcctgtctggtaagaatccagcctcctgttacttgcccaggatgctgactgtgggccctctcccgcagtggaacatttggcatcaggtaccaggaacagagtcagtatgctgaaatgtttgcatgaatgtggattttcagaaagctttcttatcagcagggcacacctgtctgttcgtgatctttgcccttctccctttattggcatcacttggacgatacctttaattgccctgctgggcttgatgttgagctgcttttctccatgtgtgtcgtgttttgtgctttcttgcggcaggagccttttgctttgtttatctgatgcttcccttttttggttttccccgggctttccagctcttggagcacccttttgtcagcagatgtacttttgtttccagtttttaaattctaattacagtgtaactcaactaaaatcatggaactggggaacataaaacaaatcattagggtaatggaggcatagaagaaagtgaaaggaatccagtccacctctttgctgtactaggtatggatatgcctcagctgtgagtgagggccttcctgagtagctgactacaaactaaacttttatgaaagaattttcttaaataattagagatgcctttcatttagctaaaaacaagacctcaaaatacagtaaattcatgtctaagactgtagcaaacagtaagtaaagtaatagagtaaaaattctgcttaaagaagactgcagaataagaattgcaggccgagcgtgctggctcacacctgtaatcccagcactttgggaggccgagatgggtgaatcacttgaggtcaggagttcaataccagcctggccaacatggtgaaaccctgtctctactaaaaatacaaatagttgggcatggtggcacacacctgtaatcccagctactcaggaggctgaggcaggagaatcgtttgaacctgggaggcgtaggattgaaccaagattgcgccactgcactccagcctgggcgatagagtgagactccgtctaaaaaaaaaaaaaaaaaaaaaaaagttacagcgctcagagtgccagatgctgcgctcctggtagtttctggtcttggcccttccttagctcaaagtgcactggcataggtgccattttttagtcacacaattcccttcattgtaattttcttagcactgtctttgcttagtggatctgttgttgccattcagcagtacatttctctctgtgtggaagcaaacatcttctcaaacctgatgctcagtgaggataggcagtgggctattaaataggcagtggcctcagattcccagcatgtgtatgattgccgtgctaaccagaggcgcatgtgtccagcatctgggcattggaacctgcaagctgctcccccaaatcaggatgccaaacattaattggcaagttactaaaagttgcctcaaataccatctttaatgcatttaactgaatttgcataatttttctttatcagcacaataattattataaatattgtagaattgccattaacttataattgtcatatctaaattttaggataaaaatagaacttaactatttttatacccatatataagcaagtgaagtaaaggtatttatgtttaaatcaagaaatctaatcaaaggtttttacaatccttccaaatatgcaatctcacttatttcttgccacttctggtgataggtctgtgtgtggaagacacgggattcctgcctgtccacagctcagtgtgaacggaccagatatggtcacagattagaatttaccatcacagggccgggcgcagtggctcaggcctgtaatcccagcactttgggaggccgaggtgggcggatcacgaggtcaggagattgagaccatcctggccaagatggtgaaagcccgtctctactaaaaatacagaaaattagccaggcctggtggcgggcacctgtagtcccagctactcaggaggctgaggcaggagaatggtgtgaaccctggaggcggagcttgcagtgagccgagatggcgccactgcactccagcctgggcgacagagcaagactctgcctcaaaaaaaaagaaattatcatcacaggcctcgtgggtggttcgtgtaagaggctgaggcaggaggattgcttgagcccaggagttcgagaccagtctgggccacattggcgagacctacctgggcaacatggcgagaccctgtctctacaaaaaatagaaaagttagcggggtgtggtggtgcatgcctgtagtcccagctggttgggaggctgaggcaggaggatcgcttcagcctgggagttcaaggctgccgtgagccatgtttgcaccactgcactccagcctgggtgacggcaagaaaagaaagaaaataaaagaaataacctcaaaagaaaaaaaagaaaagaaattacctcaaaagaaaataaattacccttacagacattttatttttattttattttttttacagacaaggtctctctcttgctcaggctagactcaacctcctgggctcaagtgatcctcctgcctcagccttctgagcaggcactacaggcacacgctgccatgcccgacaaccaccacagataatttagaaaaaattagccttttagttttaggagctttcttttacagtgatatttagtttggggcctttgaacttggtctttgcttttggagctgtacttgtaggtgttgttgttccagcctgggaacgagacatgaccgactccagtgcggcctgcttgctgtcctcaccatcagtcagtgtggtccgtgtgtgaggctgcagttgtcctcttggccacttatttctccttaattctctgcatgtaatttaaaacattatcccctgaaacttagtttttcattgacttctaatatctttacttctccttttaattttcctattgagatacttaggatgacatgaaattctttggatctacatatggacaaacagaattgtgtcacataaggttcagtgtgctagctgtttaaaaaaaattaaaaacagtttgttttttttagagacagaatcttgccctgtcacccaggctggagtgcagtggcgtgatcgtagttcactgtaaccttgagctcctgggcttaagcagttctcccgcctcagcctcttgagtagctaggactcacaggcatgtgtcaccatgccaggctaatttttattttatttttatattttatttttattattatttttttgagacagagtctcactctgtcgcccaggctggagtgcagcggcacaatctcggcttactgcaacctccacctcctgggttcaaacgattctcatattctcctgcctcagcctcctgagtagctgggactgcaggctcacaccaccacgtccggctaatttttgtatttttagtagagacagggttttgccatgttggccaggctggtcttgaactcctgacctcagacgatcctcctgccttgcctcctaaagtgctgggattacaggtgtgagccattgcacctggcctttatttttttttagaggctgactgagttttgctgtgttgccaaggctgatctcaaactcctggtacttcaagcagtcctcttgccttgacctcccaaagtgctgggattacaggtgtgagctaccacgtcctgcctgctagccatttttttatgttcgtggtggtggtaaggagtggctaccaggctgtgcgggattcaggaatctggatgttccccccaccaccgttttttaccccacgaaaaaaattgtaaacactttctaattgagataaaatttacaaaacaaaattcaccacttaaaccacttaaagtgtacaactcagtggctttgtgtatattcagaatgttacggccgggcgtggtggctcatgcctgtaatcccagcactttaggaggccgaggcgggcagatcacctgaggtcaagagttcgagaccagcctcgccaacatggtgaaacccccatctctactaaaaatacaaaaaaattagctgggcatggtggcacactcctgtaacctcaggcaattgggaggctgaggcagcagaattgcttgggcccgggaggcggaggttgcagtgagccgagattgcggcactgtactctagcctgggcgacagaggcaagactccgtctaaaaaaaaaaaaaaaagaatgttatgcaaccatcactactatctaatttcagaatatttcatcaccccaaaaagaaaccccataccactaagcaggcactctccattcttcgcttgccccagcctctggcaaccactaatctactttctgtatctatgaatttgcctattctggacatttcatgtaataggaatcatacaatatgtggccttttgtttctgacttctataacttacataatgttttcagggtccatccatgttgtagcatatatagtacctcatttttttttatgcctaagtaagagttcattgtatgaatagaccacattttgtttatccatttaccagttgaccatttgagctgtttctactttttttttcgctattgtgaatagtgctgctgtgaacgtttgtgaacaagtttttgcgtgaacagactggttctcttggtatatacatagagatggaattgttgggtcatacggtaattctgtgtttaacttttggaggaactgccagattgtttccacaagggctgcaccattttacattcctgtcaacaatatgtgaagattcccatttctccatatccttgctaacacttgtgattttctgtttttaaaattttagccatccaagtgactaagtggttatagtaggttttggttttggttttgagacagagtcttacttttgtgttgcccaggctgcagtgcagtagtgcaaacatggctcactgcagcctcacctcctgggctcaagtgattcccacctcagccccccagatagctgggactacaggtgtgcaccaccacacccagctattttttgtatttttttgtagagatggggttttttactgtgttgcccaggcatgtcttgaactactggcttcaagtgatctgcccacctcagcctttcaaagtgctgggattataggtgtcagctgccgcacctggctgtttttttttttttttttttaacaatgttttaaaataaattgtggtgagatacacataacattagccatttaaaagtgaatgattcagtggcattttgtacattcacagtgttctgcaccatgatctctatctggttccaacacatttttttcgttcccaaaaggaaaccccatacccataagcagtgagtccccattatgcctcctttcaaccactggtaactaccagtctgctttctgtcttgtggatttccctattctgtatgtttcatgtagatgaaatcgtagtgtgtgccctttgcttctgacttactcacttagcatgttttcagggttcatccatgttgtagcatgaatcagaacttgattcctttttaaggctgaatggtattcactgtctggatagattacattttgtttattcatgtattgatggacattttggtggtttctacctttttggttgttgtgaagagtactgctgtgaacatgtgtatacatgtgtttctttgagtaccttttttcagttattttgagcatgtacctaagagtggaattgctgggtcatatggtaaaatgttttaactttttgaggaactgccagcctcttttccttagtggctgaaccattttgcgtttccacagcagtatatgagggtttcagtttttccacatcctaacacttgttattttccttttttaaaaaaattataggccaggcgcagtggctcacacctgtaatcccagcactttgggaggccgaggcaggcagatcacctgagctcaggagtttgagaccaccctgggcaacatggtgaaaccccatctctactaaaatacaaaaaattagccaggcgtggtggcaccagcctgtagtcccagctactagggagcctgaggcacgagaatcacttgagcctgagggatggaggttgcagtgagccaagatcatgccaccgcactccagcttgggctacagaatgagactttatctaaaaaaaaaaaaaaaggccaggtacgttggctcatgcctgtaattccaacattttgggaggccagggtgggaggatcacttgagcccaggagtttgagaacaacctgggcaatataatgacaccccgtctctacagacaataaaataactagctgggcatggttgtgtatgcctgtattcccaggtattcgggaggctgagttgggaggattgcctgagcccaggagttcaaggctgcagcaagtcacgttcacaccactgcactccatccagcctgggcaacagagtaaaaccctgtctcacaaaaaaaaaaaaaaaaaaaaaaaattacagccatcccagtgggtgtgaagtgggaactcactgtggttttgatttgtattttcttttttaagtgaaagcaagtttattaagaaagcaaaggaataaagaatggctattccataggcagagcccattgccactcagctgcttatacttattgttacttcttgattgtatgctaaacaaggggtggattattcatgagttttatgggaaaggggtgggcagtatctggaactgagggtttctcccctttgtagaccatacagggcaacttcctgacgttgccatggtatctggaaactgtcatggtgctggtggaagtgtcttttagcatgctgatgcattataattagagtataatgaatagtaaggacaaccagaggtcactttcatcgccatcttggttttggtcagcttctttactgcagcctgtttcatcattaaggtctttattacctgtatcttgtgccgacctcctgtctcatcctgtgacttagaatgcctaacctcctgggaatgtagcccagtgggtctcagccttattttactcaccccctattcaagatggagtttctctggttcagacacccctgacatgtttcccccctcccttttacagcagaacccttaatcctaacagtcgtagagggacaaagatccatcttctgtaacttcttcaggctgaatggggcgatgatattcctgcctaactatgagggtctcttgtattcagggtagagaagagctcagtcagaaagcatcaatatggtgagggccattcatagctctgagttccaacaaaaggtggtatctggaagattaataagtgttcagtttaagaaaacattcagtaaacttatcctgcattcctacacaaagagtacaacagcaatatattccacaacagtaaagtagaataactaaaattatcctgagtaaactaaacaagaaggctttccatgaactgggcagttgttgaaaccaaactgatacatcgggttgctagccgactccagtatgtgcccagaattagaatattgatccagatttttacattacccatctctcttgtttcttgtgagcagcagccagagatcactgattggttcacaggagtaagcagggttagcctaagttgcagaaaaaaaacttaaaaacaactgatgagactagaatctagtaacaggtgtaccaagttcctgaaacataatttattttctctctccggtctcccatttttactgaagacaaatcatggtacaactgatttgctttattatacttggcctgattatttgtataaagtgcagcaagaacagttatttttcacataggtttttaaaattggctttgatgaaacttcattccataaaaggaagcttagataagactttttgttaaagccaagcccagccatgggtttgtaccctcaaataacctgtgagttgggaaattcctctcctcttgaggtcccaagatggcgtggggttcctgggcctgtcggaaagtgacattctttactaaccacaggtcaggaaccctgcacaggaactgtgtagacaaggtatgaggccagttttcccaaggaacttttattggctccataagtcaagtttgagtccttaaaggaaagcacaccattcccatcaaagtcctggtaaaacaactagtttctctaattgtgtcctgttgcaaaagaaaacagattcttattgcacttgtgcaaataactatattgccataagttaatactcacaaatagtttccaaattccagagaaagcaggtagagaaaaacaaatatgctccaaattttgttcacaggagtatactttactcaattgtcaaaagctgtaagtagctcaaaagttttcttggctctgaaaaacaaaaatgatcagcaacgttttaagcaaaaagtcagaaaagattacttgagtcttttgttcagtccatgcagttaactcctgttctacttgatattcataatcatttcagctctccatgagagtcctgaaagaacctctgttcttcttttttttttttttcttgagacagtctcactctgtcgcccaggctggcatgcaatggcgtgatcttggctcactgcaacctctgcctcctaggtttaagcgattctcctgcctcagcctcctgagtagctgggcttacaggtacgcaccaccacgcccagctaatttttgtatttcttagtagagacggggtttcaccacattggtcatgctggtctcgaactcccaacctcaggtgatccacccacctcggcctcccaaagtgctgggattacaggcgttagccactgcacccggcctaagaacctctattctaatgtcacaatctccaaagttattagaaacctgcatccaagagcacctgttgaagtcctataatagctgactataaaccaccttttgaagaggatcaacacagcagttgtctgtggttgacagaaagtcttaaggcagccactattaaaggcacaattgactaggaattttgattacttttgtggcatacgattttacataataattgtaattattagtaacatatgctaagtcatatcacaattctaggagtttcccattactttggaacacataccaataacatatttatataaatacaggtcaaagaaagccaaacaccatttcatatttgacagtgcttcctgtatgatttttataccaaataagccaaatttcaccattgcattagtgtactattaatgttaaacccaattcttaataaaacattatagacaaatctacccaattttaatgtcagaccagaaggtaagattcttataaaccttttataaccctttacaaatttttgttaaagagcagatcagtgctctaagaaaaccttgttacgcttttattccagtgttcaatttacggaactgtatcatacccctttaacttcagccagtatgttcacacacagaatttcttttaaaagattaatttttcacaaaatttccacaacttttgcaaaccttcagctttatcctaacttaaaacaatcccttaaccctttaatttaggccaaaaaaaaaaaaaatccacattcacatgtctccttctcttttaccaaaaacacatttcactttccctacacaccttgcatgtaaaactgtttttccagtagtctcaagtagatgttacactgttaactcttagcagtgtttatttttagtgaaaaacttggtaagcaattttaattatgtactaggtatggagcctaggacaccaggcagaagtgcagataaggtctgacacttactagcatagctaggaggcatggctaactccacatgtccctaggccttacctagaatctaatggctgtaggtaagtttaacaattttcaaaagtcaaagaggcagtttataaagttaaagcgtttagcaaacctaaaatttgacctgcctgatttagaccgaatgtctttattttaccaataatctttaaaattttctttacttcccacagcttaagtcacacgaattaaaaggcattacgctttttatttttctgacaaaatatttgatttaaacacttatttttaagccaattaatcaaagccttttatatcacacacacaacacatataaatacacagacagaagaaaatgtagtagttgtaaggtttttcctttgccagtttcttaattggattagtggctttatggtggagccctggaggaacagggcaaggaaagcatgcagtttctatggcctaataagcaggcacaattggaaggcaagacagagccccaaaacttgagggtcccatttttatattgatcctggatcccccaaagagaaacgctacagaacacaacagtgcaatgattttaccacatatttcattgccaggcaacccagagccaatcagccctttctgagatcagcccatcccccatgggagtcttatctctcagtggggaagggtgaggacatctccataccttccaggtggccaagagcatgctcttaatccagacacacaaagatccaagtatcccccacagtgccatttagccatccccaaaagtattaaatgtatttcctacctagttatattacacaccaaagttctctcataatgtgaagtaatttctgatacccccaaagtaaaaaacagataatgcagtgcaaaacagaacagagccatagattttgagagggatctatccacttttaataattctcggggttccatgaggaaaatagaggtttttcccaaaacagggtatgtggtgcctcctctgtttttcctaagaagtcccaggctgttagagcttgaatatcgacttttaattaagctgacttttaaccatagcactctttaaaaagtcgttttaaatatcttattacccaactttagccacgccaaactgccaatattcctggctttttaacttttccaaatgtaacctcccaggtgctcagagaaaggaaaatttaagacagtttatgaaagggaggagaatcaacaaatggcacaggtcacccaaatgccaaccagaaagtgctcattttctaggctaaaaattgaacctgaactcaggccaccattgtgaaaagacaaagccttaactgctaagctacagcattgggcagtttccactgcttttcccagaaggagcccagagcagtaaattttgagcttgcaaaggcttttaactgctcaagataatttgtagagctaactactaccccaaaatccctgttgcctggaaggcagagacaaagagaaagtactgccatatgattacaaggtcaagctctcagggacatttctcaacatgtggtctttgggcaagatggtggccctgaataacagaaaagataggaaagggaaaggaaagaaagggagaaaagcattgcctgcagcaggctggggaatgcaagaagctcagggaggccagagaaagacccgcccattgcagctgacactgaatcagaagttcaggtggctgctttttgggagcgtagggatctttcccagcattcccatcagctctagtttccccttttggggaggaaaaagctccccatgtcccataatcttggacatgtctagttctgtcacccacagccatcagcaaagagtgcaaggcagattaatccaaagagaatagcagttaacatcccatagtgccaaactggttcttagtcgagagggactctactgagaggggcctccaaccccctaaattttaggaaggactctaaccttcctaagttgggcatcaaacccaagttcagtcaagcgtgcttgccttttattaacaggcacctttatccctctcttaggagagactctaactctcctaagttgggcctctaacccaatcccatcctttacccaggtaactgcatcccacttacccaaggtcggccaatcagtgctgcagtctatttcctttgggttgggagtctcctcagtatcatccctttggggcttgccaggaagatgttaccggaaaggggtcccaatccagaccccaagagagggttattgaatctcatgcaagaaagaattcagggtgagtctataaagtgaaagcaagtttattatagaagtaaataaaaaagtggctactcaataggcagagcagccgatttgtattttcttaatgatattgatattggacatctttttatgcgcttgttgaatatttcagtatcttccttggagaaacgtttatacagatcctttgctcattttaaaattgggttgtctttttgtggttgagttataagagtgctttatatatatcctggatgctaaacccttattagatatgtgatttgcaagtatttcctcccattctgttaattgtcttttcactttattgataatctcatttggtgctcaaaagtttttcattttgatgaatgaagttcagtttatctagttttttattttgttgcttatacttttgttgttgtatctaagaatccattgccaaattcagggtcattaaagatttacctcctgtgttttcttctaagagctttctaatatattttttggggatctcattcatttttgaaagatagttttactggatatagaattcttggttgaaaaatagccagacatgatggcactggcctgtagtcccagctcccagagagactgaggcaggaggattgcttgatcccaggagttggagactgccgtgagctatgattgcaccacactgcactccagcctgggtgacagagtaagatcccttctccaaaaaaaaaaaaaaaaaaaattattggttgacagatttttttctttcagccctttaatttgtcacctttcggcctccatggctttagatgagaaatcagttgttaatcttactgagaaatccttgtacttgaagagtcacttctctcttgctgctttctacagtttggctacagtgtgtctgggtgtggctctttgaatttatcctacttggagtttgtcgagcttcctggttatgcagattaatgtttctcattaaatacaggacttttctaccattatttcttcaaacttttttttgtctttttttctctctgtctttctaagaccctataatatgtatgttggtacaattgatggtgtcccacaagtctctgaggctgtttattttcttcattattttttcttctgttccttacactttataatctcaattatcctatctttaagttctctgattcttactgctgtttatttctgctgttgagcccctgcagtgaatttttcatttcagtttttgtgcttttcaactccagaatttttgtttggttctttttttaaactatttttttctttatcaatattttctattcagtgagacattgttctgatggatcttgtagatttttgaacatggttttctttagttctttgaacatatttaaaatagcatatttaaagtcttcatccatacgtctaatgcctgggcttcctcttaaacaatttctgttagttgccttttttctgcatgtgaaccatactttcttgtttctttgcatgccttgtgatattttgttgaaaactggaacttttgaatttttaccgtggcaactctggaaatgagattcttccttctcccccagggtttattgactgcttgttacagtcattgtttgtatagttacttttctgagctaattttatatagtatatattctttatcatgtgtggcctctgagttctctgttccattaatatagtggtcagcttgtgattagacagagatttaagcgcctagaacaaaaaatgtctcccagtcttttgagatgaggtctgtgtgtatgttggagcacaccttcaacactcagccaggcatttgacggtgatccctgagcattcgctgcctgcttgcacagatcctgaaggtcagccagaggtgaaagcctagggccttttcaggtctttcctgaacatgtacacagccctgggcatttgtggagccttctggatttccaagaatgtgtcagagcttttcaaacctttattttccaaaacatcttactcctcagcttttcttcccaagcttttggttaaatctattgtttgcctcaactgttattcagtgcttcaggcagcagcaaatatgtttgtctgtaaatgtttccaataaccttttcccatctttccctagtagatgcctcagcactgggaggtaaagtcaagccctttgagccagtcttccagggactcagtagacaggtcgaaacaaacaactgcagttctttgccgatgaggcccattctgctccctctgggaccagtgcatgcaccggagtggcagcctcttgtcttctaggccactgcggcagccaggatgggaccagagaaagttaaaatgccatggaactcgcggttcttgctgagattcacctggtttttcttgattaagcattcttctgattgctgcaagtttttaattagttttccaaagttttaaaatagtagattctaacggtttttgcctttttcttttttttttttttttttggagacggattcttgcgctctcacccgggctggagtgcagtggcgccatcacggctcactgcaagctccgcctcccaggttcacgccattctcctgcctcagcctctctagtagctgggactacaggcacccgccaccacgcccggctaattttttgtatttttagtagagatggggtttcaccgtgttagccgggatggtctcgatctcctgacctcgtgatctgcccacctcggcctcccaaagtgctgggattacaggtgtgagccaccgcgcccggcctagtttttgccagtttttaaaatgtgtatattgaaggatggactttgagttccttactcagccatttttgtggacatgatttactagtcataatttaaattgaatattttaggacatattaaattatgatcagtttcgaggttgccaaatttacgtacaccttacttggttacacaagagatttaagatggcttacaaggataaatagcataagagatgcaataaattatcattgtcagtatttgttgggttgagggcatgttagtaaaaactgccctccctgctgttaagaacttgatcctacagacagaaatgtttccttggcagccttgagattcttgccctctctctgttacgtcagtggtggggaacctggggcagattcgcctccgtggcttctcctgcatgactgcgttgggctgagggagatatgccaggttagtgcccagcagtagggatggttgttactgtctgcctctgagttgattgtgagaaatgtgtctccagtgttggttttcctaaatctaaaactctcctttgctcaggacaggacaggtaagtgtttatatcctatttgaggacttaagacatcatgtctattgtcctatttgcttcaggaggtgatcaggggattcttacacttcagatcagaagtgactgctcttggtggctgttgatcactgggagagtcaagagtcatcagtaaacctgagacttgtccatcccctggttctggtgcctgttgaggtgtctgtctcctgctttcccaggagccagttcagtcctgtggccacctcattgatatagaaggtcacggggctgccggctgggctctgctcagggttcgtgtcatttctttcttcagcttttgtttagaaagcatattttccttgagcaatgtctgtcaatttgacatagtggctcatttactagtcttacttgagaacacctccttttgacattgcttctgtgatagaattagagctgctttctgtttttatatattggattgtccctttttcatcagcatcactcataagttaatctgaattttttttttttttttttttgagatggagtctcattctgtcaccgaggctggagtgcagtggcacgatctcgggtcactgaaacctctgcctcccaggttcaagcaattctcctgcctcagcctcccaagtagctgggactacaggcatgtgccaccatgcccaactaatttttgtattttagtagagacggggtttcaccatgttggccagggctggtcttgaactcctgacctcaagtgatttagccgcctcagcctcccaaagtgctgggattacaggcgtgagccactgtgactggcctaataaaattaagatttctcttcattaaaagacactataaataaagtcaagccatagtgctggctttggcagcacatatactaaaattggaatgatacagagaagattagcatggcccctgcacaaggatgacatgcaaattcatgaagcagttccgtatttttaaaacacatgcacacatatgtttattgcagcactatttacaatagcaaagacttggaaccaacccaaatgcccatcagtgatagactggataaagaaaatgtggcacatatacaccgtggaatactatgcagccataaaaaagaatgagttcatgacctttgcagggacatggatgaagctggaaaccatcattctcagcaaactaacagaggaatagaaaaccaaacaccacatgttctcactcgtaagtgggagttgaacagtgagaacacatggacacagggaggggaacatcacacactggggcctgtcggagggtggggatagcattaggagaaatacctaatgtagatgacgggttgatgggtgcagcaaaccacaacggcacgtgtatacccatataacaagtctgcatgtactgcacatgtatcctagaacttaaagtataataatttaaaaaaaagtcaagctataaatagggaaaagacatctgtaatacataaaactaacaaaggattagctgttaacatattaaatagatggggaatctccccaaatcaatattacgagacaggaacccaattaaaaaaatgacaccaccaggcgcagtggttcatgcctgtaatcccagcactttgggaggctgatgtggaaggatcatttgaggccaggagtttgagagcagactggggaacatagcgagacccccagctcctgaaaaaataaaaaaattagctgggcatggtggcatgtgcctataatcctagctactctggaggctgaggtgggaggattgcttgagcccagggggtcgaggctgcagtgagccatgatggcaccactatactccagcctgggcaacagaacgagactccatctcttgaaaacacacacacacacacacacacacacacacacacacacacacaaaacaatgacaagaaggcacaatttggcatttcacggaagagaaaacaagtggcctctcagcatatgaaaagatgccaaacctttctaatcaggataaggggcataaagaccatagtccttggttggtagaaattaagatgactgataactgtaagtgttggtgagagtgtggtttcatagaaattcttgtgctgctagtggaagtatttgttgttacctctgctttggagagcagtttggcactcatttacaaaactggcctttcgtacaacctacacaccagcgactcctctctgctctttagatgtagagtccagagcaaggactggtaaactctttctgttacgggcaagagagtaaatatcctaggctttgtggactacatacacacttagtctttgtttttataacacttaaaaaatctaaaaagcattcttagttcaaagaccttacaaaaataggctgctggctggatttgatttgcaggctgtagtttgccaattcctggttctctgatctaggggacgcatcctggagaaacttagttacatgcagtcttagtggcaggagggccaggggaaaagcacagagcggtatgggggagttgagagagactgggagggtggcctcctggagaaggtcgggggctggactgcatgtgtctgggtaggctcagccatggcctggctgggtgggcctaggggaacgtagagcttctgaggcacaataggccagtgtggagagcagagtggcaggcagggctgggggctgcaggtcgaggctggtcaacccttttacctggcgggcaaggctagtaccaggtgcccttgctacttagcttggaaagattagtgagcatcataatggaccggcaagtttgtaagcaaatgacatctataatacatatactttaacattaatgttttgaaaactttgttttcacaaataagtaatttcccacattttgccacagttatgttctatgaagctaacccaagtgtggctagaacgccagttcatccatctctcaaattgtctgctgccggcgttcattcctgtttgcttctagctgtaaagtcaggctaggagtctgtcagctcatgtgcctgtcagcttcatgcaggcagcaagaacggggctcggaagcaagggctccgcccgcccacccagcaactacctccccaggatgcccaggagctcaggggtggaaggaatttggctcttatttttctaagtagcaaaaatagatgaattgggtacaggaacgcagtgtatttttgagggagctggtgagttgtgaaagaaacttcctctgttcacctgaggcttaccgtatcgtgagaaaggatggaggaggcatggaggtgggaaactctacacaagaaaaatcctatagtgcagcagctactgatgtgaggcggctggtctaggcagcggtgttccctgaggctcctgagtctggttctcactgggtccctcacctcccttcacagccactcccttccttaccaaggtacatgggagtacagggctggccaggggctgttgacagtgggggagtggtgcaggctgagccttagagacaggaagggcatctgtgctggagctgccctgcagaagcctcgtaaaggtcgtaaggcactgggcaaaaacttttccaagaaagttcatggtgcacacgctgacctaaacactggccgacattcccaaggtttttttcattatggaagtgcatggccattgcatggtatccagaaaacaaagaccagagaagccagactttataccaccatctggaaacatttaatttgtgctttaggtaagtgttagcaaatatttaggatgattgatcaaatcattagtgtgtttatgagtgcatggtgtaatttttactaaagctcacatttcttcaggaactcgattcaactcctttacattcctggttattttcatttacttgatcttgaggtctcatctggcagagctgtgcaagctgggacctttgtggcttattttgaggagctgtttactttacctgttgatgggaacttgcaggtgggaggcagccagtcttaaagagtaccttgttagcaagtgtggaagagagtccgcgcagacagacttgccctatgtggtgtcccctctgccagcccagcccttgggcacattggcacctacctgaacccgagccccctcatgcacacagggagccgcacctccctcacacgctcctcaccagtgtgacatggtgtgacgtgctctgtgggtccacaacgggcccactccacagctctgtgcacagcatgctgggtcagggtggtgctagattaataagatgagggtgaatgtcaaaactgagcactttgagtactgtgggcacactgtcacagggtttacccaggaaggaacaacccctgggctccagaagcaggttgaccaggccagtctgagttgtagcattgagactcatctagcggaagtcaatgaggaaggaaaactggctgagaacagctgttgtttcagttaaaatctcagaatgatgcattgaattcaaagttacaacacagcaaaatagtatatgtatttttttaaacctcaaaaatactgtattattaactttaaaacatttttggctggtgtggtggctcacacctgtaatcccagcactttgggaggctgaggcaggcagatcacgaggtcaggagattgagatcatcccggctaatgtggtaaaaccccgtctctactaaaaatacaaaaaattagccaggtgtggtggtggccgcctgtagtctcagctactcgggaggctgaggcaggagaatggcatgaacctgggaggcggagcttgcagtgagccaagatggcgccactgcactccagcctgggcaacagagcgagactccgtctaaaaaaaaaaaaaaaaaatttttggagacagggcctcgctctgttgctcagcctagagtgcagtggtgccatcatagcttggtgcaaccttcaactcctgggctcagcaatctttccacctcatcccaatttattaagtatactttttaggaagttttttgaataataatatcaatagttactatgtgtttgggtaaaatagaaaggatggaagcatatttgatcatgttttgttcccaacacatattaaagttgggaaggattcttgtgttgcctaaaactgaaagacagcaggtctcaggcacttttgctttcccaaagctgtgtttgtttccttgcatgagaggatatgatggcactctactgttttttcccgacagaactcctctttcctaaaatggagtcgagtaaaaagatggactctcctggcgcgctgcagactaacccgccgctaaagctgcacactgaccgcagtgctgggacgccagtttttgtccctgaacaaggaggttacaaggaaaagtttgtgaagaccgtggaggacaagtacaagtgtgagaagtgccacctggtgctgtgcagcccgaagcagaccgagtgtgggcaccgcttctgcgagagctgcatggcggccctgctgaggtaggcgccctcgcccggcccgtcgcccggccccttctcagccctcggcctcaccctctccttcattcgtttctctaaaaataaacctctagaggtttaaagccctaaagaagtccataaaagcctccgggcccagcttgtgaatcctttagggaggtgcagtgggatcccacgtgtgggtttactgaggcctctgcgtgtctctgacctgccccgcccgtgtcttcccactccgtctgtagagccttggtgcccctcatatgtgttgctgtattttattgaggaacctcacagttccatggaggagatacaccaggaaatgacaagccagtcatttaagggcacgtgtgctggtgtgcaaggatgccgcagagaggagggaggatggggtcagcttaaaggactggacaggtccctacccgagcagaaacctaggccgcatgcttactcagcaggcgtgtgtggaacatgcaccgagcccatggcagccctttgctgctgagtgccagtgctggtaccgctggtggatcatgaaggcaggctggagctttactgcagaatagcatcggccagaagagcaccttgattcaccctgcaggcctcatgttttctggcattgtgctgggtgctggggtcgctgcgggatgccctggtcttggccactgccgtcagggcatgtcggcctgggaaggttgccagctcctcctcccacagcactcaagcctgggctgcacccgagccccagcctgggcacagcagccagccccctgccctgtcacctgccttcaccctcccccttctccatgcttccctctgtggtcttacccactcatcccaaatagtcagctaacctttgcccacttgggggcaaaatgacacttgagcttagtgacagcacaggagacacagaacaccgtgtctcctaacacaagagcctggactacacctctgggcccaggagaagcttcccggtggaggaggggctggagcccccatatatggtgggccacaggggagggaggctggtccccctgtgcaggtgccattggccttccaatagacagtgaagccaaatggcctgtggagaagggctggctgcttttacaacgcaggagcaaggctctccaagtaaacaggtactcacactgaagagctgctctgcagacagctagctttggtttctgaaataaaatttcacttttacattaagtggaaggggctttccaagtgggactgaactaaactgttctacttggtaacttccttttgaaaaatcagcattttaaaaaatgtagcccttttctcccatggcttcctatgtaaagtgaatcaccagggcgtcctgaagctctgctggttgctgtgagccactgtgcagacctgaccataaagtgaatgctcccagaatctcctgagtcctctcaagaaagggacttccactctaatgcagtcacttgtgtttccctgcagctcttcaagtccaaaatgtacagcgtgtcaagagagcatcgttaaagataaggtattctggggttttttttaatcattttgtcacatgttttcagctgggtaatacttttcacatagtttgcattcggcactctggcacaacacattctctcagttttggcagctgatgcggcaggctcccaggcaggacactgtgccatgtgatcacctgggcagacagtggattcagatccacttggccacttccctactgtgtgaactctgtgagctacttcaccccctcacctgtaataatcatatcacctgctaagaccgcagggagctggtgtgaggagtaaggggttgatgtgagcaaagtgctgagatgcctgtctgtggcagggctgtctgtggttgggtcacttccgtcattgcaggtctttatcccagacagcttctactcaactcttacactaggttttaccttcagactcgctaggctgaggggttcatttgagtttgtgctccctgccccccaggccccctgtgatatctttaagtcattagacatgagtgagattagccccttctcgccccctgtggctgtcctcagctagagcccgtgggcgtctctgcacattcagaggatggggctgcccagcctgccaccagcttctctcctggggcctggtccttctcatggagactgacagtcatccatgtgctgctgtaccctgccaggtatacttggagtttgaaacaattcttttcttttctttctctctcctttctttcttctttttcttttttttttgcgacagagttcactcttgttgcacaggctggagcacaatggcacgatcttggctcgctgcagcctccacctcccaggttcaagcaattctcatgccgcagcctcccgagtagctgggattacaggcacgagccaccacgcccagctaatttttgtatttttagtagagacggggtttcaccgtgttggttaggccagtctcgaactcctgacctcaggtgatccacctgcctcggcctcccaaagtgctgggattacaggcatgagccaccgcacccagcaattcattcttaaagtgcttaaaatatcaataaaaatgtgtgtttccctactttgagtaatatacctaaccattttttaaatgcaggtcactaagttgtacaataaaattcttactctggggttttcctgtctaaagcaccttgcagattgggtttgttggtcagagcagcccaggtgagtgcagtgatttgaggattgctggtagtcagtgtccctgggctgccaggcacacaggcatccagtatagccgctctggaagggggagagatggaattggccacctggccctgtaccttttctttctctgcatttacctgctgctgctgcaggcttggttagttccttgagtgaaaacagcccctcccctccactctgtgccttggcctagcatggtactcggccgccttgttaacatgtgcctaacgtgtgagtgagagagaagctcgcgacgatggctgagatgtttttttagtatctctgttttgttatgcagaatcattatccctattttttaatgacataagtagctgaagaaaaatggctagttttatcaaagaatcatgaacgagatgcactcaagttgtggaccctcatggagagaatggagctgtctgggccccgggtgacccggatcctcacccgtcagcaggtcatccaggggtgggcgggcctctggtcttcatctgtaaacagagacattttgagtaaatagtctcagatcctttccattccaaagttctgttgactttagtatctcaagtcatgaccttcttttttttttagtcatgtttatgaaagataagctttggctccaaattagtttatttttaactcttaacagctgttgattttatttctctcagcagtccaaaaaggcacattaagctcctgttattccactttcatagagcaacaggcaggagtttcttagaaataacctttggactaagatgttgtagatcgtgttgttagaaagagtgagagggagctgggcatggtgccttatgcctgggatcccaggactttgggaggctgaggcaggtggatcacttgggctcaggagttcgagaccagagtgggcagcatatggagaccccatctctacaaaaatgaaaattaaaaagttacctgggcttggaggcatgcgcctgtagttcaagccactcaggaggctgaggtgagaggatcgcttgagcccaggagtttaagggtgtagtgaagccatgattgcaccagtgcgctccagcctgggtgacagagtgaaacccaccctgtctctttttgagacagagtctcactctcttgcccaggctggagtacaatggcgtgatctcagctcactgcaacctcctcctcccgggttcaagcgattcccctgcctcagcctcccgagtagctgggactacaggcatgtgccaccacacccggttaatttttttgtatttctagtagagatggggtttcaccgtgttggccaggctggtctcaaactcctgacctcaggtgatccacccacctcggcctcccaaagtgctgggattacagaggtgagtcactgttcccagtcaaccctgtctcttaaaaaaagagtgagaatgagaatacttgtgttttctaagggaaaaataaaattaaaagttgaaaggttttttcttcttcttttttttttttttaaagaaatgggggtctcccactgtcgcccagtctggagtgcagcagtgcgatcatggctcactgcatcctctacctgccaggctaaagcagtcctcttgcctcagcctcctgagtagctgagactgcaggcgcatatgctgccttgcccagctaattttttaaaaaaatttttgtagagatagggtctcattgtgttgcctaggctggtctcaaactcctggactcaagcaatcctcctgcctcggtttcccaaagtgctgggattttaggcttcagctaccacgcccagcctcgttttcattttcaaagggaaatcttttcattattagactaacttcagactgcaatatatgtttaaagagagtgtttttcaaccacaggctaatgctgctttttttggtgaaaaatgagttttaacagcatgacctttagaaggaaccaacagttttacaaatcattccccaaatatggtctcttatgtggtctctccatttctccagcaagcgatctatacaatgtattcagttgtgtccagttctgctcttgtcctctggtgacagctgcaccataatggccacctgctccgtgctggctcccggaaggccccagagtctgaatgtgaacctggtcctcctctgccctcatcctgaaattatgtcaaagttaatagaagatgtttagatgctccagagtgatcgttaattatcaagtctaattcattttcttttggcttaactaataaaagataacagttaatgttatttaaattgtgtctcttagtgggggcagcttcttcattctacttctagaaatcaagatggtccttaatgctttctgaagttcacttaagagttcctctcttgttttttttttttaagtggttttgccttgtccaaagtagcagcatgtggagattaagaaatattaatcctccaaaataatgatctttcattttcaggtgtttaaggataattgctgcaagagagaaattctggctcttcagatctattgtcggaatgaaagcagaggttgtgcagagcagttaatgctgggacatctgctggtgagtagcaaagggacactggaaccttttacatgaaggaattcgagtcccttacatccagctgatgaagtggtcagtaggatgtggcactttaagaccatgttgacattagtttttcaaaacacagccaaataggaaagcagtcagaaccacttgagtataagttgttatttttatgacatcattggcagaattgtcaactggtttttaaacactcccccccctacttagaatagagaaaatctgaattggattttaattttggaaggcccattaaaaccttttttcaccatgaaattctacataacttcttatttttttagttagtaccatattttagcttagaaaattatttgaactggaataaaacaaagttcttagcagatattcatttatcctggaagcagagttgacttaattcttcaacaacaatatggtttgagtaatcatgaaatagaatatgaaattcagtgtctcttggcatacttgttactctttgctgtggaaaactggtctaacagcagatgagaaacatttctttagggtttcattgcatagagattagaatctggtatttcagatttagggtttttttcccaattaagaacattgaatggtctgtcttacaggtgcatttaaaaaatgattgccattttgaagaacttccatgtgtgcgtcctgactgcaaagaaaaggtcttgaggaaagacctgcgagaccacgtggagaaggcgtgtaaataccgggaagccacatgcagccactgcaagagtcaggttccgatgatcgcgctgcaggtgcgggtcctcccattccacaggccttccactcaattcctatatgatacattccacaggccttccgctcaattcgtagataatccgttccacaggccttccctcaactcatagataatccgttccacaggccttccactcagttcatagatattccgttccacaggccttccgctcaattcatagataatccgttccacaggccttccctcaactcatagataatccgttccacaggccttccgctcagctcacagataatccgttccacaagccttccgctcaattcgtagataatccattccacaggccttccgctcagttcatagataatccgttccacaggacttctgctcagttcgtagataatccgttccacaggccttccctcaactcatagataatctgttccacagtccttccgctcaattcatagataatccgttccacaggccttccctcaactcatagataatccattccacaggccttccactcaattcatagataatccgttccacaggccttaggctcaattcatagataatccgttccacagaccttgtgctcgattcatagataatctgttccacaggccttccctcaactcatagataatccgttccacaggccttccgctcatctcgtagataatccgttccacaggccttccgctcagctcatagataatccgttccacaggccctcccccaactcatagataatccattccacaggccttccgctcagctcatagataatccattccacaggccttccgctcagctcatagataatctgttccacaggccttctgctcagtttgtagataatccattccacaggccttccgctcaattcatagataatccgttccacaggccttccgctcagctcatagataatccattccacaggacttctgcttagctcatagataatccattccacaggccttccgctcaactcatagataatccgttccacaggccttccgctcagctcatagataatccattccacaggacttctgctcagctcatagataatccattccacaggccttccgctcagctcataatctgttccacaggccttccgctcagctcatagataatccgttccacaggccttccgctcagctcatagataatctgttccacaggccttctgctcagctcataggtaatcccttccacaggccctccctcaactcatagataatccattccacaggccttccgctcagctcatagataatccattccacaggccttccgctcagctcataggtaatcccttccgcaggccctccctcaactcatagataatccgttccacaggccttccgctgagttcataaataatccattccacaggccttctgctcaattaatatatacttcttccactgtacagcttcttaaagactattctaataggactaaagagaaaagataggaataaatagcactttttatctgactttatttcagaattaagctttgttttgcctattttgatttatgtagttaacattttccattgccttgattgactatcatttagtatgtcaaaaaatgaatagttattcaaaaaaggtaaaatttttatcttgtcctagggaattgcctcaaaatgttgatagattgcctggtcttattacagctctgtgacataaccatcacttacaacaggctaatttgtcctacagcattgaaatgcagctgtttatcttggagagagacagcttctcatacttcggttactttggcacagttttgcattgtgtgtttctgtgggggtgagtgtgtgaatgtgggtgagtgtgtgggggtaagtgtgtgtgggggtgagtgtgaatgtgggtgagtgtgtgggggtgtgtgaatgtgggtgtgtgtgtatgggtgagtgggtgaattaaagaggaaagcagagatgttgggggtggaggacacacttagaaaacaatgcatttgttgaacaaacacctattgggtacctactgtgcgccgggcagtattccaggagctggggactcagtggtgaggctcctctagtgggaaaaaatactaacaaatgtgtaacatcgggtagtgatcagttccatgaataaaaatcaggtggcatcaagggaagagaggtgatcagcactggcttgtctgaggcagccaagggacagtgggggagcatgtggaccctaagctggaactggcagggctgtggggttcaggagctgtgtggaacacaggtcagatgtgagggcagtggggcagccagagggtgaggggaaaggcactgggcagcccagaactgggagggtgagaggggccccggggcaaggcctggtgttgctggggtgggggaaggttgtactggggtgtgcctgagggtggagcggtaggattggccagcaggtggggtatgaggtaaaggtgactcccagtgcttgtggagaacctaggtgtcctgccgagggggtgcccagtgagtggagggtgatgggcttgggggagaatggggagtggagccatgcaggctgcagatgggggtgagtttggtggctcgcaggatcatggggctggagcgagtggagaggaggacagagctcgtgggggcctgggcacaccctcagaggctgcctagaggctggggtgggcttggccatgaagtgactgaagggaggcaccagggcagctcagccagggcgtgggccatcatccagttcctggtagatattgtggaatggtttgttttgtttgagagagagtctcactctgtcatccaggcctggaatgcggtgacacaatctcagctcactgcagcctctttctcccaggttcaagtgatcctcccacctcaggaaccataggtgcatgctaccatgcctggctaatttttgtattttttgtagagacagggtcttgccatgttgcccagtctggtctcaaaactcctgggcttaagccatctgcccacctcagcctcccaaagtggtgggattataggcgtgagccatcgcacccagccgtggagctctaatgaccaaaatttagggagagtttcttttgcttttttctctatgaaatgagttgtagtcctcttaggttggtgcaaaagtaattgcgttttttgccattaaaagtaatggcaaaaacggcaattacttttgcaccaactaaatactttataatctctgaatttgccttgctttctgtaattttcctgtgtccatgtctttcttccattgtgaaatctttttcttgtgtggtacttcagatgtttccagttattaagaactcttgaggctgggtgtggtagctcacacctgtgtgcccagcactttgggaggctgaaacaggaggatcacttgagctttggaattggagaccagcatgggcaacatagcaagactctgcctctacgaaaaataaaaatttagccgggtgtgctgaagcatacctgtagttctagctactagggaggccaaggtaggaagattacttgagccagggagtttgagactggtagtgagccataattgcaccactgcactcagcctgggtgacagagtgagaccctgtctcaaaaaaaagaacttttaagaactgtgccctcccctttggaaaatagcagtagtgtttttttggagtcaagtaattcctccaggctgtgcataatggctcatgcctataatcccagaactctggaaggccaaagcaggaggattgcttgaggccaggagttcaaaaccagcctgggcaacaaagtgagaccccatctctagaacgaaaataataatttctccagttgttaaatttcagtgaatgagacacatgcctaattaacaagacttcaggctttacatatgttaatatgttgccatctcatgccagtcagaatggcgattattaaaaagtcaaaaaacaacagatgctggcaaggttgcagagaaaaaggaatgcttttacactgttggtgggagtgtaaattagttcaaccattgtggaagacagtgtgacgattcctcaaagatctagaggcagaaataacatttgaccaagcagtcctattactgggtatatacccaaaggaatataaatcattctattataaggatacatgcacatgtatgttcattgaagcagtattgacaatagcaaagacatggaatcaacctaaatgcccatcagtgatagactggataaagaaaatgtggtacatctataccatggaatactgtgtatccataaaaaggaaggagattggctgggcgccgtggcttacgcctataatcgcagcactttgggaggccgaggtgggcagatcacctgaggttggaagttcgagaccagcctgacgaaaatggagaaaccccatctctattaaaaaaacaaaatgagccgggtgtggtggcaggtgcctgtaatcgcaggtgcctgtaatcccagctacctgggaggctgaggcaggagaatcgcttgaactcaggaggcgtaggttgcagtgacccaagatcatgcactccagcctggtcaacaagagcgaaactccgtctcaaaaaaaaagatctgccggtcacggtgactcacacctctaatcccagcacttttgggaggccaaagcgggtggatcacctgaggtcaggagttcaagaccagcctggccaacatggtaaaaccccatctctacttaaaatacaaaaattagctgggcatggtaacacatgcctgtaatcccagctactcgggagactgagacaggagaatcacttggacccgggaagtggaggttgcagtgagccaagattgtgccactgcacttcagcctgggcgacagagcaagactccgtctcaacaacaaaaacaaaaaaaaaaaaaaagaaaaaaaggaaggagatcatctactttgcagggacgtggatggagctggaagtcattgtccttagcaaactaacacaggaacagaaaaacaccacatgttctcacttataagagagagctgaacaatgagaacacatagacacatttaggggatcaacacacgcaggggcctgtggggttaggagagggagagcatcaggaagaatagctaatggatgcggggcttaataatacctaggtggtgggttgatctgtgcagcaaaccaccatggcacacatttacctgtgtaacaaacccacgcatcttgcacatgtaccctggaacttaaaataaataaatatatagctatcaaagttatattttgcttcttgccaaaatcagttacctttatttgcagaatagaatccaacaactgatttttgtttaagaaggaatcgtagcgtatgtctgttaaacaccatataagtaactgactctgaacaccagatgaggctgtaacaggtcaggtttaagcacaagcatatagattcacgaaatggcgtcagaccctgccctggttgcttaggatgcacaggagaataaattgcactctctccttcagtttgcagtctgatgagagagacagccagatgtacagtttaattcatgttagtatgggaagtactgggactgtaatattaataacatgccaacaaggaaggaccagttacaatagcttagccggagtgtcaaggaaggctttagtgaggaggttgcctttcatttgatctgggccttgaatttgtcaactaaagacaagggagaaagagaatagatggaaagcacagaatgataatgagtttggggcctgatttgtgcaaacattccttataaattgcacttcatgcttgagatgaaacaagttgaaaaccgtttgagcagtgttgacagtagagtgcattttaaggtgtgtgtcagcttctctcagggcctgcagacatttcagcaagcacgcgtgtttggggtcctgccagtgcatctgcccctgcctctcagcctgaccaggggagagcagttgctggttggctgcctttgctccaggcctggttctgtgacttgcccttgccctaggccacctctcttttcagtgatgtgatttaattcccatgtattttgttttttttttttttcaatttgaacacccttattctcatcccctgaggccttcgttgagtttatttctaggaagaacagtcctgatgtagggagacctaaagcccaggtcattctaattctcctacactccctgtgttctgtggtgtgtcacaacatcaagtgttgataaaatgtgctgaggatgcatggaaaccctggaccattgcagttcatataaggatttcttttctacgtttaaactgtggtgtagacagtatgccagctattttcaggttttattattactttttaaatttataggttagcataatttaaagtgtcaggaaacaaaccttttagatttaatctagaaattctggaccatcattctttaaacagctctgttaacttgtgaaggtcaggatgataaagatctcaccctatgggaaagcatacgtggtacaagtctgtaggtatgaccgctttggaaatcaactgtcagtatcctactaggttggacattcaggcactcagttaaccagcagttcttctcctggatgtgtaggagaaacacacacgccaggaaatgtggccaggtgtgaccagagccgcagaaatctggaaacagccggagcacccatcagcaggtggaaattatattacagtgttgttatacgacaaggagatgtgtcatacagtagtgaaagttagaggcctgcagttatttgcaataggcagatgagtctaagaagtgtaatactgagcgaagtccagaagactcctatggtagaattctgtattaacaaaattcaaaaacaatcagaatgaaacagtgtttcatttggcacacatatgtatagtgaaacctttttagaggcagaattacaaaactcagggttgtggttttaatgggtactccttgtgggagaatgagggtgagatgggagaggtaggtgcagaagatggatgttatcagtcatgctcttggacctgggtgttggcttcatgggtgttcactatgtagttatgctttttttttctttctttcttttttttcgaggcagtgtctcactctgccgcccaggctggagtgcaatggcacgatcttggctcactgtaaccttcgcctcccaggttcaagcaattttcctgcctcagcctcacgagtagctgggattacgggtgcccgccaccgcacctggctgatttttatattttcagtagcgacggggtttcaccatgttggccaggctggtttcaaactcctgcccccaggtaatccgcctgtctcggcctcccaaagtgctgggcttccgcacccggcctgtgcttttcaactcacacatgtgtgcacatatatgtttgtgtgatcagaattacatttaatttcatagataggactgatttcattaatagacaaatgaaaaaaaatcagcagcagattcagggttttttaaaaaatgaatgtgttattttcctttggcttctgtaacaaagtaacccaaagttggtggcttgcaaaaaacaaatttatcctgtcatagttctgggtctggaaatgcaaaaccaaggccctgctgtctcttgacaactgtagggaaggcttccctgcccctctcagtttctggagccaccagcagtccttggccttccttggctcatggctgcaccactccaacctctgccctccatgttcacgtggccgtcttcctagtgcatgtcctcacctcttctaagggtggcagtctttagatttagggtctgcccgacgccagggtgtcttcgtcttaactgacgccatcttcagaaatcttatttccaaataaggtcacattctgaggttccagatagacatgaattttggaggacattattgaactcactgtagtagtcaaaagctgtgaaaatgccttttcacaggaaaagaaatagaaatgattaatagagaaatagaaatgattaatatcaaaaatatgcttaagactgggtgcagtggctcacacctgtaatcccagcactttgggaggccgaggcaggtggatcatttgaggtcaggagttcgagaccagcctggccaacatggtgaaacccctcctctactaaaaatacaaaaaattagctgggcacggtgatgtgttgcctgtagtcccagctcctccggaggctgaggcaggagaattgcttgaacccaggaggcggaggttgctgtgagccaagattgcaccactgcacttcaacttgggcgacagagtgagactccgtctcaaaaaaaaaaaaagaaaaagcacatatatatgtgcttaaccacacattactaaagaattgcaggtcccactcaccccatttttttacctatcagattgccaaagattgtgcgatagaattggtgaggatgtggaaacgtgcatcccctgatactgggagtggagactggtgtgggcttgttgaaagtcgaacacagaaagttactgagtggccttctcttccctggccacagtgctgccctccactcccttctttctcagcctccctgccctgagccccatccctattctgccgcaaaaccactgtgggtgcctgcagagttgggccttagaaacatgccgaggaaagcaagctcctgggggagaggagcaaccacgttccgaggacgagcttccctcgggtgggccgctgccctcctcagccctcagacccgccagtcagactctggctctcagcaaatccctccccagttccttcagcagaacagcaacataactggaggccaaaagaggacctgaaaagatggatgggggaggattgaggcatcctgtggccactgggaaaccgctgccacagtcttctgctcagcagggactgttcagcgtggctccatctctggctcttcctcatcagtctctccccaggggccctgcagttgatgtccttgtggggagtccttgcccttgctctgctcatggacaggcacccagcaggtgcccatgggatagggcttaatagtcgccatcatccagccttagcaaaggtgaagtttgtgctattagggaaggcctaacccaaaacctatcccaattttctatggactaaagataatgtagattaaggttctaggttagtaatgtaaatactcagtaggttatgctgctctgacatacttgggaagcatcatttccagactccaaactaagaggccaagggaaaccctccgtctctcaaccagcagaggcagacaccagctgggtccccagctccactgtccacctgtgctgtgagtgctgtgtgagtggccatgcctgcctgagcattgcacgataggggctgtgtgaaccaggagcagctctggcacagaggaggcgtgctaaggggaaacccttgtggcgaggcccccaccagcagactgttctgaggcaagccgccctcactggtcagatctgaccagatctttggagatacctgtggcatcctgagacactcacactccgtgacaataatgactcagccatacgtaatgtgagtgccataacttagaggacagcgatggtgagcagagccattcctgggggccccatggggatctcagcgggactgaaggaagacaggttgtgtgtttaaagttgatagtactttctctctctgtagaaacacgaagacaccgactgtccctgcgtggtggtgtcctgccctcacaagtgcagcgtccagactctcctgaggagcgaggtaggggcggccgggcccggccgggagtctgtggagtcctcagggctgcgtgcctggctccccttccctgcatagccgaagcctcacgttttcccagttcgtgagagtcatgtgtatggcagacaaacaaaaaccacagcaaaaagccttatgccattttttggaagtcagaagcaagcattagggttaaaagctacagtgtatggccgggcacagtggctcacacctgtaatcccagcacttttggaggcctaggcagatggatcacctgaggtcaggagttcagaaccagactggccaatgtgctgaaaccccgtctctactaaaagtacaaaaactagccaggtgtggtggcgcgcacctgtaatcccagctattcaggaggccgaggcaggagaatcatttgaaccggggaggcggaggttgaacagagccgagatcacaccactgcactccagcctgggcaacaagagttaaactccgtctcaaaaacaaaacaaaacaaaactacactgtggtaaattcagagcaaagattgtgaagcattaagaaaatgggaatattttacatacagtacaagcaaaggtgacgaggggtttttaaagcaattttaactctatagaatagtaattgctgtaagattatctcaagaacatgaattaacttagagacacttcagaaccattttgctcacacatgccgggtggaggacagctcccacattttagggctgccagaagggcccctgtgtggcctctcccaaaggttgcacgtctcacattgcgcttggcactctttctttgagacaggtagattttgcattgacttcacttgatcaggatatgtccagttgggaaaatttcaaggattcttaatgtttctgcatctgtcctgacggggagctcctttagttagtattctgggagtcatctggggctaccctgggctccctggatgtgtggtacgctgatctaaggagccggctcaccttttcacctcagcatttttcaacagcctgaaattttaccactggatactgggtaacagggagaaccagcctcgcatgcccctgactgagcaagagggcccatgtggggctagggccagggactcagggtagaggagggcccagagagccactctcccccagggtgtgccctcccagcaccttgaagctgatgggtgagggcaaagtcttgcctgatgacagtggcctctgggccctgaatctgcccctgggaggagctagggaaaaataaatgtaaattattgccacaactggacaatcctctgttaatgtataaagagtctgtgctgttgaaataatttctttttttttttttgagacggagtctcgctctgtcactcaggctggagtgcagtggcgtgatctcggctcagtgcatgctctgcctcctgggttcacaccattctcctgcctcagcctcccgagtagctgggactacaggcgcctgccaccacgcccggctaatttcttgtattttttagtagagacggggtttcaccttgttagccagcatggtctccgtctcctgacctcgtgatttgcccgcctcggcctcctaaggtgctaggattacaggtgtgagccaccgcgcccggccaataatttcttatttaaaacattgttaaacctgcatttctgttgggtttctgatgaaaggtgcttttgagctatagattattcttgcccctattccagagatcctgtagattccccgagactcagaatactgataataaaaccaatttagaaaaagacccaacaccgaatttactctagtacactgaaaataacatacatcaaacccagtgtgtcagtgtgtccctggcttaacatgtaatagcgttgacactcaggtttgttattgcagtaatgacactggaagaatacattccaagtttttaaatgaacctggttctgcgcagtcttcacactgcgtttccttgccagtcacctgtcacgtgccttgtgggcgcttcctgcaggggcagccggtctgggttctgaggagcagcaagggcgtcaggctgccaggttcctaccaccttgactctgccctggctctgagaccttccttgaaggttgaccctagcagtggccgcatgggcccctcagtcccttcccgcagtgtccctcctccttagtttcgcagcagggatccattttcccctctgttgtaaatatccacctagagggaaggaccgcctttgtcctggtagactgagaagttgtagaacttagctgcgccctccaggaggatgtgctctatgagccttgggaacacatgcatgctggcacacagaagaacacattcccggctgctgcacccacacacccatcctcccaaaaagagtctgttttctgtgaagaagatctatccctagagtttcctgatgggaatttcttcaataaaagacaaaacttctgctcagtcttggggcatgataaagaaaaagaccaaactatacctcatttgtattagcctaacacatgactctaagtccttaaaatgtaatcctttccattcccttttctcttgttagggcatcataagtaatttttatttgataactcaccagcatttgagctgagcaagggacttttttcttgcaaaacgagttacctgctcccagccccacctaattttcctgccatcaattagagttgacagtagtaagagtgtatggttagactgatcttagaggtctttgaaaagctacctgagtttctggcccttacagagggaaaaagtcttttcagatgaaggaaaaactcatctgcacttatctcaagtattatgagtaatggtacattgtgtaagcttgctttgaaaatatatttatttttgtgtaccgtatattaggtgtgtgacccagttgcattctgaatgctttctatttttttgtgttttcatgcaatttttgtttatggtctttaaatgtgcatttcagtttatgttttttctttcttttttaaattctggcactacagatggcatgtcacattgaacaatttgttctaaagaaactggaagtttaagaaatgttatagtaaatgtattcttgtatattggcgtatatgtgtatacacgtgactagaccgtatatttactgcatagaagtctaggcagcagatgatatatacacacctgtagcgataaacaccattcttaatagtacagctcagatgctatctgtgccctaatatgtttgaacattttcatgcaaacgtttgtgccacaactcacgtctctttcccgttgcagttgagtgcacacttgtcagagtgtgtcaatgcccccagcacctgtagttttaagcgctatggctgcgtttttcaggtcagtatccgacatttgtccttcccagtcactgacattctgccatgagagaaagttattatattaacattttaacatgcaagctctggactccttattctttgtcatgaaactgaaacaccctgttgcatgggtgacgaaagccacatgcagcaggtgggatgctcgctttccagttggtggtgctttgagacttcagggagacactgtgctgaggtggaagttaatacattaagagaagtactacatccaaaaccagctagtaatgcaacaggtagacttgacatttggtggggttttcagatagattgttacggaaattttagcagttacctgaatataagcgaatatcaaactgagcatagtttcaacagcgtgtgtgtcagtacacagccataacgatcacacacgtgtgtatccataaatgcatttgatgtacatgtctgtgctgactctgaccccaacgggggacagacgcaaaatggagcacagctcatagagagcacacctccccgagaacagtgtggggagggcatctctgttgctgccgcacatgtagtgtgagaaatctgcatctggtgttttgttgttgtttattttttaacacatctgagattgctagtgaattggaactgagttttcatttaaatatatgtatcttaaaactatcaagaggcagtatatgttacaattaaagtattttatattttatgtagcaccaatacattattatgaagtcagtacagagagattggcatcttagtattttctgaggaagagaacagccaaagagtaagaatgactgtgccttcctttgctttagtctctaacaagactgagcctcccctgttctgtcgtacgtagtatcattcattctctctgtgtatgtgtatatatatgtttatatattgcaacacttatatcaacatatatatatgaatattctatgtacagagtatatgttttggagatcattaaaatgctttctgtggcttcttaattttctaatagcaaaacaaattatatttcagacaaattattttcttaaatatatgaagtacaatttcatgtgcttattcctgactctaaaatggtctacatcttatgtactctgtagattgtatttgttttgtatgtaacttttctaagaatactggaatggtgaagagcaatacatctttggatacagtgtatttgaactaatacattaatactttagtaaattcttttgaatcctgctttgcttacgtgtttactagactgttgtggcagtatctcgctacaactacaggtatctaaacattttccacttatgctatattttaatgggaaaaatagcttataataggtcaagaatgagtttaaaatttaatttcttgatattacaagtgtcaacccttgataagaagccacttgagatgagctgaagggatgcggagataaccctgagatgctcactgtggcactgcagggtgctggctctgctgctcctggcggcctcctcacctgcacgcagtagccaggtggccctgagcacagccctccttaggcgcagagattccctgttcacttgacgcaaataggtctcccctctttgtgtttagtgctgcttttagggtcgtatgttagccgttctgccctttgaaatgcagcgaggttcgctgaatgcctcacatgtttgctctcgcaggggacaaaccagcagatcaaggcccacgaggccagctccgccgtgcagcacgtcaacctgctgaaggagtggagcaactcgctcgaaaagaaggtgggctgcacactttcctgctgctatgggatttgtatcatctcttcagattatttaaagacaaaacctttttgtagttattaatgggttttggataaaagaaactatcaagagaatgtcaaaaaaaactctgtgtgatcttgagcttataaatgaaggtgttttatttttgttatttgttttttaattgccaagcaagtgtgaagtgcttttttaaagtcaatcacattgtgattattttagcatccatccagcacagagatgatcagatgcccagtccccaccctgctgttttttttttgtaaacaaagttttattggaagacagccatccttactcactctgtgttgtctgtggcttcttttgctcgaaagcagcagagttaagagacatgtggactgtaccgcttgagatactgactacttggctctttacagaataagtttgccagcccggacctgggtggttacccctctaaatgcgttaaacttctgtgttttttacaagagacaaacaggaaaaaatatttgatatgattacaattgattttgtcatttgacaccttgtgaaacttggtgcgctctccacatagacagggccacttcccaaagagactctcccatgctgttctttttttttttttttttttttccccaagacggagttttgctcttgtagcccaggctggaatgcagtggtgcgatcttggctcactgcaacacctctgcctccctggttcaagcaattctcctgcctcagcctcccgagtagctggtattacaggtgcgcaccaccacacccagctaatttttgtatttttagtagagatggggtttctccatgttggtcaggctggtctcaaactcccgacctcaggtgatctgcccacctcggcctcccaaagtgctgggatgacaggcgtgagccaccacgcccagcctccatgctgttcttaagaggccttcattgcaggcctataggcgcaggagcaagcaccttcctccagtaatgctggttctcagtggagtttgttctgtgatgttcagctcagtggggccttcttttcatgagaagatgaaaacctctaagaatggatagagaagaagttgttataggatctaccattgtggcttaattacaaaaatataaacttaattcaatattcaacaaacgtctattgagaacttgtagtaggaggatactatggtgaattagaacagccagtggagttgacatttgagtttcgtaaagatttgaatgtcttgtttccagtgttaaatcccagcaatttaaaatgtaaatatactgcaaggagtctaaaattttaaatagaaagatttccctttaatctgccataagagagtgtttcatgtaaatgcgtgagctgagcttgagaagcagcaggaggatcggcatcctgtgcacacacacggagcagaacagcgctgatgagcagcagtgccggactcatattcgcagaatcctagccatcttcccgtgagcatagagcatctgctctgagttcaacaatggtttacctaggaatcttttttttccctctttttgaagctggcattttatttctgtctttttaaaattataggcatagatcacaggctttttatctttcatagatgctgtgtttctcatttagaaggttcttcctttcattttaaggataggctttgtggccgggcatggtggctcatgcctgtaatcccagcactttgggaggccgaggctgaggctgaggtcgggagttcaagaccaagctggccaacatggtgaaaccccgtctctaccaaaaaaaaaaaatacaaaaattacgccagcatagtggcaggcgcctatagtcccagctacttgggaggctgaggcaggagagttgcttgaacccgagaggtggagtttgcagtgagccaagatcgcgccactgcactccagcctgggcgacagaatgagactgtctcaaaaaaaaaaaaaaaaaggaatgggctttgttactgctgtgttagatacacagtagttgaacaggtctgcagcacatggttatccagcaggatggttgtggaccgtggtgtcatctggcagcctttcggggcctaatccctgtggggatttggctccttccttcctgttctgtgctcttttccccactgaaagtgaatggtttgcatcattggaaaccccaggacataccagagcagcctgcccacacacagtgcagcagtttctcactctgtcaatgcctcatgtgtttaaactatctccagccaagtcacgatggaagccccgagagtgcaggatgcataactgtgcacttccctcttggacgttgccaaaggactgatctctcccggactctgtccatcagagcagagtcctcgccctgttgtcaggccagccagctcggctctgcacgttctcattgtgctcacgagaaggtgtatggtgccctttgctaggtccaaaagcaaaggctggacaaacagcagagatatttatgtttacttaaaatgggaatttatttcttattatagaattatttagttggaatttcttaggttattttgttcatctgtcttagaaaatagaatgtttgagcgggttcacaaagactgatcctcagctgggcgcggtggctcatgcctgtaatcctagcactttgggaggccgaggcgggcagattgcctgagctcgggagttcgagaccagcctgggcaacacggtgaaaccccgtctctactaaaatacaaaaaattagctaggagtggtggtgtgcgcctgtgatcccagctactcgggaggctgaggcaagagaatggcgtgaacccgggaggcagaggttgcagtgagccaagatcatgccactgcattccagcctgggtgacagagtgagactcgtctccaaaaaaaaagactgatcctcacattcatagtcaaactaaagaaaaactgcaaaatctggacttaaaaacacccattttatattttaagagagcttaaatggaggggaaatgtaaagcccaccaaagtgggctggagtaaaggatgttctcattgcagagaacctcggacctcctgggccggtgttttgccggctccttggaacacacctgccaggtggactttcctgtgcctatggcatctccctgctagaagagtggaagcagtgatctgcaggacctgggagttggattcttcgattaaataaataaataagtagtttaaataagggaagtcctaaagtgaaagaagttgagtttagtgtggcatgatgtgtgttcattgctgtaagctgcttctgctcatactcaactgcttgatttgttggagagcagtggcgcaattatggctcactgcagcctcgacctcctgggctcaagtgatcccatccagcctccccagtagctgggactgtaggcgtttgcaccacacctggctaatttttgtgtttttttgtagagatggagtttcgccatgttgttatccaggctggtcttcaattccttgggctcaagtggtccgtctgcctcagccttccaaagtgctgagactacacgtatgagccatcacagctggcctattgacaatgttttggagacattactgagattttttcaaaagagttggcatacatgtcatctttttgcagggatatgagaataaagagtctgagaattctgtcccgtctttgacagatggaaatgaatgaattgttactttcagagggacacaactaccacgcgatgctgcatatggcccgctccacattcgtgcaggttgatcacttgtaggagttcatggacgtatgaggcaaggaaggaaggaaagcctttgcggagtaaaatcctaggaaagtgaagttatattttgcccatgagacattgcaagttttgtattccttagtaaatacatacttgttttaaaataagacggtgattgcttcaaaagatgtctcttgacttggccaactgtgccgaatatgaaaaggacacccatctttaggctggctaccctttagatggacagcatcgggagtcagctctttatcacatctggttttgtgccgagatgccctcgggccatcacctttgtgaccattggtccccacgcattggtggttttagagcgtacatcgttggagaggcacacatcggatctggcacagagcttagggtcttctggggtggagaccaccaccccaatggatagacagagacactcgttaatagatgggggatcaagatgccctttgtaaaaatcttgtgagaaagaaaccctcgttggagttacccttgaacttttcatctttgagaccaggtgttaatttgtctttgggagctaattatctttcagaaagattttggaaaggtcaaatgtggggttggaaatgctcactcagcaagccctccctttggctgatgtgggttgcaggggctcttctgcgcttccgtggaagggtatcctcaggcatcagctctgcctctccgtgttgagggtgagcaggctggccccaagggtgtagcacccatgtaattttttgtattctcgtcacgctctcattatgttggcagagctgttcaaactgcagggtgtggcccctgggtggatgtgaaataatttagtaggttgtgaccagcattgtttatatttatggggtacagtgtaatgttttggtatatacacacacacattgcggaataattaaatcgagctaattaacatatccatcacatcactttgtttaaaatctgctcccccagcagtcttgaaacacacgttagtatgaatcacagtcaccatgctgttcagtgggctcaaaaacgtccgcccctctgtctaactgaggctctgtgccctttgcccagcagctccacaagcctacccccactacccacctccaccagcccgggtaaccaccattccctgcttctgtgagcttgacttttttagatcccacgtctaaatgagagtgcatcgtgtttgcctttctgtgcctggcttatttcagttagcataacatcctccagggactagtattttcttaaatgaaatggaataaaaaaaatcagggtgcattgtaaattattagggcaagtacagctttatgacatctgttttcagggatacacacacacgttggtataagtggggtgatacataagcatctgtttcttactatgttacctggtcaacaattgaaaaatactctgataaaagatttgctagtttttagcaaaaacttgaaaaagcatctgatttattctgaaattcaatcagccgctgcactttgcctcaccctaattactggaagagattctgagaaacactgtttatagcattccctattaaattaggactggctgggtatggtgactcacacctctaatcccaactctttgagaggctgaggtagtaggatcactttaggccaggagtttgagaccagcctgggcaacatagcaagaccctatctctaaaaaaattatttttttaaagcctaaccagacatggtggtggcatgtacctgtaggcctagcttactcaagaggctgaagtgggaggatcacttgagcccaggaggtcaaggctgcagtgagctatgattgcaccactgcactccagcctggggacagagcaagaccctgtctctagaggggaaaaaaaagaaagaaagaaaagtaccaggactgtcattttctgtgtgaagggatttttttcttctgaaactctgtcaataagctaacagaaggcctatattgtgaaaatttaattgatattgttgttaattaatatgaaaaccacttttggttacattaattaaagaatttcttttttaggtttccttgttgcagaatgaaagtgtagaaaaaaacaagagcatacaaagtttgcacaatcagatatgtagctttgaaattgaaattgagagacaaaaggaaatgcttcgaaataatgaatccaaaatccttcatttacaggtaagaatcttaggactacggccagatcaaagggtggaggagcttgcctgtgttccccttaagggtttcttagcaaactctttgagctgagtccttgacctttgcaagcagaaaggcaactgatttctctggcctaagtgaaggcttagaaaaggcagctggactagcacaggcccggcctgggaagccgcaggtcagcgttttcaaactgccttttctctggagagcaagcctccacccctcttccatgcctttgatctaccgttggagaaataagatgcgaagcttgtatttgttaaattagctgtttttattatttaagatttcatattgttcatgagtagttgctgtgtgcaaagtctcacttcctgcagtgaggtgctgtgcagcccagctactctgtgtgagctttccagtgacacgcgctcacccgctgggtttcactgtggaaatccacacgcacctccagaagaacaaaccagtgaacctttgctcccctgaatagaggcgatgatgtaaaggggactgatgaaatgtcgcttctcctgtcttctgtcgtcacaggtgtctgtggggtgcttgttaatagatgatcattgtagatgctctctgcacattcacttactcgtgtgcatttgtgatagcacttcccatgggtgtgtcacacaccgtggaagaatcactcatgtcactgaagggcctgaacttagacggtgtgtccctagattatctggaagagaaactacttctaatagcacagagtcatggcatctttgagaatgccttttctccaatttttgacattggagatgagtcatagtgacttgaattgcgtagggatttattaaattaatttcatttttattatattttgtagttatccagagagagaaggagaaaacacaatgaaacattagattgtattagaaaaggcacaagtcattagcattaaatcaagccaaataaagtacaatgtttcttaaaacaccaagcctcccgctggaagcccctagcattttgctgagggcccagtgatgtgtcagtcatcagactggccaaggcgactggtcaggccactgctgcggggccctggccatcctgtggcccgcctgcacctgcgctccctggcaagcagctctggctgttcatgagattattgctgtgttttgacctggggctcagagaggcactggaaaggccggggaaatcacctcttaaaatagccacaacagaaggaagaatgcacaagtactggattcatttacaacaaaaagttagaatatacacagtgatgtaccaacgccccatcccaaacctcacatttcctctgcattcatcttcagtttctccccttccagtcaggtgttgtcatttactttcctttttagtcgagtttaatcactctatggtatgtgatttctacttgaaaacttttgtgattggatgaaccaatgaagcataagtcagaaagaaagggggaagccaagttgccaagggcagagaagtgaggatggagtggtgacggcagcggtcagtgtcccttgacctgtgacgagtagaaggtgatggcgcacctgcctcttccccacaggaggctgggcgtggcggagagcaggttgtgtttagggaagggactcagagcaggctgcccgcgcctgattcccctgagtgcagggacacggctctgcctgaaacatgtgaaaactcttctccatgtgacctgttgagcaggcgtggtctacacagaaggtccttccaaccgtgtggttttttgaaaggggaaattcagtgttacctttgggaccactgtggggttggtggtctttggccaggaggattctgcactgtccatcctcaggaaatgctgattgaaagccttctgatgcccagaggtgctggctgtgtgggagctgcacggggccaggccatccctctgctgctgcaggccccgcctaccctcttgagcagcagcccagctcagccgtgttccccactgtttcatcctcagagcccttcctgttgccccaggaagggtttatcgtaaaatcttactgtggcccagaaaacctctgtgcctggccaccggtcaccttcccagcttcgccccactccctgcgctaaagtggacccgctcattgttccttgacaagctccatgctgctgcacagatgtctttttctcctgcttcccttcctggccagctccaggcactcctccagccatgtttgtggaccagctaggtgatgagggcacacgtcacttggggtcttcttctttcttccttgtctgattctccagtagaccctaaagccctggtgatggcgggagtcgaagcacagagggcccgatggcctggctgtggcagtgggggtgcaggcagggggtcaaggagtggaattcaagagtgtctttgcttttttgcctgtccggggaacgatgagttcttaatattttacttcttaaatatcctgtttttctttattaagaagacagccaggccggatgcagtggctcacatctgtaatcccagcactttgggaggccgaggcgggcggatcatgaggtcaggagatcgagaccatcctggctaacacggtgaaaccccgtctctactaaaaatacaaaaaattagccaggtgcggtggtgggcgcctgtagtcccagctactcgggaggctgaggcaggagaatggtgtgaacccgggaggcggaacttgcagtgagccgagatagcgccgctgcagtcaggcgtgggagaaagagcaagactccgtctcggaaaaaaaaaaaaaaaaaaaaaaagacagcctaggccggtaggccggacacggtggctcacacccatattcccagcactttggaaggccgaggcgggtggatcacgaggtcaggagttcaagaccagcctggccaagatggcgaaaccccgtctctactaaaaatagaaaaattagctgggcgcagtggcaggcatctgtaatcccagctactcgggaggctgaggcagaagaatcacttgaacccaggcggcagaggttgcagtgagcaaagattgcgccattgcactcgagactgggtgacagagcaagactgtctcaaagaaaaaaaagaagatagcataggtgcgagcatgacccaggcttctggtgtcagtggactagatgaactggtggttcttacagtcagggggtccacagggcacacgtagaggagcacgcactgggacagaaggcagggacgtccatccacgcggccttcactcaggctgccggcaccaccgggcttctcacagcgccgggcttgtgtgccagggtcgcagtggcctgagagtgaggcatcacagcaggtgacacggttgcagccctggcatgcaagtgtataaggctcacgggctgatgctccctgaaggcaaaccttctgatttggattgttgatgtggagtgcagtctgtctcttcagctctgtgtcggagtcttttttctgtacaattccatacctgcacttgagatttattttttatagaaactgcagtgactgagtgtagaccgttcttcaaggatgaaatcacgtttgctgcgttttagagaacacttgatgtgactctgcgttctgctttgaaatggtgccattgatacagatgaagtgcctgttttaaaaatagcccgagttcccttgctgctcatggagacgccttttatttagtcgtgctggtctgtgcatgcggtgcacgcatgttgtgtgttcctgactcgggggcccctgctgtgtgggggagtccttgctggagactccccgttctgtgcttgaggtcaggcgtgcccttgcgtagcacaatcgcggggaggggtggctcggtgccatccccctcttaacctcgggggcctgaggctcagcgtgaggcgcagcttgtcttgggccaccctgcctgggactcatgcttcatttcggggtttgctaagttacaaagggcgtctctcagacctctgttgatcaggttttcattaactttcccctgccactcgcgagcacccctgccagctcagtgtgcgtgttagaaggtggagatgcgagaggcttccggtgctcactagaggagccgtgtatttggatgttcagtgtcgtcagtggtattgtcccccagcaaatagacttggtgagctaattaaatatccttctgaacatgtatgattgtgtaaaataaagggacagtgacagtgtcagtttaaagggacagtgacagtggaaagaggtgttctttagagaaattatccttactttttagaggttaactaatatcatgtttcttggaaagaacaggaagaataacactgcttttacgcccaaaaagccacccagacctgtcatgtttgtgtctttgtggttaataacagccagcaaaggtgctgaaacctagatgtttaaaaatagacttccaaaaggagaagtgaattcagggggccctggggcccgcccctcgagcacccggtgtggccctcagcttgtgaggtggctcagtcattccacagctgcattgagcactgaactctccagccatcacaagctgcttgaaaatgcacatcattttttgaagtgaaaaccctttaagtccctggcttcatctcacaggtggacactccagccccttaacacagactgggccaccagggcggagtacagctcccacccctccaggtagtgacaaatatgagcagcctgtgtgttttgggaaagggctttctgaattagttaaatgaagtagcataaagtcaggcctggttactggcagcctcgtgtgttcgtggcagggtttctgcgttcctgcctccctcgctggggcctggcagcctgagtgtggagctggagggggaagacccctgcgtctgcagcatcggcccactgggtttcacctagggcctgaggacatgccttggggccctttcctgccaccatccaggtgggaggggtctgaggagtgggagtcttctcctgggaccctggggtcgttctggggaaccccctgcagccacagagacaggactgtgcttctgccccagacccagcagcagggtaggaggcctttagacgttccaagggaagatgaggccacatgggcatgattctggcatcctaaacctgagaccctgtggcagccatgcagggccacctgtcccgtgggacctgcacttacaggggtgaggcctctctgggaagcagggaccctctgtattatggcccccgaggtatacgagggctgcagaggagatgtccatgggagccttgtggccccgcacaggtgctgtggcctgggagaagagctgggagggacacatgggagtgtgagggtgaggtcggatcctggtatctgaacaggagagctggtggggttggctgatgccagggtgtgggtgtgtgagaaacaggcgggcaggcggcaccagtgccactgtgaaacagggaagcctgctgtgggcagcagaagcatgagctgctgcctgccccagagacagtggagacctctcccctggtcttctgaacacttgccacctgtcactttgctttcctgatggctctctgttgacaaagcaagctgacttagtggagcctcctgttgttttcttccatgtggcttcatgtcacctcgagtgctccctgccggcacaagcacttgatcccagggagctcccaggaggcctgatgcagagccccactcctggagtcagagccgcgggtggcaggcctcatacaggggcctctgactgttctgctcctagcctgtctgtatttgatggaaggtggtgcagcattttccgagtcctaactgtgttttgctttttaacacctttggtttggaagcgagtgatagacagccaagcagagaaactgaaggagcttgacaaggagatccggcccttccggcagaactgggaggaagcagacagcatgaagagcagcgtggagtccctccagaaccgcgtgaccgagctggagagcgtggacaagagcgcggggcaagtggctcggaacacaggtgaggcaggggccggggccgggccagcagtgtgcatctgggccccgggcgagtgctggggcggggtccgtgggatgagggctatgttaggtacatgtgccttaggacagttttttctaattatgggtaacacgcagaggtgtgatgactttcctactgaaagtcccccagcaaagacaaacgtttcccgcgcaggcttgtcccctccgtgtgaggccctacatggtgtagaaagtaggggcagctgcagccacgggaagctgcaaagccctcctgggagagactggccgcagggtgacccacaggacaggcccaagcgcagatggcagaggccaggacctgctggtcggggcgccccagaccccactcctaagggccagggggcagcagtcccaccgcgctctgccagcatgtttctgatccacaagcagatgtgggcctatggctttggggactgaaagagtattgggaatatttacatgaggaggattaatggcagaaaggaacacagattaccggtgtgtgtgtggggccggatgaagcaggcagagaatgaggttggaggagaggggagcagcttcgcctccaagagagcagaggccacctgtgggtgctgaggccggagggaggagtggggagagcacagctgtctcctgctcccaggagctcccaccagcgggcttcccaggaagccacagtggagcactctgtcttggaccctgcagtgaggtgtcctttgacacacaggcaggtcaaccgcccaggacatcccctgtcagcagtctgtgcctagtaatgtgtccagacagacagggctgtgggcatgagagctgtggtagaactggggcagggacctgggctcttccctgggaggcggtggcctcaggacatcttctacacagttttgctggtgttacccccagaaaccacagtgatttttatattgttgcttcagatgctggtatgactgggcatggtggtgtggcctatagtcccagtgctttgggaggctgaggcaggaggattacttaagctcaggagtttgatgccagcctgagcaacagagcaagaccttgcctctttaaaaattaaaaaatgaggccgggtgcagtggctcacgcctgtaatcccagcactttgggaggctgaggtgggcagatcacgaggtcaggagattgagatcatcctggctaacacggtgaaaccccatctctagtaaaaatacaaaaagttagccgggcatggtggcgggcgcctgtagtcccagctactcgggaggctgaggcaggagaatggtgtgaacccgggaggcggagcttgcagtgagccgagattgtgccactgcactccagcctgggcgacagagcgagactccatctcaaaaaaaaaaaaaaaaaaagagccaggcacggtggctcacgcctgtaatcccagcactttgggagatcgaggcaggtggatcacctgaggtcagaagttcgagaccagcctggccaacatggcgaaaccctgtccctactaaaaatacaaaaattagccaggcgtggtggcaggcacctctaatcccagctgctcaggaggctgagacaggagaatcgcttgaacctgggaggcagaggttgcagtcagctgagatggtgccactgcactccagtctgggcaacagagcgagactccgtctcaaaaaaatgaaataaaataacgagtgctggtgcagctttgctttcctaacctctctgacgttcacctgtctcattcaccaaaccctcctcacctgtggcaggcctgctggagtcccagctgagccggcatgaccagatgctgagtgtgcacgacatccgcctagccgacatggacctgcgcttccaggtcctggagaccgccagctacaatggagtgctcatctggaagattcgcgactacaagcggcggaagcaggaggccgtcatggggaagaccctgtccctttacagccagcctttctacactggttactttggctataagatgtgtgccagggtctacctgaacggggacgggatggggaaggggacgcacttgtcgctgttttttgtcatcatgcgtggagaatatgatgccctgcttccttggccgtttaagcagaaagtgacactcatgctgatggatcaggggtcctctcgacgtcatttgggagatgcattcaagcccgaccccaacagcagcagcttcaagaagcccactggagagatgaatatcgcctctggctgcccagtctttgtggcccaaactgttctagaaaatgggacatatattaaagatgatacaatttttattaaagtcatagtggatacttcggatctgcccgatccctgataagtagctggggaggtggatttagcagaaggcaactcctctgggggatttgaaccggtctgtcttcactgaggtcctcgcgctcagaaaaggaccttgtgagacggaggaagcggcagaaggcggacgcgtgccggcgggaggagccacgcgtgagcacacctgacacgttttataatagactagccacacttcactctgaagaattatttatccttcaacaagataaatattgctgtcagagaaggttttcattttcatttttaaagatctagttaattaaggtggaaaacatatatgctaaacaaaagaaacatgatttttcttccttaaacttgaacaccaaaaaaacacacacacacacacacgtggggatagctggacatgtcagcatgttaagtaaaaggagaatttatgaaatagtaatgcaattctgatatcttctttctaaaattcaagagtgcaattttgtttcaaatacagtatattgtctatttttaaggcctcatctggtctctgttttaataatttgtttgtcagaagaccctgaagtatatacctaggtcttttttttgaaagtctctaaattcagaatcattttttaatttaaagttctacaaataattgttactgcaaacattttattttaaaacgttgatagactgatatttcttggaagaaaatataaaatatcaaacactggttatcacttgtgataggaaagagaatattcaacctgttgttatttctcgttagaaatgtaaaccttcaaatatctgtcgtagttaatgacacgacttcacaattctgaacggagcctcgctcatggatgctgtgcatcattttcagatttataattgttttcaccctaaaatagggcatccgttgaactttggagttctaaacaaaatcctgtaggtgtttggattctgccccatgtgttcggacgagctctctgttgctgacagcaccggccttcggtctccatgtcaggggtgggcgggtgactgctgagggaggcccgcaggtgtgtttctccatcccgtcatcttgctgcatgccgtcaacggtctccgaaagcaacgttgtgcgtagagctggtggcatacggcccacgtgccttagatgggacatgctgcttctccaccctgggtttgcattgagcatcattctagaaagtgctagtttaaccagacttttctctccaccactagatctttgtctctacaagggccctcagacacctctgcacctgctgaggggaagccaggctccaccgtcggcttctggagcctccgctgcttaattaccacagattccaaatctctaggccccacgagtgagccgcctggtccaagtacggcctggtcccaccctgagggaggcaggtgtggaacagaagccgagcctctccgtgtccccaccggggccgtgggcacccccacagcccgaagcagaaccctctgagcattccagagaccgctgctcgggggcctgcccaggctgaccaacgggcgctcctgaccaccaccctggcgggaagggtggccacggggcccgtcgtcccagcctgtgcctgcccagatggcattttctcaactcactgtttactgtctctcagtgtccaactgtgattagaagcctggagcctgccccctgcaccccttttgctatgcaccacgcttcatggtgctcttaccactgatgggtgctacacgcgacgggtgcttcttaggcaaaaccaatgtgtgcgaactgtcacacctgtgccactcgcccacaagccgcgcccacaattggccagctgggccgtgcacgtcagactgcctgcctcggctctccccgtggccgcgcggggacagcttggtgggtgcccggtggcccacctgtctctggtgctgccatctgtcctgggtgtgccttcgccccagtgcctgctggaagtgccctccgtcgcacccctgtgccctgagctcccgtgaggggcccgccgcgccctttcgcggtcgaagcgttccgttgttcttatctgcctttcctttccccgctctcctgggattactttgggggaatgagtatccttggttctgccctgtgagggagtcgtgtgtccctgctcataaaggaaggacttcctgcagaagctgcggaaaactactgttccctcgaaggtgtcccccacctgaggcctgtcccctacctgccctcaggtagttttcctgaggccaggggttaacaacagggacatccctgcaacttccccttcacaaaatgtataatattagatgaaggatatgcaacatcttggtctagtaagaaccgtttcctcccctctgggttgaagtcctggtgtggcccccagaagcagcagtgcgtgtcactgggacgtctccagtagcccttcccaggcagacgctcctggcgggacgccatggggcccacctgagggtcccacagacgtaacctgagtgacaggagtccttgaggatgggatggcctatgtcacacactttgtccttgaacctgagtgatgggggtccttgaggatgggatggcctgtgtcacgcgctttgtctttgtgtttggttgtatcggggtctctgttctgagtgtgtcttcctctcatgtactcaacacagtgggcagcagcctgggacggcgtcccctctcccggcggcgggcaagccttgcgctgctccaccctcggcctgggcaccctcacttggcgctggccacctgggccagcctggggccatggtctctctgcagctgaggcccagtggccccttgggcagtgatcggccctccccgcatcacagggccctggcagcaagcgggaaatgggggcgcacactgtgtgcttgggggtgctgcttgtttaccacacatgaccagactcccagcaggacagagctgctcagtactttacagaaaccaactgagtcgtttgtgcatgaattaagccggtctgcttccccgtcaccttcgtaacaaaacaacgtcccctctcccctcgcctcgagcagtttcttcaggacaccgtggctcgggctgctccctgctgccaggcacgctggttggctggcctgggcccggctcacgtgaagggcactggctcttgtgaccacactgagccacgtgcaagccgcagccgggcctggaagcctgaccctctggttctagggcttgtcccgcggagcctgcagagctagacgttggggtgtgtccgtgatgatatgggggccaggctgggagtagggcctttctagcagggttgggtggctcagtgagggtgtggaagtgggggacccacggggcctggctttgggactagacatgccagccccagctgggctggagggagcctgagtgagccccgacatacgctgggcctttcagctcgccgtgctctggtgacacacaggcggccaggttgggatttgtgtcaattctaggagccatcaagcatgaaagtggttctgtctcctgagcgcaagcctcgccggacccctgggcgaaggcctggacttgcagatgtgtgttccctgtgcgggtggacagagggggcccttatgacccacattgcagccccattccaccaccccttcctccccagagcagtctctgccgagggacagcacctgtgtcccttcgatgccacaacagccagttgaacaggggagccctttgctcaggcagcttctcctgcctctccctcctttctccttccctgccccatccccgtgcccttcttggcctgtggcgctggggagccatggtgtggcatactggggctcctgctccttgggccacttcctcagcccgggccccacaggcccaccacctgccagggctcccactgcactggctgtggcaggaggcttccccatgaccccgtgtggcccagctcggtgaggatgcagttctaggcacagcccctgggacagccagctgcctcccagaccacgtcagcctgctccagggtcctcagtcaccctgggccaggggccacgtgtcccatggatgtcgaccatgccaacgtcacattccagcaccccttttgcttgatggcgtctggtggtagtcagcatggtggacccacatcctacagccagaggtgatgttggacaaaggaaggggagtctggatgggtccttaaacgaccattctgtccgcagcggggtcattccttgtcagcccaagggagggccggggagtacactgatcccaacagctgggctgacacctcctttctcccctgcacggggaggattggcctgaggaccgtcaccctgtgcacagccccagtagggtggcagtgccactgtctccttgggccgttgcaggattgggcgggtgcagactccccttgcgggccccttgctcaatccccggccctcccagactcctccctctactgggggtaatttgtgtgtcagaagggctctggcagagctgtaaaatactgttttttaaaaattttagtccagatctttacttattagactgcagaaggagagctagggagagtgggggaagcccccttgcttttgtatctgtgaggtgaatgagggtctgtcacccaaatctacttctcagcccatgaccatagttctgttttccgtttgcaaatctcagtagctctgttttctccaaagtagaatgtgcgcaccggggtcctagccaggcgaggtcagtgtcggcaggctacctggtcattattgctgcctcgtccaggctgatgctgatggtcacaggcacggtggcatcagggagccgggccagcaggcggcgtgaggcggggccagcagctcactgcaagggcattttccacctgatcctggtgtgccccacatgcggtggcagggcagacgtgtgaagcctcggccgtctcggggctggcaggtgtgcgggtgaggaggccccggtggccaagcagagcctgcgtttcatttctcctgctgcactgtgtctagtctgtcttgtgaactctcaccgtgaaaagaggctagaagtccaggatcgctgtaccgctcctgtaattaggtgatgactggatttgacaacttagtcccctcagacaagtaagataccctccaacagcaaattcaatgacttaattggaaaacacacaagctggcatgatgtccggtgatttctgtaagaaatgcctgtaggagaaggtctgtgaagtgtggagggcagtgtcgacgctgcacagcatctgcagattcgcagcctcttctctgccggtgcctctgttcggttctgttacccaaaaacaaagaccaaagaaggccaatctctcatttgaccctgtctttttaatctgcctgttttaaaagttgcgtctgtagtagccgcttgctgtgaagacacatcttgacagtccaagtgattttgtgaccagtgatttgggtcctgttttccgctcttctaagaaaaaacaaaaagaccgtgagttattgcccagcaataatcatgttgttactgtgagttagcaacatgcctgacttcctgatagcattactgttttctagttttgtttattgtatattatgtgtggttttatttggtatttatttgtgttttgaggtcttgcaatgtttttgtgtttctgatgctaataactaaagtttgtaagactgtagaatgcaaaactcggagatgctaaactgtcttattagaggaaaataaatctgattatggagtctcagtctctgatcacaccgtctcttgcaggctgggccccaggtgagtggcttccctcctgccggactccccgggctgtcctctcagtggctgggcccagtatggccgcctggccaagacctgtgtggccagaggcccgtgcttggtttgctgccctctgtcaccgtcttgaaatactttgcaattctcagcgaggggcctgccgtcgccttttccactttgcttacagttttgcctgcggcctttaacctgaagggaatcccaggggccaggctcgcaaatctgtgtcttggtccagagcagataaggcggagctctgacctcctgcccggacacgtgcccgccatctggcatggtggaaagggcgtgctggacccacaggcctggggtcagtctcagctccacgacttcgtgggactttggaatcttcgagcctcagtttcctcctctgtccgttggaaggacagcacctccttccacgccgaaacaaggtggttaatgaggagtgacaccagtgctgatgtgcaggcggctgcagggtctgggcagtgtccttctggcagctgctcgtggcagttaagggctcctgggctgtcaccgccaccatggcctgccttccatttctccaggaagttgtttgggtcaggcctggtagcaggaagccctgcatctcccccaaaattatcagatggggagaaccgctcagccctcccccactgtcctgccactcccagggtcccctgcagccaccacagcgccctgctcagtccctccccatccttcaaggcactgcatggggccacatccagaacagatgccatcggtccccacgtgtggcccactgagcagggaggagtggacctaggagcagcaccccagggtcctccctcagggtctcagggcctctcctgagggtcccttgccagcgcagcaccagccccgccctctctgcgggcccacaccacccctgccgtgccctggctggtggcagtagtggggcgctggaatcctgggactggcagcctccaccccacacacgatggggagcctgtggtaccttggctcccgggagctgccccaggacacagccttgctggtccttccgtctgggggatcccaaatcctcacacccctgtggtgggggcctgcgctccatccatctccctgggcgctcaagcccagggtcctgccgcagccttgaggacaccgggacacctatggagaccaggcagtgtgcagttgtcaccgctgaccgcaagtgtgagctgggccgggggtgggatggcgaggacagccagcgcgatgtgccgatgaatggggaatgtcagctggaggcttgagggattgcagaaactggattccttttttttttttggagacggagtttcacttgtcacccaggctggagtgcagtggcgcaatcttggctcaccacaacctctgcctcctgggttcaagcaactctcctgcctcagcctcccaagtagctgggattacaggcatgcgccaccacgcctggccaattttttgtacttttagtagagacggggtttctacctgttggtcaaactcccgaacacaggtgatccgcgtgccttggcctcccttttttttttttttttgagctggggtctctctctgtcacccaggttggagtgcagtggtgtgatctcagctcactgcagcctcaacctctcaggctcaagtgatcctcccacctcagtctcctgagttgctgggaccacaggcgcatgccaccatgccaggctaatttttgtatttttaatagagacggtttcgccatgttgcccggggtggtccggaactcctgagctcaagtgatccccccgcctcggtctcccaaagtgctgggattacaggcgtgagccacccccggcctggattcttgcaccctcctgggagtcctacaggagaggagatgggcggcaaaccccaagacctgctggactggcctgggctgagggtgctggtggggacatctgcagagctggcctcagatcatgcagcaagaaacggcgggggggaggaaggggagcttctgagctgctccccccagggcattgggcagggactccctgcccccagcctgacgtccagacctcaagggggttggagggactgagtccagccctcaggtgcacaccgggccatcacctggctccgtcctgctgtggggcagcccagatcttgcagggaattgggaaccaggggtgtcacagtctaggcctagggaaggaggaggccgtggccctcgcctgcctcccctcagctcagggggctgctctgttctggcccagatgagtgatgccggaaggggagcggtgcagagcagggaggcacacgctcagagccctccgtggccctgactctgcactgcagcagcccccacgcccaagagtcaacccagcatccaaaccagggaagagtctggactgaaagcgcaaccgtacttggtgagaggccggtaatctcgagttctggtaaggaaagcaaggcctggggcggaggctggggctcggctgctgggctggatcaggcggcacacccggctcacactgccctgcagtcctgtgggagacagcggcactcggacccgctcacaagccctgcaggacaccagtggaaccacatgggtggaagcctagaaatcagattctgaattgaagtccagggggttttctgttttctgaaaatgagtagttgcataatctaaccctaaaatcaaccatttcttgttaaaagaccagaagaaccaaagtgctgtgcaggggaggtgtccgcgccgcctatgctttttgtcttagttttttaattttcaaggtcatccttaaagcctctgccttgaccctgcagccacaggtgacttggaggctggaggccaggcctggggtctgtgtccttcaaataaatgcctcagtgccgcttgggggactcggtcctgtgccggagttactcgattagaagttaaaggtggaggggaaagacacctgtggggccatcccaacccacttcctccactcagaccacagctttgaatgggctcagtccccagggacccccaggccccagggtcagcctcgcagggcagagctcagaaccccctgcccagaccccagggagccaaaggggcccagatctgggcacagggcaggaagagggctggcacctgctgggaggggtctaggagccaggggcacagctcacatgagtgcatacccagcacctctgcttcatgtcaaagggagatgatgctggcgtccacccgagaggccacatggaaagcactcgacatggacaggacatcgcccacaggaaaaacccctgcaagggaccttggaccttggggaaggcggctgtgccctcccgggctgggccttgcaccctggcctgcagccattcggctcggaggactcccggcacccacaggcacttggctcccgccacttccctggcccctgtggcacttggggctccacagctctccgactccctgctgagggttgagccgtttgcaagcatgtgtccccatgtgtgcttgagggccgggggcacctgtgcatatggtcaagggccttctgtgcacacatggcacctgcagtgtggtcccagccgttcctcagcacccgtgggcccagctccatctcgggcggcctgcttggcgcagctctcgctggtcacctcgtgccgggtgactgctctccatcagctgtgcccgggctccacatacatagcccgggtcacatccactcacgtcctggtccagccagccttgcggggactctgcccaaggagggacagtaagggtttttgagtaccaagtcagtgaccctgactgccagcagcggctcctcttgacccggaggccggtgaacacctgacaacatttccctccatacagcgcaggggcaggggcagattaaccctccgtgcggaaggaggagtggaggtggaggcgggacagtggctggcccctggtccaagtcttgcagagccctccccatctggggtggggttgaagcaagtcactcaggggcagcttcctagctggtgctcccgagaccctcagctccccaacaccctgatgtcctcctccttcctcccattgtccatggatggagaagggaccaacggttcctccggggctgagctctcgtctcctggtgctcctgcttccctaccccccaacccccaggccagggctgcagcctgaaggggcactgggtccctgcgccctgtgagatgggcgctgccacccttgctctgcaggtgacgaatggaggcgaagtgaattgcagtgtcatatggcatttgagtcctagacagcgcccaggactggtccgaccaccgctagatgccaccaggggggctctgcctgtcccccaccccagcagacagcaggcccagccccatccaagctaggtggagacccctggtccataccctcctgggcttccctctgagttgtatccaacccacccagcaacagctgctctcagcaagcctcctggcctcacctgcactctcttccctcctctcctgcctcttgccttcctttttttgtgagacagatcttgctctctcgcccaggctggagtgctgtggcgcaagctcagctccctgcaacctctgcctcctgggttccaacaaatctcctgcctcagcctcccaagtagctgggattacaggcacccatcaccacgcccagctaatttttatatttttagtagagatggggtttcaccatgttggccacgctgatctcgaactcctgacctcaggtgatctgcctgccttggcctcccaaagtgctgggattacaggtgtgagccactgtgcccagccaccttcctttaaaaacaaaaacaaaaaaccccaaaaacctgaggtcttgctctgaggcccaggctggggtaatcgcagttcactgcagcttcaacctcctgggctcaagcaattcttcctcagcctctgcggcgccgggaccacaggcatgagccactgcaccgggtgttcttggctccctcgaagcatccctcatgttcccgtctcaaggccttggcgggctctttccctgtcttgctgatgtcccaggcccaccccaccttttccctggccctgccatgtgcaggaggcagggctgtcactcttgctgcctccacacctcaggggaggctgtgagccagcgtggccagtcagagcacagcaacctcaggctacaggaactggtgcagagttggagacaggaaccaatcagagacctcactgagaccctcctgccatggcctggtcaaggaggtggtgagtctcactctcccaagacaccttccctgccacgtggagaaggccgtgcacacggaaaccaacacaggagggccgccagccatagcggagacagacacagggaccaagagactgagacagcctctagatgctgaagcctgcgctgaagcagttgggccgtgagaggttcttcttactggaggaaactccggggctttgcatttctccacgtccctgctgaggttctgagccatttgcaagtttgtgccctcatgtgtgcctgagggccgggggcacctgtgcatatgctcaagggctttctgtgcacacatggcacctgcagtgcggtcgcagccattcctcagctcacatctttgcatgtgagtggttctggtaccgcttgtctgcccagcgccctggtgcctatctgctgcctcatgtgagctcgctgggccaccctctgactgctggacccacctccagaggccactcagggcaagagagatggatcccaataccccacccagccagccccagccccctatggtctgccaccttcaattcaacctcctcactgtggctgcagctgtgatctcatccttcctgtctcattttaatgccacctttttcaggaagcctcccctgaccaggaagccaagtggcctcactaccctctccacacagcacaatctaggaatggcctgcccaggtggagcagcagtagtcaaagaggctccattgctgccccaagtcctggccgtccagcactctggactcccctgaggccccaccatcaggagagggagccccagcctctgggccctttcagtcctggctgtggccctgagcaccaggggtgaagtttgctgagcctcacctggccctctgcatttatggtggcggtggggatggggggcagagccagacactcaggggtgaagcccaacgcagccctgtcagtcaaactgcctccttcccactgagaagcaagacaaggggcaaaacagttgtgacccccaagtatcctgtttgttcctggttgaggacatgtgagtccagcaaggggcagccaaactccaggaccgtgaggacccaccctccccgtcctaggctgggccagcaccacagagccactgagcgcagggacctctgctcaaggcgatccctccaaggtaaggggcaatgctggtggcatcagagatgtcgaggcaaggcgcccacccgggacacaaaaagaggcagagctccccccagtggcggctccttcctccccggatgcagcatatcactcatgaaagaagcaaataccaggccaagcaaaggggtgctcatggcagagtctgcagatgaggggtgggggtgcaggaaacagcaggatggcctggagggtggaaggccctggaagtctccaagactgagtagtttccctttcaccttcagtcctctgcctacatacccacctccaccatccttcctgcacccttccctagtcactcatccaccatcctgccattggaacccagtgtaaccatccaccattctcccccttccatcagctacaaccagtgtctccccaatccacaaggcacaccatccatctctccaccagtaatcccctaatgaccaattcaccaccctcccagaaactcatctccccatcatcaaatcatccaaacatcatgcacaatccatttgctgttcatctttctacctctctgcttcccaacacccacaaatccatcctccattcactcaccacccagccattccaacgtgcatgatgcagatccaagcatgcactgcagacccattcccccaacccccatcaatcatccatccatcacctagcgcacattcattcacaatttatccaccatgctctgtccacccacccattgatttatatccagtaactcctgtactcttatccatctacctactgtctctctacttactactatccattcacacatcatctaaaattcattcaccattattcatccaccatcaatccatccctccaccatttggtcttgtccaccatccatctacatccaaaatccacaactttttctcacccaccgtgcattgcaacaactatccatacatacacatctgttcaacagctacgatttctctttcacccatcaaccatccactatgcaaccatgattcattttgccaccgtccgccctttccctcgttctcctttattcaactaccatctaccatccatcaaccatccttccataatcactcttctatccatccatccaccaataacattcaccatctgtgagctgccatccatacacttacccattcaccatccacaatcaactatctactctttttttttttttttttttttttttttttaatagagtctcactctgtcgcccaggctggagtggagtggcacaatctcggctcactgcaacctctgcctcccaggttgaagcaattcggccccagcctcccaagtagttgggattacaaatgtgcaccatcacatttggctcatttttgtatttttagtagagacaaggtttcaccatgttgtccatgctggtcttgaactcctgacctcaagtgatactccatcctcagcctcccaaaatgctggggttacaggcgtgagccaccgcgcccagccaactatctgctttcatctaccatccggcatctgtctgttgatcaactgtccttctacaaaatactatatcaacccaccacccatcatccaccattcataacgcaccacccatctatccccattcaccatccaccatcacctttcatctacctaccatccaccatccaccattcataacacaccacccatcatccccattcaccatccaccatcaccttccatccatctaccatccatcatccaccacccatctatccccattcaccatccaccatcaccttccatccatccaccatccatgatccaccatccatctatccccattcaccatccaccatcaccttccatccatccaccatgcatcatccaacatccatctatccccattcaccatccaccatcaccttccatccatccaccatccatcatccaacatccatctatccccattcaccatccaccatcaccttccatccatccaccatccatcatccaccatccatctatcctcattcaccatccacaatgaccttccatccatctaccatccatcatccaccatccatctccacccatcaaccatccacaatcaccatccatccatcaaccatcaaccatcacccatcaatccccacccaccatccacaatcaccgtccatccatccaccatcgatcatccaccaatcatttagtcccattcaccatataccatgatccatctaccattcaccagccatcaaccaccactcattctgtgccacatttctatcctaccgcgattcattgtataatcttcccttcatgcagccaatcatcaggcactataccatccaccgacgatcatccatgcatcggtcacttacccaccatccacccaccatccgcccccccattgacgagtagattcacttattccatattcacttaacaaccaccattattcatcaaggattcatcagagacgacatccatgctacattaatcccaccgtcttttttgtgagacggggtttatccttatgggcccacgtggggaaagtggcgtgcacttggccactatagcgtcgatttaccggggggggatcactaggttgcctttgggaggcgggctacaggtgggccacttggcgagtatccagtattaagcacaccgggtttagnnnnnnnnnnnnnnnnnnnncccaccattcatctatcatccctcatccactgtgctaccatccaccattcatccatccacccattcacccatccaccatccatccatccaccatccacttatccacaatctgccatccaccattcgccattcatccatccattcatccaccacccatcaccattcacatccaccatcggccattcaccatccaccatccaccatccacctattcaccatccaccattcactcattcaccacccatccttccatccacccaccatccaccacccaccatccaccaaccactattcatcttaccatccaccatccaccatctatcatccactatctaccatctgccgcccatccatccacttaatattcaccatctactcatcaccattcacttgtccattatccaccacccaccaaccatcatccacctaccatccatcatccaccatttatccattatctacttatctaccatccattacccatccatttatcatcctatccaccatctactatccacccattatccactatccactgtctattcactatccaccatctattcactatccaccgtccatctccatccacaattcaccatttatgcaaccatcatccaccatctatccatttaccatctatctattcaccatccaccatccatccattcagcattcatcactcaccaaacatccaccatttaacacccacttttttttttttgagatggggtttcactcttgttgcccaggctggagcacagtggcgtgatctccgatcaccacaacctccgccttccaggttcaaacgattctcctgccttagcctcccaagtagctgggattacaggcatgtgccaccatgcctatctaattttgtatttttagtagagatggggtttctccatgttggtcaggctggtctcgaactcccgacctcaggtgatctgcccgccttggcctcccaaagtgctgcggttacaggcgtgagccaccgtgccccgccaacacccactctttatgatctacctgtcggccatgtatccatttatgccattatccatccaccactccctgattaccatccattccttttcctttttttttttttttttttgagacggagtctcgctctgtcgctcaggctggagtgcagcgcacgatcgtggctcactgcaagctccacctcctgggttcacgccgttctgcctcagccccccaagtagctgggactacaggcgccttctaccatgcccggttaatttttttgtatatttttagtatagacggggtttcaccgcgttagccaggatggtcttgatctcctgacctcgcgatccgcctgcctcaccctcccaaagtgctgggattacaggcatgagccaccacgcccggccattcattcatttttcactcaccatcctcatccatccattcatcacccatccaccctctatcactcaccatccaccccgtcaaccatttaccattcatctgccatgcgtccatatgccgtacaccatgcaccatcaatgttgctgtccatcagctgtcccctactcaccatccactactctccaccatcatccacaatccaccctcctataccatccacataccatgttccatccaggatcttccttctatcatccaaccaccacccacagcccatgggacaggggcactgcgtggagaagtggacacccagttccaatggtgagcagactagctcagccctagcagcacacaggacagagaaaggggtgaattcaaaggtcgtttattccccctcccggcaagacacccatttttcagggtaggtcagtctcgccaagcccttcttctttgcccttcttcctgagaacctaaggtgttcaggccctgcaggggcgggtaaggggaggctgagaaggtgcctcccaggggcctgaagagtcggccctgggcgggtctggaggtaaatgtgtaaccgaccctggtgcccccacccgacctgcctggtcacgtgggtccagtggggcaaagtctcctggtggggtgcaaggagccgaggcgagatgggcgtcctgggccgggtcctgctgtggctgcagctctgcggtgagccgggaccacaccggtgcgggcccggacggtagcggtctgtcaggacccagggccgaggtcgctctaggcctggagggtgaagatcttccgaggagtgggcagggagggctttggagggttgggggcgtgaaactcggccctgcctccctcgtctggcgagtgcgcagcccggaagtgcgcggccagtgcatcgggcggtgcgggagaggagaggaggggctccgggaacctcggccagccccggcctccggcggctcctgccctcgcggtttttccgtctgcgaaatgggcgcggtccccagaacctgccgagagcagcgagtgtgcgcctgcggggctcggcagaccgcctcagcttcccggtccccaagggagcactgagccctcctccgccttcacaccaggccggcgcgtgtccctggcgcccccttccctaaacccctcgcggctccctcaggacaaccccacccaccacattcagggccggcctgacctggtcctgccgcccccagccccttcttacttctcataccgggttgcgctctgtcgcagctcttcccggcccaggtaggactcctccgggaagccttcctgattccaaggccgagaagaggtctgtgctgccccatcctcctccatgccccagttgtcactgtccttaacaacgctgtcctctgctccagcgccaggcaaactgggggcagtgccgggaggctatctaggcaggcgtcctgcagggcgcgtttgagcgggctctgcaggtatcagtagaagtccgttggagagcgcccgggcagggcgcccacagtctggccgggagggaccagggtctgggtccgggcccccggggatggggttcctatgcgtcccgggtgatccgcgcggaccttccgcacttctctgggtgggtggccttccctgagaagggagcatcccggagagcatcccgggcactcagtcgcctcctccccagcactgacccaggcggtctccaaactctgggtccccaacacggacttcgacgtcgcagccaactggagccagaaccggaccccgtgcgccggcggcgccgttgagttcccggcggacaaggtgcctgggagcgccggcggggtcggtgatgggcctggacccctgagaccgtgtggccccggtgggggttgctcccggctcggctgaggcagcttcttcctgcagatggtgtcagtcctggtgcaagaaggtcacgccgtctcagacatggtaaggccgggctgctactgccactgggctgggggttcacagagtctctgaagcgccttcagggactgctgtgccttgagggcggaccccaccggcatggaggcactgcaggactgggactttggcctctggagaatattctaggaggcagggagtgggggggaacctaggggagcttggtcccatggtcccagccaggctgtgtcctgggagggatgggaggcacccctgtccccacagcccttgtgatgcccagcagtgggtggtcttcccaggaagcgcctgctccatgcccttcccccaaagccttgccttgtcctggtgcctaaagctccatctttagaacactagggaaagtgtccccaacacccccccctctacccaccatccgggtccctggcctgttaggaagtggccgcccaggaagaggcgagcccactcctgcctggctctgcctcccttcagatcagatcagattctcctagggacccctattgtcactgcgccagcgaggggcctgggtgggtgtgcactccttaagtggctgacatctgagatgggacagcttaatcctgaaaccttccccactcccatcagtccatggaagaactgtcttccacaaaactggtccctggtgccaaaaaggttggggactgctgccctaggggacctttttctcaaactgcttcacacaacactccaagaacatgatgggaactgggaggaaagcgggttccatgagtaggtaagtttgggaaatgctgcagcctgcactttcctggagcttcatcacgtattaaaggctctgataaggccccagagaaagaagctaatttccttgtttaaggtggagttccgcaagctacaggccaaatgcagcccctacgggtggagcaaggaacggtttttacactttgtaatcgttggggaaaaaaagaacaatcttttgtggcacttgaaaaatatatgacattcacacctcagcgacagtaaatacagcttcactggcacacagcctgcccgcttggttgagtatcctcggtggccactgtcccattgcatcggcagcccaccagcttccagggtgactgtggggcctgcaggccaagcctctgggcaaaagcttccttccagccccttcacagccactcctgggctgcgtcctcatcctgtcacctgcacacctgccagctcagtcactcctgagtgagggtcactggtgagctgggtcggggtgtcggctccagatgtggggtccaggcctggggcccccgcgtgtgcgggtggggaggatggctcaatgggcttggcctggcccattcctgccccatgcggggtcagggaccctgggcctcatttccaccccagggccgcttggttcattccttcaggttttccaaagctgccttaacccaaaagctgccacgcactggggagggcacccacagcaagatggcgacgctcccacccgggaaacaggaggagggcagggagagggaggcggttgccccttgtggcccggcccccagaacccacgcataaccttggcaaccaggcagcccgagtgaggggggcactgggagctgatgggggacctgtgggcagaggagtcaggctgggctgggggttccagggcatggatttccccctactcccctcccctgccggcctccttactttcatgatctcctttggaagcacttgggctctgaaaggaggcaatactccattcattcatctattcaataattcattcattgatcatccattggccggtgggaacagcgcaggggcaggggacagtggccccagggtcccagcctgcagaggccgaattcacccagagccgcccaagcacccccatcccctgcccgcgtcggctatgttgccctccacacccctggctcccagcttcatccatctgcctagatgaggcccgagtaacaggccgtgcacatcagtgccttactttgtaattctgtggttgggagcgtccctccctgcgattttccttttccttgcccttcctcccatttctaccttttgcctgctttcttgttgggggagtctcctgtctttcacccatccccctgccttggctggaggctttgcaagtctgctcactgtggacttgcctgcagtgtcctgtgctgaacagaaaccttcattttaatcgacctaatgcaaaacgccttaccttagaactgtgttttttctgtttcgtttgagaatcgcgtctgctcctcagtcacaatggtaatggactgtgtacctatggggcacgtgcaccagcgagggctcctgctgtgtttctctccttagagtgaacccagcttccagcatcctccgccttgcccttttgttctagcactgctggaatccgtcgtgtgcctgggtgttgtgggtctctctgagccttgtcttcaagtccacaggccgctttgccgaccctacactatccacacagtggctctgcaggatggcttaatatccatccccttcactcctgctccaaggttctttgtggatctcattgttgcagataaattgtagaataggtttgccaggtaacaactaccaccaccaccaccaaaaaaaccctggattttttttttttttttttttgagatggagtcttgctctgccacccaggctggagtgcagtggtgtgatctcggctcagtgcaacctctgcctcccgggctcaagcgattctcctgcctgagcctcccaagtagctgagactacaggaattttgattgggataaataacagccttatgctgtcaagccatccattcaagagcatggacggactctctctaaatatttcaggtcatccatggcctctttagcatcttaaagttttccctgtagaggtcttatattgtattggttaattcatcaatactttgttaagtttgtttttttgagacagggtctcactctgttgcccaggctggagtgcaatggcgtgatcacggctcactgcagccttgacctccctgggcgcaaacaatcctcccacctcagcctcccgagtagctgggactacaggcttgtgccaccacgcccggctaatttttgtagtttttgtagagatgggggtctcactatgttggccaggctggtcttgaactcctgggctcgagtgatatgcccgcttcggccttccaaagtgttgggattacaggcatgagccaccgctcctggccttaagtttggtttctattataaatgttgccctatatttaaaaattatatcctctttttattttgaaattttttgtagagatggagtctcactatgtttctcaccaggctgatctcaaactcctggccttacctactgtgctcgtctgttcaactattatgttacgtttctatttttccccttcgttctttaaaaaacggtgttcttggtatgcttcctcctgggaacccctccctgttcctgaggcgctttgagctatgacacattccgtccccacggctccacctctgcacctgtggggggacttgccctgctggcagtgccacaccctcaggtgtgcacggaactgaagtgtgacctcacgtcgctgggggtgttggcctcttgctcaggtgcagtgctcctggaagggccgaagagtgggtcctgcctcgggtgggcgcgccctgctgtgctgagcccctcacaacctggcagcaagggttgccctggcccagcgctcaccctcagcccctgagggagaagtgcagaagcaagaaggcaggaggctgaggtcctggcacttggaggagagggggagtgaggggcggccagtcagaccccccgtatttctgctgacacccgagacttgggctgtggccccacttctgtggtgcgggagctgcacggcccagcccaagcctataggaaacagcaggggcaactccacctccccgctacactccctgcctcctcctgcacccctggccgccagatgcagcctctccctccctccctcacacaccaagagcgcggcctcagactccccaggagccgggcaactttcgaaactttagttcctggaacctgggagccctgggcctgtgcacgttctcaaggggctacggggggaggcgacaggccctggccagagtcacctccgccccagactccccacggctccgtctcgctccccggctccggctctgcccctggcctgtgagacctccagctcagggacaggacactgggctgtgcccgcttcggggccttgcccacgcggccccatctttcccaggccagatccgcttcctctgccagcctcagccaggccgaggaccccgggcctgagctcgcccgggctccttccgtgcacagggtctcggcttctcgtcccaggggactgggggcggggtgggcgcggagcaggcccggacccccgcgtggcgccgcctcagcccgtgtctcttgcagctcctgccgctggatggggaactcgtcctggcttcaggagccggattcggcgtctcagacgtgggctcgcacctggactgtggcgcgggtgaggcggtcgggcaggggcggggctctggaaaggcatgttcaggggcggggactggagggaaggcgcgtcgaggggggcgaggaccggagggagggcgcctccgggggcgtggtttagggagtggcggaagtgtcccgaagcggggcttgggaggtcgtgctcagacgcgtggcgtggcgtggcgtggcgtggtgtggcgcggcgcttgttccgtggagctcagggatgtgctccggctcaggcgaacctgccgtcttccgcgactctgaccgcttctcctggcatgacccgcacctgtggcgctctggggacgaggcacctggcctcttcttcgtggacgccgagcgcgtgccctgccgccacgacgacgtcttctttccgcctagtgcctccttccgcgtggggctcggccctggcgctagccccgtgcgtgtccgcagcatctcggctctgggccgggtgagcactgaggggagggaggctcgggtcccctctccccacctcggcccgaccccgcccctcctggtctgcacacgttgggtctgagcactcaggtgaagtctcttcctcgggctggctccggtggggacccggctgcccgcagacgttcacgcgcgacgaggacctggctgttttcctggcgtcccgcgcgggccgcctacgcttccacgggccgggcgcgctgagcgtgggccccgaggactgcgcggacccgtcgggctgcgtctgcggcaacgcggaggtgagcgaggccgcagtggagtcgcgggggccgcgcgagggtcgggactgtgcccgggacagggccgctgcgctcccacggtctctcgccggcttgcttctcggaggcatcgcccttctcgctgcggtccgctctggccctccgcgctgaccaccgcccctcgcaccaggcgcagccgtggatctgcgcggccctgctccagcccctgggcggccgctgcccccaggccgcctgccacagcgccctccggccccaggggcagtgctgtgacctctgtggtaagcgcccccgccgggccctgcttgctgggaaggcctggaggaccaggttcgtcccccgcctcagtttcctgccgggcccggatccacggcgctgacccctgccctcccgccgcaggagccgttgtgttgctgacccacggccccgcatttgacctggagcggtaccgggcgcggatactggacaccttcctgggtctggtaatggggccgcgcgggcagctgaggggagtcccgaccccagccctaccgcctccgcctaggacgccccttctgcagggtccctgcggctgctcacttgcccactatctgcctctgcccttagcgtccccataggctcggggagggcggggggctgagtcaaaccaaccccgtccccctccccagcctcagtaccacgggctgcaggtggccgtgtccaaggtgccacgctcgtcccggctccgtgaggccgatacggagatccaggtggtgctggtggagaatgggcccgagacaggcggagcggggcggctggcccgggccctcctggcggacgtcgccgagaacggtaaccgcgcccgccccatcccgccccgccgcgcctcgccccgccgcggggaagactgagccggcccctccgtcgcaggcgaggccctcggcgtcctggaggcgaccatgcgggagtcgggcgcacacgtctggggcagctccgcggctgggctggcgggcggcgtggcggctgccgtgctgctggcgctgctggtcctgctggtggcgccgccgctgctgcgccgcgcggggaggctcaggtacgcggggcgggggcgcggaggtggggctgggggttgctccgaggggctcacgctgcgtccccgctacgccctcaggtggaggaggcacgaggcggcggccccggctggagcgcccctcggcttccgcaacccggtgttcgacgtgacggcctccgaggagctggtgagggggctggaggggggaccggggcctcctcggggccgggactcggcgccgaccgccgcctgaccctgtcaccccgcagcccctgccgcggcggctcagcctggttccgaaggcggccgcagacagcaccagccacagttacttcgtcaaccctctgttcgccggggccgaggccgaggcctgagcggccgcctgaccgtcgaccttggggctctccaccccctctggccccagtcgaactgggggctagccacctcctcgtccagcccccaaacctccccttcctttccccctcctccgggggccaaggacagggtggccttactcagtaaaggtgtttcctgcacctgctgtcagcctggctatgccgccaccggccccgcccatgaggactaggagcccagccttgcgccgcattcgcactgggggacatgggaggggtctagctggccactgctggaggcagcgctggtcgtcacctgggcggccagaggctgggatctgcgaagttgaacccagaactaggagtggggcttcccccgccttccggtgaggggagggtgaggagctggagggaggggcgggagagaggcaaggggtggacggagccaaaggccgtgcctggtggggcggacggaaaaggggtgggcatccctcctggtaccaagctgctgggtgcgaaggcagatcatatggggtcacccatgtgcaagcgtgcgccactgcaccgacacagacaagggtccagccctgtgtgtgcagctgcaactgtggcagtgaccacttctgtgaaaccagcatctggggctggagatgtcaccggcatccccagtcatggcctggcccccatttggaatcttctgcccaggggcccagcttagccaccaggacacgtgctgtaacccagatcagggccccgtgcttcgaggtgcggctgtgttgtggttggaatgagtcactctcagtgctgtgcagtgtcccgttgagtgaccgccacagttcacgtgtgtgctccaacagctaccatctcgcatttttaaaagaagtggccgatactcccacacgcactttttagccacaattttctttagtgtcaggtgcaaactggagagcaagcctgagctgaccagacaccacctgccacccactgctcacccgtcacagatggactgtgctggcagggacctgcctctggtgtggactgtggaaggagagatgctctgggcttccaggggagccgcctgctgcagcagcagcccaggccatgctgcctggcacagagctcaaggtcccaagtgcccccgctgggtgctgggctgcctgccctggcttgcagtcttctcccaggtccgcactcttctgcaggggccatcactgcccttgtcctaccaaggacaactaggtctcagtgagtggcaaatagaagccaactccctgcataactcaggaaactgactccgagcattccctcaaccagggaccactcaccctggcccagacctccccgagaactcctgcctcttcctggggcctctggcctaccccatcctgtcccttggggctgctggcagggttggcgtgtatgggtgtggacaggcagaccctcgcgggcagcctgctcctggggccctggcactgcctggctggggctcacaggcacgctgccctcctcccttcactcctgccccaaggatgccctctgttcaggctgaacaccccaacagcagccttttgggtgacctccgagtgagttacccagaatagcttctgctggcgaatagcatcttctgcaaggtggctccttcactgccttttggagctcaggcacttctggggcccagacacacgggtgacatgttaccacatccaaacggaccactgggaactttaaaactgccgtcttctgctttattgacaggtaaattgttcaaaaatgttctcacaattcaataattaattacaaagactgagacttacattaaaaaagtaaaaaccagaaccccccaggtgcccatccagcagaaggcccaggagggcagtggggtggcagggctaggcggtgctgggccactcagtgccgacttggggaagtgcacgtcctgaacagccttgccaagcagccgaccggtgggaggacaggggaagcctggcccaagctgtggacaagctgtgtctgccgccacagttaatcacaagcctctgacgacacagggccacagagctggtcactcaacatctggtacaaagggtgaggtgaaatccacgcgcaggggattgctgtgccgtgggccggggccagtgtgcaggagtgtgttgggtgggtctacgtgatcatacgggctactaatcacgggggctccatgcgggggcaggactggtgggggggggggcgggcagggcggggcggggtggggtatcccagtggctgcttcgtggcgccctggggctctgacttccctcagcccagcaggccacagggcctgcctgcaccacgacactcgctggttttatggcaggaggcagaagccgtggaagcgaatggaaaacagcacagctgacttcacagtagtagatactggtgacacttcatggctgcgacccagaatgaacttaatgcacacagggacgcagggtgtcactggtcctgggcctttgtccatgactaggtggtcagcaggacttctgcagctgactgtgcaatggctaaatgaaaaaaaggccacagactaacctccactttcctgtcttcaaaattctagtgacactgggaatgctataggacctcctactattctcttaaggtcctaggaaagtttcaggaactagggaaaagactgggtactgaggctgtgtccccagatgtctgcttccgaagcagccgcgtcatgacgggtttctgctgaggaagtggtgttggcagggccccatatgccctctcgggttgtcaggggtgggagacaggctgtatgggggtccttcatgtgcagatggaacagcatcgcctcacagctgtgcagacgaacagatgtggtctactgccacgaacaatgcggcataaaactgatcaatattataataaagatttgtcttcttcatctccatatctacaaagtgattctacatttccttggacaacactggagggcccgctcagtcttggcactgacgctggaggccatctccagctccctggcccctgtggcgagctggcggcttcaggtgtcacaggccggctgctccaggccttcgagggggagctggctcctgtggggggagttggggctcggtgggccgctggggttggagctattcgatggagttgagtgtttggtggagtccgaatcaggctgtgaacaggaagagggcagggtgagcacccgctgccctagcctggggaggcacgcgtgcccagctggatgcaaatgtttgctcagggacaactgtcgcaactgctcttctcccttcatgttatgaaaacacacacgctctacaccagcgattcgtggggcccttaggcgtgctggtgagagtcacaaattgatgtctaatcccactcaaaaataacatggtaattatcattacaaaagacagcaactctgtagtgaagaaatcagatggggccggacgcagtggctcctgcctgtaatcccagcactttgggaggccaaggtgggtggatcacacttgaggtcaggagtttgagaccagcctggccaatgtggtaacaccccatctctactgaaaacacaaaaatcaggccgggcgtggtggcttacgcctgtaatcccagcactttgggaggccaaggcaggcggatcacaaagtcaggagattgggaccatcctggctaacatggtgaaaccccgtctctactaaaaatacaaaaaattagccgggcgtggcagcatgcacctgtagtcccaactgctggggaggctgaggcaggagaatggcgtgaacccgggaggcggagcttgcagtgagccgagactgcaccactgcactccagcctgggcgacagagcgagactccgtcacaaaacaaaacaaaacaaaaaaaacaaaaatcagccgggcacagtggtgcgcacctgcaaccaagcagtcaaagtcacaaacgcgacactctttcctgagaaaagcactaggaatagaggggaacctcctcaacaaaataaaacagctaaccatacccaatggtgagagacaaaattttcccctaagatcagccacgggccgggtgcggtggctcacacctgtaatcccagcactttgggaggccaaggtgggcagatcatgaggtcaggagatcgagaccatcctaacacagtgaaaccctgtctctgctaaaaatacaaaaaaaaattagcctggcatggtggtgggcacctgtagtcccagctactcgggaggctgaggcaggagaatggcgtgaacccaggaggcggagcttgcagtgagccgagatcgcatcactgcattccagcctgggctacatgtagagtgagactctgtctcaaaaaaaaaaaaaaaagaaaaaaagaaaaaagatcagcaacaaggcaaggatgcctgctttcaccactgctattcaacatggggctagaggttctaggcagagcgatcagggaagaaacagaaatgaaaaggattccaagttaggaaggaagtaaagctatctctctttgcagatgacatgattatacacgtagaaaatcccaaagaaaagaatccacaaaaaactaataagctcagcaaagttatagggtataagatcaacacacacaagtcagttgtgtttctatacaccagaaatgaacacactgaaaaggaaactgaaaaaaaaaattcaatttacaacagcatccaaaagaatagctaggaatagtttaaccagagaagggaaaaatgtgtacactataaattacaaaacattgctgaaaaaatagcttaaataaatggaacacatctcatgttcgtggagtaaaaatattgttaagatggctgtactaggccgggtatagtgcctcacgcctgtaatcccagcactttgggaggccaaggcgggcagatcacttgaggtcaggagttcgagaccagtctggccaacatggtgaaaccccgcctctactaaaaatacaaaaatcagccaggtatggtggcgggcacctgtagtcccagctacttgggagtctgaggcatgagaatcacttgatcccaggaaacaaaggttgcagtgagccaagatcgtgccactgcactctgtctcaaaaaaaaaaaaaaaaaaaagacattaattatgaggaatgtaaataacgacaacccatagaacaagagaagacatctgcacatcacatctctcacaagagcctggtactcagaacatgccaggagctcctacaacccagccacaaaaggacaaaccacccatttcaaaaatgggtaaaggccttgagtagacatttctctaaagaaggtacggaaatggccaacaagcatatgaaaagatgctaaacataagtctttagagaatgcaaatcaaaaccacaatcaggtactacttcatagccaccaggacgactattaaaaagaagaaaaacaagaacaagtattggtgaggatgtcgagatatgagaaccctcacattgctggtggaatatagaatggtacaactgctgcagaaaacaatttggtggttcctcaaaaagttaaacatagaattaccacataaatccagcaatcccactcacaggcataaacccgaatgtgaaaacaggcactcaaacacatatgtgcacacacgtgttcacagcagcaccactcacaacagctgaaggacagaaacagcccaaatgtgcctcaggggaagaatgggaaaacaaaccgtggtctagccatacaagagaatattatttagcaatagaaacgccagcactgatgcatgctacacaacgggggtgagccacaaaacagtatgccaggtgagagctaggcacaaaaggtcaaacacactgccatacgagaggctgggcattccatttccacgaaatgtccagacagggaaatcacaggaaactactggctgcccaggtgctgaggggagggagggacggggagagagtgcttaaagggcagggggtttattttgaaatgatgaaaatgtcttttttattatgttttagagacaagatctcactacactgcccaggctggccttgaactcctcaggccatccttccacctcagcttcactagtagctggtactacacacgtgaaccgtggtgcccagctagagtggaaatgtttctgaatgagaaagaggtggtgactgcatctctgtggatgtaccaaatgtcactgagtagtttaaagtaactttaaagtagttattttgggcccggtgtgctggctcacgcctgtaatctgagcactttgggaggccaaggtaggaggacagcttgagcccaggagttgggagaccagcctgggcaacaaagtgagaccctgcctctatattattatgaaaataaaaa

SEQ ID NO: 12211 - DNA, 85368 bp, Human
gccgtggctcactcttgtaatcccagcacttcaagaggctaaggcgggtgaatcacctgagatcaggagttcaagaccagcctggctaatatggtgaaactaaaaatacaaaaaaattagccaggcatggtggcgcacacctgtagtcccagctactcaagaggctgaggcaggagaatcgcttgaacccaggaggcggaggctgcagtgagctgagatcgtgccactgtactccagcctgggtgacagagtgagactccatctcaaaaaaaaacccaaattttgttttgttttgttttacagtttgggaacctagaagtcagaaatgaagatattggcaaggttgacttcttatgagggtcgtgaaggaaggatctgttctaggcctctctcctttgttgtagttggccatcttcatgttcacatgacattctccctgtttgcgtgcctgtctccacatttccctcttttataaagacactagtcatattagatttagacctaccttgaggttttcattgtaccttaatttcctttttaaagactccatctccaaataaagttatattttgatgtactggtagacagaacttcagcatatgaaatttggagggatacaattcaacccatagcaagcctctctagtgaatttctaatttcagtcattgtactttttaattccataatttccattatagtctttttttttgagatggagtctcgctgtgttgcccatgctggagtgcagtagcgcaatctcagctcactgcaaccttcacctcctgggttcaagcaattctcctgccccaggaaaaaaaatctgtgtgcagaataaccagatgtcagatttaagagaaaaagatttcaaactagccattataaatatgctcacagtactaaaaggacagcatgattgcggaagtaaagcagggtaagaggacaatgtcatgtcaaatagagaatatccataaagggagaaataatgaaaaggaatacaggccggatgcagtggcttatgcctgtatcccagcatcctgacatctggtcactctgcaggcagtttttttttttttttcctttagggggtatgggtcatacttttcccatttctttgcatgtcccttaattttttggttggaaactgggcattctagataatatggtagcaaactctgtgtgctagtccccacccaccctctttcctggggcttgttattgttatttatttgtttagttttttagtaatggattggattattttaatgaagtctatccccgcccccctctcccccatagtggtaaacctctaatgttgctcctcagggaggcaccttttccttgaacatctagtatttgtttgtttgaaaactggacagttttgtatgtattatagcaactctgcatacttttttcctgttttgttgttttttatattttttacattacttgcctagcctacagaatttgtctccttgtgttgtacatttattgatgtctgtgctttgtttgtgttttagtctcattttcattgtttaggtttgattcctaaggactctttttagtgtctacatatgtcagccaaagatttgggctgaggttctgctaatgcaccttcagcccataaagtttgtactatctgctaatcaatctgtgggttagttggggaatgcatttgaagttgtgggcatttattaatttttccttggtcttttctttttaccaactctctgatgttccccacacatatgtaattttctagtcagccaggaatttgtggagaacttatgtgaatccatttatggctttcttatttccaagctctccctgttaagtttctggttggtccactgcttgcctcaacttggtttgcaacctcagtcttgcaaaactgcaagttttctctatccatgtccaccaagtccattactttcagccagtagagctataggcttttgcctctcattgaattgattttggcaccctggcatgaaactacaagtataccagctacaggatggcaaaactacaaacctcattgactgaactgggggcaggggtgatggaggcagttctaggcaaggctattcctgcctgaagcactggcagtttttcaacaatcaacaattctcaataaacagtttccagtggcctgaaatggttggtctttttggataattttgttcagttttatgtattttttttttgtggaggggaattactgacctcttcatactgttattattttaatggtgttttgagtaccaaaattgatagatcttatgaaagaagtggcttcattattcgtcagattatatcaaatgctttccacacaatggtgcttcattataagtctaatacaaatggttaccaatcttttcattccaccattattggaagttactcttgctgtgcattttgtgattaatccttactatatcttgagacatgataaagtaggttaatacaaaagcctatttttgaaacagtgtgataaaattaattaatgtagacattgttggaaatggataagttgcacaattacatattatttttttctcagttttttgacagtgtagtataggtaaatatgtcttcagaaatccttaatatacttattaattaactagatcataactgaatttcataaatattgttttcttaaaaatgcattatatgggattacttttgtatctaagtaagacattaaacctataagctaaataaggactatatcaataaacttgtttaaatgaagatttggaatttccgtatagaaaaattcattacaacaaagtagaaagataaacaacaaactggattaaaagtatttaagtcgcctgtaatcccagcactttgggaggccgaggtgggtggatcacttgagcctaggagttcaagaccagcctgggcaatatggcaaaaccccgtctttactaaaaatacaaaaattagccaggtgtggtggcacgcacctgtaatcccagctacttaggaggctgaggcaggagcattgcttgaacccaggaggcggaggctgcagtgagcaaaagttgcgctgctgcactccagcctggttaactgaatgagagtgtctcaaaaaaaaaaagtatttgaatcacttttgattggacagtaggctaatttctttgatatgtagaaatcttacaaattgactaaaagcaggataaataatcattacaaaaaatgggccaaagaatatgaacaggcaagttacagaggaagaagtataaatgaatattaaacatgaaaagatgctcaggcatctaaagaaattcattttaaaccacctataaaatcctattttctgttagattgaaatagtaatacccagtattaatgaagctgatggagaaaatgagctctccttgttattattgctttggaaacatctatcagaatttaaaatacaaatgccatattccctagaaattgaaagtacacaaaagatatgcaaactgaagaatattcattgctgcattttttatagcagaaaaaaattagaagccacctaaatgttcattaatggagagcttatagacctccgtccagttgtatgagatgaatctgtatatggtaacacagaaagagattcatgatatgttacactttttaaaaagcaagctgttcctttattatgtctgattatgttcgtgtgtgagtagaaaatatcagggaggacatgcacaattctctgtaaaatgacgagttttgaggattgcagttgggaggtgatgggaggacatggatgagggagtatcatgtttccaaattgcttaccttatgttttataataagcatgtatttaaatttatattaaaagaaaaatataatatctactaaatttgtaaattaagaattatattaataaatgaactatagcaaatttttctggtttgttttctatttaggtatggaaatttgaatattaatttatagatggcaaagggagtgcttttttacattacagactgtgcataagtaaatgatttcactcttaagatttgaaacatctttcaaactcataacctgaatgaatgaaaaatgtattatatatattgagcatattaaaatatttttatggtctgggcgcggtggctcacgcctgtaatcccagcactttgggaggccgaggtggctggatcacaaggtcaggagatcgagacgatcctggccaacatggtgaaaccccgtctctactaaaaatacaaaaattagccaggcgtggtggcacatgcctgtaatcccagctacttgggaggctgaggcaggagaatcacttgaaccagggagtcggaggttgcggtgagccgagatcgtgccattgcactccggtctggtgacagagtgagactccatctcaaaaaaaaaagaaaaaaaaagtatttttattactgagagagaaagaaaagatttattagtcatcaaatccacatcatattaaaaatttatgttattagcatattttatttaaaattatgttgggttcaaaccaggcacagtggctcacacctgtaatcccagcactttgggaggccaagatgggaggataacttgaggccaggagcttaagactagctgggccacatagcatgaccctgtctctataaaaattttaaaaattagcctggtgtagtggcatgcacctgtaatcacaaggctgaagtgggaggatcccttggcccaggtgttcgagactaaggcaagctgtgatcactccactgcactctggcctgggtgacagagcgagaccctgtcttttaagttaaaaaaaagttggtccagaaatatgaatttaattaaactggattaaacaaaaatctttatattataccaaaggcattttgaatctatgaaaagagacagtaaaaaaattttctaaaaagcaatagatagcaaggtttttcaatatttatatctcaaaatatttgttttaagtctttttatggaggttatcttgtaataaatatatctgtagtttttcttttaattttataatattttaagtatacatttatgaaaattatagattaaaatacgaattatatgtgtataagtttattttacattatggaatccaattttatcacaggtttcgtcttgatatatatcgatgtttggccagtccagctctaataatgttaacagaggaggatccaattctgagagcatttgaacttagtgctgatttaaaagaactaagtcttgtggaggtggaattcaggtgggaatgaatgcaaattatataatgtattttgttttaaatcttcaacctcagtttcttcattacccaaattataatttgtatatatttacatttgatccaagaacactacaccttgttgccacttacttggcaacagacccctgctctccctcaaaggaacagaccctggtgctacttaagtcattccttccccatctgccctctgccaccctataaacacctttaatctcttccccacttttcaacctaaccaaaggcattgtagagcagtatgaaatacagtaggattatagcctaaagcaggagcaaatttattcatagttgctctctctctcacacatatctcctcattctctgactctataatcatccttgagtaatgatccttcagatctttcaaaagcatatggaatgctttctgtatgtcaaggacattccacacacagacatagtcccttttcactatttgctcagattttctggtaagagaaataatatatgtaatacatgtaaacataaaaataaaatacaactaattaagagggatgaacacccagtctgagttctcttctgaaatgaagattaaatgtaattttggcacttggcataccaaagaagcactcctattattttcctttaggggggtaagttgaaaaaaaaaaagactttgtaatagcagcctatgaaactactaatttaaatattgtttttaaaaaaatccttagaaaactacttttattaatagtagagttgagagaaagcgttgagattttcctttatggaaaagtatccctgttgccctctaaagaaggaggaattgattacgattttttactagcccctgttgcaaggtttctactggggatctataactattcctaccttttctttcctatacggctgctattagagccccatgtcttgtgtgacactctttcagtgacttgacaaaattgggaaagttcaaatttctacttcctggaagggcagtaagaaacttggagttttctttagctttaacagcagtacttaatgtgttcttcatagacctgagttccagaaactgaaaaaagacctgtttatattttcaagtttggaactactgtcttgtaacttggataatttaaattttgtttaaacttgatatgacatgaagtatgtactttactttgatgaacacacaaaacatggttcaaatgtaacttgttgctacttttaactttattagcacatgaggctgttaaattattctgtttaaatatgaaaaacttcctattgtaacctcataatttgagtctgagttatataaaataaaacttactcaactcctttcaaacaggatttgaagaaactgctatgattatataatcataaaataataaagttagatttggaagcgatcatagaaacccatttacttcaatccagtgttttatagacaggggaggagatttataaaggctagatttttactaatagcagcatctaattaggaatagagttaaaactaaaagtaggagcaaagttataactagaatatatgactccttgcttctggttttctatatttccatctaaactatacagccacttatttgtcttcagtaatctattagaaatgaattagattaataagatgtataaatttcacctttgaatctcgtagtccatcaaatgtttatccaaagatggaatatttttgtaataatatatacttctgataaacattccagtctgcagttagattcctaaatcaagaagcagggagtgccgcatttgttaaataaatccaattacttattttcaggagttttgactacatagaatgtataaagaatgatgagagaaattaaggcaaagaagtttttattcttaagttatgatttttatatagccagttcctggaaagccccattatatagaaagactaaccagtgggaaatcttcctgtttccccttcctttcagtttgggaaaaaactgaataaaaacattattttctgaagcccaacctcaagactatgactcataattatttatttctgacttcattcttaagttatgattaagcttagacataaagttaatgtaattgatatttttttttttttttttttggagacccaggctggagggcagtggcaccattttggctcactgcaacctcccctcctgggttcaagcaattctccctgcctcagcctcctgagtagctgggattacaggcacctgccaccatgcctgactaatttttgtattttttagtagagacagggttttgccatgttggccaggctggtcttgaactcctgacctcaggtgatcacccgccttggcctcccaaagtgctggcattacaggcctgagccaccgcacccagccgtaattgatattttttaaaagaattatatactaaaacttcttcatttctcacaaattagtttaggcctgcctttaataagcagttcaaacccaagattcaaggaatagggattctgaaagagaggtttttgttaggcgcattttaatatctttctttctaatttgaatttcactcaaatgagcactttaaatatgaatcaaaatgctattttaatattagaagtaacataaacatattgtagatgactattgaaaaagctctagttaaaaattttatgataatgattggatagcattaagatattatgtctattgttaaggtgagtaatataaaaggaagttttagccaagcttacagagaataagggaaaatgagttaagcgaagaactggttgacaaatattattagaatttttaggaataacatcagtatatataaatgaacactgtgctcatctaagattattagtatgaacacagggaacataattgtgttatggttttccccaaagctgtggaaaattcgtgcatcactagtttcctttgattatccacagaaaatgacttcagattttgtgtaacactgtcagaattaaaatgttgctgagtaaaaacgtttttagtgaatatagcttaattagaagatggaaacgacgtttctgataatagaatgctgcattttataggaatgattatgaggaactagcccggcaatgtaaaatgtttgctaaggatttacttgcacaagcccggaattctcgtgaattggaagttattctaaaccatacgtctagtgacgagcctcttgacaaacggggattattagaagaaagaatgaatttaagtcgtctaaaacttgctatcaaatataaccagaaagaggtatgaggctttctgtaatatatttaaattattttctctacagtagtctagtggctcagggcaaaggctttggagtaactcatctgggttaagatcctagttctgcttcctaaaaattgtgtgtcttgggatagttattgaatctgtttgagcttttgttttaataattaattaagaatatatactaaaagggtttagcacagtaagtattagcattaagcaagtatgcaataaatggtagtttttattatttttagtaatattgattataattataacatggatgttgatttaatgtttttgctaaatagttgctacacaggtaagatcctttgtagtaggtacaaactttatagtgaagtttccatcttgtgttttgtctgtcacaggttggttttcattgatctggttataaatagccccttctatagtaatagtgatttctatttaaaaataaagtatcagatactatatttcctgattcctcttatttataattcattgtgaaactcaaaagtggagaggtacatgatatgataactaagttgaatctgacttttctggcatcatccctttctattaagagatatgcccatttctactccccatgcatacatatacatatgatccaggaacttgaatcaggaaaatatgcattttaaatttcatttttgagataattaactaaacagtgatattcatatgtagataataataatatctaattgatagtatgggatgttgataaatggtatttattaggtattacttctaagactattttcattgttaacatagatgtttaaataaaacttgcttatcaaatttatattattacaaaaatagggcctgaaatatataatgatagaaggccagatacaggacctttggtgctaagggcagaattttttcttaccttggttaaaaatttgagcctcacaaagttattaggaaattgatggaggaattgatggaggatgtttattggttaatatatttgcttctgtgttccacaacctaaaagggacatgaagtcctagaaaatgatagaataaggggattacatggtataaaatcaattaaagtgatttaaaaaaagaacctcaaagaaaggcgtaaagaactaaaattatcctgtttaggaaaaaaaatcttaagaggtaattttctaatgatagctatatccctgaaggactcacagagtggagtccaaatggaaccaaatgtaccattctaaagaagatgaaagaaaagacaagaagtagtagtaatatttgttagttgaaaggaagatattttgcgattttaaagatgaatgaaaatgtaaagtagtttttaaaactagatttctaaatacgatcagtggggaagatattttctcaaatagttggtaagctttgtttaggttatcaatcttgaatagcaaactactctgaaacttagtggcataaaacacttcatagttattttataataatttcataatcattttattatgctcttggattcttaggtcaggaattaggaaagggcatggcaatcatgatttttctctgcttctccgtgtctgggaactcatctggagataaatgacagggctataatcagctgggggcttctccactcacatgtctggtgtctgagcagcagctgaggcctcaggaacagggtgctcagatgggtgagtccacagaaggtggggctcctgagaactcacaacaggaaccaaggagaggcatggccatcacaatgggcagactttgaggatgtggtctgagaagcctctgcgggctggctggggtacatacatgtgacctctgtgtgcagcctgggcttcctcacagcatggtggcttcagagtggctttttacatggtagttcatggctccaagagcaggtgttccagtgagcaaggtggaagatgcgtagccttttaggacctaccttcagaagtcacatagcatcacctctgttagaatctactagttaaatcaatcacaagcctgttgaattgaagagtaggaaattttgacttcctccttccccacctcttgatgatgggaagaaagcgtgtccatctttcactgcagacttagaacatttctagttaaactttttattccaaatacatagttaacattactgcaaattaaattgtcattgtatagagggatagcaaggacagtaatcagtcctgagattgctttgatatttggaggaaaggtgacactactaaatttgagatttactaaacctggtcattggtgagaggaaaagctgtttctctcccaggcatttcaccttgagggacaaattaagatttcccaagaacattggaatctgagcagaagagtaaagaatgaagtattgccaaaaataagtatttgcatataacatacacacatcttcccatatactttaaagtatctttcaattacttataacacctaatacagtgcctacacatcatttcattcatgtggattcaacatagtacttgctgtgaagaatattcaagttttgcttatttggaactttgtgaattttttcttccaaatattgttgatccatggttggtttaatccacagatgtaggacacagagatacagagggccaactctacagtatactagaaattttcttgaaagcacaataaacaacaaaactctgtccaattctttttttcactacagtgttaattctacaaattatattctgttttgggataaatcattttaaaacagaaggttgaccaaatattattgtggattacctgaataatgtcattttataataatttcaaacctgatcacatgagtatatatagaattatcaggacccttaagttatacttcacaacatgagcattatattggaaaaatattgcctatgaaatttgtcaactaagaagatttgtaaactttggtaaattagtttctgtacctgaactaaaatttttctcatatttgggaatatttttcctttcttctcacatgaaattcagttttaatcaggcttaagagtgtctttaataccttttaagaaatccgcagtgctttcttggagcaagaataggtctaatatttagctttttattgtttttgctatcttgacttcttggcttctggtaactaaaatcaatagtttctctagactgaagatgtccaacattagttagtggtatctttttctatggattgtgcatgataactttgaaatttcataaatattattatgagtttttatatattaaacatgaaaaaatggctaagtaagctaataataatagttaatacttatagagtgcatgctatgaaccaggtgctattctgagggctttacctttaatcttcacaactttattagtagatactattattattcccattttacagatggggaagttgaggcttagagaaatttaaaaacttgttaaaggtcatttaccaagtagcagagcccagatttgaatctaggtaatctggctccatagtctatcctcttaacctctacatgcttttattgttagaaaaagggaaaaaacaaaactatgttgaatgtatagaattgatttttaaactcttattcagtaaactttgaatatcaaccaatcagtatttaaaggtttccttttactttttttctttttaatgtgtgtgtatgtccttttcagtttgtctcccagtctaactgccagcagttcctgaacactgtttggtttggacagatgtcgggttaccgacgcaagcccacctgtaagaagataatgactgttttgacagtaggcatcttttggccagttttgtcactttgttatttgatagctcccaaatctcagtttggcagaatcattcacacaccttttatgaaatttatcattcatggagcatcatatttcacatttctgctgttgcttaatctatactctcttgtctacaatgaggataagaaaaacacaatggggccagcccttgaaagaatagactatcttcttattctgtggattattggtaagtatcaagttagtttgaaaggttttgtctttatttagcccactgattctttcttgattgatggcattgtgaatattgggttcaatttgcaattttacactgttcacaccacaagaatttgaacacttccatgatcactgaagacttaactaacatgtctgtaaagataaatgttcctgaacttgatgataaggaagcatctctcttatttaatatttcttaaatacatggaattttaaaattatttattctcagactctatggttattcatgattgtaaaacagaaaatcagctttaacacatgaatgcttttttggtgtaagaatatgaagttttcttaggtattttgaaacaatctattttatactgttgtgcatttttaaagttaactattctatttcatttataacattagttttccttttaagaacctatgagctttttggtttttgttttgttttgttttgttttgtttgagacagagtctcgctctgtcgcccaggctggagtgcaatggcacagtcttggcttactgcaacctccgcctcccgggttcaaacgattctcctgccttagcctcccagtagctgggattacaggtgcgtgccaccacacctggctaatttttgtatttttagtagagatggggtttcacttcattggccaggctggtctcgaactcctgacttcgtaatcctcctgcctcagcctcccaaagtgctgggattataggcctgagccaccgtgcccggcctagaacctatgaacttttgcagatatatcttgctttatctctattttggaaacattgtttaaatttagatttaaaggagtccctggtgactcattccataaatcatttctttgtagagatagccagatctctttagaaatgatagttttttaaaaagtataagacattttattcctgaaaattatttttataagtattacactgtataataaatgtcttaaatcatcttctacaatttttactcgtcttgccttctgtgtgtcggggtgcgtgtggagagttgaggtagaatcacattatctgtttatggtattttaaagatattttctttatttccctctgtatcttctaccttgtttttaacctcagcacttcccatctgtccgtctactatttgctatagagtaaaagggtaataaaatttagtcttatctatggcacaaagtactgagtgtatttatcttttgattactacattcctgattgtttcaattatttagtactttcataagttatttcacaatgttcaattttagctctttagctatacaaatactttttatattttagaatgtttatttgaaaatcagttaatttcaggtaactagattgtaattagagttttgcttttaacagtatttaatctatgatgcattaatgtttaaaattaggtagataaaataatacacatctaaactctaggttaaagagaattaaataattccttcttgttaatatttttatttcctgtagttttgctcttatctaaaatttaatcttttaatttaggaaataatttaaactttaccatatatggttttatattggactgtgggactctttcaatgtgaaatatgtttgtattgctagttgagtagttaaaaaattcctggaagaattttacacattagtttgaagagaatcgctaaggagcactttccctatattcatttaaactatttctgattgttatatattccttagtcttaaacagatgaaattttataacatttatctataacctattgtttagtagtaagaaagaatattttctgtgttttgttagatttagtttaccccagtctgtataagaatcaaattaaagtttatatgtcttagcaatgagtaaaaactcaccgaactaaaatagtcataccactctttgaatagcataaatattactgctgtccccgattttcataataatggtaaaactatagctcttcccttttatatgatgctgttttcaatgatattacacgtatatatacatgggtacccccttacacacataatatgattaattttctaaccatattctacctcactagaagaatgcatgtgcattaagccagtaaaattcctggaagtatcttcctttcctcagcacagcttctgctttgaaacagtttgatctgaataagccttgccaaggaagtcttcttaagccttttatgtaattaggtcactctgggctttttttcagtatatagatccaaaccggctctaagtgagcatggaggaatattttgcttgcttgcctaaataaagtcattgcttggttcaacttactatttcaagcaatgaacacagtgactttttaactcatcatgaccaatttttgtatatttgttttgtttgctttcattagcttttcagaaaaaagtaaggttaggttataaaaagcaaggtaggtaaaaagagaataatttgttgaggaatgcacagaatattaatggtatccttttacttaatttttgctattaaacataatagaatggctattatagaaatgtattttttaaatgtcatgtacctactttgtctaagcacaggcaaaagcagatatggcccatacactcgtgaagcttatgatctaataaaagccaaataaaaccatcaaaaacttgacttgagaatcatatggaaaaatgaaaactcaaaaatggattaagtgctattggttaaagatcatagtgttaggagagtaagcatattataggggcatttgccctagtcagggaggttgggaaagacacgttgaggaagtaataagtgagctaagatctaaaagataaatagatgtcaactgagagaactgggagaggaagctactctaggctgagataaaagcacattcagaagctcagtggcaagagagagaatggtacaaagaagggtctgagtaaaggctaacatttctggagcagggagaaccaggagagcttgattcaagatgaagctacagaaacatattgtaccagaccatgcatggccttgtaggtcaggttaagtaattttgactttatattaagaacaaggggaaaccattgcctacctgaagtaggcaagtgacatgatcagttttgcctttcgaaaagatcattctatctacagggtggaggatgagctgggaggatagtgctgtggcaggagtagatggagggagaccaatatcgatgctgttgcactaatccagatgagagctgatggcaccttggacttagggtgattgtgatagagaaagagagaagggaacagacttcagagatatttataatgtaaggccagtaggacatcgaaatacatagtatatgagaggtgaaggaaagggagattattaagcaatattggtcttttggaagagtactaggcttggggatttgtgtgttgaggggtagatcctgagtacagtttcggatatgttgagtttgaaaagcctttgagatattttttaaatatcccttttagggatgtcaagcagacagttggtctggagcttgagttagaaaggtatgcatatctgaaaataggtggtatatgaaactataggcataggtgagacacaaggagaaagataaattgagaaaaagagaggacctaagatcaagcccttgagaaatcccaagatggctgggattgctgccttctaatgttattattaacattaattctaaaaaaaatagaccctaaaatatagaatgttggttatgtagtgtttgtattgcttggattagtttcaacttactatgttctttgtgatccagcttggaaacatgcaatacatcaagtgtattagcttcatttttgtgggggtattgcagaggagctgggaaactaaccaattggtcttcactgtactttcatgtctgtcttttttgatcaacagttttctccaattcatgttgtaagtttttgttaagagtttcttttaggtaaaatattgcatttcacagaaataaacacatttctgtaaacatctttcttagtttgatgttttaaatattaacaggagtgtatctaaagtttaaatataagggtttttgtttgaagatgtttcataaataaggattcgcacacatcaggatctagaattagacaataattttgagtcttcaagaaagtatggtcatggaggatttgtttaatatgtttctgctccacagctctgagtggtaggtgaaggttgaacatgagaaatatcagaaagctttcatccctactccttccccaaataaaacagtatttgagttaataaaatgttacctgctagactatttcattttacatttttagacagttttcatctattcattttgagtaaaaacatactaaggtggaattgttaaaaatgtttttcctgtcaaatctgcaaatgttttaaacactttttttctgtataaaatatgggtactgcataattaagatgttttgaacagagatcttcaagaatgtttcttgtgtttcccaggggaattattttgcctactgataagccagagaatgattctgattggcctaatttgatctccacccatgtgtgatgctacagcactctattcttttgttactctgtagtctccccgaaaatgacttaatgaaggaatgtaccataaaatgatcctgaattatgttactgaagtctggtacccataaaaatatatagttatagaggagcttctggccaaaaaacggaaagtttttctgtttgtttgctttggtttttatttttgtatatttattcatttggcaatattttttagcaccttgtttgtatcaggtacttttcaggacatttggaaacatcggtaaataaaacaaagattcttacccttgaagagcttacccaaagtgggggaaagataatcaattaataatagacctaataagtaaattatattcagtgttagaaaagagataagtaatacaaaagaaaggtaaaagcagagttaggagaattgggagtgggggacaattttaaagttgcaaagagtttgcaattttaaatagggtagtcaggaagggtgatgagcaaagacatgaaaaagtgaggtagttagtcaaatggatctctgggtgaggagggtccagccagaaggaagagccagtataaaggccctaaaggcaggagtcatgtgttcaaagaacagcaaggaagcaaggaggccagcgcgactagaatagtacaaggaaagattagtaggagatgaggtcagagaggataggtaatttggagacttgcaggccattgtaaagactggttttgattctgagtaaaatgggatttaagggagggtgcagtgcccactatgcacaatgagcagcagtggttttgcatttttttgacatttgcactcacagaacaaaacaggctgaaacctggtactaggtttacttaaatttgtagaagtaaaagatttgaacttaaatatataaacttgagagcctttgccatgtagatgatatttaaagccattagattgggtgagatcattaaagtagtaagtataggtagagaaaagaaaaggatcagggactgagccccttgtgcgggggtgtgtacgtgtgtgcgtgcacatccatgtgtgtatccgtgtgtgtctccgtgtatgtttgtatccctgtgtatgcatccatgtgcatgcatccgtgtgtgtgtgtttgtgcccatgtgtgtttggcattaatttatttggtttcttacgtttgttccacatccaaagatgaaacttaaggttattttcttcaagtcgtatgaaagttaaggttattttctttcagattttaagaacttttcactaaaatgtttttggttttgtttttttttcttttgaataaggcccaaggattatttatttaatattttgagtcttaaagtattatttagtttatttattgaattaagaaagtgttatctgatttttttcttccttttctcagggatgatttggtcagacattaaaagactctggtatgaagggttggaagactttttagaagaatctcgtaatcaactcagttttgtcatgaattctctttatttggcaacctttgccctcaaagtggttgctcacaacaaggtgactatttactatgtcaattgaaggcacaaattaagtttattttggaaatagctaagatatttagctatgtaactcagagttacattgagccagatcagtgtctggtgtgttttcattttaagcctatctgtgtgcacatagtttcctatttttccagtagtttacaggtgttacttacctttacatgatggttatttattatataacagggaccatagttcacatttggtatactttatctctttttatctacactgggattctttgagactgaagtccttatttccttattcccattttgcaagtaagaaaaatgaagcctaaaaatattaaacaacttgtccgaaaccacacaataggaaaccaagactggatttaaatcctgccctgtctaggcattttctttctactagatgccaattccttatatctgacctaggttcttttagcttattaacctgtatatacttaaaatgagaacaaagtaacttaaaatgattagtgttagatatctttatatctgccagaaaaagagtttccattccattccatttcataatgaatgaaattggttatgtaatattttacacatttcaaatcatgattaacagctttaaaagtgatgtaaatgttattatttttctaataactatatatttttatttagaatttgacaaaaatctacccttatagataacttacaattttactttcatcagaatttaagctcccccaagcccagaaagggtaacaaattgtgtgttaactatctttgtttaaaccctgagtttagaattcttctggggtgtcacattcaaggaactaaaatatataatattctctgttttttattagttcttagattattgaaaaggcaagctcattattttacataattttactttattaaaaaattctgtttaattgatcagtagtatggaatatgttaggtacgttcagtgtctagagtgtgaaattactaagaaaatgaaaattggtcatatatagataaatggtttgataaagggattgagagacattgctttttcagattgatctctttcgttctataagtggagtacccatataattttttatccaaatcaggacattttgagagtgaaagggggcactattaataattatgccaggacaactggtacagcatcttaaactatcccaggcaatggggacaattgaccactgtgtctaggtacaataatgccctcttttttattttgtatttaaaaggggggaaaaaaactctgaattccaagtcaaagcagtaggttaatgtaatatgatagggaattaattgacagcacatgtacttaacgtttgtgttgtggaatttaagaaaactagccaacatttcattaataaaaagcttaatgatcatttaaaaaattatttaattttctaaaatttaagagtttctggaaaaacctcttcatatagagtgataatgcctcacatacataataatattttatttcattaaaatattatttctatttttaaaaaaccctataaaacataagtggagatcccctataagaagacaaaattaaaatggctttctttcaacagtcagaatatttgcttttattttcctaaattgagagagcttatttacctttggctttttcttcctaaccttagtttcatgattttgctgatcggaaggattgggatgcattccatcctacactggtggcagaagggctttttgcatttgcaaatgttctaagttatcttcgtctcttttttatgtatacaaccagctctatcttgggtccattacaggtaaataattaaaatttcttaaagaacattttttagatgtcattattgttacatctttctccttgtccagtggaatactgttctctcatgatattaaagctaaactttgctcttgagaataagtagcaattagaaggacacagcatgtttatctactttgcttctggctcagtgataatcctttgctttcaggtattccaagttaattatgctgtggtccattagcctcctccccccacttcatagacatagatatgtttaaaatataattacacttcagacagtagagtaacataaaaatctgctttttatcaaaatgaatctcacatttaaagttttaaatattttaggttataagtataaaggaggacctgtgcaaacaaaaataatcatatttgatgatttttgaataagctggatttaaaagaatacttacactttcgtttaataaatattaaatgtaataagttggaaagtagcatacttagagctaaaaaatttacagaggctatgtagttcagctttatattttataatactttatagttaaagaaattgagcttttgagatgggatttgatttgtccaaagtagtatgattattatgtatgagagttcaagactaaattctcagtctctttgcaccaaagaaaagactcataattggttgcatttaccccacagaatttagtaactggttttcagaaggtggggtcaactctgctagctctatgtaatactatagcttattatttctgaaaatctgaacaatattcatttttccttaagtcaaaatttactaacaatttagattgtctcatatttttaaaggtgatattttaaataaaaggcataattaccttctccaaacagggatatgaaaataaaatatataggaaaaacctgatttgattaggcttgtgctgtcatccagcaacagtgtttcctgaagtgtggctctcttaaccaagtcctgtgagatgctctgaattaagtaagtttgggacacactgtatactgtatacctcttgggaattgacagtgcatgttatcacattaaagcctctgagaaaaaaatttgtttaaccttgttcaaatcatcattacctaaagtcatttaacctcatacctgtttttcatgaaatatgtgcaagtctctgtatttttccaaaacacagtaagccatagaaacactggcttaaactatctgtccttttgatttatttttgccactaatatcatctacgaatgctttaatcaagagtctacagtgtttttacatgcacattgatttttttttaactgaaaatggacgacagaactaggtttctatactggaaatttctttatggactcctataaagggttaaaaaggagaaagtataatattttttaggaatgaagagtcaatttctgacttctgtttccagccaacatggagtaataaggattggatttacccttctatctaaagcaatcaaaaaggaaaaaagaacaaaatatatgaaacaacagcttataagaaactagatatcaggcagtaaacaacagtgatctctaagaaacaagaaacaaagatcactccagcttactgctttgtgagaatttttaggctattgtgcagagtgggtcagtgcagtcagagcctggcagaattctggatttagcagcacagaaagaaaattctggagatctgcagttgtctcccttgagtattcagcagagtactgattagcatatgcatgtgaggacactacctcgggcagggaaagaaccatctcatccgacgggattagaagaatactcagaagggtcttgcctcaatagttatctcaagcctacacactgctctagtttcaacgaacaaatattaaaagcaagatgtgaaaggattaaattttttccaagtaacttaaatgtgttcattaaaacctatccaaaagcaacacagatgttagagttatcagataaggactcttcagcagttattattattgtgttccatatgtacaaaaagtttaaagtttagtagagacatggaagatgtaaaaaaaagaaaaaaacaccaaattaaactttcagagatgaaattttcactgtgacctgaaacatgcactggatgtgattaatgacaggttagaccttgtagaaaaacacattagtaaactcgaataggtaacaatagaaactattcaaaataaaatggagaagaaagaatttttaaaaatgaaaagagtatctgtgaactttgggacaacttcaggtggcctaatattaatactaatgtaattggaatccctgaaaaaaggagagaccaaaaaaattttttaagaaataatagcagacattttccaaatttgaagaaaactataaacccacatccaagaagttcaataaacctgcaaacacaagaaacatgaggaaaatcacaccaagggacatcatattcagtgtatcactgctgaaaatcagtgataaaaaaaatcttcaaagcaaacagagaatagcaggtcatcatatacagaaaaagaaaggtaaggatgacagtagatttcttgtcagaaacagtgcaagcaaggaggcagtggagtgacatttgtaaagcactgaaagaaaaaaaaaacaactgtcaacctggagttctctacctagcaaaatatcattcaaaaatgaaggtaaaatgtagacttccagacacacaaaagctaaaagaatacatcactggacaccagcactacaaggaacgttaatagaagtccttcaggtggaaggactacagtaacataggggaatatggatctaaacagaagaatgaacaaaatacaaatatacccaaagggaatgtaactacaaagctaaatagacaggcatttttttgttgtttcttttgcttttatgaaggatgccagctaatccacttcagcagatacaagaaacatgattgggcataaatcagtaatgctttatattttaaagaaaaaacgacatgaagatagaatctgtacataattgtggtaataatagtaataacagcagacatttattgggcccttactatgtgccagatactgttctaaagtctttattcacatttattacctcatttaatcctcacaaccattctaagaggcagactcttttatttccattttacagaggaagaatctgaggcatagagacattaagtaacttgcgcaaggtcacatggttggtaagtagcagaactgggattccgcctaggtggtttggctccagagccagtgatcttaatcactatactaaatcgccccccaggttgtataatactacagaataatatgattccctcattaactcttactgtataacttctgtgggcaggctttaataatttacagttttttaaaaagttattcaagtcacatgtttcaaatgaattaaacagccttttacactgacagttggataatttagacagaaagaacaacccatggccacacagcactctacccttttttccttatttccttatttccttttttccttacctggtcccagggtagggccctctctcaggtcccacatgcttcctgtctttattcttgtagcttagtacaaaagatgtgattattatcagttcctcctgctccaagactctgctgcgtgggtccctgattcttacccatctgtagcacatactattggaaaaatggctcccatagacttactcaaaaaaggttgccacaaacaacacagtatctgtggagcaccacaaagttaagtgtaataaaacgaggtatgcttgtattttgagggcagttactggtactaagtagtgagagggttctaactgaatctggcatttaaagtgtagagtggagtggattgaggaggatagaagagaaagaggcaaggccttcagagaaagcaacctttcaaggagttttactcctgctgtccaagggactgtcaaatccaaaatctatccaaagagaaacctaaggtttattatgattgtcatatttgataggacccagacataaagtcgagtggacctgtttgcccttcctctttttttcttccccttcgcactgtaaaacatcaccaccttttcttcagtgctatgataagaagtccttacaaaagcaacaagtctcccacttcagcttctgtttttgacctcatgctttcaggcctcacatctagagaaactaagtggaaaaaaggttgttttttttttttttggaggggaataaattatttggcaattttctcaaatattaatcccttttcttccctaaagttcctccccttcctacttcatttaggataggaggtgcgtttctttcccagaggttgaaatgtttcctagggaaatctgccgtatcatgtgattctaaaacagtttaaaggcaccacatacactgattaggtttctctgaggaggagccccaaagcagaaatctctggcaaggattagttctggaggggtggtgatgagcaaatcagaccaaaggaggggagctcttgagggtctatgcatgcattcctaggcctcaacatttatggtacttgaaagagcttgtatctaactgtcttgcttttctgtttggtctaattattagaattactaatattacaaatgaatgaacatccccttgggttctgacaggttggttcaaaatcttgctccatcacttactgtttagtgtctgtgagcctcagtttctttatccgttattgtgaggattaaatgggtcagtgtatgtaagatgcataccacagtacttgacacatggtgggctttacgtaaatgtttaggtccattttttccattccttttatagttagttaactatggcagacctgaaaaataatataagaaaacttggaaagcttagtacttgaaacatgagtgtgtattttatttctagtgaattatttggttttactggataattatcagatttaatttagtagcctgtataatataagtggcatgttggtgctgcttctaacgagtaaagagctgtttcaggtgttttgcattttggtgtatattagagttagagaaaccgaggagtcatgtagtccagaggttcaaactggtggggctgcagaatcacctggggagcatgttcaacctagattctcaagtcctaccctcagagatactgattaaattgattgggttaaagctggaaaatgacatgcagatgagtctgatgcagcatttgactatatcccttgtatagatcaggaaactaaggcccagctcacacagtgttagaaccaggacttggtgttaattaactaagttaattaagaaactaagaaagtggtaaagaattattcaacattttaattaatgcactgggctctggagcttactaagacatggtgcctgctcttaaagactgctagaggagacaaacataacataaatactagtatgaagtcaaaaatactgttttagcaataacaaacaaagttactttggaagcatgactgaggaagtagccggagagagtcaggaaggctccttagaggaggtggcatttgatctgagccttgaaaggatgagaagcctgcctggcaaaggacaaagggaaagtaacacgcagaagcgtggagtcctaaagcatggtgtgcttagagaagacagcatatcctttatagttggaccgtggattggagttggggagatgaggctaaaaaagacaggctgggctggacactgaaggtctctgtgccaggaattttaatatcacatgtgcaaaggaggtttttgagcctgggtgacttgtttagatagaacttttggacagataattatggctttattctggagggagatttggaaagacagtgactagaagttgtgattattattgctttcttttgttagcaacttgtgtaatttaatgagcctaatgatagcaacctttcccttatcagagatttaggttgtttttgttgttctgcatagtactctgtgtatgaggctttttgcctctgttatttctaagggtaagtctccaaaaatagtattaacagatcaaaagatatgatccacctaacacctcagtatttttatttttttacaataaagtgtgttaattttctgcaatacaagcagtataaaaatagtttcactacattaatagcatttggtgctgttttaaagttatgctaatttagtagtttgctttaatttccctttttctgattagcaagaaggattttttcctctgtgtgtactagtattaactctatgtaaattttagtattaatattttaattacctttctcttttcatttcacaagttttcatatttctcaagttaaaccgccaagtactttttaaaaagtaaatgtttgagaaagcattattacttttacaaatacataaaccttataatctctcagtctaaaataaatttactgtttttaatatttgcctttcacatgaatatttcattagtgtcttcaagccagtgttttcctcagtggtatccactgttctacttttacttcttcttgtattaagaaccaataccatgctattaaacaagtcaggccgggcatggtggaacacacttctaattgcagcactttgggaggctaaggcgggaggatagcttgaggccaggagttcaagaccagcctgggcaacatagcaagaccttgtctacaaaaaaataaataaaaattagccaggcatggtgggatgtgcctagtttctcatgaggcttgagtggggaggactgctgaagcctaggaggttaaggctacagtgagtcatgattgtaccaccatactccagcctgggaaacagagtgaaactctgtctcttaaaaatttctttttaaatttaaaatttaagcaagtcatgaagtttgtggtgttctcattcagaattgcttaccttgatattgaactcgattacatttatttaaaacttaggttaaattaaagctactttgactacatgttttaaaattaaaatgatatcatacatggtcactattggaaaacctgatttacctgtaagcttacagtgtccagactttcctcaaggtgatcttttctgtagttatcaaaagcagttactgtattcttactgtcataagggattgagttctgtactgagatggtatagctttattctaagcaatcacaatctgaatggatgcttttctttctcaaggtgatccaataaagctgtcattgattaagaggaaaatgcatttcttctccttcttacatattttgagttttctgattctaagtgtcccctgcttcttgtgtcagaattttgtaagggggccaagtgagggcagcataggccttgaaaagtaccacatggtctagtcaaaagcacaagtcaggcatattggacctctccactatggcagagtctgggttactagcttgtggcgtgcctaagaatttaaactcacctattctgcttaagtagctggtccactttagtgggctggaagcatctggccagttgcctgtggctaccattttgtatcactgaaagcgggatgtgctatgctggccgacttgggccaattaggaattttatttaaagcttgatgtaattaattatataaatttgacctgttaaatttgaggaagggttgtttcaaaacactcaattttgtacattaaaaataatgaggccaggcacggtggctcacacctgtaatcccaacactttgggaagctgaggtgggcagatcacttgaggccaggaatctgagaccattttggacaacatagtgaaacccgatctctactaaaaatacaaaaaattagctgggcatggtggtgggcatctgtaatcccagctacttgggaggctaaggcaggagaatcacttgaacttgggaggcggaggtttgtagtaagctgagatcacaccactgcattccagcctgggagatagagactgtcttaaaaagaaagaaaaaaaaaaaaaaagtctccctactatacccttagatatatgcccttccatagataaacatggttaacaatttcttatgtaaacttccagaaacttcctatgcatattaaagcatatctatattaaaatatgtatcttgtctatcctttaacaaaatagaaatgggggccgttctacatatacatactgttttataccctgctttttggatttactgtcttacagccatctttgtatgctagcacatgtagatgttcttcattctttttaaaaacaatgttgagtaatgttacagctcttttagaatttgtctagcaggctttccggttcttgcgggaaagtcccccccaaaaaatattaaaaaataaaaaataaaaacaatattgaggattttctaaaatttttttgctacctctaacaatgttgcaatgtaaatccttgtatatacatgcatctttgtgtacttcctatctattggttaaatttctagggatagaattgctgggtcaaaaaagtactatcacattattccccaaatttgcatgccaatttaaaaaccaagaatttatgaaaagtacctaatctctaaattttgaagaatgaaattaggattaaagcttccatatgcactatacatgtctaaactacaaaagatactcactactaatactggacaccctcatttggcttgcacacataatattttcttaaaatggacccaaagggaaagaaaatctatcacttcagcaaaagaaattagggcagtcccataggaggaaatgctgattttaggaattggtttagaattggtttcaaaaatcaggtgaaatactttgcctcataatgattttatgtttgtaaaatttaagaagccatgtaaatataagcatttatttctctttaagtttgagcagggtattttccttttatcccttgcaaattaggccttttcttaaatctccatatctctgcctctatctccataacaacaatgtcctctgaaaccctgatccaggttctaggaacgtgccatctaacactgatagtgttggtatgattagaatgactttttgttaggcagctggattttcgatgtttttaaaatgatctgtctcaaccagatgcaatagaaggggtggcctgtggattatgtgtttgtcttcttccttttgttgctgggtcatttatatttaatattttgtttttctgataatcttaatgaacacctgtgtaatatattccacagatttcaatgggacagatgttacaagattttggaaaatttcttgggatgtttcttcttgttttgttttctttcacaattggactgacacaactgtatgataaaggatatacttcaaaggagcagaaggactgtgtaggcatcttctgtgaacagcaaagcaatgataccttccattcgtgagtatcttttaaatgttttagtaaatatatttgtcttttttttttttaccatcttctatatgaattagtatctatagaaatggaacttcacattttaagaaattccttagtaatgttcataaactttaataaatacttatttttcatgaatcactatagtcatctttacatacagcatcttaaatagtgggtccaagttattaccttgtcttccctactgcagtctatcttaacagaggaattcttggcattttgtgtgttcttagcattttgagcaattctttgtcattcctatgtattgcaagatgttcagcatctctgtccttcaggtattaaatgtcagtagcaactctcagtcattgttacagccaaaaacgctcacagcttcaacactttttaagaggtcattagaattgagaatcattagaacttcatgaacatttttttctctaatgtatcataaggatttgaataacctgttttgaggtaaacaaaattcctcccgtcatttttaaataaaacaatggagaagagttgtggaaggacacatttgtcatgttcttattatgtgtcaactattctttagttattttgtgtgtcatcttatgtaaagaataagattaatgagtatgtgtcagtgtaccacttactatataccagccaatgttctaagtgctgagcaaatgaagtattagtaaacaaaactaccctgatgaagcttacattctagggaggtgatacaggcaataaaaagaggagtaaaatattcagtatgttacacagtggtcagggctacaaagacaaataaagcatgagcaaaagagtgtctgtgtgtcagagttcagttttaactaaggagctagggagtgccccagaagagatgacattcatgtgaggatctaaagctggtaaaggagcaagccacgaagaacatttctgggggaagagcatttacagagagagagaacggcaaaggcaagtgtccagaggtaggagcatgactggtatgttcaagaaaaagccaggcagccagtgtggatggaatgtgttgaatcagagggggagttgtaggaaatgaagtcagaaaggtaatggggatcatgtaggacttttttgcccttgtaaggattttgagttattgagattgagagttatttgaaggttttgagcagaggtgtgacaaaatccaattagatattagcaaatcatataggctgccttgttgagaacagacagaaatgaagtcagaagggtaatggggatcatgtaggacttttttgcccttgtaaggattttgagttgttgagattgagagtcatttgaaggttttgagcagaggtgtgacaaaatctaattagatgttaacaaatcatataggctgccttgttgagaacagaaagaaaggcagcaaggggttaaacagttacaaataatttatcttccttagggtctctttgtttaaatttaaagtaaggcatatcagtactgtggaagtcaacatcatttttaaataaggaacttttcatggattatcaatgttttatttaaataattttgatataaacaaatgattcatttttgctaatttctttaattgccttttaaacagaaatgcaattgtctttacaggttcattggcacctgctttgctttgttctggtatattttctccttagcgcatgtggcaatctttgtcacaagatttagctatggagaagaactgcagtcctttgtgggagctgtcattgttggtacatacaatgtcgtggttgtgattgtgcttaccaaactgctggtggcaatgcttcataaaagctttcagttgatagcagtaagttcattcttttaaaaactttatattctcctcagaccatactaagtgcatacaatagataagatagccaaagattataagattataagaattgaaaaatagtatttttaaattaaatatagatttttaaaatgtaagtaatgtataataattgcaaatgttgaacaaaatttttctgcaaggtgtggaaacatcccccatatttgtgtgtgtattaatattctagtttgctttttaatttgccttttatatagaatcatgaagacaaagaatggaagtttgctcgagcaaaattatggcttagctactttgatgacaaatgtacgttacctccacctttcaacatcattccctcaccaaagactatctgctatatgattagtagcctcagtaagtggatttgctctcatacatcaaaaggcaaggtcaaacggcaaaacagtttaaaggtaagaaattagaagcttgaatggcaacataaaagttttaacaattcctaatctcagatatttcttaaagcgtaagtatgcaggttccctaagggctgtgactgtctgactttttttcactgctatataccctaatgtacggcatcgcatccaacataaagtaaggattcaataaatactattgagagtgagagggctgggtgcggtggctcacgcttgtaatcccagcactttgggaggctgaggcaagcacatcatcacttgaggtcaggagtttgagaccagcctggtgaaaccccatctctactaaaaacacaaaaactagctgagtgtggtggcacatgcctgtagtcccagctactcaggaggctgaggcaggagaattgcttgaacccaggaggtggaggttgcagtgagccaggatcatgctactgcactccagcttgggtgacagagcgagactccacctcagaacaaacaaacaaacaaatatatatatacacacacacacacacacacacacacacacacacacacacatataattattaagaatgggagatagtactgagatttttttttttacttttcagattcctccaatatataaaatttcatctcatagttttaaaacatgggaaatattcaaaatacccattctgtcactgtagctaaagaatgactactagaatcagctcatatttttctggttcttcttgaaagttattcaatacatcaataattcaatatatgttactataaaccaggggttgggacattttttctgtaaaggtccagatagtaaatactttacacttttcaggctgagacaaaatcagagatattgtaagcagtgatacagtaagagagaaaacaaattttcacaaaacttttattgataaaagtcaaaatataacaataacagtaataactttttaaatataggtctactagtgaaaagaatggagttccttttgggaggggataaaatttcacttaactagagtttaaaattagtgttattatcaattgatgataaatgttcatctgtaaaatctattcttagctcacaggctgtaaagtcaggatatggaccatatttggcttgtgggttgtagtttgccaatccctgctataaactaaggattcctaagactaatttttttcaatcaagataagcataaaattaaattcattaaacaaatatgcaggctatatttgttttaaacaagtgttgaatattataccatgtagtagaaaaactatagtctaataaagcatttaaagatgtgtttgtgtctgtgaatatatttttgaactctacctcatttaaatatcgtttctgcatatccttagtatcatattgttgttttgaaggaatggaggaatttgaaacagaagagagatgaaaactatcaaaaagtgatgtgctgcctagtgcatcgttacttgacttccatgagacagaagatgcaaagtacagatcaggcaactgtggaaaatctaaacgaactgcgccaagatctgtcaaaattccgaaatgaaataagggatttacttggctttcggacttctaaatatgctatgttttatccaagaaattaaccattttctaaatcatggagcgaataattttcaataacagatccaaaagactatattgcataacttgcaatgaaattaatgagatatatattgaaataaagaattatgtaaaagccattctttaaaatatttatagcataaatatatgttatgtaaagtgtgtatatagaattagttttttaaaccttctgttagtggctttttgcagaagcaaaacagattaagtagatagattttgttagcatgctgcttggttttcttacttagtgctttaaaatgtttttttttatgtttaagaggggcagttataaatggacacattgcccagaatgttttgtaaaatgaagaccagcaaatgtaggctgatctccttcacaggatacacttgaaatatagaagttatgttttaaatatctctgttttaggagttcacatatagttcagcatttattgtttaggagtataattttattttatctaaaataatagtctattttttcttttgtattttgttataatcttaagcaacaaagaaaaaaccctaatatttgaatctatttatgtctttcaatttaaattcacttcagtttttgttattgtaatatatttacttttacatggttataatcactttatatttttaatgtttttttcacttaatattttatatatacatttccatgtattgatgtagttagtccacatttaaatttttatagaattatatagtttttgaaaaatacagtcagtagatgttttattttttagctattcagttatgtttataagtttgcatagctacttctcgacatttggtttgttttaatttttttgtatcataatagtcctatttttttttcaagttggagtgaatgtttttagttttaagatagataggagacacttttttatcacatgtagtcacaacctgttttgtttttgtaaaacataggaagtctctttaatgcaatgatttgttttatatttggactaaggttcttgagcttatctcccaaggtactttccataatttaacacagcttctataaaagtgacttcatgcttacttgtggatcattcttgctgcttaagatgaaaagcattggttttttaaaattagagaataaaatatgtatttaaatttttggtgtgttcacataaagggatgtagctaaaatgttttcataggctattatatattctcgcagcatttccagttaagaggatattaggtatataattctcttcttaaccgaatgtcagatggtcttacgccacagggtgcaggtaacccttggtctgtaagcaccaccgatccagggatcattgtctaaataggttactattgtttgtttcatcttgcttttgcatttttattttttaatttccaaattttaagtgttccctctttggggcaaattcttataaaaatgtttattgtaaagttatatattttgtctacgatgggattatgcacttcccaattgggattttacatctggatttttagtcattctaaaaaacacctaattattaaaacatttatagagtgcctactgtatgcatgagttgagttgcttctgaggtacattttgaatgacagcatattgtaagaaaaaaaaaggtgaataaaatttgacattagattataaatggagtctgttcattgtattaccaattttaaaaagttgagatatacagtagtccccctttatctatctgcagtttcactttccatggtttcagttacccacagtcaatcataatctaaaaatattgaatgaaaaattccagaaataattcttgaagttttttttattttttagagacagagtgtctctttgcccaggctcactctgcagtggcatgatcatagctcactgcagcctcgaactcctggtctcaagcaatcctcctgcctcagcctcccaaattgctgggattacaagtgttagcctccatgctcagacagttcttaagttctaagttgttcactgttgttctgagtcacatgatgaaatctcatgccatcctgcctgggcgtgaatcatccctttgttcagcatattcacagtatacactatccaccactgaatcacttagcatcattctctgttatcagatcgacggtcatggcatcccactgcttgtgtaacccttgctttatgtgtaaccctaattttactttataatggccccaaagtgcaagagttgtgatgcaggcaattcaaatacgccaaagagaagctgtagcctgcttcctttaagtgcaaaggtgaaagctcttgacttaaggaacttcaggaaagagaaaaaatgtatctgtggtaacatctacagtaagaacgaatcttttgtctgggaaattgtgaaaaagaaaaaaaaaaatctgtgctaattttgctgttacacctgaaactgcaaaagttacagccacagtgtgggaagtgcttagttaagatgtaaaaggcgttaaatttgtgggtggacagtatgaacagaaacgtgttccagttgacggcaattgggctcagtagtatctgtggtttcaggcatccactggggtgttggaacatatcccctgtggataaggggggactactctaccatgttttgaaataatctgtcaaagacctgtatgtgaacatttatagaagctatattcatggtgtcaaactgagaacaaccaaatgtccattaactagtgactggatcagcaaattgtaaatccatacaatgacaatttattcagcagtaaaaaggaattgtatcagtcacaatcagagaaacagagctactaggatatttgcaggcacacatgtatgtgtgtgtatagtgatttgtttacagggatctgacattacacaactgttggagttggtaagcagtctctgtaagtccctgtttttttatctaatgctggagcagagctggaagtccacagggtaggcaggtgggaagaaaagatggatgtcaagtgggagagatcagggacaagctagaacccatgaagacagaccgagtcccatgtgactcctcacatctccaaccttatgatgtggtaccctgttggagaagtgttgccctttgccacttgcttttgcaagtatgttactaaacactcacttggcccaggaatcaagagaagctgaagcaggatccaaggaaaggtgggtcaactgtaggcctggctgctgccccacattagcaaagtgaaccagcagataagttacagcacgtgtgagctgcagaagtgcccgcatcaagaacaaaacggctgctgcttcacttctgctctccagtcttgcactaaaatgtctcttgtaactggaagcatacaagaaagggaattttgggaaacataattaggcctagccaagttgatacattataaagccaccacaggaacaaactgctgatatatgcaatagcatggatggattttaaaagtaagtgaaagaagccagtcacaaaaagctacaatactgtatggttccatttagatgacattctagaaaagacaaaactataggaactgaaatcagatcattgagtaccagggtctagtggtctaggagacaactgactgcacagctcatcaaactgtatgcttaaaaagagtgaattttaatgtatagaaattatgccttaataacccagacaaaaaatctaaaatacaatgctacaacatactaaaataaataagaaaataacagtggaatcttaaaattcattaccactgccaaagaaagcagtgcttgcatctgcaagttggtagcccatcactcacacagcacagtggggtacagtaataaatgccaaggtgaataacttcgtattactttttcaaaattatttttgctatccaggttctatgatttttcatttaaattttggaatctatcaatttcttaaaaaataaacgggatttttattggaattgcattgaaactagagaccactttgggaagaactgacgtctttacagtattgtctaaactatcaacatgatgtagcttctcatttatttaagtcttccttaatttcccttagcaatgttttatagtttttagcattgaaatctaatagcattatatattaataactaaaaaaatagaatgagattctactcacatgcaatcccaatgaagaccagtttgcttatcatttagttatgtgttcagatttcaaagcttaacatctttccttaaagtaactacaggttgttgttattaattgtttgaaggatacaaaccaactgctaatcattgacagtctttcttaaaaaatgataaaagtggaagtgctcttaatcttattaataaatacttattatctcttttctacctgataaagaaaactttctttgattccttagacttcaaaatttttgttttcctcagaaaatacgtgtataaaataccaaataaattgagggtatagatcctgggagtaaaccaactgggtctagttattcagattacactaagaaactaataatagtatcagggataatcactgctctgaattcctcatttataagttaatgtattagttttctggcatcacggccccattcataaacaagctgtgtttctggaggatatacttagaagaatttcccattacagtgcttctcttcatttgataatttcacattgttttttcctattctgctctccctgcccccagactgaaataaatacttcagatatgcaacacataaattaggaaaatttttatatactagttgatgctttaaaaataaccatcttctgtaatcccagcactttgggaggctgaggcgggtggatcacaaggtcaggagatcgagaccatcctggctaacacagtgaaacgccatctctactaaaaatacaaaaaaattagccaggcatggtggggggggcctgtagtaccagctactcgggaggctggggcaggagaatggcatgaacctggaaggcggagcttacagtgagtcgcgatcacgccactacactccagcctgggcgatgaagcgagactctgtctcaaaaaaacaaaaaaacaaacaaaaaaaaccatctttaagagacatgatttctgatataaattaaattatagtaataaaagaggcaaaacagcaggtttgtgtaggaggtaaatgtatacttaaaaaaaaaacaaaaaacaaaaactactatcccagccaatccaatatgtgacacagtaagttcctttttcttcatcctgctaccaagaatctggaaaattatctctctctccctctctctccccactagaaaggttatttaattcatccttcaattttaggcaaatttattcttattgaaagataaaatgggccgggcatggtggctcacgcctgtaatcccagcactttgggaggccaaagtgggtggatcacctgaggtcggtagtttgagaccagcatgaccaacatggagaaaccctgactctactaaaaatacaaaattagcctggcgtggtggtggcgcatgcctttaatcccagctactccggaggctgaggcaggagaatagcttgaacccgggaggtggaggttgtggtgagccgagattgcgccattgcactccagcctgggcaacgagagtgaaactctgcctcaaaaaaaaaaaaaaaaaaaatgagataaaatgattgagtgctgttttaaaaattttaaggaggaaaatgcacaagctacctcagtaactcattcagaaattgaattaattctgtgaggtaattcagcttctcattttaaaattcatttcctccaattttatttcaacggaaaaagcaatcacaatattttctgtgtttgcttgaatgcagatgttttcttctcccatccacccccgctgaccccagtgacagagtctcacaatattttccaggctggaagtacagtggctattaacaggtgccatcatagcacactacagcctccaactcctgggctaaagagaacctcctacctcagcctcccaagtagctgggactacaggagtgtgctaccacacccagcctctttcttttgaaaagctgtaaaacaagaccaggcacaagaaggaacagttctctcattctcttttgtatcctcactctaagtatggtattaatgttgaatggcacaaagttattgaataaaaatttagccattatccgttagtgtaaatattctaggaatgacaactagtttattaaatactcttaacaattgtgtgctccagatcctattttctcaaactacattaaaagaaaacttagattccctacttcaaccttctaatttaatatacaggaaaactagcattttgagtaatttgtccaagtgtatatactgactggagatactgaattcaattgatttttcctatcagtcaatatatatccaaaagctttccatttttgaattagcttctcattgtaggttcatcttggtcagcaaacagaacttaagttcctacttttctaaataactaatttgttaaaaacttttatgacgagggtcaagcagagaccagcaagatgagcaagagttggaggaaaaggatggacaggtaggtagtgaacatcataggaaagggggagttagcctcagaaagtaacagccagaccagaagggaccagagtgtttaaagcacacagactggtgaattttatttctgtgccactttctatcctaatcaatttgaatattcagccaggcgcagtggctcatgcctgtaatctcagcactttaggaggccaaggcaggtggatcacctgaggtcaggagtttgagaccagcctggccaacatagtgaaacattagctgggcatggtggtgtgcggctgtaatcccagctactcaggaagctgaggcaggagaatagtttgaacctgggaggcagaggttgtagtgagccaaaatcacgtcactgcactccagcctggtcaacagagtgaaactccatctcaaaaaaaaaaaaaaagtacatattcaaggatccagaaaccacttaagaccataagggatctcagaaagtatccaattcaacttcatgttacagataaggaaactaaagttctcccattgccacactgtgaatgagaatccaagtctttttccttttcagctgggaggctcttacctgcattatgttactattaatatcagtttttttgtgagatgaattaatcagatatatgaagtcttactttcagcttgtaaattttcttcataggtttctatacttaaaagcttcatctcgttgaaatctaacccaatcttagtattagaatgctacagggacatcattcaggcaaagatgtttcatttatatctaatcaaattttagccttttaaactcaattgttgattttgtttttaaaagggagaagcaaatgacaaaaaaatcaaaaccaggatttttaataataactttagaatacttcagaacaaatttttatgtatatcccagagctactcacccagaacacccgattccatgcatccatgggcaatcccacacttgtacatccagagagcctttgtcaaaaagaggctattcgtggcccagtgctgtggctcacgcctataatcccagcactttgggaggccaaggcagatggatcacctgagatcaggagttcaagatcagcctgaacaacatggcaaaaccccatctctactaaaaatacaaaaattagcttttcttaatttggtcagagttttgtcaattatattagtcattttaaagaaccaacatttggctttccttttttctattatttaagatgacaattttattcaatttctgctctatgctattttatcctaccttttaaaagtttatggtgttttccttttactaagttcccaatttgtatcattcacaaattaataatttccatcctttcttttataatgtaaacatgtaagattataaattttaaagtgttatttaagctgcatttcacacattttaaaatgcagtttttctattgttcagtttttaatattttgttttccattatggtttcctttttatcatgagttgaaagtacatttcttaatttccaatttttttcttgttttttgttgtttactttttgttattaatttctagtcatttactgttagagaaggctgttcgataccagttgtttgaaatttgttggaatttgcttcatggtgcatggcaagttctgaaattgttccatacgagctcaaaataatgtgcccttggttctgttctacatatgtgtgttaggtaaatctagctaattgtgcggttcaacacttctatatttttaatgttttctcttttaaatctgtcaatactgagagaaacatgttaaaacctccccttatgatggtaaacttgtccatttctatttatactatatcagatttagttatatattttgaaggatgttattagctgtgtgcaaatttagaattgttatatctccttgtaactctcttcatcttgagtaatgccttgaagtattttttttctggtattaataaaaccataccatttttattttggttaatgtttgcctggtatactgtatttatctttttctatccctttcctctcaacttttccgtgtcctcatgttttagatgtctctttcaaatagcacatagctgtatttctttttctaagccagtctgaccattttgacgtataactttcaggacttagtttaggtgtttactgaaattattgatatgtttgtatttttaccttattttgttgtatttttcctggtttcactttctttaatttcttcttttttttcctctgctggttttaaatgttgatgctctatttatattatttatgctctatttatattattattttattatattaccctagaaaaattaatgtaaatacttaaattatcaaagtcctaagttaatatttttatctttctctctctcaatacgaggtctttagaatacttaggtcaaatctttttaaaaaacatttgcttgctaattgaatttaattgcaaattttttgtttccatttatataaaaaatataaatttgtttgcttgaatccatgaactcaagcaaaaggtgtttctgattaatattacttaactcacgttagaactttctcattagtgcctgtttaattacagggcttttctttaagggagttttttttgtcattagttgataccatttaaatagtccagaagtaaatgggagcctggtagcagtagtctattaatacatgaaagaaaagaaggtaaatgtcttccaattaaggttaacttggaagtaaattacagaatttaagacttgggaacttgggaaaaatcttaaatgttcatttacaggaattcaaaggatgaaaatcaagctagcaagatgctctgaaacagtgagatttatttataattttgaaatgttttgtgatatgttagtatggtcacctattcattcttcatgtgtatttgattccccaagtataaatacttaaaaacaaaaacaaaaccttatcaactattcttgaaaaataaacaattcctaaaagagaaaatagtatgggatcccagaagttatgtagtctaactccctcaaattataactaaggaaactaaacctcagtcaaaataaaggtgtcttagtccgttctgtgctgctataacagaatatctgagactgggtaattcataaagaacagatatttatttcttacagttctggaggctgggaagtccaaagtcaagggcccacatctggtgacggccttctcacagcatcatcccatggcagaaggtggaaacgcaagagagcacatgaacacatcaacacatgtgcatgcccaaaagagaaagacaaggatggagtggggacgcagggggccaaattcatccttttaccaaggacccattctcacgataactcactcactcccatgataatggcattaatccattcgtgagggctctgcctcataaaagagcccacctctcaacactgttgcattgaggatttactttccaacacataatttggaggatacagtcaaaccatagaaaaatgattgtttaaaaaggaaagaaattacaaagtggttgttattccagaaagagcagcttcacgattcatcttatctctatgttttgaataactgaagtaaaagacaaaccagtgccacacacttttaaccgtgaatcccctaagcagttgtaaaatactgtgtcagagatgtcaatagtatgaatagtttagattactcttctcagtttttaccccactgtgactcaagcccccactcacctgaagaagtctttccgctggtcatgcagaagcttgatacccgccagcatgctgcttgtaattcaccaataggagattctattcagaaagaagaaatactgaaatctttaggattccctcctaagtcccggaacatgtattcttaaagggaagcaacttgctttgagaaggctggaatcaatgaggagtccacagttacatcctgtgctgggcgcagctggtctgcgaagttcagctggctaagagaactttctaaaagctgacactggccagggaagccagtcacccactgtcatcagggtcttctagttcatctacttcctgctgacggctcctcagtgggaaagtataggagcagtttctgacctgcctgtcagcccaattttgtcgtttccttaggctcacccagctgccgtaacagagggaacagagttccttctgaacttctattttgccaccctttaaatgtctggtcatcctagggctgggaattattgttttcatctaaaagagtattttcccttatttccaaaactttgcttctaccgtggaagagtttgtgacccacgtctttgttcatccctaatgttctttcagccttctttggatagggatggttatccgctctcccacagcccctggctggtaacctcctacagggctggttgctgcactcatatagttgtgccttaagcagctctatgtgaatgaaggtccttttgctgttcttccactaatgagtgaaaatagatttctcaaaggctcttagctgatacagcctgatccagttaactggggataaacagggcagcagtgtcaagctcacttctaatttcaagttctgtaaaatgaccaattatataggctagtaaatactagcctaagtactaatatttagtacttcactcttcaaatcaggataagagggctttcctctgggggtagggaaggctcttctagtggcagtgagggcaaagggtttggaattaggactctttagcttgattgttttgtctcttaggagacatgtgctctggcaagtcactaaacatacctgagcttccgtttcaattacaaaatgaaacagtgtggactagatccctgagagatgttattctagcactaacattctctgtttctgcagagagaagaattatagtctattgacattactggatccatttagtccctgaaattcttggaatgctcttttagcaaagtgtaaattgatacaaaggcaatcttatgcataaatcacactattcttattgctaaaagggaatattccttctacaatgtcccactatctataaaaagaagtttagtggttgttctgtaatcctttaaaaatattttattaagcattgatttagaaaacgcaagacaagattgtaacacctcagggcaaaggcttgaaggtgaaacaaataacactataaatattgcacttctaaaatctttttttgacatcttcacacaactcaattctaaaatatccttttacagagatgtataaataaacgcttccaagctgtcaacgcttgacacttttagcttcctatcaccgcactaagtcggcaggtttccaatcagatagctgctcctctgacagcaggcaaagaacttccctcagctatctcggaggcctcatacctccatcatgtgaagagtcaaccagtcccatctttcggaatcctctttcagaatatgtaattttataagtatttttttttctactgagagaacatagatctttcaaaggcaatggcagaatacagcttaaatggacacagttcactgttaacattgcttattttttaaggcatccaggagcttctgattcttggtcttgaacatcatgataaagctgtttggcatgattttgcctcgcccatcttcacctacttggcccataataatgtaatttagacctaaagaaagagaatacagaaattaatctttttctctatgtatcatgtgtgaaacaacttagactgtaagttacctctagataaatgttctcttctgcaaatggtaagattatacatgtattccatccacgataaaatctgggtttcttgtttttgctttttagagatgggggtcttgccatgttccccaggctggtcttaaactactgaacttaagcgattctcctgcctcagactccaaagtagctgggactacaggcacacgccattgtgcctggatgataaaatctgttttaagactctcatcggcaaaaagccaaattcaactagtaaggtatttcagctacgctaacaccaggaagctggactgagtggttagatcagccatgtcccgctctgcagtgctgtaggtctgttgtggtttcaaatgcctgctatgaagaatgcaccgcgttaacgtgaaagactctccttcctcgaggggcctccagggctccatgatgggccatcctcagatggcttctcagtcccatcatgtgtctggattttcctggcatttggcaaccaatgatccactctcttatgttgctgttgtcttgaactttaatcaacatctcaaacatgtatgctacgcaagcttcttgagggcatagatggatcatatactacttgcatttgtacagtttcttgcaaaacatcggtgtcaagagtacttatattggttatactatgtttttatacattggtgtgactggctaagttaggcctagactggggcctgaggtgttgggtaactctgaatatttatattacctcagaaataaatcagaaaaaaaggtatgggttaattcctcctttagttcccctttcccctggtgtgtcatagagaaaatgtgtcctttttctcttgcattttcctgtgtgggtggaccttgtcatcacagtggtctgtgagagcctgagagtctgggcaggtaatgctgcctcaaggctgaagtgctagcagcattatgagaccttatagaatcttgaggtgcagtatctgctgctcctggcagttctggaaagaaatgtttctcttttacagagcctttgtgattctctccagagactcaacatgaggctactagcctcctgacttttctgaacaatctgaattcacagtaaagcttgctttatttttaaatttttttctttttttagacagtcttgctctgccacccaggctggagtgcagcagtgtgatcatgactcactgcagactcgacctcttaggttcaaggcatcctcttgcttcagcctcacgagtagctgggaccacaggtgcgcaccaccacacccggctaaatttttttatttttagtagagcagaggtctcactatgttgcccaggctggtctcgaactcaggctgaagcaatcctcccatctcagcctcctaaagtgctgggacagtaaagctttcttgaagtggatattctgtatctttctctctctttctctctctctctctctgtgtgtatgtgtggaaagatgttagagcttatgtaggggaaaaattgcagaacttgtgtgtgatatgattccataagtgtatatgcccatgctttatgtggatagaaactttctggaaggaacttaaattttttttttttttatagaaatagggtctcactacatcacccagcctgatctcgaacttctgggctcaagcaatcctcccacctcggcctcccaaagtgctgggattacaggcatgagctactgtgtctggctggaaggaactttttagagtacttctaaggaaaggaaaagggtttcacttttaaacatactcttacctacttatttcaactttttaaaaaccatgaaacatatgttacttttataagttgttaaatacatattcttaaaaagtcatgtgcctctagctctggagtaactttccgtttttcgtaatttctttcaataaactcactcccatccatggacttaatagtcctatctctgcaaatgattcccagatcttgattctagcccggatatacctccctcttctgaacttcgggtctgcatttcctgttggctgctggatatttttctttaaacctagacagtactggcatcttaagtgcaatagtctaaaatctctccaccctgcactgctctgtgtgtctgttgcctattgactcaacttcaaacgcttctttcacttgttcatcatgtccactaccccttcttctgccacaagttacaaggacttggatgagagcccaattctgcctgactccaaaggccttcctgctctgcaagaagtgggcaacatattagccctgattttacttccctagaccaaccatggcatggaaaatccatggcttgctcagagacacccagttttctccctactcacctcttctgaggagagggcactgcttgcagacgacagtcagcctggcactcatgttcttgcccgcctgctgaatcgccaaatttccctctttgtagatgttgatgatcgagactgtggcgtgcaaactcccatcgcgagtgatggttgtgataacagtgccggctaatactgcagaagaaaacattttgaagtgatgtgacagtgaaggcaaatgcaagcagaactgaaaaacaagtttacattcttctaagtttcagatacgaaacattttaatgttaaagaaaaggccctcatagaggtttcacatttgcttctgtacatttgtcaccaaaattcaggttggagctgtgatgttacgctggttgttggggattgataactagaagagaagcctaaatacttgccacactgcggtccattgccaaggttgaaactctttaaaacgttttatccaacttgtggcttgattgtcacataggggatagtctggcttatgaggctctacctgtgaatactcaaaaagatcttgtatctttagaggcagtaccacgctaaaagattgcgcgatgggggtttgggccactaagatgtgagtctttgtgtcggtgtgggtgtgtagccacctttctgtgtctctcctcacccttctctgtagctgtcctttcttcctgaacttttgttcattccctgggtcctcacctctgtctaattatcaggaaagctctgtcttctacggtctttcatattctctttcttatccactccgtttatttcatttaacaagctgaagtatagaactgaggtattaacttaaacttttttttttcttaaaaaaaaacctctagtaaaattcagttgattttttcattatgtaaacccctgttttttccatcatgacactccgagaaaagagtctctctttgaagccacagaaggaaagatgttgtctttctcacgggggtgcgcctggcattctgggggcttgagcaaggacagttccttgtggtgtaggacttgcactgaatacagtttttttttgttgttgttgttttttcatgagatggagtttcgctcttgttgcccaggctggactgcagtggcacaatctcagctcactgcaacctccacctcccaggttcaagcaattctcctgcctcagcctcccaagtagctgggattacaggcatgcaccaccacacccagctaattttgtatttttagtagagatggggtttctccatgtttgtcaggctggtctcgaactcccaacctcaggtgatccacctgcctcggcctccaaagtactgggattacaggtgtgagccactgaacctggcctgaatacattttttaccagccttgtccttcctagaaaaatcagtagcagttcctagttattgtgacaaccaaaaaaatgcagtaatctaacatctctaccactccccaggggagcattatcagccctggttgagaaccagtgactgatgatagttttggtcattttgccatgtaagcggtcacattaatggaataaatcaagttttggacttggttaatctgactccttcagaataaagtgaacactcactgcttaggcagtgtgcaatgttcataaaatcagaattcctatgatgctttactttgatcctgcgtgataagtgttcactccaaaattcagtctatagtcaagtgaaatcagtggctcccaagacacagggagggagacttcctgaagcacctcctacagaagagtaaactggatgtggtagcaattacatgtggcgttgttttcacatttatgccagttatttgaatttcagcatgtgaactctagtaaggtttagggtcccagagtcttcagtgtcttcacaccttcactatgatacagctcgtctggactacagaagtcacttcaaggcacagaaaaagcaagcagagcctctctggggaagttttgtttggggaaatgtatttaggccatagcaacttgctcttcctgatcagatttgtcttaaatgttcctttaaagccactgaaaaaataaccaagataaaatgttgtatcttttgctcttaagtagctatcatagatggtgcaatctttccactggaaaaagctcttaaaaattctaaatcattaaagaacacctcctcaggttccagtttgtgagagtttccaaatggactccagatttccaacttttacttcagtacctcagaaaggcagtacaggggaaatacttgaatttcttctgagagagaccagcttctgaatataagctcgggtatgtttctaatttacttaagttgagttatagatgtgtgaaaaaatactctgtatatgaaaaatatataaggaaaaaagtacataggttttttgcaggaatagtcagccagaacacacaatgtggcagtatcatgtaccaagagtcaaattattaagcttatatgaaaaaagtatattttctaaatccatatttttctcagtggtgaaatctaacaatttgaccattctggtgtataggcaagtattttcttggataaatgagcagcgttattgacccttcaccataaattcataggaattcctttgagattaagcatgcagcctcaagtttctggttaaagagaaaaagactggcttttatttcttaccaaagtcacttgaacaataattgccctccagagtccccgtccgtctacacttttgttgacacaaggccacggtgggttttaaaccttaattcaaagaagacataagtttcacgaaaaatgaattcaagcataattggtctttagttctgaatctacccatttaaaattatcatttatttccctgagccaccaatctatcactacaaagaaaaaatttaaaaccacgcaaaataaattctccatgctaccaactactgctctaatttcaccaggacaactcaataccctctattgaattttaaacctgagttcaaagatagcacaaatgtagccctgttctcttcttcctttatataaaacaaacactataagaaaatacaggcgtactctgagtgtgtgccctgtttagaaaaacccagaacaacaaattggaactcacagaatgtaggttaatccctcactttacaaaaggaatcatagggtgttcccctgaggacatccttaaaatatgcaattgcctaaacatgagtagcataggtttttagaaatactgttcatgtgtaaagtgtgttacatctgtaattagatgcaacccatcactaaatatttattttgagcctggcactggctataagaatcttaagaactaagaagtagacaaatttaaaagtataccaaatagacaaaacacagcagttcttaagtacgggtgacgttgcccccagcaggcatttggcaatatctagaaacatttctggttatcacaactagagggtattgctagcatctagtgggtagatgccgagacgctgctgacatcccacagaaaaaaggacagtccccgcaacacagaaggatctggcccaaaatataaatagtgctgaggtagagaaaccccgggttaacaacgtgaaaatagttcatcctcataatcatcttaagaatgtttcagaaatacttgctaattatttgtttctgtgtgacaatatgctaggaagaactaaacagaaccacggtaacagaattgcccttgttgggtgaatatccacagttgtaatattgctcttccaacaggccccaccaactcctctgttaatttattatttatctatttatttatttttgacatggagtctctcgctctgtcgcccaggctggagtacaatggtgtgatcttggctcactgcaagctccacctcccgggttcaagcaattctcctgcctcagcctcctgagtagctgggactacagatgcctggccaatttttgtatttttagtagagatttcatttcgccatgttggccaggctggtctcaaactcctgacctcaggtgatttgcctgtctcggcctctgaaagtgctgggattacaggtgtaagccaccgcgcccagcctatttatatactcttaatctgtaccccctagttaactccagaaagaatctgaagcagatggcaatattaaaacatatgtaatttaatgttaaaatacatataatagcttaaatatgcatttttaaaaaagggagagaaagagctcagaagatgtttggaagggagagacataccattgttccagaagttgggaacctcacttcagctgtaaatttatggaattaaatttactcagttaactgagtcaaaaagttgtggtgtgtctgatggtgagcgccctttcccgggcccattgggaaccggctgcttctcagcctccgaaggtcagtctggaagtggggtgggtgtccaacatgcccttctcctgctttggtggggcctgctgtctggcctgcaagtcactggctctctccttcccctcctcatcttaactgtcatctgtctccttgcccttcactcacaaagctggtcccggttctcagccctccctggctgtgttcccgcgatcgtttctatgggtccaccctcccatgtctgatcccgcagtccccgtggcctcatcttcaccagggactttcctagacactcagttccaggctcggatgtcttcatgctatggctgttcattgccagtctatcaaatttagacctgctggcaaccaggacagcgttctcccctccaagcttatttatttaatcactctatgactatgttttcttccatctttgatggttcaatatattggctgctctcatttttcccaacccgtcagccctggcctgtctttacttccttagcaattctatttcatttccatggtccattatttcaatcattttctacacaatgccttaaggtcccttcccctctgcccttcagccctgtatgaatcttcagagaaatctgtttttcctgtgcctgccctcagacaactgagtacacaaatgggccttcagcagagtgacaggctggagttcagcctactctccaatttctacagctgtttttcaaattctttctcattctcctaacctcccgtgctgccactcccttctccctctcagaggtgaccttgcctttttttttttctttttgagacagagtctcactctgtcgcccaggctggagtgcagtggcgcgatgtcggctcactgcaaactccgcatcctgggtccacgccattctcctgcctcagcctcccgagtagctgggactacaggtgcccaccaccacgcccggctaatttttttgtatttttttagtagaggcggggtttcaccgtgttagccaagatggtctcgatctcctgacctcatgatccacccgcctcggcctcccaaagttctgggattacaggtgtaagccaccgcacctagccgaccctgcctattttctaggaagaagagaagcatagcagaaaatgttctcaagatccccaccaaacctccaagtcatctttataccatctctcttcttttcctcctctgagagaggggtcacccccctccgacctgaagtcatgccttctgtgagtcctctggagccagcccctctcacctttatagaaactttccttctcagtttattccttctgtctgccattgccttcttctttgctagttactcccatcaacataagcaggttcaagactctcaaagcctctccttcttctttaaggccaaacttggggaatgagctactgaacttattatctcaatttgccatgctccacactcccctcagcacacactgtccgggttctgctggcggcacaaagccacttacatagattgtgctggcgtctccagtagactccatgtcatgaaaccaaacggaaacactgtagtcctcccttattggaagtctcatcaacgcttgactcacttaccactcccttttgtaacattcccttccacggctttcaccacacatcctcccagttctcctccctcctccctcgccactgcttttcagtcacctttgccagtgtaaccttctcttcaaaaagacggaagtttctagagggttaatctccgcgcctctcctcctcctgccctcaatctctgcctaggtcatctcgttcttgatcattgtttcaactatctatatattgatgactcttacttttttttggcataaagacaaactttattgagccccttagcactagttctctttctcctgcacagtcttggttccccagagacgtccagtctggcgggcagcaatgagacccattttgcagccagcagggtcatctctgagatggcggaggggatgccgatgtgctggtggttgccacctccaaaaggatgctccatagggttcatggccacatcccatactcgtggccaccagttcctctttgccttatatttgtggtaggcttggcaagccttcaagatgggtttgtcagttcggccacctccagccaccacaccaaccacagctctgttggctgaggagacaaccttcttggagccagagggcagcttcacacgggtcttcttggtctcagggttgtgggagatagcagtggcatagttccctgatgcccaggacagcttgctacggcctccaggcttctcctccaggcagcacacgatcataccctcaggcatggtgcccacagggagcacactgccaatgttgagctgggccttcttgccgcaatacacaaactggcccgtgtgaatgccctcggcagcaatgaaaagctccgtccgcttcttaaaccagtacgggtcgcggaagaccaccttggggaggggcgcgctgtgacccgagttgtggatgatgggtgactcttaaatttaaatctggcttaaatcttttagtctggggacccgtgtacccctacgcatggcatatccactggaaaatctcacggacacctcaaacccaacaaggcgacagcctaatttataaatccacctccgaatccagttctctacctctgtgaacagtggcagtatccccctagctgtgcaagcccgggacctgggaggcattcctgacacctacctccctgacctccctagtccaatgaatcaccaaggcctgtcactgtttccctctcatctcttgactctctctgaatttgtgccatagcacagttcgcctggaccagcacgagactctggtgaccccctggatttctacaattcattcacctgacagtggccacagtgatctttgtaaaatgtgaaactaatcctgaactttgcttaaacccatcaacagcttcccccacacataggataaacacaaaaatacttagagcataggagagagtttgcaaggcctgaagacgaaactagaaagagaggctggggacaaagtgtgaagggtctgacacaccacgggaaggggtttgggctcccatgtggtccaatctggtagtcactagtcacatgaagcttttcaattttaaattcattaacattaaattaaaagttcagttcctcaatatcattagccacattttaagtgctcacagtggctgccatattggatagcatagctgtagactataaatttaatgggagaacaacacagtctactcggtgtggtgggagcggggtagggcatgaggtcaggagaaaagatagaggatatcaaagatgaccctatgagtgcggctaccgatgctgtggacgtgcttgggaaaataggtggagaagtaggtctgaggcagaaaatagtgtgataaaaacaagtttgtatatgctttcatttaaatagctacagtcacattgtgtccaggaaagaattacaaatccatgcttgcgatttcagagaaagttgaggatggagataaaagcaagggaaccactagctcaatgggtgtgaccagataattcactggaaagaacatggacaccaaggcttactgagctgagctggagaaatacagcagttacatgaggcagtacacgtccacaccacacagtggcgcacttgcagagtgcaaggaaacgttagacccagaggcgcctgcctgtactcagccccagcctaggtgtacatggaaaatgtgggcaataaagctgggcttatttcagcctattttacatcttaaccttcagtctttccttcccgcttttccccctcctccctgggtttggatttttagatctgaggcctgaaatcccagggggtggagctgataggccaggtactacctacagagaccctgcctctccactccctacatacatgcctcagccccccaggccagtttcccaaccagcctctgtacttcgttgaatattgttgtttaatttactccgatttgaaaataaataaataaataaataaataacattttatatgacatttcgctgagaagcaaaaaaaaaaaccaaaaacaaacattggcagaatatgaaaacacagatagcaaggccctagaacttcaacctaaaatatcacaattctatgtaataaaaagcaaacgacaagtttgtcagttccagaaacagaaacttagtcttagaatgatctgtgcttctaataggcttcctagtcattgttcaatggtcataattttcttacctgatatttaaaaactattagcttacaagcattcttacaccccatacctttctttcattaatgcagtcatattattctcttaccaaagctttcatcctatttaactttaatttcaagtatcttcctcttattttttttctactttaaaagaattcttcttatactcctaaagtttttgcacaaacttccaaacaggaaaacttacccgtggttacagggaatgtggtggtgacaggctgttctgtagttgtaggcagtttttttggcctgaatatgtagtgaccaataaacccatctgcagttaaacttaagtctgataaaaactgaataagaagttcatttctctcagacacaattggcctaaaaaaagaaaaatgtgtttttttataaatacttaaaagtggtgcctctctgaaaatgtaaaattttctagttttccattaacttccgacaatagattaccagttgtttaaacttaaaagttaaaacgtttaaaaataccaattctaatagctaacatttaccgagtgtttgctcagctaggcactgtgctttatgtgaattgtcacattccaccttcacaacaaccctatttttatctctttttttatggaaaaggcaattgaagttcagagagttcaagtgatttactcaaggccctatagctagtatgttgggagagtcagaacttgaacccaggaccagataactctagagactgtggcagacgttgggacatggctggttttcaaaaagcacctcatgatttgcctgattgggaaaaggcagattctctgaactaagacttgcgttcaagctggcctgggtttgccatgttggctacagagcataaaatggacaaatctggtgaacaaattcccacgccctgtaaagatgcagccagagggattatctcagtggactgattatcttttctatccactccgggctaagaaagccatgcaaaggacttccatttcattttcaatggcagttcttcggtatgtctgaaatggaaacatttctattataatctccattagcaaaatgctgtaaaggaaaaaaaagaaagtgatgaatctgttttggtgttcatgaatggcatcattgattaagagctctaattttaggagcttcctggttagctggcactaaagatttagtggagatggtaagtgaggctcaaaagctctctaaaatcttaggggattactatattacacaagatagtttcatttaagttttgctattgttatttacacaatggttaaaaaaatgctgtctgattaattctgtttaaaaactaattcagaagtagaaaaaatttaacaagttatttaaatgaattaaccagtggtctgactgaacacctttttgagacatcttctcagccaatcacttcttacacatcatggacaccaaataatgaagcagcatttttttccccctactgtcagctgtgctgagtggggttgggtggcagagagggtagatctacctgacccaaccagttagaaaaactgcgtgatcttttccgtcctgaatataaccttctgagccaggggatgagatgaatcaaaaagtgagctttgtgatctacatttacagtttactatgggttgaatatttatcccctccaaaactcatgttgaaatttaatgcccagtggggcagtattgagaaatggaacctttaagaggtgattgggtcatgagggctctgccctcaggaatggattcatccattcacagattaatggataagtgggttaatggattaatgggcaatcacgggagtgggactgatggctttataagacgagagacctgagttagcatgctctgccccccttgccatgtgatgccctgtgctgcgtggggactttgcagagagtccccaccagcaagaaggctctccccagatgtggtcccttgaccttggacttttcagcctccgtaactataagaaattctttttctttataaattactcagtttcaggtattctgttataggcaacacaaaacggactaagacacttccagccacaaaagtgatgaagttatttaaataatgcttctgagattcgagcctttcacgaaaatattctatcatgcttttgaaaaacactcccattaaataaataaaaacaatgcactacacacaattctaacctacaattacaaataaaacatgttaattttgtttaaatgataaaattacaaaaaaagcacttataagcagcaaaggaaaggaaagactcaatcaggtcagccttctagacatgatgttataattatatgatcattcactgccttttctatgaattaaccttgggggtagtatattggaaactgaattttctcaaggaagagtattttaggaacaaagacatatttttgttctgctgcaactgagctttaggataaatgtgacagaatcacagtgccacaaatgtactgggggccatgttacatctgcaaattgttataaatcactaggcagacaagaggaaatttcacttagatccactctgcattggcaaatcccaagaacggactgagatgctgtttcatgtggtatagagccagttactgttagctgtctctagttatcattccatagtcttcctgtccttcagtcactacagccaaccaaacaccatgtcctgccatttttgcctcctaagtatttcttgatccacaccctcctcttcatttctaccacccttctccacctcctcgactttacctggaccattgcaacagtctctgaactaggctccctgctcaccttctctaggacgggggttctagagcctctggtcctgtcacgcctggcctaaattcagttgagcgttaccatctctgcagcacacggaagccaactcaaccctcctgcctcatctgtatagaggccccaactcaaggttttggctgcagaaataacacacatctctcccgcgtatctttattaatggagttacctctgcttgggatgagcttgtcctccctgctgtctctaactccaactcttccttcaagactcatcttcgagaggcacaatctcctttcaaaagctttccctgatcacttgtccagactgggccaaagaactcaaaaacccacccaggacattcattagccaatttacttatctgccttattctgttccctcccagtacttttctttgcagttttaatttatctttgtattccaggtgcccagcacacagccggggaggaatcaatgtttctgaacagaattcaatggcattgatctacactgaatcaaaccaagtatgatggggtgctgtctacctatccccagtgctcctcctgttcattttttaacagggaaaagctccccaaacaggttttctcattttctgcactgctctaacccagacgtattctgactatgaaaactattcctctggataaaagtgttagttggtgagctggcagccaagctcttccagtcaaacccctggtaaatgagtgatgctcaatagccgccgccagggctgcccctcctccaccctcatggaggcagccactaccctgaattttgtgcttatcattttcttgtttttagctataggtttatcacacacatatgcatcactatgcgatatattgtgtaggtctacatgtttttaaacgtcataaatgaaagggtacagtgtgcattttttttttcttttttgttttgtgtttttgagacaaggtctcactctgtcgcccaggctggagtgcagtggcatggtcttggctcactgcaacttccatcttctgggttcaagggaacctcccacctcagcctcccaagtagcggggattacatgcactaccaggcgacattaattgttttgtatttttagagataggatttccacattgcccaggctggtctcgaactcctgaactcaaatgatccacctgccttgggctcccaaagtgctgggattacaggcatgagccaccacgctcagcctttttttttttttttttaaaccctcaacattataactatgagattcatccactgttttcattgctttatagtgtgcactataacacaatttaagaattctcttgttgataaacattgggctatttactctctcccaccctcattacaaaccatattgctgagaacattcttgtatatgtcttgcagtgcaaaagtggtcgtaccaattcacacacctttcaaaggtttattcactatgcagctttcttcttttgggaatgccttttcatgtcttttacccccttttttttcctactgggtggttatctgttccttgttaatttttaggatttcttaatacgttctggaacctaagcctttgtcaaatatatgttataaatatgtttccatttgtggcttttcttttccctctctttcagggtatattctgatgaacagaaattctcatctaagtttctcatttaagtttctaatccatctgtcattgattttttgtgtgatattagctatgaatataatttcatttttccatatgaataaaaatagtctaggccccatttttcaatgaggccatccttttcctgctgactgatggttctctgtgacgggcccaatctgcagatacatgtggatatgtttctggcctctccttgttgtttaattagccatctacccatcactcttttaaaaccacactgtcttaattacaacagctttctgataaggttccatacatggtaaagcaagtcttcctgccaggttcttctccttcagaactgtcttacttttgcccccttcttcctatccccttgcaatcccatgcacattttagaattagactgctaggcttaatggaaaaccagttttaatatttttaaatgatattgagtcttcctattcatgagcattgtatatagctccatttatttagctcttttaaaatatattttagcaaggttttataattttccctattaagcacatttttatacttattcctgagcaggatttttattgcttttaaaataaatttttttcaaaatgtaaacttttaagttcaaactatctaagaaaagacatttgtgaataaaatgatttttccattaaataacataagtccacaagtcacactttaatctggtgaggtataaggttaaattaataaagtttctaaattcaaaccaaccttggattcctggtcatagaattttttttatacattgctaaatttggcttgccaagttttttgtttcagcgtttcttttttatcatactgataaatgagattggtctctaatattattttcttgtactgtccttaccttgtttttgtgtcaggttcatactagctttataaaattagttgtggaacaatccctatttttctctggaagattctgtgcagtattagaaatgtctgtacctcaaatatctgtcagaacttttccttccttgacaggaaaacctttaattactgattaaatttctttagtgatcatttggcaaatatggctttttctttctcctgtgtccatttttgcttgaaaaaaatagagtttctccagttgctggatgtagtgttctctatttgtctattagaccaagcctgttcattgtttttcaaatcttctacctcctaatttcccatctttctctcattaacagttagttaatctgttaattattgaaagagatgtgttaaaaatctctactacaataatgaactttgtagatctgcctttcttaattttttaatttttttgcttcaaataatcttatgtacaagtttacaagtttaaaattttacaattattacatctgcctgataaattgcatcatttatcatttatatagcaactatttctggtaatgctttctgcctaaaattgattttttcctaatatcaatgaagctatgccaattttccttcaattagtgtttgcttctaatcatttttatatccttttattttcaaactctgtttttattttggggggatgtgtcttgtaaacaacatataactggattttgtttaattatttagtataacacttttctattaattatttggtccatttgtatttatattgattacagttatatttatagatatacctatatatatctagatgatagatacatttctaccatcttatcttgtactttttgtttgtcttttgagacagggtcttgctctgtcacccaggctggagtgcagtggcacgattatagctcagtgtggcatcgatctcctgggctcaagtgatcctccgcctcagcctcctgagtagctgggactacaggtgcatgccaccattcccagttaatttttttaaaaaaattttacagatggtatcttaccatgttgcccaggctggtgtcaaattcctgggctcaactgatcctccaacctcaggttctcagagtgctgggattataggcttgagccatcacacctgctttgtcatgcttttgaaaatatttctcattttttcttttcttactttcttttgcactgaattttttgtcacttcatgtttccttccactgttttgcaagttaaaaactgtatttctactgtttctaatgcaggcattatcaacttggaagctttaaactaaattcttgacctgtttttttggggacagtcaggtagtgtaaattctaaccccaaatgttggctggtttttggtcagaaattctcatcggagactatccgttccttcaccaaaagccaaggcaaaaccagccagttttccttactatctcccttagggaagggagaaagttagcttacttatattggtgtcagcttctctgggtcccttttctatacatgctgtggtctttgctccaaacccccctggcctggaccctgagctttgtctcttgtctgcaagcacagtctgttagaatgaagtgctaggcttccaggaactggcacatgccccgggggagctgccatcttcagcatgtgcttctctctctggctttgggcttcttactacttttgacctctgatgacttctcttattttttgacaactcagcgatgctttcaaaattttttcttaatctttaggaatgttgtttagtgtttattctataaagttttcaaggatatcttatcttgcatattgctagaaaatgaagcttgaaattactttttaaaggtatttggatatgaagaggagagacatggaagaaaagttagaccaggacagagtcaatagagtttaaaacttttttttttaatttgggagaacttaggtttataggctatggggaaggaataaaaagggaggtagaggataaacatgaagaaaaagaggagggttaataaatggaggaaagtttcaagggaaaaaaggaggaggtccaaaggaagacatagattaatgtgttggctttcaatagggtgtgtagtccccaacaatgtccacatcctaatccctggacactgtaagtatgtttctttataaggcaaaggggctttgcagatgtgagtaagactcttcagaagaggagagtgtcctttattacctaggtaggccctaaatgtaaccacaagtgcccttataagagggagatttgactaagaagaggagacagaagcagcgactgaagtgacacactttgccgatgaaggaagagggctacaagccaaggcatgcaggcagactctagaagcaggaaaagccaaggaaacagattccctttcagagctttcagaaggaaacagccctgccgacaccttgactttagtccagtgtctggcttccagaactgtaagagaatacatttgtgctgttttaagtcgctgcacgtgtggcaatttgttacagcagcaatgggaaaagaattatctaggaacttagaaataggcccttctccaatatattcatctgtaaaccaaatttgggtatggttatgcttaaattataactactatcttgtatgtattaaaacattcttatcaatgtaaatgtaatagaaaataccctcctttaactcaaatatgtcaatgaaaaaccataataatgcatataaaatcaagtgatgcatataatctaattacgtttaagcaacagagtagaaaagggtatttaaattggcataatggtgacttgaaggcaagctgcagtaatttcagctgttgcttttactaatattgtaagtgaagttatgaaatatcttgcaccaaaatacagttatatattgcaccagaattacaccagaaatagttatatattgcagttatataaatgcagttacataattacaccagaaatacagttatatattgcagcagagttaagtaacttgctcaatgtcacacagttattaagtggcagaactcttggctccataaatgtttgttgaataaatacatggtgccttcaaggtccacttagcaaaaatttggatagcaatgtgagggggaggcataaggcctcaaacagtccaggacagatctctgataaggtaaaatcatttgggtttgtcgtaaacttctgggtctccttgtctggatccccagtattaagccccctggttgtttttgttttgttttgttttcagaattttcccattccactctgatgcttgatctcattcttacagggcagtgatgtatccaggtacccggctctgcatctgaccctggggtatcaccagctctacttgtttctgtttggctattgacactcctgttaatgttgcctcagggcctgggttggctattcttttttggtggtgctgactccatggttatgggacttgtagtggtttggatctgtgtccctgcccaaatgtaatataatccccaatgttgaggagaagcgtggtgggagatgactggatcatcagggcggtttctcatggtttaaacaccatccaccttggcgacagtgagctctctgctctctggtcatttaaaagcatgtggcacctcccctcgaccttgcttctactctggccatgtgatgtgtgtgctccctctttcctttccaccatgattgtacatttcctgagtcctccccagaagcagaagcctcatgcttcctgtacaacatgcagaaccctgagccaattaaacctctttttttaaataaattacccagtctcaggtatttctttacagcagtgcgagaactaatagaggacccaataatttaacaaaacaacaacaacataaaatcttccagaaaacaaatgtgattgggaaactgaacaagaaacaagtttagagccataaaactattaaagacataaataggtgctacttacgcaggtggactatcaccacaatactttccaattcttctagcatcgttgacttccccgccattaaacacagccacataatcatatcggcagtagttatctcgctccacatcaaacttctcaaactttaattctataagctttagagaaagcacaatagaagtgtcaaatattaatagcattgttgaataacctcaaatggaattcttcctctccccagatttggaggatactacgattttcctttgtaaaaaaagtatgcattaagtgctttttgttgcatatttcttatttagttaaaaaaaaaactgtggtattcttttgcttttaattgtaatctttccaaaagatcatctcaaactcagatcaactctagttaggatattcaacttaagaactctgttcacttacagctacaaaagtatgggaacattatgtaacactagcaacctactttaagactataattggttttggagatctattgtacagcatggtaactatagttaataataacatataataaacttcaaaattgctgagagtaaattttttttttttttgagacagagtttcactcttgttgcccaggctggagtgcagtggtgcaatgtcagctcactgcaacctctgcctcccgggttcaagcaattatcctgcctcagcctcctgagtagctggagtttcaggtgcccgccaccacactcagctaatttttgtatttttagtacagacgggatttcaccatgttggccagtctgctctcaaactcctgacctcaagtaatccacctgccttggcctcccaaagtgctgggattacaggcatgagccaccatgcccagccgagagtaaatcctaaatgttaacaccacattccacacacaaacaaaataataactatgtgaggtggatatgttaattactttgattgtggtaatcatttcacaatgtatacatatatcaaaatataatgttgcacatgataaatatatatgttgcacatataaatataattttcacttgtcaactatacctcaataaagctgcagagaaaaagaaaaagaaagagaaaaacaagattgtaattggataactggatgtgtgttatagtgggaaaaggggctacataccttaatagaagctaatagaaataaaaagtattatctaagatgctccttatactactgtatgtcagggagtagtagtgtgtgtgaatatatgtgtaggagggtgagctgagtggatagagttgttccccttttgagggaaggagactgacatttctatcagatgtaaagaagtcaaattttcaggaccagttattcagggaagtggaattgatggcagtgtcttcttgaagtatgtttgaaatgtgtgataccgtgcacggcctaatcagggtgtggttatttttgaagaggttgcacagaagcactgatctacaaagtcagtgttaggtttttagtatttctcaattttttgcactagtaccaataatagtgtcctaaattattcacgtgaatagaaaattttgattaaataggcaatcaatcattccccatacaagcaaatgtttaaaagaacatttccaacatgtgaatcaaaggaaacctcactggatttattattacctatgacagctggtacccaatcttgccgagcagcaagtgggcaagaaccctccttgctacttcagggaagataaaggacattaattcctattagctagagaagactcaaacacagtaatccaggtgaagatgataatagcaacagcatcacagatggacacaaaggtaattttggctttgaccataatttccacacatctttggactgaactaccttttaaaaagtcagtgccagtgataggtgaataatgcttattcatacttaagatggctttaaattgtattaaaatatttcctctttgggtccagtgacttcttaccacttactaataaaatgctttccaggttattaaaaaaattggcgaactttttctacttagaaattagtcacaaaggctgggcgtggtggctcacgcctgtaatcccagcactttgggaggccgaggcaggcagatcatgaggtcaggagatcgagaccattctggccaacacggtgaaaccccatctccactaaaaatacaaaaaattagccaggcatggtggcgggttcctgtagtcccaactactcaggaggctgaggcaggagaatggaccgaacccgggaggtggaagttgcagtgagccgaaatcgcaccactgcactccagcctaggtgacagagcaagactccgtctcaaaaaaaaaaaaaaaagaaattagtcacaaaaacttttgcagagaagattaaaaaaagtaaagaagaagataaaggaaaagaactgtggtaacaaatgatggtaaggtaattctttaatagaagaaaattccaatgaaattccttcaatacaataattcccttgcatagaaactatttaggacttaattttcccattatatttttctcctttgagaaactgccagtgatttcaaacacagtgattaagaactcaattgacagaagccaaaaatcacattaaaatcaaataaaaatcaaacttaacatttaaatgatcaaagggaagaacaatggaaaagagatgcttaactgtaatctgcaagtataattaagttggaattatttggtcaaatatatttacaaatgtcacagagaaaatgatcaatataatttcaagaattacataatggtttaaatgtttcagaaacacaatttttaaaattactttataaaacattcaacagacttataaaatcttccattattaaataaatggccatatatttcttcttaaaaataaaaccaagttttggaattatgatcactgtttatgtctgtatatatgtgtatatgttcaaatcactaacttgcatggtatattagcttaaataattttctataaaaaaagaaatacatgacaaatggtatctgttcaagctatatgaaaggttaatttagaaaagtttttttaaaaacagtatcataatgtttacctcatagtgtttgggttaaagtctatagtgtttctaatagtaataatttttataaagttatctttaaaggtccacaaagtagatttcatgtgtttctatgctaagttctttcctgcaattaatatgtgaaactggttcccagaaagggtaaaaagttgtatatgtaaccacaaattaataaatactggaaaagtcgaccttctctgttgattatttcagaacaatgaatgaagctttttgtggggaacctgcacatattttattttaaatgacaaccaaaaacaccctaaagcagaccagcttgttctttgaagagataatgtggcttgcttttgttggctttgttgaggcaaagcatccacacttttttatttagtcactagaataactattatcaggacatgatgggtttgtgatgggagcaaatggtaacctgaaatgtccatggacctggggatttttatcctcccacagttagtcgctgctgcttataacatccactgcagggttaaacaatcctatgtgagatctgcttaccatttgtatttttaaaactgttttgaaaattgtcattatatagcaggaaattaaatccatgaatttgcaactcaaaaaaatgcaaaggctaggccgggcacggtggctcacatctgtaatcccagcattttgggaggctaaggcagacggatctcctgaggccgggagtttgagaccagcctgaccaacatggagaaactctgtctctactaaaaaaatacaaaattagccgggcgtggtggcgcgtgcctgtaatctcagctactcgtgaggctgaggcaggagaatcgcttgaacccaggaggtggaggttgcggtgagctgagatcgcaccattgcactccagacagggcgacaagagcgaaactctgtctcaaaaaaaaaaaaaaatatctggggtcttcgcatgaagaaatacctgtgtccaggaaccttcctcttcttgtatcccttagctctcgaatagcccccacaacaggaggctcttgagagttggtgggccccccacactgggcaattcacacatgcatgctttcttcacacttccagggaatctcacctgattctttggggctacaatgtgccacacacaagtgactcctgcagggtaatcccggtctggccagttgggggttttaaaagagccggaaggtctgtcaaggagtcctccacaatactgatccccttcaagtattaaacaaggaaaaaagcccacaagtttatgtaggttacagcaatacaaccatgtggagattaggaatgtgggatctttggtgagagtacagtaaataaaggcaacagcagaagcgcttacattttctcttaaacatatggttacatacataaccccccaacacacacaatgaatgatctttgttacctgacatagcatagcaacacgagagaggggagaagtggactcagggcctcttttctttttttttccttagacaaggaagacaaaacatttgaatatgcactcactcagaaagcttgcaggctcaaaaaatcatagagatgttaaggctcctcaaggcattggtatttagtaaacacccagggacaaaatttgaattagttgatatagacagctctcattactagaaaacttcccatgatatatatataatatgtatataatatatatatgttttaagaataaattttgtttgtaaaaataatatttacaaattttcagcaatacagaaaggcacaaggaaggaagcaaaaatatacccccaaatccccagttttagccaccaaaaactcatcaaaattaataggtgacaaatatcatttcaggcatctgtactcataagttgcatatgtacctgtaggttggcagaaataatgtaagaattattttaatacgaagttctaaatttaattttacttgaatgtaaataacaaataaaaactgaactgaaactaaaataattatacttcaatggaatatttctttgacacagaatatatccaaccattcttaaatcaaacttctaaatttaagataatgtattataaaaatggaggttggaataatttctaaatctccatttaatgaaaaatttcaagtatatacaaagtaagtagaataatataatgacctcctacatatccattacccagttacaataatagtcatcattctattattctatctatattgccacccaatccccacgacctgcttcattgtttttattattattattttacaggttttggggagagaaattcacatactctgaaatgcacaaatcttagctgtacaaatctgaaaaatggatatacctgtgtaaaccacactcctatgatgatatagaatccatttcccactaaatttgtgcatctcttcccatcctgccagttctctacactacttttctgaaaaacttcccattagatgagtttaattttagagctccatataaatttgtttacccattctcctgctgatgggtggtttctagtctggactattgtgaatgaagctgctatgaacagttttgtacacatttgtttgtacatgtatcttcatttctcttatataaatacccaggactgcaactgctgggccaagagtcgatgtaaatatttaacttcataaaaaactactggaacttttctccaagtggttttacacctctctcgagtatgaacacttcggttgctttacatctttgctaccacttggtggtgtcagtttttctagccaacatggtgggtaagtaatggcatctcactgtaattttaatttgcatttccctgatgactaatgagagatactgagtagtttttcatgcacttattggccattcatattttcctctgtgaagtgtccaagtgttttgccaatttttatacttactggaatctttacctttttatcgttgagttgtatgagttctttgtatattctgaatacaagttcttcaccagacatttttgtgaatattttctccccttctgtaggctatttgtatttgtaaccatgtctttttataagtattagttttaattttaatgaagttttgtatttttccttttactttcaaccaacttggtctttgtatttcaagtgctttcttgtagacaacatatagttgggtctggcttttcaatccattctaacaataactgtcttctaatcagagtatttaataatttacatttaatatatttattgatcttcttggatttaatgtgccatttactacttttttctatttgctttacctttcttttattccatctgtttttccttatagccttctttgggttagttggataattttagtattctattttaatcttttggcttttagtgataactcctgcatttttaatgggttctctagggattataatatgcatgtttaagttatcaaaatttacttagagttaatattgtacttcacgtgttgtatatgtatgtgcaacagtgtaattacatttatgtgtccatcctttggttgtcaaacatattacatcatacactatatattccacaacacagtgctaaggtttttttgttttgaacagatacatgtaaagaaattaagagaagaaaagaaaataacatatacccttttatatttactatttccaatgaccttcattccttctgttactttcattttacaaggtcatttacctcaacctgaggaattctcttcaatatttctaccagtgtaagtataaaaatgcctttcagagatttttagtgtttatctgaaaatgtcttcattttacttacattcttgaaggctggctatagaatagaggttgacagttttattccagcgctttaaaaatactgtgacaggccaggggcggtggctcacacctgtaatcctaacactttgggaggccgaggtgggcagatcaacctgaggtcaggagttcgaaaccagcctggccaacatggtgaaacaccgtctctactaaaaatagaaaaattagccaggcatggtggcgcatgcctgtaatcccagctgcttgagaggttgaggcacaaaaatcgcttgaacctgggaggtggaggttgcagtgggccgagatagcaccactgcactccagcctggtcaacaagagtgaaactcagtctcaaaaaaaatactatgacactgccttctggcttccagtgtttctgaggaaatggaagccatcattcttatcactcttcttctgtatggaatttagtttcatctgattgatttcaagattttctctgtctttaaatttctgtaatttaattataatgtgcatgggggtgcttcatttttatttgtcctgtggagtttgttgaccctcttgactctatttttcttattttcattatttattttttagatggaatctcgctctgttgcccaggttggagggcagtggcgcaatctcggctccctgcaacctctgcctgcaggttcaagcgattctcctgcctcggcctcccgagtagctgggattacatgagtgcaccaccatgcctggctaatttttttgtatttttagcagagacggggtgtcaccatgttggccaggctggtcttgaactcctgatctcaggtgatctgcctgccttggcctcccaaagtgctgggattacaggcatgagccactacgctcagcccctcttgactctgtgagttgatatttttcactgtatttgagcagagtcaagtcataatatctttaaatattttttcactttattatcactttctgggacaaaaattacagatgttagaccacttgatattgtctcactggtttctcgagctctttttcttcaatctttttcctcctttttcttcagattgagtaatttctatttaagttcactgactctttttctctgccatctcccatctacctgtgagtacaataggtaaattttaaaatttcagatcctgtttcttttatctctagaattattaatttattttttaatagttcctgtttctcttctgagattctcaatttgtttatttattatgcacatatttccctttataaatcctgaaacaaacatgtaatagcagctttaaagtacttgtttgctaattgcaacatgtgagttaccttgagatcagttcttattgactgcttttgtccttgaatagggacacacttttcctgtttcattacataactacagactggacattatgcatgatacattatactctagattctgttgtgttctgataaaaataattttgttctagcaggcatttaacttggctagactcaaacttaaagtctgtttccctggcagcaggcagcagctgtaatctcttttcagttctttcatttttcagctgatgcttttgtgccaggccaactgggctctcctccacatatgtagagtttagctgtcagacaaagatttcagtagattttatacgaatattttgtgcctcaattctgtaactccctgcctggatttcctccccaacattctggctgctctttcagccccagattctgtcctctgacctttcaagtaaaaatgttgcactacagtccaatccaaaagcagattatggactgctcttgggtaaaaggctgaaaacatacaaatattgcccactgcagtgatctttcaaaagtagagatttctacacttgggagctcactatatctcatatatctgtgtgtgtgtatatatatatttgttgttgtttgagacagggtctcaacaacacccaggctgcagcacagtggcatgatcacggtcactgcagcagtgacctccctgggctcaggtgattctcctacctcagcctcccaagtagctgggacaacaggtgtgtgccaccacacccagataatttttgtattttttgtagagatggggtttcaccattttgcccaggctggtcttgaatttctgagctcaagagatccacctgcccttggtcccccagtgttgggattacaggcatgagccaccatgcctgggctccacttttattttttaaaagctattgtataagtactcaaataaaagcaagcacacatagaaaggtatgggaaccactggccatggctatttctggagaatggactatggagtggtgaaggggtgtgtttgcatatttgcatgtgtgcttatgtatgtaagctccacatttttactctatgaatttctatacttgatttacaagaatgcatgtggacttaaattaaaaggctgattttttgtattggtctcatcatggtttgatggcattcactagctctttgagaaccactcttaagctttaaaggagtaaataaacatcaagtgccaagaacagtgaaccaacattactgttgttattgccattatgtggaaacagtacctctttcgtttggttcagcagcggagaacatggccatgaagccattgccagctgtgttggcatcagaaatcatctgcaccatcatcttgttgccactggacacaagggctccaggccggaaagtgccacagaagcggccaatgcgctggccattggcatggccattgtacacatccacaaagtcatagcggcacaggttgtcactctcgaggtctatgaatcggaaattgagaacgactacttttccttcgggaacctgccaagaaaagcgccaattagaaaactgtcatgaaaacaatatctgaggctttgacatctagtcacttacttaagtgtgtaaagtataatatccaagataatgctttttcctctctcatatctgaactaacccaagggaagttttctagcatattgcattcctaaaaaatttaagtacttattttcttttgacaaattctgcaattctccaggattcacaatcttattccttaagaacttacctcaacaaagctgcaaaatattaggtcagtattattaatagatgagtcattgcttagaatgaataccagtcctgattggaccttagcatatatttgcatattctaatacctagagatattgcttagcaaagaaacatttaaaaatatcatttcttggccaggcacagtggctcacatctgtaatcccagcactttgggaggccgaggtgggcggatcacaaggtcaggagatcgagaccatcctggctaacacagtgaaaccccgtctctactaaaaatacaaaagattagccgggtgtggtggggggcgcctgtagtcccagctactcgggaggctgaggcaggagaatggcgtgaacccgggaggcggagcttgcagtgagccgagatcgcgccactgcactccagcctgggtgacagagcgagactccacctcaaaaaaaaaaaaatcatttcttacaaataatacagtaggacgcattcaatgcctgtgtatagaatgtttctatgaagttcaaaatagaggatttatttggcaattgtgtagttaatttacagataattcattttgggtcctgaaacatccagatgaactaccgatactgactaaatgaactgagtaattgctgaatcatctcttctgaatgtcactaagttttttgctcatttgttttccaggtgaagactttatatgtcaggaagccttgagacacaatgcgctaatgaagaaaaagataagctttcattttatcataatattttattcatcataatttccccataaaattcttaatgatggttccttccttattccctgagtaggtagaaaaaatggctataaaagcatttggtaggattctcaggttaccaaagccccatttctttcccagttcataccaccttttaatttcttcattcaagttgttcagtcataaagtcttgatcataattgttttactcctttaatcagatgaggtctccactgaatagtggagaattccattctgtaaaaacttacatataacaaaactcagtgattaaaaaaatcaaacacacacaatcaaaagtggttggtttatattcatcttaattaactatttcagactcaagggtcaatagatgctttgacattaatacggcttccccatgttggtaagtacagtgccatacgttttattttcctatggtaagatgaagtgttttcagtgctatttgctttttgtgtcaaacacatctacacttcatcgtagaaattataatggcgtagttcccaaaagggacatgtttggatttgccatcgttgcattctaattcctagaagcttgtctcagtggtgtgaatatcagagttccaaagaacttagaacagcttaagaagctaataacagaaagaacaatttaaattttaaacattatcaccaagatgtctgttgtaaaacttcctgtcttttgctttgttttttgttttgcacacaacctctatttgtacaataatcagaaagttatcaaaatatgatgccacatctgtaatcttaaatataagcaggctctctatgaatcaccgaaaaagtcctagccatgaaaagaatctcaaactaatttgtttttttcctgcatgaatagtgactatttgtataaatgtatagagggtaattcaaagctacgaaacttgatgaagtcactcccagagtgaatgtggatagaaaaaggaagaggtctaagtatagaggcctggaacactccaatgtcatcaagtctgtgaagaggtcaaaccacaatagagactgagtcaacaagtaggaggcaaccaaagtgtgtggcgtctggaagccaggcgaagagagtatgtcaaggaggaatgaatgggcaactgagttaagtgctgctgctgagaaagaccagtggatttagcaacacagaagtttagcaaccagaagtcactggtaatgctgacaaagctgttctggtggcaccatggggagaaaactggataaaaggatcatgagaaaatggggtgagaggaaatggtgacaataaatataaacaagcttttcaaggagttttgctgtgaagatgaacagaataatatgggggtaaggaaggggatatggggtctaagcagagtttttgcaatgggtgtttcctaaggcatgtttgcatgctgatgggaaggattctgtagagagggcaaaactgatgaagcaagagagagggaggattgcttaacagatgtccttgagcaggcaaagggggatctgatctacagaaggaacagctggtggagttggccttagtaggagcagggacagttttgcccaatgacagaagggaagacagatgtaggtaggtcagtaaatgaggtggtgaaagcatatatagaattttttttctggattgcttttcttagtaaaatagaaaacaaggtcatcagcagcaaatgtggaagagagaggcactactgggaatctgataacagaagagaaagtgaggaaatggattaatgaaatgcagcaggagtaccaggactgctggggtccacttgaagtaaatgaattaaaattaagacctctctgcatggtggcgatatttgtttttgtttgttcgtggtcttcttccccagccacattcagctccgtgggcaaaggtacagggcaggtggagagttggatataagcagtaggggagagtggtgaggtttgccaagggaggatatggcaggagagaaggacaagagagttgaagacataggcaagggagtgaccatgatgatgtgctgtggaatccaaactgggttaggatggaaatcaggacgctgtggggtgaggacagtaacaaccaagactgtggtggagtaaggacaaaataacagtggaagtgggaggctgaggaactatggaggataagttatttggcggagaagaggttaaagacctgagaagatcacccatatagatattgaaattacagttgattaggacaaggaagagtgttgaagacagtgacagtgaaccaggagttaaaatttgcaagaagcgaggaagactgtccaggaggcttttagattatttcatcaaggagaggaatagggaggtataatcatgtttcattggcaggttcttggttctctgacactacgtagacaattctgttgactctctcctgtagagaggtgttgaaattaactacaggacttggatgctcattcccaataaaataaatcatttgttcccaaaagttttgtacctgttcccatggcaatgaaaatttgagaatgagacacaaatatgatcagcaatagaaactgggttacatcattgcaattttgaacacatgctgacccgaacaaccccgacaaagcttcttttgaaagaaggatgcagaggtgatctgtaccagtgtaagtctcctataaccagagacaaatgtcatcttgcactgaaggccagagagaaattctattgcaaatgagaagcatactgctgtgagccttttcagtatgacacaacatccgttcttcattttttatatgagtgatcaagattgtctgatgccctctgatgcaagctttgataagagctcctgattgtcattataaaggactttagagagcatattctccgaagatggcctttccacttggagaatctagtctgtatccttgaattttctttgttaagaatagaaaaaaaataaaaaaataaaaaatacagaaagatacacagaataatataacacctggataccaaccacgaaattgacttttgttaacattttgttaatagatttttaaagtctcctttaatgaagtaaataaaacatttcagataaaaatgagatttcctttgtcttcatcccaggccccatttcctcctccttcctcagaagcaaccactgttacaaatttagtgggtttccttccatgctgatcaaaatgtgtgtgtgtgtgtgtgtgtgtgtgtatttatatatatttatgtatgtgtgtatatacatatacacacataagtatttatgtatatgtgtatataatatatattttaatatatattatatatatgtaaccatgcaaaatgcacagtgactttttgtgttgttttaaaaattaacaaaaatggtgccaggctcatgcttgtaatcttaatactttgggaggccgaggcaggaggattgcttgagtccaggagttaaagaccagcctgggcaacatagggagatcgtgtctctacaaaaaattttaaaaattagctggatgtggtggtgcatgcctgtagtcccagctacttaggaggctgacgtgtgaggattacttgagcctgggacatcaaagctccaatgagccatgatcacactgtactctagcctggagaatagagagagaccctgtttaaaaaaaaaaaaaaaagggaaaatgggataatgtttacatatcactccacaacctgggcatccttgaattttctggctgaggaagaagagaagaaggaaaaataaaaatacataggaccttcacaagctattccttctacctggaacatgttcccacttctgcccttctctcactcatgcttagggtctcagtttcaaggtcactccctcctggagacatgcctaaacacccccaaacccgaaggtgggctctgtccaattagcagtgctcccctcaggtctgtgagcatgggatggctcagcccactcactgcatgttataaagctcaacctcgagggggcaaggatccttcctgccttgttcactgttgcatccccaggatctggcatggccccaagttaaagcttaacatcaaaaatatttgttaaatgaataatccattaggtactcaatgaatcaccggcctccttgcacaaatcacagacaatatacctactgctggctccacctttttcattctaatatttcctaccttgcctggcagcagagctccaaaaggccactctcttttctaagccattctttgcaaaaagcagatgcatatctttttggaaactttatatttcaaatctcctgtaaatgctaacacttaatgcagaaactcaaggtgcttttttggtggcaaatagatgaagctactgttttgtgagattatattgatttggggattcattatctgcctgcagaaaaacaattcgacgtttgtgttttttcctatcaacagcaaagtcccgtgtgggccaaagcgtagagcttccacagtgacctcaactcaccccacagctcctgggatgtcctcactgtcacaagcaaacgtgccaaagctctcgatgccggggctcctgccagaggacagaggaactgcattttaagctgatggtttgcatttttaggatactatgagcaaaatgcaaataggaggccagcttcttctgtgtggaggagtgcatttctgcagaaatgggaatgctcctttgtgtctgcagcttttcctccctaaacacatcatttactactttgatcaaaaagaactgtttttgcagcacatgtgatttttttttaagccatcattctaatcttctacgatttccctcttccacaaacaaacctttgggaacgtgcattctaaaatgcagaccacagttgatctacgtaaagcttgaggcacaaccactcagtgtcacctctcccatggacctccaaaggtagtccagaaagatctatagacaaattatgtaaaaatatttggcagtctttctagagggggataaatcagaagcttacaagatcttattcatctatattctgggtatatttcaatactactcttgtaaaggtaaatcttatacatgtttaaaaaataaaacatattttgattgtagaaataacgagatgttttgaacattttcttttgtttttggggatttcactaaaaaaactttacccctggatgtctagaaggggcgtggaaactcccatccaccttgggcccagcctgaagacaccagtggagataacccccgaaaaccacccaaaactttcccactgcacttagaataaaatcttcaccttaattatagttcacacacttagtgaacatcaggtgccaggtatttttctatgcactatatacgtatcatttcatttaatcccttacagcaaccctatgaagttgatattattattggcccaactttatagtttacagatgaagaaactgaggcacagagaggttaagacactgcatgatatatccccttacctctcatctttctccttcaagcaacaacttggctgtcatgccacttttctgttcaaggagccctccgagctggttcccacctaagggcctttgcacagcctggtcctctgcctggcacagccttctccctgatatacacgggtctcactccacctcatcatctaggtcagctcaagagtcactgtttcagagaagcctatcctgagcacccctggtcacttagatcacacagccctcttatttcttcacagattatttatcatctgtctcactatcagaatgtaagctacagagaacagttggtctgtgggtctacagtttgtccaatgctttggctactatgagtactcagaaaatattcattgaataaatgactgcgatccttataatcttaaaataatagtgcaggccatgactcctattactagcacatacttttatataaaaatgtaaactcacaagtacagggcaagtattattaagatccttacggggaggaagaaatggctgacagcggttatgatgacttgcctaaggccacccagaaagacaatggcagaactcaggtcaccagacttccaccttgctgtgtttttccatgacctgactgtggcagaggctgaggagatgctcccaaaccttgtttcttctcaggtcacacatggagtcgacatttcccagcctctcttgcagttaagttggggccatgagtctgggtcctggtcaatggaatgtagatgaaagtgatgcacccattacctccaggcctagccataagacacccagtgcaatccttttggagttctctttttgctctaaggaggggattcagtagaagaaaagtggaggtgttggaagacagcagagccacacaggagaagagagagctgcccagaacagccctcccactgcactggacggtgaagggaacaagaaacagccatttattgggttaggccactgagactggggaagttgtttgttagagcagttttgcactttgtgttaattaccctgattaacaaatggatagtgacattcaccaggtgtccttacccagcacctctgtggcaggtaactgtatagacacctttgttgtttggggttcctacaggctctctaggaatcaacagtgtgacgtggccaccaagcaagccaacacaggctgtgtgaatagtaagggagacatcagctttgcctaactgtatactgcttggagtaccatgggctgaattcaggtcaaagcacctcactttcgagtagacgtagatgatttggagcaaccacaaaggggagaaaattcagaatcatcgaggcacatactgtaatttccatggcctctgcaaaagtgtaactaggccctcgagcccctgttatcacctctgagttatcaccgctgagtcctttacctgtggctggtcagttggggtgagaggcaaccagcagccactagtacttcttaagctgaatgaagacttggctacaaaacgaacaagacaggacttcaggttatgcctcttgtgcaaatgctgcctaagcatgaagatgttcgaaagatcccagctgcgaacaggcccttcggcattgggagggtgttcagactgaagtctgccaagtggaaaggcaaatgggaaaaacgtgaagggacaacaaagccgaacccacagaagcaggaaggctaaggtagatgcagcaggatgaggagacaggcaatcgtgccaagagctgtcgcattaggttttggctggggaaagagataacgttgaaaacgaagagtattccttttcacagacatttgtcttgcagttttcctttggccagtgataccctgagatcctactgtggacataagtggtggcaaatcttctgagcaagttatacattcctcatccatgttcttgagaaaactggaaattcactactcagtttttctctaaacaggagcttttttttttttttttagccatttgctcctgaaagggtttacagcaaaaatttttaaaaagcattaccaaataataagataaagagctgtggatacacacggagcaataaatttcagaaacactctaggcaagagcatccaggatattctatatactctatagtaagtaagagtctccatttcccaatctatcgtatgtgtgcaatgaacctgtactttcccatgcttcctactgaaccagctggtgcgagcctggtgcttcgggtgccttaccaggtctggcatcaaccacagcactggcacctcctgtggctgcgaggagcagcagcagcaaatgcttggagactggaaggagtaaatagcacctagtggctgaagcccaagctgtttcatgtgatcagtgtgtgtcctgcctgctgtccttgaaagctgttagttgtgtcaggaaagggtttggaaaggagagacaggttatcactggttgtctttcacatttagccatgtgttcaaggagaactccgggcactgcatacatgcatgatacacttctagacaagaccacggcaaaagatggaagtactaagtgaagctctaccaagcccatcctagattattttaaagcaactattaagagtaatatttctaaagtccttaaaatgactataaaaaagggaaaaaaggtaatatttcttttaaaacaatgaaaaaatccatgacaaattgtaaatcatatgtgatgccctggatgacaggtacacatcagaactgtccaggacaaatgtggacacagggccaccctggccttagaacatctaggcctctcctctaatgtttgaagctgccttgctgaatcccaacaaccacaggttgaatgaatgaacagctgttgaaggaataaaagaatgaaagaataacagaggagcttcctattacctgcagaatgaagtccaaactcctcagaatcatagggtactgggcccaccccaggctaacattctggcctcatctaccccccagc

SEQ ID NO: 12212 - DNA, 97195 bp, Human
  misc_feature (1)...(97195): n = A,T,C or G
tggtcttcccgctgccacccctgccatgcgggacccccggggctgagggaggggctgctcagtggctaaccctgaagggtagggaatgctgccccaacccacactccctggggctccactgccccctttctccgggaatagctctgtgcagggcttgggtttggaaatccacccacatggggccttgccttgctcaggcctgcttcatgcatctgtcttctggaagctcatttcctgagtgctctcaacactcacacctgtgccagttgcttgtggagaattttagctgtgaaccagggtggcccaagctgttctcaggtgacttgtgagaaagggattgagcctgtaattttgggtagaagaaccccagaaagggctggatgggcccttggaaggtcgttgccaggcctgggttttcagggttctgcacccctgggctgaggctgaggcacccgtcctgttgggcactgggtcgagccattggcccccccacagcgggcatcagatgctcacaggggctcctggctgcctcctgcaaagtcgggtggtgctggagcaggtctgacctgcttcccagggcctgcttgcctctgggattagaggaacctgcacaagaccccaggggctgtgctgaggtggacagctgcctgaaagatgagcgtgtgaacagaacatgctggtcttaaggcagagagtcccacaccgtggaccctcccgtctgatgctggggtcttcgtttccagcgtggagccatcctcatcccgtgcagggtggaccgcctgcctggggagccacctgcagtctgggtccccttgcggtgccactgcgatctctctagagcctcctcttcctcctgccactggggacatctctgcccctctgcttccctcggaagctggttgtgaagccgggccagtggctgcggggacagctcatggccctggaaagaccccactggcatgcggcacaacatctgctctgagaactgcaggaaaaggccgggcagggcacccctgccatcctgccagtgaagtttacgggtctcggaatgagtgtggccaaggggcaaaggggaggagggagagggggaggtggggttgcctgagagtgcccgccccaggacagcagcccgtagctcagccccaagagcccggcaccgagcttcgagctgcgtggccccgaagaggggctcagtcacctaatgtgatgaggggacggcagagcaaaggcttgtctgacagtgaccgtcgtgtgtagtggagaggacgtggccagagatctggtttcagggcagggatgaggggggattccagtcagatcttttgcatcccagcaaccctccccttgacacctttggggcagtggcaggggatgaccatggatgacctcatgagaacactgtgggtgtcagggactcagggaggccccgcagggcttgaacatgcttatgtttctcatttgtaaagggagggcagtcatccggtggcttcttgtggcctcggtgatgaaggccacatcagagccagggggaaaggatatgagagaaaaagattcatttgaattattgtctttttcctggagtggagagatgtggtactccccaaaacttcctttctaggctgggcacagtggctcacgcctgtaaaaccagcactttgggaagcggaggctggtggatcgcctgaggtcaggagtttgagaccaacctgaccaacatggtgaaaccctgttgctactacatacaaaaaaaattagcagggtgtggtgattggcgcccataatcccagctactggggaggctaaggcaggagaatcacttgaaccagggagaccgaggttgcagtgagccgagactgcgtcactgaactccagcctgagcgacaaagtgggactccgtctcaaaaaacaagaagaaaaagaaacttcctttgtggacagtgagggctatttaaaaaaattttggaatatgaaagtagtcactggtgtctggaagcaggagctgtgcagaattgtacagttgcgaaaccatgtcgctggcagctggtgctggcggtggagacttccctgtgcggtgctcagtgcagctgcacccgtgggggagggagctctttctctggccctgcagtcacctgaggttgttaccattatgaacggccgctgggacccccgcatgtgcatgtactcccccagagtgtccgggggccccagccaagggacacagctcaggcagctgggaacatgtgcaggctgatgaagagaaccggatgagggcttcacatgaggaagcatgtggccaggtcctctcagaacatcagcctcatcttcctgtctctgatctatttcagcaaccaccccatgtgtctctagaaccccagtgtagcgagctggagagaggactgtcctgagggcagcaggcctggttgcagctggcgtgggggtctcagaatggagccctcagccctgaggaaagctggctcggagcaggaggagggctttgaggggctgcccagaagggtcactgacctggggatggtctccaatctccggcgcagcaacagcagcctcttcaagagctggaggctacagtgccccttcggcaacaatgacaaggtaggctttctgctggtcagcctgcagttggcacgtggccacggaggtcaccgttgggcaggtcatagcttgaggctgtgacgacgggggtgggaaagggtctgctgaccttgggggctcctgcccaaccatacctttgggagaacagaactggggagggtgatgcgtgtctcgtcttctgtgggttgcatgaccatttcccatggttggtctgattgggaaatcaccgggttaactcaaaaatgttgcgctagagtcctggaaatctgttacccgtgcttaccttgttgcataatgatttcacatcctttatccgattgggagggcctgggcctgggctagctttccccaaagccctggatacaaagacacaagtatgttgaaagcacatggcatcttgcagtccccttgccaggcaggcaggagggtggctgccctttttccgatggtgcaagatccaggtccccagatccccagcctccacgttttccaccacaccatgttgttcccaaggaaggtggtggtgctgtagaaactgtaaagtgcgcgcacattcaaaatggtcccaagaggaaatgatttcttagattcattcctccctcctgaatccccaccggagagtcttggcaaggtgcttctaatctttggctcagggtcgcgcaggcttccttccttcaagcaaatagtgtgaaagctcctcaaggagctcagatgtgtctccagggggctgggtgtgctctttcgaatgttggaagatctcagtgtgctgtctttaccttcagcaagaaagcctcagttcgtggattcctgaaaacatcaagaagaaagaatgcgtgtattttgtggaaagttccaaactgtctgatgctgggtaagtgacgtgatttgtgtgtaagacctctgacttcttccttccgatcccacatggagtagctgatcaggccaagacccctcagggcctcagtgaagggtcactggagatacctctgtctccatacgaggcttagagtccacagagcatttccacctaacccttgcaagcctcctgtcggggacagttgaccctcatcctgcctcgcaggtgcagggaccaaagtgcagagtttaggtgacttgttcagggtcataagggcactgtcgcgcggcgaggcccagtggtgtgaacacagatgcatcctctaatcctctcatttccacacctgcccccaccccaagagagagagtcccagggtccaggaactggaagggccttagggagagtccatggccagaagactgcccccctgcacagcttgccaaagccagaggcccgacttgcccccaggccccacagagccccctttgcccctcctccccacagagcccacgactcaggtgtggccaagacccccgcccaggcaacatggccactgtctctgagtggctggatatggccctccggagccgatggtgctccccgcagttggcgcccctttaggcacggacagagtgttgattcatgtttgtgtgccctccccgagcaacacccatttcatgctcttccacaaatgggccacacgcttcctccttttactccattgcctggtgagctcctacttatccctcaaggcctattgcagatgctgcctctgccgtgcagccttccgtgactatacaacctctaccaggaagtgagcttccctcctaccgcaccgtgtgtttctctttgatcccagctgtcgtgctgtaactgtgtggctttgtgttcatctttcttgctagctgctgagcttctggggggctgggacgaaagcagagtgttgtgttaattcccagagagtggccttcagctcatatttactgaatatggggagggagaagcatcctgtgcttgggaaatagaagaagactgtgttgccccagggtacctctagtgtactcggtacatcatcagagtttcacggtcaccaatacaacagctgtccctccgcatccctggggaattgttcccggacacccacggacaccaaaatcccatatctcgtatcagtcccaaaatctcatatcaagtcactgatatgagatggtgtggtatttgcatataaactatgtacatccttcagcatactttaaatcatctctagattacttataatacctgatacaatgtagatgttataaaaatagttatactgcatttaaaaaatttgtatttttgggccgggcgcggtggctcacgcctgtaatcccagcactttgggaggccgaggcaggtgatccacccgcctcggcctcccaaagtgctgggattacaggcgtgagccactgcatctggctatgttatttttaattgttttttttttcctgaatatttttagtctgcgtttggctgaatctgcagatgcaaaactcgcggccatggagggctggatgtagagacagtgatgaagagccccatgtggaaggagcggggtctgtagagcagtggtactccagcctcggagctcacccttgttactggaaaggggtcccgatccagaccccaagggcgggttcttggatctcacacgagaaagtatttggagcgagtccacagagtaaagtgaaagcaagttattaacaatgtaaaggaataaaagaatggcttctccataggcagagcagccctgagggctgctgcttggctattttttttttttttttttgagacggggtctcgctctgtcgcccaggctggagtgcaatggcatgatcttggctcgctgcaaccttcgtctcccaggttcatgcgattcaccatgttggccaggctggtctggaactcctgacctcaggtgatccaccagccttggcctcccaaagtgctgggatttcaggcataagccaccgtgcttggctggttggctatttttatggtagttttggatcatgtgcttaacaagggtggattattcatgagttttatgggaaaggagcggggatttcccagaactgatttcctctttctttcagaccatacagggtatttctgatgttgccatggcatctgccaactgtcatggtgctggtgggagtgtctcttacatgttaatatgttataattagcgtgtaatgggcagcgaggataaccagagcccactttcgtcgccatcttggttttggtgggttttacccagtgtcttgcaccctgttttatcagcagggtctttgtgacctgtgtcttctgctgacctcttgtctcatcctgtgacttagaatgccttaaccgtctgggaaggcagcccagcaggtttcagcctcatttcacccagcgcctattcaagatgggactcactctggtttgaacgccgctgacaccctgacctgctgtgtcctgagaagcctaggtgaggccccgtgggtctggggcctctgccagtcggctctgcgtgcttctcacatggaagtggaaacccttggggcagcagggcccagagaggaaggggtgctgacctggatcagatgtaagcaggacagacttgcttctggaggtccccaaagccatcccccatgctcaggggtttgctaggactcacagctgtgcacacagctaaggtttatcatggtgaaggcctacgtgatgggcttggcaagggagaaagacacaggccgagtctggagaatctgagggcaggctgctgcggctctcctgtgcaggcgccatgcatgctccttcctctagccgagaagcacgtggccacctgcaaagcccattcgaggctcagagcccagggcgtgcatcctgcgctggccacgtgggcccctctgcatggcaaccacccaaatcccagactcccagcaggaaagcagctgttcagcacaaacccattgcaggaacagtccaggcccggcaaagcactcctagcagtcaggggacggagagacgctccaaaagccccgttcccagacaccaccttgaaagcaggcccctctgagaaggcaacctgagatctgctgcaccgagtctgtcccgcacagaagccgctctcatctcaccaaccacggtggtcactgcagcaggatgggaagagggaccaggtgtgttcctggctgttccttcctgaggagtggatggaatgtccctccttcttgtggaaagaccagggcggaacgagtggtgagcatcgtctgccacaaacacagcttttcaagcagatttatttataccacttacatgtttccattaagcatggtagggtcttcctaccccactcgtccagacctggagcccctcgacacccgcccgggtaatcccactgcttagccccacgtcctggtaaccctcctcagctctgcacagactcgtctcatttccgtgtctgctgtggccaccctggtccagacctttgtgctcacattttgccaccatggatctcatgaccttgggcagatgacttctcttccctgggccaccaatcctcatctgtgagcgcagagactggaggggatgcctcagaattcacgcgcacatgcggtgggggtggggaggcagggagccccccttgggtggcaggaaggagcccaggttggagagaatacacctccaagagctctcatttcccgtggggtgccgggggtggtgtcccgtttacgcctatctgggccgagttccgagcgagctctccggcgatgtaatttctggatcagtgtccgcaatgcagtttccagcatcacatcaggcttgcaaacgccatgcaggttcaagttccaatctcatcagaggtgatcgttcaaggacaagagggacaggaggtagcttgtgataggctgttaggaacatacaaggacatttggggcagcattggagcaagacgggagagctcaggtccttgtctagggaactcctttccccacctccgacccaggtctctcatccataaacagtggaggtcacattgtgtccggagttggttccttcccgggggtcttggtctcgctgacttcaagagtgaagccggggaccttcgcggtgagtgtcacagctcttgaagatggcagggacccaaagagtgagcagcagcaagatatattgtgaagagcgaaagaacaaagactcctcagcgtgaaaggggacccgagcagtttgccgctgctggctggaggggtggccagcttttattcccttatttgtccccgcccgtgtcctgctgattggtccattttacagagcgctgattggtccattttacagagcactgcttggtccattttacagtgtgctgattggtccattttacagagcactgcttggtccattttacagtgtgctgattggtccattttacagagcatggcttggtccattttacagtgtgcggattggtccattttacagagcaccaattggtccattttatggtgtgctgattggcgcattttacaatcctcttgtaagacagaaaagttctccaagtccgcacccaacccagaagtctagctggcttcacctctcaacatcaggtgctcgcaagatccctgcaagtctgaagtgccttgagcgtgaccttaggggtttgtacggatttggatttgtagggtgcacatccgggaggaattattttttccattttaatgattgagaaactgagtgtagaaacatccgagatcacacagtcaatacgtggcggggaaacctgtttcctttctcactgctcagtggtctttcccctgtgccatctggttcaggtttcatctggttttagagtttttttgtttgtttttttttaattcccttatttgtccccgcccatgtcctgctgattggtccattttacagagcgctgattggtccattttacagagcactgattggtccatttttttcctgtctcatctgtgtatatatatacacatatatatgtatatatatatatattttttttgagacggagtcttgctctgtcacccaggctggagtgcaatggcctgatcttggctcactgcaacctccacctcccgggctcaagcgattctcctgcctcagcctcctgagtagcggggactacagctgtgcaccatcacacctggctaatttttgtatttttagtagagacagggtttcaccatattagccaggctggtctcgaactcttgatgttgtgacccgcccacctcagcctcccaaagtgctgggattacaggcatgaggcaccatgcccagcctcatctgaacttttctaggttatttgttaccagcaaaaaattggaatctaaaaatatggtggatttccaattaaacaagttacaaagaacacataaatttatctcttcttgccctgaaacaccaatgaattgcagtaaagcaaaaaaagacttcaacccacaaagaaaaaagagggaagttagcagttgaagaaagagattgccgcattcttgccagaggaaggggaggaggcagagtagcaggtcctgaaggctggcgactcgggcagctcctgccgtccccaggcgaggggaggaggtgggagaccttgggcgaggtgctagccccatgtcgtctgcttggagcctccatttgtgtgtgcttttaactttttattttgaaataattacagatgtacagaagttccaaagatactgcagaagggccccacggttccccctgtggctacattctgcataactgtagtacagtacccaagccaggaattaaagctggtagaatgcatgtgtttagttttatgtctttttttttttttttgagatggagttttgctctgctgcccaggctggagtgcagtggcaccacaccagctcactgcaatctccgcctcctgggttcaagcaattctcctgcctcagcctcctgagtagctgggactacaggtgagcactaccacgcccagctaatgtttatatttttagtagagatggggtttcaccatgttggtcaggctggtctcggactcgggacctcaactgatctgcctgcctcggcctcccaaagtgctgggattacaggtgtgagccaccgctcttggccttatgtcatttttcacatgtgtatttgtgtaactaccaccgtggtcaagatacagcactgtccatctccaccgagctcttcctgtacttcctccgtatggtcagctcaccttctcccccatcatccctgatccctgcaaccaccagtctttcttcatgcctatcattgtgtcatttcaaggatgttacgtcaatggaatcatacgctacatgacccgtgtctttttccctcagcacagcgcacttgatatccatccaagttgctgcttgtgtcaatattattattattattatttttgatatggagtctcattctctggagtgcaatggcacgatctcagcttactgcaacctccgcctcccggcaactgggagtagctgggactacaggcatgcgccaccacgcctggctaatttttgtattttcagtagagacagggcttcaccatgttgtccaggatggctttgaactcctgacctcaaatgatccactcgccttggcctcccacagtgctgggattacaggtgtgagctaccacactcggcgttgtgtcaacattatttaactgctgaatattcctttccctttcgccttgcctgtgtcattacacttcaagtgagattttggtagacgtcaaataattgggtcctatttttttaaatacattctgtcaatctgttttttaattgtcatatttagaaaatttatatttagtgtaattattggtatgttagggcttatgtctgccattttattttttgttttctgtttgttctgtgttttttttttgccttcttgtgggttacttgaacattttttagaattctattttgattattcatactatttttgttttttggagacagagtctcactctgttgcccaggctggagtacagtggcacgatctcggctcattacaccctccacctcgctgggctcaggtgatcctcccacctcagtctcctgaatagctgggactacagacatgcaccaccatgcccggttaatttttgtatttttggtagagacaaggtttggccatgttggccaggctggtctcaagctcctgagctcaagcaatctgcccaccttggcctcccaaagtgttcggattacaggcgtgagccactgcttacaccatactatttttgagtgtatcttcttgtatcactttttcttaaaggggttgctctagatagtatattatataatacagcttatcacaatctgctgatgttgacattttaccagtttgagtgaaatatagaaacattatctccttttacatctctgtccccttcttaatctataatataattgcttgaaatatttcttctacatatattgaaatgagggccgggcatggtggcttaagcctgtaatcccagcactttgggaagctgaggtgggcggatcacgaggtcaggagatggagaccatcctggctaacacggtgaaaccccgtctctactaaaaatacaaaaaaaaaaaaaaaaagccagatgtggtgatggccgcctgtggtcgcagctacttgggaggttgaggtgggagagtggcgtgaacctgggaggcggagcttgcagtgagcagagatcggcgccactgcactctagcctgggtgacagagcgagattccatttcaagaaaaaaaaaaaagaaagaaagaaaaccatgtcagatagtgttataatttttgcttcagccatcaaacatcagttatgaaattcaaggggttactctttttgttattctttcttcctttcagatatttcaaaattccttttcttgtttcctttctgtttagagaatgtcctttagccattcttttagggtgtgtctgctcgtgacaaattccctagccttccttcaattaagaaggtccaaacttcctgtcttttctgaggtgttttttttgttttttttgaggagtctcccactgtctcccaggctggagtgcagtggcaccatctgggctcactgcaacttccatctcctgggttcaagcgagtctcctgcctcagcgtcccgagtggctggggttacaggctgctgccaccatgcccagctgattttttagattttagtagagacagggtttcaccatgttggccatgttggtctcgaactcctgaccttgtgatccacctgcctcagcttcccaaagggctgggattataggcgtgagccactgcgcctcgccgcttttaaaagtttttatttgtttttagtttttggaagtttaactgttgtgtgtcttggcatgtatctctttggatttatcctgtctggtgttcactcagattgtagcgtgtgtaggtttatgtcttttttgtcaaatatgggaaattttggccatgacttctttacatacattttcaggatcactgtctttttcttttccttctggaactctgagcatgaatgtatgatcttttgttatagtgctgcaggtcccagaggttttgtttacttgtgtattttttctttgttgttgtttgtttgttttctctctgttgttcttattgggcaatttctactgttatatcttcctgctcctgggttctttcctctgtctcctccatcctgctgttaggtccatcctttgagttttttatttcggttactgcatttttcagctctaaagtttgcatttggtatatcttctctttttttactggaaatttatattttttcatttgttttgagcatgttcatgattgcttgttgaagcatttctaatgtggctgctttaaaatcattttcagataattctaacatctgtgtcatcttggcgttggtggctgttagctgtcttttttcatcctggttgagattttcctgtctcttgttaaaactagtgatgtttgattgaaaccttgatagtttagattttatgttaagagactcaagatcttgagttttagctggtcctcttgacatgtctatggtgaaggaaggaggtccccccatcactgccccacaaagggtgaagtctaagcccccctgtagcctccactgatccactgacacttcctggggaggcttcttgttactgctgagggtgagaagagctccagcccaccattaggcctttgctgcctcccccatggctggaagggcaggtgctttgtttttgctgggtgggggaaggttgcggctttccactgggcctcctctgatgccttcacagggagcaggaagggcaccacactccctgggtgactggtgctgtgtctttgcaggaaggtggtgtgtcagtgtggctacacgcatgagcagcacttggaggaggctaccaagccccacaccttccagggcacacagtgggacccaaagaaacatgtccaggagatgccaaccgatgcctttggcgacatcgtcttcacgggcctgagccagaaggtgaaaaaggttggtttccatcactctcgctctgaactgtaggtggagctgcatggccccacagtgacacgcggtggtcggcatttcctggggcaagagcaggaggctggcaaagctccagggtgcatagagcccactgcacagcaagggaagcggcggggaggggctctgcaaggcaagcaagacatgcaccccactctcagagtgcttggccatctgcaaagcagggtggggcacagtgagctttctaggaaggtgcaagctgggagtggtgagtgaattctggctgggtgtccttgggcggcatttgtcagggcctgggagggagtagggaggaaggagagggatgcaggacacagatgcgctcagggtgtgctgggagaatggtaggaagggtgtggggagggagggaaaagctgggggaaggggcccaggatagcagggaggcccatgtggcaagtctggaagcaaacgcgagagtccttgcgaggagtctgggccaggcatggcgggatccaggctgagcctggcctgcaggagagcgctgtgagggtgcagactgctggagggaggcccaggtgcagggttaggttctctcgtgcacaacctcactgaggtccctggaccagccatctctgaccaattctcaggccccatcccaggcctgtggagtcagaggctcagccccttgcatgttgaccagccttctggagggttctgagactcgcgtgttgaccagccttttggagggttctgagactcgcgtgttgaccagccttctggagggttctgagactcgcgtgttgaccagccttctggagggttctgagacttgtgtgttgaccagccttctggaggttctgagacttgcgtgttgaccagccttctggagggttctgagacttgcatgttgaccagccttctggagggttctgagacttgagtgttgaccagccttctggagggttctgagacagtgattgggtgccactgtcctggaggtggggagggtggcactgatctctgtgctggcgtctggagccctgaacttggtacctgtcgagtgtgacctgtccactcaatgcatggtgttgccatgaggtggccaaagaggttgagtggggcaggtcccggagacggggtcatgtggccccaggcttcctggctggcacagcccctgagccaccctgtgtcaccatgacacgtgggtgttctccaggcccctggacccctctgtcgctgtggtcacggggacagtcctgttgttgggtttcagatgagggattgaggtatggggaggccctacctaccctttgtctgatgccaccgtggccgtggcagtggtgggtttgaatccagctgtgtctgagcctggggtctggctgcatccctcccccaaccccccggcttctcccagccccctccctgcagctgccgacaggggccggtggtgtgagggagaaatgcctgtggcctgacagtgagggacgccagggacacagaccctgtactgcagcaggtctgcctcgaagcccgggagcgtccaccatgcaggccacagccctgctcctcccagggagaccagcacctccagatgcctggtggacccggtgggacccacgttctgatggtgacaggcactgtgcttgtgggttaactggaccttctttagtgacaatgccaccacatggttgttttgagggcacctaatggcatttctggatttcacccatcacctttgtgtctctgctaggccaatcccggcggagattgcagaccccgctgggtctcttcagacacagcccgcctagcggaacagggaaagtccgctgtgtacttgggagggtctcctggaggacggggggccagagtgacgacagaacctgggagagccgtgttcagacgggaggcagaggaagctgggcccactgagtccccaggacgggccagggcacaggggccacagagcagaggggatagggcagaggggacaggagaggggacaggagaggggacaggagaggggacaggagaggggacaggagagggggcagtgctgggtgcacaaggacagaagggcagagaccccggtgcaggagctgattagacccgggggaggcagggcccaggcgctacggcgggaattggagtctgtgctggcgcatgtttgggaggcgctcccaaaatcgagaggaagaggaaaaagtgggtgccgtgggggcacgagggctgggggaggtttgctgagggcgatcctggtccccaaaggatggcctgatgctcctggcttgggcctctctgcctccctcttctctcgtgatctgtgccctgcccacatggggaccccttttctgggtctgagccggaaaggtgtgcggtgtctgccgcccgctggggcctctctgcatggcctgtgtgggtcggtgctgtccctgaccactgacacacaggttccctccgccgttttccctttcccgcagtacgtccgagtctcccaggacacgccctccagcgtgatctaccacctcatgacccagcactgggggctggacgtccccaatctcttgatctcggtgaccgggggggccaagaacttcaacatgaagccgcggctgaagagcattttccgcagaggcctggtcaaggtggctcagaccacaggtaactcggaggctggagggacacgaggccccggcgggtggggtgggctgtggaggcagtgctggggcaatcagggccatcaggacccaaaaagtccctgggagccgccgaggctgtgccccagcctgagtcggacccatgcacctctcacctgggcacagctgctccctgacgcccgatgctcccactggcttgcctgtgggctggagatggctcagtgcatggccctgctggtgcccagggccaagcagagatgagaaccttggtggcctgggaaccttggtggcctgagaaccttggtggcctgggaacctcggtggcctgagaaccttggtggcctgggaatcttggtggcctgagaacctcggtggcctgggtgcacggctggggccagcactgcaggccatttgtagggggtcagcgagagttcccagtcatcaagctttccattatcgtgtttttccatcaaaatcagggaaggagcattattatttccatctcttcacttaaggcaactgcctggttggagtcaaatcacctcccaaggttgcaccactggtgagagccaggcagggacccagtcctggtggatggtgtgagatcccaggtgccgtgacctggtgccccgccccaccctaattccatggggagggggccccaagtcctcaaggctccctgggcctccctggaggggactgtggatgaatagtgaggccctgaggtgactacttggcaatgttgcgtccggatgggcctagagtcaccctgctcttcctggggtctggggtctggtctttgcctcgcagtggagtcgtaactgagcctgacttggcctgcatggctcacagagtcctcagtttcattgtctgcctggtgagcgtgaggcacggctgcatcttttgacctgtgagtcccacagccctgcttgtaaaatgaccagaccttttctcagcctggtcacatgggactgggtttaacgcaggtcaccatcccacaggctctttctgaagctttgctgcctcaaataatgccatggatttgttcaggtctcacctgctccaggtcttgatgttgcatttttttagctttcaatatccgtgtccttgttgtccgcttcctggcccaaagccagtaccaccttttcaattgttatctttctatctatctatctccatccttccatccatccatctatttatttttgagacagggtctcagtctgttccccaggctggagtgcagtagcacgatctcagctcattgcagcctcgacctcttgggctcaggtgatactcctgcctccgcctcctgagttgctgggactagaggcgtatgccaccatgccaggctaatttttgtagagacaaggtctatgttgtccaggctggtcttgaactcctgggctcaagtaatcttcctgccttggcctcccaaagtgctgggataacaggcgtgagccaccatgcctggctgattggctgttttttttatttttttgttttttttttggagttggagtcttgctctgtcacccaggctggagtgcagtggtggtggcgctatctcagctcactgcaacctctgcctcctgagttcaagcaattctcctgcctcagcctcctgagtagctgggactgcaggcgtgtgctaccatgcctggctaatttttgtatttttagtagagacggggtttcaccatgttggccaggctggtctcgaactcctgacctcaggtgatctgcccgcctcggcctcccaaagtgctgggattacaggcgtgagccaccgtgcccggccggaggtgtgtttcttacaggggtggctgcaaaccaccagcagcagatggcaggtgggaggtgaggggcatccttcctagggaccaggctgagtgttgggagcgaggaagcactctgccgcacctgggtcctgaaagctgggaggaagagggaaagcaaaatacaagaatgcagagaggtgctgagaaccgcgatcctgagactggggcctgaggaggcggcagggaccgggagaggggcggggcctgctcctgttcccaccccacctgagcgcgtgggaacctcggttccttacacctgatgctggtttgaaagcccctgagtgaggagctctgcgttgttgggggcggggcatcgctgagcctagaagggctcaggcgtcaggctcctgggtgtcagggtgcccctcagtgctgtggggcctgcccacccgtgctccttccccaggggcctggatcatcacaggggggtcccacaccggcgtcatgaagcaggtaggcgaggcggtgcgggacttcagcctgagcagcagctacaaggaaggcgagctcatcaccatcggagtcgccacctggggcactgtccaccgccgcgagggcctgatccatcccacggtgagtgcggccccctagggaggggagcctaagaccaggggtgtgggtgaggtctgactgggcgctgtggggagcaggtggagtgtacgggggccggggtgtgggtgacgtctgaccgggcgctgtggggagcaggcggagtgtgcgggggccggggtgtgggtgacgtctgaccgggtgctgcggggagcaggtggagtgtgcgggggccggggtgtgggtgagttctgaccgggtgctgcggggagcaggtggagtgtgcgggggaggcggggtgtgggtgacgtctgaccgggtgctgcggggagcaggtggagtgtgcgggggaggcggggtgtgggtgacgtctgaccgggtgctgcggcgagcaggtggagtgtgcgggggccggggtgtgggtgagttctgaccgggtgctgcggggagcaggtggagtgtgcgggggaggcggggtgtgggtgacgtctgaccgggtgctgcggggagcaggtggagtgtgcgggggaggcggggtgtgggtgacgtctgaccgggtgctgcggggagcaggtggagtgtgcgggggccggggtgtgggtgagttctgaccgggtgctgcggggagcaggtggagtgtgcgggggaggcggggtgtgggtgacgtctgaccgggtgctgtgaggagcaggtggagtgtgcgggggaggcgggcacactcaggagattgggtgcaactcccggcccacccctgacccaggtgaccccggacaaacggctaacttggctggactctggtatctccctcaaggttgtaagaggggtccacgtgacagtcactcgctgcgagggttccgctaacagagcagagggagggggcgtggccagcaggcagctgggtggggctgagccagggcgatccgaccccgaaccggagcttttagcactttgagtccctgtactcagaggtctcctgcagccgggaatcccactgtgctgtggtccctggcagccagcacccacccccagcttctccgtcaaggttgaggacggagcactcctgcctctgattaactggacgcaggagaagcagttgctttaatccggagccttgagttgggacagataatgagtcattcaaccagattttccaaggacacactaactttggtatgatgcgtgtgtgcccctgaatccacgtggtcaggaaagcccagggaacactggcctgtgactcactgagcaggttcccttgttaccccgaggggtgatttactcctctgacagtgacacggacactgtgcgtccattccccgggcgggcagaggacactcccagatgcccacgaggggcccagcaagcactggccagccccagcccggccttcgccttcctttgcgtcagaatcatgaatgtgtccggcggggtcggactggaccagctgttgggctttgtttgctctttttacgaattgaaaaactgaagccaggagcggctgggtgacgtcccaggtcactccttactttcctccccacgctgagttcagacgacttcccgtgacaccactgttggtggcggaatgggactgtggctgcttccgctcagccacgctccctctctgtggacggcggagggtgtgtgtcccagcccggctgccgccctcccttaggtctgtctcccggggctgctgtaacccaggctcacaaacctggtggcttaaagcagcagaaacttagtctatcagatctggaatccgcgtcgattggccatcatccagccatcggtgttggcggggccacctccctctagggcctaggggaagagcattccttgctgcctccagcgtctgggtgctgatggcattccctggccagtggccacctccctccagtcgctgcctccgtgtcccatggccgcctccctccagtctctgcctccgtgtcccgtggccgcctccctccagtgtctgcctccgtgtcccgtggccgcctccctccagtgtctgcctccgtgtcccgtggccgcctccctccagtctctgcctccgtgtcccgtggccgcctccctccagtctctgcctccgtgtcccgtggccgcctccctccagtctctgcctccgtgtcccgtggccgcctccctccagtctctgcctccgtgtcccgtggccgcctccctccagtctctgcctccgtgtcccgtggccgcctccctccagtctctgcctccgtgtcccgtggccttctctgtgtgcctgtgtcaaatctcccccaagagttccgtaagaacactcgtgatggcgtgtaggtcccactagggtcatctagggtgatgccttcatatccagatctttaactgacatctgcaaagatgcttttccaaacaaggaaatgaggagcagcacttaccgggtccatgagcaggccttgatgtctttgggtggccatgattcagccaactgcggtcctccctctgacctcaaagatttctgtccactccacaggcaaaatatgttcacaccattgccagatcttggctgggtgtgggggctcacacctgtcatcccagcacattgggaggctgagatgggcggatcacttgaggacaaaagttcaagaccagcttggccaatatggtggaaaccctgtctttactaaaaatacaaaaattaactgggcatagtggcaggcgcctgtaatcccagctgaggcagaagaattgcttgaacccaggagctggaggttgcagggaaccaagatcatgccactgcactccagcctgggtgacagagcaagactctgtctaaactaaaccaaaccaaaccaaacaaaatgatcccctccaactacaaacctgttacagcagaaactccaagatcaaaatctcatgtaaatatcataagcttggccgagtgcggtggctcacacctgtcatcccaacactttgggaggccaaggcaggcatatcacctgaggtcaggagcttgagaccagcctggtcaacatggagaaaccccgtctctacaaaaaattagccgggcatggtggtaggcgactgtaatcccagctactgggaggccaaggcaggagaatcgcttgaacctgggaggcggaggttgcagcgagccaaggttgtgccactgcactccagcccaggtgacagagcgagacaccgtctcaagcaaaacaaaacaaacaaacaaaaatatcatcagctcaaaagtcccaaatgtcatcatttaagtcagggacgctgaagactctgggtctgatccattctggggcagaatttctcttcatatgtgcacctgtgagaccagaaaacaagtcacctatctccaaaatacaagggaagagcaggtgtagcatcacagctgcagacactctcattcccaatgggggaacacgggaggaacgaaggcatcaccagccccaggcaattccaaaacccggcaggcagaatgcactaggtgataagaccggggagacccctctgtggcttgggcaccccctaccctgctctgtgtccacggccctgccttcaggacgatccttttccctgaaggttatagcttttagtctgcttgaagattttaaggagtctgacgacctttcattttatcccgtctctgtccctttcagtccaaatttgcagtgttgttgttgatataacatttgtgaaaaccttgcagtcctcctttgaatgccataggaatttctgccagtagacaaaaagggctctgcagacctttcctgtgatgctgtctccactcctggcttctgagatggttgagtgaattgcagtctccttgcctggtctcttcatcactagcaggaggttgtttagacacacccttggccctctctcttttttctttttgttttttttttgagacagtctcactctgttgcccaggctggagtgcagtggtgcgatctcagctcactgcaacctccgcctcctgggttcaagtgattctcctgcctcagcctcctgagtagctaggtctacaggcacccaccaccatgcccagctaatttttgtatttttagtagagacagggtttctccatgttggccaggctggtctcgaactcctgacctcaagtgatccgcccgcctcggccccccaaagtgctgggattacaggtgtgagccactgcgcttggccgttggccttctctttagagtctgcttttcgaacagtgaatctcttttcattttctgcattatatgcgacctgcattatatgcgacctgcattatatgcgacctgcattatatgcgacctgcattatatgcgacctgcattatatgcgacccggataggctgagaatttcccacatcatcaagtcctggttccattttgtctgtcagtttttccctcaatttctctctttccttttgcattttgtgagaagcagcaagaaaaaaaagccaggccacaacttgaacactttgcttggagatctctgcggctaaatcttcaagttcatcatttacagttctgctctccacaaaactgcacagcacaattcagccaggctttctgtcactctgcagcaaagttggccttccctccagtctccagtaccacatttcccacttccttctgagccctcaccagaagaagcaactgtgatgttcatttttctgctaaaattctgttcatgccagtatatgtattctctctctctctctttttttttttttgagatggagccttgctcttttgcccaggctggagtgcagtggtgcgatcttggctcactgcaacctccaccttccgggttcaagcaaatctcccaccttagcctcccgagtagctgggattacaggcatgtgccaccatacccagctaatttttgtatttttagtacagacggggtttcaccatgttggccaggctggtctcgaactcctgacctcaactgatctgcccaccttggcctcccaaagtgctgggattccaggcgtgagccaccgtgcctggcccgtatatatattttctaaggcagcggtccccagcctttttggcaccaggaactggtttcgtggaagagagtttttccacagatgggggcggggtggtaagcggttggtttggggatgattcaagcacgttacgtttattgtgcactttatttctattattacattgtaatatataatgcagtaatcatacagctcaccataatgtaggatcagtgggagccctgagcttgttttcctgcagctagacggtcccatcatctgggggtgatgggggacagtgacagatcattaggcattagattttcgtaaggggagtacaacctaggtccctcgcatgcacagttcacagtaaggttagtattcccatgagaatctaatgccgcggatctgacaggaggtggagctcggacagtcacacacacgatggggagcggctgtaaatagggatgaagcttcgctcgttcacccaccacccacctcctgctgtgagcagcccagatcctcacaggccacagaccattaccagtccatggcccagggggtgggggacccctgctctagggcaacaaagccctctctgccctgctcctcacttccttctgagcccttactgcgagttgttttttttctgagacagggtctcactgttgcccaggctggagtatgttggtgcgatcctcagccttgacctcccgggctcaagtgatcttcccatctcagcctcccaagtagctgggactacaggtgtgcaccaccatgcccggctaattttttcatttttgtagacatgagatccgctatgtcgtccaggctggtctcgaactccagggctcaggtgatcctcccgccttggcctcccaaagtgctgggattccaggcgtgagccaccgcgcccgtctccgcaaggcctttaataccacattcccaccaacattctcttcaaggacgttgagacgttttccattcatggtgcttctaaatcctcccgtcgtctccccattgccggtttcaatgccacttccacatttttaggtgtttgttgcagcagcagcccacttcctcaccccagacctgtatccgtttcctgtggctgccgtaacaaatggcctcaagcctgaaacagcagcattgtggtctctcacgtgtctggaggacagaactctgaagtcagggtcacacgtctgtttccccgcctcctccactcctggggggtccggctttctccacttgtggctatgtcacttgcccctgcctctgtggtccctcggcctcctctcctgtgtgtgtcccccaccacctctctcctgtaaggacacctgtgatggtattttgggcccactcggatcatccaagttaatctcatgtttcgatcacatgtgcaaagtcgctttctccaataaggccacgtccacagattccagggactgggacctggtctctgtgagggccggtgttcagcctgctcgcgttagagaggcagagctttccagaagcagtgtctgacgcttcctggccatcccagggcagcttccccgccgagtacatactggatgaggatggccaagggaacctgacctgcctagacagcaaccactctcacttcatcctcgtggacgacgggacccacggccagtacggggtggagattcctctgaggaccaggctggagaagttcatatcggagcagaccaaggaaagaggaggtaggggagcttgctttcgagggtgattgggcagagagcacagtgggctggtcagagtgtcaggtacagctggtcacgaccaggacgttcaacaggcctggcgtttggcagagagtgcagtgggctggtcagagtgtcaggtacagctggtcacaggtcattcgtggcactcggcagagagcgcggtgagctggtcagactgtcaggtacagctggtcacaaccaggatgttcatggtactcggaacgtcctcagaacacacctgggtttctttcccgtgtctctttatactttgttccaggagggtcatcttctcttgcccattttagccagtgggagggcggtctggggggctggcagctcacctgtgtgctcgcaggtaatgggccaacctacattttttttgggacagggtctggagcgcagtggtgtgatctcagctcactgtagcctcgaacttctgggctcaagggatcctcccatcaccctcccaaagtgctgggattacaagcttgaaccactgtgcctggccctacaattattttaaaccttgatcatggtctgctctcaggttcagaaatcagaatgtacgatagtcaaaacttaggatttgatacctttttcctcataggtgggatgggatgggtttgaggacgtcgggaggtcaagtgcggggttttgcatatcacttgaggagggttcaaagaggagatggtgaacgggaggtgtctgacctgtggctgggtgggctggggtcccttgcagggttccttgtgcatcgaactcccctggagggttcctcaccagcttgtgggccccagccccagggtccaactcagcagctccaggtgggctgagaacttgcattaggagcacgttccctggtgagggcgatgctgcagttcagggaccagggaccacactttgagaaccctgcttgactagtaggagcacgttccctggtgaggacgatgctgcagttcagggaccagggaccacactttgagaacctgcttgactagtaggagcacgttccctggtgagggcgatgctgcagttcagggaccacactttgagaacctgcttgactaggacatctggggtgggatgtgtgggtgagtgtgtgaagacgatgggcccatggggggctcacagacagagtttgctgcctggggaaaggggttgccaagtccttctcaggctccactgctgttgggctggatgaagttcagggtggggctgggcggatggacacaggatggacgtgccgcatgctgctcgcatccacgcgtggcaggttgtgccacctgcttggggcctcagctctgattgtccatagcccctctccctccctcccaagaaagcaggcaggggtggatgggaagcaagcgagcggggaagtgtgggtggcggggggctcttgagtctgctcattgatgtggaacaggcaggtcccctgggaatgtggagctttgactttaaacggcgactcagcactggcaagaggcctcccagcaggtgcttcagtgtgtggttaggctggagccagcagggggcaggggagagtgccctcagtgcagggtcttgccccccacctctgtcccctcactcggctccatgctttgttcaggtgtggccctcactcggctccgtgctttgtttaggtgtggccctcactcggctgtgtgctttttctaggtgtggccatcaagatccccatcgtgtgcgtggtgctggagggcggcccgggcacgttgcacgtgagtatggccaggtgggagggggcatgtgtgggcccgtcctgctgcaggcagatgactgtccaaaagtgcttgtctcagaactcaagactgttggcaagagggcgatgagctttcccaccagaagaagagaaagagcatctacgctgtgtcggggctgcttctgggtgggtggaggacgggtcggaggaaggtgcctggaggaggaggctgggcttggctatgactgggccattgaccggcgtggaaggaaagggtggggccccagggcctggagtgagtggggagcctctgctcccaggacctgctggggaggctggggggtttctacaactctgcccccaagattcctccaggaagcatttttcaaagtacagggctgtggcccccatcccagatccgtggtgccagcagctgtgtgactgcagatttggcaggcagcttgaatgcgctgctctgccggccttccttcccgaccctaaccctaactgctttgtggcgtgcagggtgcgaggtgacctcacctgctgtaggaatgtacgaggacatatagcctgaggatctggagcaagagtatgggcttttgtgaaggatgggatcacaggcaatgtcccgtttatgtttcatgattgcaggaggtcaaaacagagccttgggggcttgaggctggatgggaatccatagagcactgggtcctcactccctatgcgtgccgagtacccttcacggctcttctgctggggcggctgcacccgcctccttaccccaggccgatgctcatgcacacggcagagtccttcctgccagacagctttgtgtccagtcccttcccgaagtccagcacaccctggagcccaggtgccctcctcatggctctgctcttactgtgggcttttatgaggtcggtaactccaggtccatgcagcgtcccctttgctgcgaggccctcacgtctgcaggtccatgggcaaaaatgctgggagtctttgattctgctggagctgaggcctgagaggtgccaggtgtgcagcccccagtgtgttggggcagctccctcttcccccagagcaggggacgccacgaaactaataagtgctttcagtggatctcggagtagtgttagccagctctgcccttagctggccttggagaattctccatttcagaaagcatcggagcggtgaggacccagtcccgggctcacacccccacctgccttgcagaccatcgacaacgccaccaccaacggcaccccctgtgtggttgtggagggctcgggccgcgtggccgacgtcattgcccaggtggccaacctgcctgtctcggacatcactatctccctgatccagcagaaactgagcgtgttcttccaggagatgtttgagaccttcacggaaagcaggattgtcgagtggaccaaaaaggtgaggctgacgggcacgacggtcaccagcatgtggctgctttgcagagacactgtcagcctggtgggcaggaccaggactcatggaccgatgcggagaacccactgggtctgagtgggtgccagagcgatttgcagagggcagggcccaggtggtaaacctcctggctgggttccggaggtcagatcccaagacagcatgtgaaaggagggtgtgaacctcacccgcagcacaccagggcgggctgggaacgctgcggggctcagtggtgctgtgaaaagggtctgctggattggaggggtgggaggcaggcgctggggaggcctcagccgagtcgggcagcagggcagctgctgagcaatggctgtgggtcgcagggtccagtccagattgtagcctcataggtgagttaatggaggcatgtagagtggcctcaggaggggccattgccccagtccaggggtagattttgggtggcccctgccatgaccccagcctccagagggggtccgttgtgaagggccgtggttggccagccctggccaccccaccaagcccttgaccaggggggtgggctccagtggagagcctctcccctccctgtgcctgctgcttccagggtgacctgactcaattcctggcaggattctttgcaggggctggcactggggccttttcatcctcagtttcccagcaagccagggccggcagagccctctgtctgtgtctttcctgcagacccgggacatctccaggttctgagtggctgacatgcgctttccactgtgttgaatttgggttctgtgggcagtggtgacccccagctgcaggccgcagggacacacctatttggccagattgggcctgtggagagtggattaaaaatgagcaccctcaggaaccacgggtgtcggaagggctgggtggaggtcttggccccgttggccgattcagaagcagagtttctctgactggtgatttgtgggtggcacagtgaccttgtttccttctgtgctttgcgatggtctcagagtgacctcgttctgcacagatgtcttctgagagcgtttttgtccggcaggagaataacatgatgtagctgcaagcgtcagatcagtttgtgaaaacatcgtggtccggctgtgagcggccgctcagctccccatgtcagggcggctttccttccttcccggtgccattgggacttgtcgggcgggccctggagccctctctctgctggttgataaattattcaggcaattctcagaactgagtttaatctgctgttgttgaaaggtgcctatttttaatgcactctccatagccaagccaaggccctgaaagtggtgctttcacacacagccgtcaggcctcagcaggggctcggcattcgctgatgctcctgctcagtggggaggggcccagccatgcagccagggtcagtgcgctcctttaacacgccttctcagagtgtccgtctacactgtggaggagttgcagagctaccctcgggtgctgctgctggtgggcggccccgtcagaggggcccggggacctccctgcaggggctcacagctgtggccaggaagaagttgcccaccctcgctcagccttgcctttctcatctgttaagtaggggtactgagtgctcgactcagacgaggaaacgaggccctggcgtccatatgggctcagacgctgggagctgcttcaccctatgaggacagggcgggctgaagtccaggagacttttatgggctcagacgctgggagctgctttacggtatgaggatgggggtgctgaaagccaggagacctttggctgctggatgagggtggagttcgccagggagctcaggatgtgttttggagttgtcatgaaagctggaccccgagggatggggcaccgttggggtcttaggcatggaggtggagtgtgaggagccctccaggtgagggcagagtctatgtggaggcaatggggccaggctgcggacgaggagagaagcaggggaggccaggtgtggctggcctggggagccagagggagaaggctgaggcttactttgggagcagtgggagccatgggaagatgcgtttgtggagttgctcgccctggacacagggggaaggtgcttcaaggaggagtaactgtagtagacatacctgctagggatgccatgatggatggatggatggatggatggtgggtgggtggtagatagatggatggatgatgggtgggtgtgtggatggctggatggaaagatggatggatgaatagatggatggatggatggtgggtgggtgggtgggccatgtggatggatggatggatggagggataggtgggtagctagatgataggtagattagatggatggatggatggatagatagatagacagacaggtgataaaatggatggactgggcactgtggctcacaattgtaatcccagcactttgggaggttgatgcgggtggatcacttgaggtcaggagtttgagaccagcctggccaacatggtgaaaccacatctgtactaaaaatacaaacattatccaggcatggtggtgggtgcctgtaatcccagctacttgggaggctgaggcaggagaattgcttgaagccaggaggtggaggttgcagtgacccaagatcgtgccactgcactccagcctgggtggcagagcaaaaagtctgtctcaaaaaaaaaaaaaaaaagatgaatgaattgatatgatagatagatggatagatagatagatagatagatagatagatagatagatggatgatagatagatagtgggtgggaggtagatagaaagataagtggatggatgaatggttggtaggtgggtgtgtgtatggatggatggaaagatggatggatggatggatagctagacaatagatagatacatgtggatggatagatggatacatggatagatggataggtagatagatagatacatacatatatacatagatgaaacacacacatggatggatagatagatttatagatggatagattatgtagatagatggatagatgcatagatggatagatagatcagattatgtagatagatagatggatagatgcatagatggatagatagatagactgatcgatcgacagacagacagataaataagtagacagatagataggcaggtaggcaggtggtgaggagtggcctgggcttagcaggagggctaggaggagcagcctcgcatgaagctgcactatcgtcagggtgaagatccgttgcccttggattgtgttttccacccaacagactctcacgaacatgatgtatttggtccccatggatcttcatctgcaccatctagggcaagaggagatgtggtggtgtcctggccacaagcgcaggcaggacccaaggctctggctgtgtccggggcctcaattctatgtgtcctggaggaggcaggggttcaggagtcactgtgtgtctcacttagaaaatgcttgttgcagatccaagatatcgtccggaggcggcagctgctgactgtcttccgggaaggcaaggatggtcagcaggacgtggatgtggccatcttgcaggccttgctgaaaggtgagggtcagggaacatgggggcaatggggtggaggccagaacgtgagctctgaggacgccaagttctagtcttgaagtgccatgattctgggaaccagaatattcctccttggtcagaaaccctggccagagggcagctggcgacgtgcaggtgggcgcctgcctgtcacctgatgttagaggtatgagctcctttatttgtaactggaatccgagtgcagcctgtgtcatttttacctttgtagtggtcataatttctcataaaacttcagggtggaaagaaagagtgcagaagttgcctctctcaacttcctgcttgctggctgctttagctcctctacctctgatgcaggaaagagtgtagaggtagagcagggcctcaggaatggtgtgatggacttgagctgtagtggctctctgtgtaacttctgttgcttagcctggcccattctccaggccacaaacatcactgtcctcttctcatgccacaggagagaaggcttatgcctctttgtcttacccagctggcacctgacactgggaagccttggtcttatatgtgctcctcccgcccgatgctgggcttctcaccctccagggtcggaggccccaggctgattctgaagggctcagcagagtgggcccaggctgggatcagcagggaacttttgtgataaaggccagactttcatcttgtttctgtgttgatttgagactccccttatcaaggacttgatgttgtgcataaaacctcacacaaacagcgagatgatagactacatattagaccacaaattaagccttaatttatctctcaatagatttaagatagatattatacaaattatcttctctgacaacaagatgaagttaggaattaataatggatgtaaaagtggaaaattcacaaagttgtggaaactaaacgacactaccttacacagccaatggatgaaagaagaaatcaaaaaggaaatcaagaaaccaatgaaaacaaaagcacaatatatcaaagcttatgggacatagcaaaaacaatgctaatggagaagtttatagctataaatgcttacattaaaaaataagatcttaaaccaacaacctaactttacaacttaagtaattagaaaaataagaacaaatgaaatccaaaagtagcagaatgaaggaaatagtacagattagagcagagatcaatgacataaagaatagaaaattgcagagaaaatcaataaagtgaaaaattggttatttgaaaagatcaacaaaattgacacacatttagctaactggactaagaaaaaagaaagaagattcatattactaaaattagaaatgaaagtagggacattactcctgactctacagaagtaaaaggattctgtgaataattgtatgccaacatgttggataacctagatgtgttagtctgttttatgtgactaaaacagaataccacagactaagtactttataaactacctagtactttataaatcaatcactgaccatccttgccttcccagaggatggtcagcatctggcaaaattgaggggccagcatctggcaagggcctgcctcatgtcattccagaatggcagcacatacatgcccttccactggaaggcagaagggtaagggagcacacagatgcatgaaagagagtaagaaagcaagagggagctaaacttgctttttataacaagcccactcttgaaataactaacccactcccaaaataagacattaatccattcatgaaggctttgccctgtaatggatcacctctattaggccccacctcccaacattattatactggggattacatttacaacacatgaactttggggaaaacattcaagccatagcactagatgaaatgaacacatttctagaagcacaaaacctaccaagactaaatcataaaaaaatcaaaactctgaatagacctataagtagtaaggagactgaatcagtaataaaaaatctccccataaaagttttagggctgatagcttcactggtgaattctaccaaatgtttaaagaactaacaccaatccttctcaaactttccccaacaattcaagaaggaaggcttcctaattcattctgtgaggccagcattattctgataccaaagacagacactacaagaaaagaaaactacagaccaatatccattatgaacattgatacgaaattcttcaacaaaatattagcatacaaaattcagtagcattaacaggattatacactatgactacatgagatttattcctggaatgcaaggatggttcaacatatgaaaattaatcaatacaccacattaacagaatgatggggaaaaaacatgattatctcaactgatacatttgacaaaatttgacaccctttcatggtaaaaacattcaacaaattaggaataaaaggaaactaccttgatgtaataaaagccatatatgaaaaactcccagcgaatatcatgttcaatggtgaaagactgggacatagcaaaaacagtgctaatggagaaatttatagctatacatgcttacattaaaaaataagatcttaaaccaacaacctaactttacagcttaagtaattagaaaaataagaacaaatgaaatcttttcctccaagatagaaataagggaaggatgcatactttcaccacttccattcaacattgcgttggaagttcaagccagagcaattagacaagaaaaagaaataaaacttataaattgggaaggaagaagtagaattatttgttcacagatgatatgattttcgtatttgtccattttcacactgctataaagaaatgcccaagactgggtaatttataaaggaaagaggttaaattgactcacagttcagcatgccttggaaggcctcaggaaacttacaatcatggtggaagatgaaggggaagaaaggcactgtcttcacaaggtgacaggaagaagaggtgccaaatgaagaaggaagagccccttctaaaaccatcagatctcatgagaacttactaccatgagaacagcataggggaaactgtccccacaatccaactacctccacctggtctctcccttgacacatggggatcatagggattataattcaagatgagatttgggtggggacacaaagcctaaccatatcaattttctatgcagaaaactaaagattctacaacatacccctgaactaagaaatgaattcagcaaagtagcaggacacaaaatcaatacacaaaaatctgccacatttgccaggtgtgatggctcatgcctgtaatctcagcactttgggaggcggaggtgggcggatcacgaggtcaggagattgagaccatcctggctaacatggtgaaaccccgtctctactaaaaatacaaaaaattagctgggcgtggtggcgagcacctgtagggcatggtggcgagcgcctgtagtcccagctacttgggaggctgaggcaggagaatggtgtgaacccaggaggcagagcttgcagtgagctgagatcatgccactgcactccagcctgggtgacagcaagactccgttcccccaccaccaaaaaaaaatctgctgcatttctatacactaaaaatgaataatcagaaaaggaaattgtgaaaacaattctatttacagtagcatcaaaaagaaaaaaaatactgaggaattaattaaaccaagggggtgaaagacttgtacaatgaaaactgtaaaacattgctgaaagaaatgaaagaagacataaataaatggaaagacatcccatgttcatgaattggaagccttaatattgttaagatgtcagtactactcaaagcaatctacagatccaatgcaattcctatcaaaaccccagtgatttttttttttttgcagaaatagaaaagcccatcctaaaattcatgtggagtctaaagggatcccaaacagccaaaataattttgaaagggaagaacaaagctggaagactcacactttctgatttctaaactcactacaaagctatagtaatcaaaacagtgtggtaatggtgtaaagaaagacatagagggctgggtgtggtggctcatgcctgtaatcccagcactttgggaggccaaagtgggctgattgcttgagctcaggggtttgagaccagcccaagcaacatggtgaaaccttgtctctataaaaaatataaaagctgggcaaggtggttcatgcttgtagtcccagctgtgtgggaggttgaggggagaggatcacttgagcccagaaggttggggctgcagtgagctgtgattgcaccactgcactccagcctgggcaacagagcaagaccctgtctcaaaaaaatcccaaaaagatatggagaccaatggaatagaatagtgagcccaaaaataaaccctcgcatatatggtcaaatgatatttgacaggaatgcaaaaatcattcagtgaggagagggacagtcttttcaacaaatgatgctggataaactggatatccacatgccaaagaatcaagttagacccttacctaacaccatatacaaaaactaactcaaagtagatcaaggacttctgaatataagacctaaactcttagaagaaagcacagggcaaaaacttcatgacaaaggatttggcagtggtttcttggccatgacacctaaggcacaggaaacaaaagaaaaaatagataaattggactttatgaaaattaaataattttgtgcatcaaaagatattatcaacagagtaaaaaggcaacccatggaatgggagaaaatatttgcaaatcatacatatggtaagggattggtatccagaatatatagagaactcctataactcaacaataaaaaaaaaacacaattcaaaaatgggcaaaggacttaaatagacatttctttaaagaagtcgtacaaatggccaataagcacgtgaaaagatgctcagcatcactaatcattagagaaatgcagatcaaaactaagagatatcatttcaaacacattaggatagctactatagaaaagaacagaaaatcacaaatgttggccagtgtgtggagaaactggagcccttgtgcactgttggtggatatgtaacatggtgcagctgccgtggaaaacaggatgacagttccttaaatatttaaaaatacaattcctatatgatccagctattccactcctcagatacatatgccactccccacccccaaatttaaagcagggtctggaagagatatgtgtatactcatgttcatagctgcattatccacaatagctaaaaagtggaagcagcccaagtgtccattgacagaagaatagataagcaaaatgtggtctatacctacaatggaatattactgagctttaaaaaggaaggaaattctgacacatgctgcaacatggttgaacccttaagacattatgttaagtgaaataagccagtcacaaaaggacaaatactatatgattccagttacaagaggtccctggagtagtcaaattcatggagacagaaagtagaatggtgggtgccaggatctgggggagaggtgaatgaggagttaatgtttaatggggatagagttttagtttccaagataaaaagatatatggagaaggacagtgatgatggctgcacaacattatgaatatacttaagaccagtgaactgtacgcttaaaaatatttggctgggtgagctggctcatgcctataatcgcagcactttgggaggctgaggtgggaggatcacttgagcccagcctaggcaacatggagaaccctgtcactacaaaaaaaaaaaaaaaaaaaaactagtcaggcatggtagcacacacctgtactcttagttactcaagaggctgaggtgggaggattgcttgagcccaggacgttgaggctgcaataagccttatgattataaatatgatcacagcactgtgctccagcctgggtgacagaggaagaccctgtctcaaaaacaaaaacaaaaacaacccaaaaagttaagatggtaaattttatgctacacgtattttaccacagtttaaaaacataatgaattttaaaatatcaactttatgaaggttcagcttagagacaataagctccctcaattctaaatgtactgtataacaagcacagacaccgtgacccaccacagtctccatacaggacatctcccctatcctgaatattccctcatggccctttgtagttaagcctccctccagactggctctggaaatcatctgtctgctttctgtcactctagattagttttgcccattttagaacttcacgtgaatgaaatcatacatgatgcattctttcatgtcttgtttcttttgctcagtgcattgtttttgagattcatccatgttgttgcatgtgtcagaactttgttcttttttgtctgtgaaggagtgtcctgttgtgtgaatacaccacaggttgtttttccattcatctgttggggtgcatttaggttgtttccagtttggggctattatgaataaagctgctatttgtcttcatttctcctgggtcaatatctaggagtggaattactggcctttatggtaagtgtatgttttactttgtaaaaaactgacaaacttttctgaaaatattgcattctttttcctgtgtgctggcagtggatgagcgttaccctacatccttgtccacacttggtgttgtcagtcttttaaactgtagccatcctagtggatgtgaagtgacatctcattgtggtttgaatttacattttcctgaggactactgatgtggagcatcattttaaggactttttggccatttgcctgtcttccttctgaaatgtctttcagatctcttgtccatttttatttgattgtttgtcttccagttttcgatttgtaagagttatttatatattcggatacaaatcgttcgtcagatattattttctcatggtgtgtagtttcctttcatattttcttcaagatgtctttgaagagcaggaggcttaaaatttttttttttttttttgagatggagtctcgctctgttgcccaggctggagtgcagtggcgcgatctcggatcattgcaagttccgcctcctgggttcacaccattctccagcttcagcctcccaagtagctgggactacaggtgtccaccaccacgcctggctaattttttgtatttttagtaaagacagggtttcgccgtgttagccaggatggtctcgatctcctgacctcatgatccacccgccttggcctcccaaaatgcgggattacaggtgtgagccacctcgcccagccaatttaatcaatttttctttatggttcatgttctttgtgtcatagctaagagatctctgcccatcccaaggttgcagatattttcttctgttttctgacggcagttttgtagacatagcctttatgtttgggcctaagaaccgctccatgttgattcttgtgtatggtgtgaggtaagggtcaaagttcttttttctttttccccaaataacaacccatgttttaaaaagttaaaccagaaagggaacacagaaactacttgagcaaaataacttgtcctgagaaccagtgaggtggttgttactgttgaacatttacaggcagttgaggcaggaaaggaaatgtgatggcttctgagtcctgagttttggatgttagtgtaagatgcctgccctccagagacctatgtcttcttaaaacagtgaggcccttttcttgcttactgcccacctgtcgcttaggggccagggcatggccaggaggagggcaggggaaacaggagtgagtggacgtgatgaccaaagccccaagattcactgattctgactccgaaatggaacatgcttttgcaaggctgtgtgtatgggaggaggtcactgggtgctgcgcctgtcactttgaattgttgagaggcaagggctcatgacacatccctgactctgacatcatttccctggagggaaatggctttgagctccagatcgaggcccaatatgcacctgttcatctgcagcctcacggagccaagaccactttggccacgagaactgggaccaccagctgaaactggcagtggcatggaatcgcgtggacattgcccgcagtgagatcttcatggatgagtggcagtggaaggtaagtcttccagagcaccccgtggaggggcctactgggcccacatgcattgcaccactgaagcaagggcaggcaaagttcgcattgtctggatcccagcccttcccttgagggtgggtgacctgggcagctttcatcctccccaggttggggacaacagcagcccccatctccagggtctttgagatcaggatgacatggggtgatgaccaaatgcaaccgtcactgcacaatgcttgctctcagccttcagatctgcaccccacgatgacagctgcactcatctccaacaagcctgagtttgtgaagctcttcctggagaacggggtgcagctgaaggagtttgtcacctgggacaccttgctctacctgtacgagaacctggacccctcctgcctgttccacagcaagctgcagaaggtgctggtggaggatcccgagcgcccggcttgcgcgcccgcggcgccccgcctgcagatgcaccacgtggcccaggtgctgcgggagctgctgggggacttcacgcagccgctttatccccggccccggcacaacgaccggctgcggctcctgctgcccgttccccacgtcaagctcaacgtgcgtgctggtaacggggcccatcctggactcgtcttcgcgggctactgctatgttcttagagctctctgtttttaaaattagcttttatttttattagaaaagacacatgctctatcttaggctgcttgggctgctgtaacaaaattccacagatggggcagaaactaccagtttattttctcgaagttctggaagcccgaagtcccagattaaggcaccagcagggctggcttctggccagggcctcttcttgcttgcacgtggctgccctcttgctgtgtcttcacgtgacagagagagaagtctctggtgccacttcctcttctttttcttttatttattttttatttttttgagacagggtctcactctgtcgtccaggctggagtgcagtggcgtgatcttagctcactgcagcctcaacctcccaggctcaagcaatcctcccacctcagcctcccaagtagctgggactacaggtatgcgccaccacacctggctaattttttatttttttgtagagatggttttgctattttggacaggttggtctcaacctcctggcctcaagtgatccgctctcctcaccctccaaaaggctggaatttacaccctccagccaccgtgccttgtctatttttatgtttgagacagggtctggctctgtgacccaggctggagtgcagtggtgcaatcatggctcaccgtaccttccacctcccaggctcaagcaatcctcctgcctccgtctcttgagtagctgggactataggcatgtgccaccacacccagctttttttttttttttataatattttgttgagatggggtctcattatatggcccaggctggtctcaaactccggggctcaagtgatcctcctgtcttggcctcccaaattgctggcattgcaagtgtgagcctccgcacctggcctcacccctctttttataaagagaacacacctatccacttaggaacccacaatgtggcctcgtttaaccttaattaccttcttaaaggccctatctccaaatgctatagtcacactgggggttagggcttcaacatatgaattttaggggggacagagttgcgtccataacataccctttctaaaagttccaaacagtacaaaaggttctgcagggagcgtgatccccctgccctgagccccactgctgcccactgtgtatgctggttttttccgacagtcaggtcagtaacattccaccgtatttttgtgagatgcccagggtgcactgcagctgtgggagagtggatgctgtagtctgcaccctgtgattcaatgggagccctgctctagtctcacctttatttaatggtgagactgccccagtctccaaccttattcaagggaaccctgctctaatctccacccttatccaatgggaaccctgctctaatctccacccttattcaataggaaccctgccctagtctccaccctgattcagtgggaaccctgccgtaatctccaccctgattcaatgagaatcctgccctagtctgtttaccctttttcagtgggaaccttgcagtgactcaatgtcaggaatgatgctggattttgtatttgtatttcctcttgggagtatttatctctgattcattaaggttttacaaagcaaagcatcgatgcctttgagaagattgagctccttttcttctttgacctatgaatttggtgaattattttaatagattttctgatagtgaaacatgtttttatccctgttttgaatttcagcttggcctcagtgcaagtttaatatactggattctcttggcaacattttcaggatgtttgcatcagaatgcttaaggctttgattgcagttttatttggggggctatatttgtcaggctctgatatcaattttatgttagttttgtaaaaaccatttgggaagctttctttccttctccgctccaggacagtttatgtagctggagttaactacttcttataagcttggtcgactcccctgtgagtccatctggacccagtgccttttttttttaattggtaatagttctagtaactttctcagtttcttttctgattatttttctgtttaggttctctatctcttctaagatcacatttttttttttttcctgctagaaaattgtctgtttcctccaggttttccaatcgatccattgttccaggtgagctctgtctgactcttgagaaagacatgggtatgacttggtttctttgttttttgtttttgagacaaagttttgctcttgttgcccaggctggagtgcaatggtataatctctgcttactgcaacctctgcctcctgggttcaattgagtctcttgcctaagcctcccaagtagctgggattacaggcgcccaccaccatgcccagctaattttttgtattagtagagatggagtttcaccatgttggccaggctgatctggatctcctgaccttaggatccacccatcttggcctcccaaagtgctgggattacaggcgtgagccaccgtgccaggccgggtatggcttggttttatacattcacgatctgcacttcttaagtccagtgcgtttatttaagacgctcagttggaatatgcttaggaaggtccaaagcagaatctcaagcttatctgtacctgtggtttaggaagaaaaacacatttcttttttttttttttttttttgagatggagtcttgctctgctgcccaggctggagtgtagtggcgcaatcttggctcactgcaacctccacctcctgggttcaggccattgtcttgcctcagccttccgagtagctgggactacaggtgtccgccaccacgcctggctaattttttgtatttttagtagagatggggtttcactgcgttagccaggatggtctcgatctcctgacctcgtgatactcccgccttggcctcccaaattgctgggattacaggcgtgagccaccgtgccaggccgggtatggcttggttttatacattcacaatctgcgcttcttaagtccagtgcgtttatttaagacactcagttggaatatgcttaggaaggtccaaagcagaagctcaggcttatctgtacctgtggtttaggaagaaaaacacatttctttataatgaaaaaccttcaggaaatttctaggatcacttgaggtgtgttttgtacagtatgtgatgtgggagatggttttttttctacttctggggagcgtttcccagctacctgagtacgtgtttcctggtccggggaaaagcctagccatgcagggaggtgggtctgggcaaggtgccctgtgcttgctcgtgagtgagccatattgcccacctgacagatctttcctagtggcctctctgccagagacactgcaggagagtccctcagggagaagacagtcactgacctattaacatactccactgtgctagaattttgcttcgttgaaagcagctttgatgccatcagataagactggggaacttgaagtgcctggcatgaaacaagagtctacacatgttggtaaaggagttagacgggcgtttcactttctagatgtctccagaacagtgttttaaaaaacttcagtgtgcataagaatgatctagggtgttgctgaaaatgcaggttgtagttctccagggacagtgagatcctgagaaggtcggggctggggtcagggcctgcacctctgacaggctccgccagtgactctgagccaggcggcccggctggggctctgacagttcactgctcaccaggtgcagggagtgagcctccggtccctctacaagcgttcctcaggccatgtgaccttcaccatggaccccatccgtgaccttctcatttgggccattgtccagaaccgtcgggagctggcaggaatcatctgggctcaggtaataagactggcttctcagtctcagcagacacagctataggccagcggccagctggggagtgtggctggagagagtggctggagagcctgaggccaagtgcacgtggaggctgtggaggggtgtggaggggtgtggagggctgtggaggatgtggaggggtgtggagggctgtggagggatgtggaggctgtggaggggtgtggaggggtgtggagggctgtggaggatgtggaggggtgtggagggctgtggagggatgtggaggctgtggaggggtgtggaggggtgtggagggctgtggaggatgtggaggggtgtggagggctgtggagggatgtggagactgtggaggggtgtggaggctgtggaggggtgtggaggctgtggaggggtgtggaggctgtgaaggggtgtggaggctgtggaggggtgtagaggggtgtagagggttgtggaggctgtggaggggtgtggagggctgtggaggggtgtggaggggtgtggaggctgtggaggggtgtggagggttgtggaggggtgtggaggggtgtggaggctgtggaggggtgtggagggatgtggagggatgtggaggggtgtggagggtgtggaggggtgtggaggggtgtggaggctgtggaggggtgtggagggatgtggaggggtgtggaggggtgtggaggctgtggaggggtgtggagggatgtggaggggtgtggagggctgtggaggggtgtggagggctgtggaggggtgtggaggggtgtggaggggtgtggggggttgtggagggctgtggaggctgtggagggttgtgggcgtctccaacactgggaaggacttggggcacctggagttggagaacaaagaacttagctctaggcaggaaaggaattttttttttttttgagacggagtcttgctctgttgcccaggctggagtgcagtggcacaatctcggctcactgcaacctctgcctaccgtgttcaagcgattctcctgcctcagcctcctgagtaactagaacaacaggcatgtgccaccacgcctggctaattttttataatttagtagagatggggtttcaccatattggccaggctggtctcgaactcctgacctcatgatccgcctgcctcggccttccaaagtgctgggattacaggcgtaagccactgcgtccggcccaggaaaggaatttttaaattaaaagttctgctaaaaaaaactggttctgtggttatgtccagggccgagtctcactgggcacgcacaggccgggtggtgccgccctctgcagctcacacgggttccgatgggggctggtgcatgtgctgggcccgtgctgtccgtcaggctttgcagggcaagcagacccctcccacaggccacgcaggagcctgggccatcatcagaggttgtgtattgactggggtggggcttaagttgtctgtatagatgtggtcacacacagtgattgcccagtggcccgcactgtccccgggcctcgttttcatcacctggggcagtgtgttgggttcctcaggctgggttgagcctggctctttagtctcacggtggctcctccggtccccagagccaggactgcatcgcagcggccttggcctgcagcaagatcctgaaggaactgtccaaggaggaggaggacacggacagctcggaggagatgctggcgctggcggaggagtatgagcacagagccatcggtgagctctgccgggcacgggctgcaggccatggctcagccgtgcatgccctcacctggagttcccatccctgggtctcagccccatgtgccctcaccctggggtcctcgtccctgggcctcagccctgcacgcttaccctggggtcctcatcccggagtctcggccctgtaaccacccagtgggttcgtcttgcctgctgctcagatagagcccatttgttaagacagcgagattgcaatagagaaagagtttaattcacacagagccggctgaatgggaagctggagtttcatcacccaaatcagtctccctgaaaatttggagactgtttttttttttttgagatggagtgtcgctctgttgcccaggctggagtgcaatggcacaatctcggctcactacaccctctgccctctggattcaagcgattctcctgtctcagcctcccgagtagctgggattacagctgcctgccaccacaactggctaatttttgtatttttaatagagatggggtttcatcatattggtcaggctggtctcaaactcctaacctcagatgatccgcccacctcggcctcccaaagtgctgggattacaggcgtgaaccaccacgcctggtgagactggggttttttaaggataatttggtgggtagggggccaggcagcggggagtactgattggttgggccagagatgaaatcacagcgggtcaaagtgggttcttctcactgtctactattcatgatcacaggggtcgaagtgggttcttctcgctgtctgctgtttctgcgtgtggtcacagaactggttgcaccagatctccagtcggggtggcgtcagtgacgcatcagaatgcaggctttcaaaatatcctgggttttccaatagtgatgatattcctaggaagagttggggaggtttggaatcttgtggcctctggctgcgtgactcctaaaccataatttctaatttgtggctactttgttagtcttacaaacgcagactgctcccaggcaagaagggggttcgtttcgggaaagggccgctatcatctctgtttggaagttaaactataaacgaagttcctctcaaagttagtgtggcctatgcccaggaatggacaagggcagcttggaggttagaggcaagatggagtccattaggtcagttctcggtccctgtctgagttttctccctgttgtcatttttgtagaggcagttccagccctacgtgccctctccctggggtcctcgtccctgggcctgggtgttttgagacaccagccccacatttgccctgtgcccttccctgtgtcctggtggtgctgtcccgagtggttgccctctgacccgtccccagggctcagtgattgtgacctgctgctctgacggggctctcatatctccgcccaggggtcttcaccgagtgctaccggaaggacgaagagagagcccagaaactgctcacccgcgtgtccgaggcctgggggaagaccacctgcctgcagctcgccctggaggccaaggacatgaagtttgtgtctcacgggggcatccaggtgacctcccaagagccccttccagaaacagacgcctgtggtgcctgcagggcggacacagcctcctgttcgtgcagttggcacgcacactcacacaggcttcagggccctcagcagctcggggacagcgcctgacccctcggccacctgctccaggctctggcctcccattttgcagatggggggaagctaacatgaagcaaaagcaggagctggtggccatggagatcgcaattcacctccccatggatgttcctacctgggagcggcaggcagaagcccaggtggctctgggaacggcgtctgccctctctccctggagggataagcgggacacggcgtgtcctccctggagcagcaggggctcccaggcatggctgccctcagcatcgccctggaacccccggcagggcctggctcccagcgagtgccccttgcacactgggcttccttggagcgccgagctattgccaagtccatgagctcccgtcatgtcctgggctgtgccaggcctagggaggcctggggaagggtcctgtcccccactgcagagctcagaggggccagtgctctacagcctgcaactgcggggccttcgaagccagcagagatggggtcccatagcttgaggtcaggtgaaaggcgggattgggcacccaaagccccagggcaagctctgtgtcttcaccactttctgctgtgagactgcaggctagctctgtccactaggcaccccgagtcctcagcagacagctgacgggcaccatctggggcacagggctgggcactgccatcctgagactgcccccatccgcaggccttcctgaccaaggtgtggtggggccagctctccgtggacaatgggctgtggcgtgtgaccctgtgcatgctggccttcccgctgctcctcaccggcctcatctccttcaggtgctgcagggctgcggggctgcgggactgtggggctgcggggctgcgggagaggctcctgggggctcaggatcttccctagatcccctcgctgggagcaagtcatgtgtcctcagaattgtccctggatcctggggctgtagagatgggggtgggaagcagagcagggccccacgtgctggaagcacctgccttgccccagccccagcactgatctcatgatgctgatgagcccgtccctcagccacatcagcctggggttggggaggccaggaaagatggtctcctgctcctgccggcactgtagacctgagccagtctgcggcgtgggcagttagtgcaggtctgggatgcgagcagcgagctgcggctgagccctgtcctcgcagccgcagagcctgtattgatggaatcgctttcccttatgaaggaggaggacacggctggccatggttgaagacctggcctggcctggtgtccccacctgcacctcctcagaggcttgctggggcgttgtgggatctgctgtgttttactgagggctggatggaggctcagggtctcctgggagtcagggcagattcaagaccccagcgaggtggctgagccccttctgcaacccgcagtccacactgcctgcctccttccctttctcctcacggccaggatgggtacttgagtgttcaggaatcctggtgggaaactgaggcagggaggagcggctcaggtgtcctaaagcagtgctggcttctctcctgctctcccgaggatggcagagccgtgtcactgatggccgcctctgctcccgttccagcggcccggggatagggacctgggatcagggcacaccacagggggagtgtggtcagccccacccccattgaggacggcaaggaaagcctgtccccatttacaggagggtgactaaggcctgagcgtccactgagcactgggagctctgaagctggggcccacccaaggctgggcttggggcaggctgggcctccctgtttgcagccattaaggtcatggccatgggcagggcgtcagcgggcatccctgtgtcctcactttgctgggctgtggggtccagccccaccccggtggctgtgtgtgaggctcccaggctgtgctgtgccggctccgcctgtagctgccgttatggccccggatccctgagtgcttttgcctctaaaagcacatctctctgaggggcacgggggatcacggggtggccaaagcctgtggaggtcaggaccctggccctggtggtcactgtctcctctctgctgtgacggccgcagggagaagaggctgcaggatgtgggcacccccgcggcccgcgcccgtgccttcttcaccgcacccgtggtggtcttccacctgaacatcctctcctacttcgccttcctctgcctgttcgcctacgtgctcatggtggacttccagcctgtgccctcctggtgcgagtgtgccatctacctctggctcttctccttggtgtgcgaggagatgcggcaggtacagccccacctgcttttccacgccccagcccggggccacccacttggctgcattctcataggggacccatggcttagagcccaccccatctagcctgcccagctccctgcaagctgagcagagccggtgtttcctccccaaaatgggtggctggggcgctgccctccaagcccctccctcctcatgccccctgcgcctgcttccctgctttccctcggcccaggcatccttccctcctggagaccggctgatcagctcaaggtggatgccctgaccttgtggactatgagtatgtcccttcccccaggaagagcagtgcaaggtgtggggtccctaagacccctctcacgttcaataacgagccagaaggacccacagacgctggggagtggcaatgctcacttatggtttattaagcaacagtctacagactaaaccagccagggggagggacgcagctgcatccaggacagctctgagcccagggcatccggccagtccctccctgtggaggtgtgggtggcactccatcctcccggtgatgatgtgtggcctcatgcatggaggcacgtccccagagaggctcgcgggccttggtgtctactggaggtcagtcacagaggcgaggctgacaccacatggttgacctcagtctccagccctccaaaggtcaaactgaaaactgcccggggccccaccccaaatcacactgtgggaccacctggcatggcccaggccccaggaacaaagacaccctcatcaggcggacattccaagggctcagaggctatctccctggagctgggcgaggccaagctgccctccaggtggggcgaatcccttactgtgtggggtctccactgtgcccccacggtgcctgcacctgctggcagccggtgaatgggaactaggtccttggaaccctcagggcagtggtgagggggtggggtcagcccacggggcagtggtcctggcttagacttacctctgctctctaaccttggtggaccaccaggcccccagttaccccagttagaaagcagtgtgcactgtgtaaataccactgcctactggggccctgggggaggcaccggcgtccccaggaaggaagatcaggtccaggacttggcggggcctgggagctgtgctgtggccctggctctgctgggctctccttggctctcctcttgccacagggcttctgccaccagaccctctctacaaggggccagaggcctccatgcacccccagccccagccccatgggcagcagcctgagagcagagggggcacttccttctccctgcatctgtctgtgatccagggagggccctggttggtcctgctggtcacctgccccacctgtccagctgctgggtcctggggcctggggctagggagggtgtggggactcctgccaagtaggccaaatgggggctcccacagcccctgccaggtcctgcactcttggcctgctaaagaaacagtgtggcccctgacagaacaaagatccttgtgggaaggcagctggcgcctgacattgagggcgctgctccaacacacacacacatgcacacacatgcatacacatacaggtacatgcacacacatgtacacatgcacacaaatgcacacacacataggcacacacacatacatacatgcatatgtacacacatacatgcacacacatgcacacagtacacacataggcacacacattcatgcatatgtatacacacatgcacacatgcacacacatgcatacacacatgcatacacatacatgcacacatatacacatgcatacacacatatgcatggacacacatacatgcatatagagatgcacacacatgcatacacatatacatgcatgcacacatacaaatatacacagataaacacatgtatacacatgcacacacatgcatacacacattacacgtgtgcatacacacaaatatacacatacatacacatgcacatacatatacagcacacacatgcatacacacatacacatgtacacaatatacacatacacatatgcacacatacatacatgcacatacacatgcatacacacatacacatacacacatgcacatacacaaatatacacatcacccaagcacatatacacatatacatacatatgcacatgaacaaacatgtacacacatacacacacatatatacatatgcacacatgaatgaacatacacatatgaacacacacatacagacacatacacatatatacacatgcacacacaaaaacatgcaaatacacatatacacagagacacacagatacacatacacatgcacacacacaaacatgcatacatacacaatacatgcaaatgtatgtgcatacacatatacatgcacacatacatgcacatacacatatacacacatgcatacacatacaaatacatgcagacacatacagaatgcacacatacatacacacacacatatgtgcacacatacatattcacacgtatacacacatacatgcagaatatatgtacatacacatatatgcacacacaggtgctgagtgagcagggggccgaggtagctgctgccagcgctattctgcattgttcctccacgtcctgttcccatctccctcactgacccagctctcttcagatcagaaccaatgttcggatttgctgaccgtgatgatagtgatgatagtgatagtgatgatagtgacagtgatgatagtgacggtgatagtgatgatagtgacagtgactgtgattgtgatgatgatagtggatagtgatatgacagcgatggtgacagcaaggatagtgatgatagtgacagtgatagtgatgatagtgacagtgactgtgatgatagtggatagtgatatgacagtgatggtgacagcaagggtagtgatgatagtgacagtgatagtgatgatagtgacagtgactgtgatgatagtggatagtgatatgacagtgatggtgacagcaaggatagtgatgatagtgacagtgatagtgatgatagtgacagtgactgtgatgatagtggatagtgatatgacagtgatggtgacagcaagggtagtgatgatagtgacagtgatagtgatgatagtgacagtgactgtgatgatgatagtggatagtgatgtgacagtgacagtgaggatagtaagagtgacaacctgtctgccttcctaccgcccctcttcccagtagctcttctatgaccctgacgagtgcgggctgatgaagaaggcagccttgtacttcagtgacttctggaataagctggacgtcggcgcaatcttgctcttcgtggcagggctgacctgcaggtgagtggcctcaccccgatggcgggcccgtctgaggcagccagccctgcaggggatgagcacaggccgggcccagaaccagccacaccgggtgaggctcagctcgtctgtgaaccctggattgtcatctgtccaatgggtgtccaggcaacagcgccccacctacccttgggattgttgagggagcacagaaggggcatgagagctcctggcagagctgagattgtccatgtgcaaggggccatagatggcaacctctggaattgtcccagctccacggacacgcggctgccgctttctccctctgcctccctactgtgggctcactgcactgcctgtgatgctctcgtgtctctgcgaggccgcggccccctttctcggaggcaatagggccctggctaactgctggctctccaggtgcccccatgccaggctgccctgtggggctgggcgtctgaagaaaagtgggaggctctattcctcaatctcatgccagctttgaacacctgggatgcagggcccaccagagccctttgcctccagggcccacctgggctaggacaggtggaggggcgacgggggacagctctgggggctgctgtgagcaggtggctgagatgtgtgtgcttctgcccggcggccaggctcatcccggcgacgctgtaccccgggcgcgtcatcctctctctggacttcatcctgttctgcctccggctcatgcacatttttaccatcagtaagacgctggggcccaagatcatcattgtgaagcggatggtaagggggcgggggcaccggctccatcgcggcctgcagcccagggtgggcctcagggagggcaggccccttgccagtggctcggactggggcttaaacacacctgtaggttccccgtccctgctttgccccttgggctcccaagaatgcccttctcgtatctttgcctgtacgtcacctcttccaggaagccttccctcattctcccctctgatccccactcattcctggcctctgattcagctctaggagctttcctccttggtcacggttatgtctgaccgcactcattcctggcctctgattcagctctaggagctttcctccttgggtcacggttatgtctgacccctcttgcactttgtggtgctagcacaaagatgtcggcagtccacgagggtgtgggggcagccccaggactgctcctgggagcctcctgcatgccgtgtctgtgctgtgagtggcagtgctgtctccaccgctgctgggcctgcctctgggcccagtgagcatcgggggccaggagagtgtagcccacacaatctctgtcctgcagatgaaggacgtcttcttcttcctcttcctgctggctgtgtgggtggtgtccttcggggtggccaagcaggccatcctcatccacaacgagcgccgggtggactggctgttccgaggggccgtctaccactcctacctcaccatcttcgggcagatcccgggctacatcgacggtaggagccgggcgccatgggagctcgggtggtgctgccgggaagcaggagagaggctggaaaggggccgcatgagtgggagtgaggccggctccatcagggggtcctgcggttcccacctggccggtgtcctccctgggggcattcattccccggctcctgtggcaggaagtagaaggggccccaccaggggagggaggaggggggcctggtgggggtgagtggtgccacgcagaggtcagagtgggccgagggcacctggggcatcagctgacagccccctgaaatggaatgtcaccctgtatcccctttccctctcacctcaatcagaaataacttccttcttctcttgatggaaataattcattcctcccttcctcccttccttccttccattttttgacagggttttgctctgtcacccaggctggagtgcagtggcacgtccacctcctgcgctcaagtcctcctcccacccgtctgctgagtagctgggactgcatgtgcacgccaacacacccggctaatttttgtattttttgtagagatgggggtttcagcatgtggcccaggctagtatcgaactcttgagctcaagtgatccacccccttggcctcccaaagtgctgagattacaggcgtgagccaccatgcctgccagagagaacacttttcatatagaaggttttttttttttttttttttttttttaacagcttcattgagagaaatttcacctggataaagtgcacctgtcagtggttttcagtatctttacagaatctaactttataacatctgcatcaccctgaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttccttccattttttgtacagggttttgctctgtcacccaggctgggactgcagtggcacgtccacctcctgcgctcaagtcctcctcccacccgtctgctgagtagctgggactgcatgtgcacgccgacacacccggctaatttttgtattttttgtagagatgggggtttcagcatgtggcccaggctagtatcgaactcttgagctcaagtgatccacccccttggcctcccaaagtgctgagattacaggcgtgagccaccatgcctgccagagagaacacttttcatatagaaggttttttttttttttttttttttttaacagcttcattgagagaaatttcacctggataaagtgcacctgtcagtggttttcagtatctttacagaatctaactttataacatctgcatcaccctgaaaagaccctgcatactcacagtcactcccgttcccctcccctcagccacagccacccacgaagctacttgtgagctgccttttctgggcgtttcatagaaactggatgatgtaataggcagtctttggtgtctgacttctttcacttgatgtcccgttttcaaggtttgtcaccgtgtatcagtatttacttcccgtttatggctgaagaggaccccgctgtgtggacacaccacattttgttcatccattcatcagttggtggacatatgggttgtttccacttttccttttttttaaaaaaaattaatatttaattttttaattaaaaaattttaaattaattaatatttaattttttttttcccctagagggagtctcgctctgttttctttttcccgagagggagtcaggccaaagtgcagtggcacaatcttggctcactgtgacctccacctcctgggttcaagcaattctcctgcctcagcctcccgagtagctgggattacaggcacctgctaccacgcttggctaatttttgtatttttttgtagagatggggtttcaccatgttggacaggctggtcttgaactcctgacctcaggtgatccacccgcctcggcctcccaaagtgctgggatgacaggtgtgagctaccgcgcagggccgtttccacttttcacatgctgtgaataacgtagcatgaacagttatttacagggttttgtgtgggtatgtttttatttctcttagacacctaggaatgcacggctggctcatatgggaactccatgtttaagtttttgtggacgtgctgggctgttttccaaagaaccggccgcattccacattcctgcctgcccagtcccaggattccaatttctctaccttcttgtcaacatttgttattgtccattaaaaaaacaaagctcgcatcccggtgggtgagaagtggctctccttgtcgctttgacgggcatttctctaaggacccgccatgctgagcatctcctcctctgctaacctcgtcgtctgtaagtcttctttcaagaaatgtctctccctctcctttgccctttttttttttttttttttttccgacagggtctcgctctgtcacccaggctggaatgcagtggtgcgatctcagctcactgcaacctctgcctcccgggctcaagtgattctcctgcctcagcctcccgagtagctgggactacaggcgcacgccaccacgcctggctaatttttgtatttttagtagatacagagtttcaccatgttggccaggctggtctcgatctcctgacctcgtgatccacccgccttggcctcccaaagtgctggcattacaggcataagccactgcccccagccatctttgcccatttttcaattgagttgtcttttatattattgagttgtcttttatattattgagttgtaagagttctttacgtaaggatgccagtctcttaccaaaggtatgatttgaattttttttgtcaatctgtgcactgacttgttattttctttatggtgtcatttgatgcacgaacttttgaaattttgatgatgttcaacttatcaatctctttgatcattgtgcttttggtgtcctagcgaaaaccattgccgtgatttatgcctgtgttctactaagtgttttatagctttcgctttttgtttgccctggtgtgcggtaagggtcagtcttcgttgtggctctcctgttgtcccagcactatttgttgacaagactgttgtttccccagtgaagcatcttggcatccttgttgaaaatcagtggaccattaacataagggcttatttctagagtctcagtttgactccactgatgtctgtccttgtgccagaaccacactgtcttggtgagcgtagccttgtagtaagttttgaccgcactgtcttggttggcgtagccttgtagtgagttttgatcgcgctgtcttggttggcgtagccttgtagtaagttttgatcgcgctgtcttggttggcgtagccttgtagtgagttttgactgcactgtcttggcgtagccttgtagtaagttttgactgcactgtcttggttggcgtagccttgtagtaagttttgaccacactgtcttggtgtagccttgtagtaagttttgaccacactgtcttggttggcgtagccttgtagtaagttttgaccacactgtcttggtgtagccttgtagtaagttttgactgcactctcttggttggcatagccttgtagtaagttttgaccgcactgtcttggtgagcgtagccttgtagtaagttttgaccacactgtcttggcgtagccttgtagtaagttttgaccgcactgtcttggcgtagccttgtagtaagttttgatcgtgctgtcttggttggcgtagccttgtagtaagttttgacctcactctcttggtgagcgtagccttgtagtaagttttgaccgcactgtcttggtgagcgtagccttgtagtaagttttgactgcactgtcttggttggcgtagccttgtagtaagttttgacctcactgtcttggtgagcgtagccttatagtaagttttgaccacactgtcttggtgagcgtagccttgtagtaagttttgaccgcactgtcttggttggcgtagccttgtagtaagttttgaccgtgctgtcttggtgagcgtagccttgtagtaagttttgaaattcggaagtgtgagtcctaatttgttcttttccaggattgctttggcctctgggtcccttggcttcacaagaatttttggatcagctcatcaatttctccaaaaagggcatctgtgattttgattgtgaacatgggatgtctttttgcttatttaattctttaatttctctcaataatgttttatagtttccagtaataagtcttaatgcttcttctgttaaatttattcctaaatattttattattgtccaagctattataaatagaattgtcctattgatttcatttcaaattgttaatgactggtatgtagacatacattgtcttttgtagattgatcttgaactctgaaaccttgctaaacttctttattacttttaatagttttttagtggatttgtcatatacgagaccatgtcatctgcaaaaagagagttttacttgttcctttccaaactggttgccttttatttcttcttcttgcctaagtgccctggctagaacctccagtacaatgttgaacagaagggacaatgggggacatccttgctttgctcctgatcttaagacgagtccactgatcttagggaacaagcctttcaccattaagtgtgatgttagctgtggggcttttataaatgtcctttatcaggttgaagaagttcccttctattcctagtttcttgagtgtttttattgtgaaggagtggtagactttgtcagctgcttctcctgcacttattcaaatgttcagatggtctttgatccttttactattaatatggtgcattccatcaattgaccttcgaatgttaaaccaactgtatgttcctgggacacgtcccacttggtcttggtgaataatctcttttacatggtgctggattcactttgctagctgttttttgatgatttttgcacctatattcatgaaggttattggtctgtggttttcttttcttgtaatatgtttgcctagttttggcaccaggataatactggcctcataaaatggcttaggaagtagttcctcctcttatattttggaagagtttgtaaaagagtggttttaattcttccgtgaacatttggtagaattcaccagtgaactcctctgagtgtggacttttctttgtgtgatgtttttaacttactaattcaatctctttatgtgttataggtctatttatattttctatttcttctccagtcacctttggtagtttgtgtctttctaggaatttgtccattcatctagatcatctaatttttttagcatacaattttctctaggatttcctttgagttctttttctttttgtaagattagtagtaatatcctctctttcatttctgattttagcaatttgagccttctctctttttttccttgatcagtcttagctacaaggtggtaattatttttgttgctctttttcaagaactgagtttggtttgttgacattcattgtttttgttttctcgatctcatttatattctaatcttcattctttccttccttctgcttgcttttggcttgtctcagggaaagcatccagtctttcccactgggtatgatgttagctgcagggtttttgtaaatgtcctttcaatcaaagaggttctctttgattcctaacttcttgagtgtttttattgtgaaagggtggtttgctcttctttttctagtttactacagtgggaagttacgttaataatttcagctcttctttattaatataggaatttatagccatcagagtgcgtttctatcttagaaaattagtaacacattcaaaataggtttgattacccaataatgcattgctcattgttgaacaattttaaaattcaagataagtataaggaaagaatgttattcataatttcacctcccggagttaactactgttaacaacttactatttttccttagagatttgtttaaggtagaagctgtttccatattcaatagcccttactttctatgcacgcaggatgctatttttcttcacaatcacccgtttcacttgtcgatacgttgcctctgcaacatcttcccttttccacatctccacgtctcccttctctttgggatagttgttatttttttccttttcaattctttttttttttttttttttttaatttttgagacagacatttgctcttgttgcccaggctggagtgcaatgaggcaacctcggctcactgcaacctccacctccctcccggattcaagtgattttcctgcctcagcctcccgagtagctgggattataggcgcccgccaccatgcctggctaatttttgtatttttagtagagacaaggtttcaccatgttgaccaggctggtctcaaactcctgacctcaggtgatccgcccgccttggcctcccaaagtgctgggattacaggcatgagccactgctcctggcctttccttttaaattatttccaccaaattgaactccccaggcttgggacctggtgctggccctggctgggaccctggcagtgccctggtgggtggcacaccctgggcggaggcacgggccagcctgggtgcagctctgcccccggggcctcctacctgcatctggctggagacagatgcctctttctggacttctggcccagaggtgacagctgaggtcacccaaatgagcagcatcaggcctgcgggggacctggcagtgactggaggcctcgagggccccctcctgccaagctcctcttgactctgtgttgttttcttggctcacccacccccattcccaacgccaggtgtgaacttcaacccggagcactgcagccccaatggcaccgacccctacaagcctaagtgccccgagagcgacgcgacgcagcagaggccggccttccctgagtggctgacggtcctcctactctgcctctacctgctcttcaccaacatcctgctgctcaacctcctcatcgccatgttcaagtgagcgcctgggtggggctggcgtgcaggtgggtgggtgggcggcgttcctgggccgcagtggccacgctgtctccagggtctcgtggacagtgtggatgatgggctggtgcacagaggcgcgtcactcatatcctggtggagtgtgcacagccactctctgtggtcactgctgcgtctcttgagctggcgtgagtctgtctcttgagctggcgtgggtctgtccttgtggctgctggggacccgcggtgctgtggatccacatgggccctgctcacggtgctgctgcggaggcagcctcctcccgcagggcagggatgttggtgtcagcctcgttccttctgcgcaggcgcagcattattcatgagctcactgctctacccggggagcgtgctggggccgctgctgctcagggctgtccccttgtcaccccaagggctctgcctgtgtctccctgttactgagcaaaagggctcgctgcccgatgtgcaggaggccaatactatgacaccaggtttttgagaaaagaaaagcttttattctaggccaacccacaaggagacaggggcgcagttcacgtctgtctccccgcgctggctttaatgcagtgtttctattagggaaggttcgggggtgggttcttggatgagtaagtggctggtggaagaaaagggggttctggaaagttatgtctcctcataggtctcgtgtgcacatttgggcggagttactgggaccctggggtggaaactcgggctgtgcagactccagctggccacagtggttccagctgtgacctcagccagttccaaaagctcctgcaagcgagtctcagcatcccagcaggtggcttcttttcccgtctgccatctgtaagtgtgagcatttcggttagttgctgggttctttagctctttggggccggttccccagccctagacgtgttcctgctgcccccaccgtgtgcctcagacggcgctggctctgcggtgccttccccagagctccaatccatctgtggacggctctgtgtctgccctcccgtgccattggggtcttcctcatctgcacgtcttcacgtgctttgctggttttgtggatttgcacacacgtgtccacctcctctgggcctggtgtttgtggcatctgtggcagtttgaataacagcccagggaggtccacactcgaaccctgtggctatggggccctatgtggcaaaagggactgggagggtggggttaagtggaggatcctgaggtgggaaattatctggggttatctgcatgggcccgacatcatcacgaggggccgtggaagagggaggcggagaaggaatgtgacggtggcagtgagcgtcggcgggaggggagagcctcagcccaggaatgcaggcagcctctggaaggcaggaaaggcaaggcatggaggctcccgacctacgggaggagcacagccctgccgaaccttggttttagcccagtgagactcctgacctccaggactgagagaagagtctgattgctttaagctgccaaggccgtggcggttcactacagcagcatcaggagacccatgcagtagctgtttcttctctttgaaaatgtctaggattttctttaaatcctagtgtcttgaagtcttatcatagaacttttggaatgttatttgctattgttgcttttgaaacaaggagtacaaaataggtggctgtccatccggcccctggtggacgtggtcctctggggtcgtatctctgatcagccgcagcagctgtgggccccaggctttgggggttctgttttgctcttgcagcttttaaacttagaacaaattaaatgctgaggacctcacaccagaggcagcataaaaaagaactccagggaaccaggaggccacgcagaatgaaaacacaggtgtttggggtcctagtgggccccagggttggctctgggggttctgtggccaattcctagccctgacagtggagctgaggagcccagcacggctgcggagctgtcatggtccacagaaagcccagtctccccatgttgcccccataattcagaaagcctcccaggccctcagagcccttcccagcatctgcagacagaccctgtgctacccaggactctgaaaatccttgtgttcctggttttgttaggaaccaaccgtttctcttcttgtttcattggctaagttgctgaggttgccacctttcagaacgtgggttctgaacattgagagaacccgagcatgggccaggactgtcatctcgaggccaaggggctggtggcaggacactgtccctgcagcaagtatggcacccacacttccggctcccactgcggagggctctgtgcctgtcaccctgagacacaccaaggaggcccctgcagccctgccccttccacatgcacccctggagggtctggctcttgtgctcgtcagaatccacagatcaggtcctagagttcagtgccagacagtgtctgtctcctgataaacacccactttgtgttattagccagtgaggcttataatatcgaaagtctgtgtgcttctccttttttcttgctttggttcccaggaagcctggaattgtgaggtctgtgggctgagttctgtgcctggagctggcctcccgtgtggcgtggctctgctctctgtggcatcacagtgggcacgtgggcatggctctgctctctgtggcatcacagtgggcacgtgggcatggctctgctctctggcatcacagtgggcacgtgggcatggctctgctctctgtggcatcacagtgggcacgtgggtgtggctctgctctctgtggcatcacagtgtgcacgtgggcgtggctctgctctctggcatcacagtgggcacgtgggcgtggctctgctctctgtggcatcacagtgtgcacgtgggcatggctctgctctctggcatcacagtgggcacgtgggcatggctctgctctctgtggcatcacagtgggcacgtgggcatggctctgctctctgtggcatcacagtgggcatgtgggcatggctctgctctctggcatcacagtgggcacgtgggcgtggctctgctatctgtggcatcacagtgggcacgtgggcgtggctctgctctctggcatcacagtgggcacaagggcgtggctctgctctctgtggcatcacagtgtgcatgtgggcgtggctctgctctctggcatcacagtgggcacaagggcgtggctctgctctctggcatcacagtgtgcacgtgggcgtggctctgctctctggcatcacagtgggcacgtgggcgtggctctgctctctgtggcatcacagtgggcacgtgggcgtggctctgctctctggcatcacagtgtgcacgtgggcgtggctctgctctctggcatcacagtgggcacgtgggcgtggctctgctctctgtggcatcatagtgggcacgtgggcatggctctgctctctggcatcacagtgggcacgtgggcgtggctctgctctctgtggcatcacagtgggcacgtgggcgtggctctgctctctggcatcacagtgggcacgtgggcgtggctctgctctctgtggcatcacagtgggcacgtgggcgtggctctgctctctgtggcatcacagtgggcacgtgggcgtggctctgctctctgtgacatcacagtgggcatgtgggtgtggctctgctctctgtggcatcacagtgggcatgtgggcgtggctctgctctctgtggcatcacagtgggcacgcaggcggtgagaggggtctgttctgggtaaacaccctgacctcgaggtgtcgctttctcctccctgacagctacaccttccagcaggtgcaggagcacacggaccagatttggaagttccagcgccatgacctgatcgaggagtaccacggccgccccgccgcgccgccccccttcatcctcctcagccacctgcagctcttcatcaagagggtggtcctgaagactccggccaagaggcacaagcagctcagtatgccagccccagtgcctctcctgaatgtcctggccacccgggtgcagagggggtggagatggcatggcagctctgcccagaaccctggacgctcagcaggcgtgcaggtcactcaggctgctggccttctgctggccttgagcaagtggtgggggctgagcccagaggcccccttgggggcaggtgtgcgatgggctcttcctgccactcaggactggccccctcccacggggcccccccggtgggtcagggcttcagggcccacctcctgaggattccaggtcccctggtctgtccgcccaccctgacagagaacaagctggagaagaacgaggaggcggccctgctatcctgggagatctacctgaaggagaactacctccagaaccgacagttccagcaaaagcagcggcccgagcagaagatcgaggacatcagcaataagtatgggggctccggtgggcctgggggcgggaagcctctgggggacctcctgcaggtccacaggcaccatgagtacatgtcccacctggggaggcccagcaatgcctcaccggtgagggagcgctgtatcccgtggcccctgcaatgctgcaggcatccgggcctgtgcccacagctgacccaggaccctctgcggtccttaggaaggctgggccccacagggcgcagggtcagaggctgggagggaagccttggcggctgggggaggggcaggttggcccgcaggatccggcttggaggcctgggggcatgtgcacacggggtccaggctggtttgggggtggtttgctctgtgagcttgttggtgcacagccttattatagcttctgcaggacctcggcagcccagccctcggggtcagccatgctcagcaccgtcctccctctcagctcctcccatcttgcttctttccaaggtgcgaggtcagtgttgggggaacatctgctcccttctctccactgccaggccttccgccctgctaggtgtcagcagggcctaatggcccagcagcgggcagcaggaagggctgcccccagtgtcctgctctcagtgtgcgtctcaccatggcatgagaggaggagggggaaatggacacggtgccacctagttatggccgtgtggaggctcctgcagccacaaacaggagcatcctggagctggcaagggatggccaagaccaggccaagtgccctcccccttagagacatgtatgtactcctgcctttccatacctccctcaccttgtctgtaagatggagacacgatagtccctgtctcttggagttgtttccagaatacagtggggtcctgactgtaaagaattgagcacatatgctggaactataaccagggatctgctaacgtggctggtgcttttatcatcacccttacttatgagtagtgggggcggtggtggtgatggtgatgatggtggctgcgatggtgatggtggtggtggtgatggtagtggtggtagtggtgatgttggtgatgatggtgatgtggtggtgattgtgatggtggtggtgttggtgatggtggtagtgatggtgatgatgatggtgattctgatggctgtaatggaagtggtggtgatggtggtggtgatggtagtggtggtgatgttgatggtgatgatggcagtggtggtggtggtggtggtgatggtagtggtggtgatgttgatggtgatgttggcagtggtggtggtggtgatggtggtgatggtgcttctgatggtggtaatggtggtagcggtgatggtggtggtggtggatggtaatggtgatggtgacagtggtggtagtgatggtagtggtggtgctggtgctggtggtggtgacgatggtggatgtggtggtggtgatgatagtgatgatggtgattatgatggcaatagtaatgacgatggtgacaatgtgaggaccttaatgaactagctgatgtcaaagccccttctagctcccattctgagtgaactagatacacgtgtcctgtttgcttgagtctgggcatgatgacttccagttgagcccttggcatgctctttgcctagaacagtcttctcccagagagagtcaggacttgctgtctctctctattcaagcctcacttcattggagggcctttcctgccctccacccaccctgtccccatcccctgtcgttctggaatctggatgttggttggttggctggtgggtttgtgggttgtgtcatgtctaactgccaggctccatgtgagagtagggacagagtcccacatgttccccatagtatcctgggatgtagagcaggcccagtgcctagaaggcactgaggaaatcctatgcaattctggaactgctgttagttcctggcctggcagggttgcaggaggctggggtcgctggtctccaggcctgctcagccctgacgtttggctctgatggtccacttacagaggaggggggcctggggccatgcagtgccctgacaaccttctcttacttgctgttgccaagtacagctttgatggatggcctcgtctgggactttgagcagtggccatgcccagggcccagatgctgggggaaggtgcttgggagagtttctgaaaggcggcctccgcatgtcaggatgaagctggaaggccacagctctgctgatgaccaacatagtcagggctggaatatgatggctggcatgtgttaagggctcattgaggaccacacccttcacctgcatcatctcgctcaacccttttgcagagggaggtatttttccttccacttttacccatgaggaagtggaggcccaggaaagtgagagaggtggctcagcttccaccactggccagcggtgtggcctggaatgcaggccccagcaactttgcagcctcctgccttaagggagtgggctggaccccaaatgaatcagtcccaggccgggcgcggtggctcacgcctgtaatctcagcactttgggaggccaaggtgggtggatcacaaggttaggagatcaagactatcctggctaacatggtgaaacctcatctctactaaaaatacaaaaattagccgggtgtggtggcgtgcgcttgtaatcccagctacttgggaggctgaggcaggagaatcgcttgaacccaggaggcggaggttgcagtgagctgagatcgcgctgctgcactccagcctgggcgacagagcaagactccacctaaaaaaaaaaaaaatttagtcccaaatgcctctcagctcctgccctatcccagacatcttaaagctcagagctggtctgctgcctatttcccagcctaggtgctcagtggaagttgggcgcctccagttattttctgaggttgaaaaagcttaactaaaatataactttgcaggccaggcacagtggctcatgcttgtaatcccaacattttgggaggctgaggtgggaggattgctcgagcccaggagttcaagaccaacctaggcaacatagtgagacccccatctctacaaaaaataaaaataacaattagccaggcacggtggctcatgcctgtgatcccagctactaaggaggccacagcaggaggatttcttgaggccaaaagtttgagaccagcctgggtaacatagtgagaccccatctctacaaaaaataaaaaaacaacaacaaaaaaggaaagagtagccaggtgtggtggtgcacatggggtcagagtcccagctgctcaggaggctgaggccaggggttcgaggctgcagtgcgccatgatggtgccactgcactgcagcctgggtgacagggtgagaccctgactctaatgcatatttgtatgtgagtagaagttttcccaagatgagcctgcagaacgtgtttccgctgggccgctggctggtgtgctgagctgtcactcccattggtcagcagctcttgctcatccgcagaggggcctgggacagaagctgatgtgcttcagtcgacctgatcttgcagaacacgggctccagggaaagtgaggaaagagctcctcagcccgtaccaagggccctagcctggtcaccgtcccctcctccagtgaagaagctgggcacctgggaggcgcatgagtgtggggtgccataaccttgcagcactgaggtgagctgagttcaccaaagctcctcgcccacagggcagggctggagctttgggggtcaaggacaagctctgtctgcaaatctagacagttcctgcatctcacggtggtggaatcacgcgggtccgagaaggctccagtaaccaccctcgcatgtttgcaaggctgtctgggaaaacatggcaggtgcggttaagcggcttttgtgggattaagcaaaatgaaatgtgggtgaaaggagatgcccaggcctggagcgaaatcactttcttccctctccctagataactgtttaaagtgggtcatatccccagaaagtttctgtgttactaaaatagttgctcagtgtattataagaatatcacttgcagtgggcgctgtggatgaaaggaagtgagggagcccaggggacagcggatgagagctggagactcgggtttgcccacagagttattttaaccataaacacagcaggccgaggctgggcgaaacaaaataagacagaaaccaaacatttccagaataatagcgccgctctacaaccccacaaaataagacagaagccaaatactcccagaaaaacagcgctgctccacaacccccacaaaatacgacagacaccaaacatccttagaacagcagcactgctccacgacccccacaaaataagacagaaaccaaacatttccagaataatagcgccgctctacaaccccacaaaataagacagaagccaaatactcccagaaaaacagcactgctccacaacccccacaaaatacgacagacaccaaacatccttagaacagcagcactgctccacgacccccacaaaataagacagaaaccaaatattccccaagcaacagtgccgcgccacatcacccccaaaacaaaaccaacctctgctgtgcccagaggaagtttcattgtttgtgacctgtcacctggccctccctcagttcactcacctccccctctctcctgggaccgacaggctgccagagcttgccatgtgagcctcggctgtccgtctgctgagacatcttcccctctggggccctgggcagtttggttctatgggagaaatgcatgttagaaatagtttcatattaagaggaagcaaaggctgacacagggccttggtggctgcatctggcagggctgtctgcagagcggtgtggcgttcccagggccccaaggtgtggtgtgcgtccagctcagctgcttcctctttcagggttgacgccatggtggacctgctggacctggacccactgaagaggtcgggctccatggagcagaggttggcctccctggaggagcaggtgggtccgaggtcggggcctccgtcaggaggtgccactgctgggcctggtgggcggctctgccatgtggtggcaccaagaaggagggctctgagtgatggtgaggaggaggccggaacgttggggcagccattcccagctggaagaggcaccctgtgtgtcctccagaaaaccccgcccaagggtttctgtgactgagttccttctgtgtgcactgaggcctccacggccgggctgtgctcctcgctgctcccaggaaacagagtgcttctcccctcccggcctccagggaggctgtgggactctgtgcctgagccctggagaggccgcaagaccgaggtggggaggacttagagacggcctctcagggtctgctcccaccaccccatcaatgtccaccagctgggccgggctgtgctgtccaacaacagcacctgtggccacggcagcccctgcgggcagtgctgagccctgtggatggctcagccaccctgtgctgctgctcccagccttgctctgtggggcagggctgggacctgtgctgctggggcatccaccatccaccagtcctgcccgttgcacccaggggtctgcccaggccgccctctacccctgtcttggccatgctgggacccctgacagggtgcccagcactgagccacacgagtgagacatgtcccactgtcccctgtgggaggcgcatcagcctctggggaggctcctcctgggaggtgcaggaaccctggaagcctctggctttggcggcctgtgacctctccctgtggtgcagaattgcctgactgtgccttcatgctggctccatcctctggcttgtccagtgcagtgacagtcccactgttgtgtctcttggggaggctgcaccatcagatgtgtgacttggcagcccccggggggagccgggtgggcctggggcagcgttctggctggcttggtggctgcctggggaggacgtggtgtctcactttcaaagggcgcaggggctgagtgacaggggtggggctcctggctgggggagtgaagtctcggtgggcagtggggtgtgtaccatgcgtgtgggtggcaggtgctcactgtgtctcgggccatgccttccaggtggcccagacagcccaagccctgcactggatcgtgaggacgctgcgggccagcggcttcagctcggaggcggacgtccccactctgggtgagtgggtggccaggccagcagctggtctccagccgcctgtttcttttgggtctggggtcagttgggaggagaggcagctgggggtggggggctctgtccaggaggaaggcactggctgcagcctgttccaggcagggccagcgccctcaggaactcagcccacccaccgacgctggcgccgaggccccgcccaatccctgacctgacctggttcctggacgtccacggggaggcctggcctgctgtgccctgagctccccacataccgcactgcagagtgggggtgcgaggcgggcggctgcagactgtgtctgaacctggtcacgtaggctgagtgacgagaagcaaagtctgttttcctaaattcgcagccggctatgaaatgcacatcagtagccttcctcgggctgctgagtttcgccggccctcaaggagcatatttgccctcgtaaccgcactgcgagttcagctcattgccgagggccctgactgccgctgcacaaagaggcaggtgccggcggggacgctgcctgagctcccgtggctgtcctccctgggggccctgcccacttcagagctggtgttcgacctgcatggccatttgggctcggggaggtggaggagcccagatgttttggcggaaggaccacagaggaagtccttgtcctgcgggcgggcacctgagcccgggctccgccttgcgtcacgtcttcctgactgtccccagcctcccagaaggccgcggaggagccggatgctgagccgggaggcaggaagaagacggaggagccgggcgacagctaccacgtgaatgcccggcacctcctctaccccaactgccctgtcacgcgcttccccgtgcccaacgagaaggtgccctgggaggtgagcgcctgcccaagcccaaccaggcggagtggccgggcccctggggaggggagggcggccctgtccccatccatctggtattaatcctggctctcagccactgcagccacagggggatctgtgcgtctggcagcccctgtttgacatttgaggaaaccgaggcacagagaagtcaagtcacaggggcctcacagctggaggtggtggaggggcctgaggggggcacactgatccccacagagctcgaggcttaggctcctcccatgaccatcccagggcccagccccccggccccattcccccaggtcatgccctggtcctagaccccacccaccccggtgaatggctctggcccctttccaggtgccaggcatggaagagagacagagacacagagacagagagatggctaatggcccctgggagacccccgccctcctggtgcagggcttctctctggcctatccagaacattccaggctgctgcttccgctgcctccccttggtctctaccacatagaatcctccttgcctctagggtccagcttagccccctgccccactctgggaagacccccaaggcccccaagtcacggccacctgcccttcagctggccccagggtgggggtccctgatcccagcccccggccctgcccagcccccagctctgcctggcacccggatctgcccagcttggagcttctgccctgcatgttgggatgttggggtcgggttcagacccagctgagcagccctttcaccctggtgcctggcccagctttgcagtgggggtaaaaatctgagggaaaactccctgttttgcgacagacggagttcctgatctatgacccacccttttacacggcagagaggaaggacgcggccgccatggaccccatgggagagtgagtatgagccgctgtccgtgctcccagctggccccaaacccagggcctcctaggggctcccttgagaatcccagtcagagcccagcccggggaggtccaggtgagcaggaggggcccgtgggggcctgaaggggcccagctcctactgttgtgtacacccagcctgcagctactcggctgggcccttggtgggggggtgatccctctgcctgtctgctctgtcccacctgcaacacgggcacacagacacgccttctcctctgctcccagcaccctggagccactgtccacgatccagtacaacgtggtggatggcctgagggaccgccggagcttccacgggccgtacacagtgcaggccgggttgcccctgtgagtgtgccccctgcgggccccgccccgtcagcctttggggtttgcctggggggcaggtttcctctctgggcaaaggaagcatttttctcataaaacaaaatcaaaaaaagcacgtgagccaccgaaaggaagaaaacatcaactcactgcatctccgtagcccccaggactgggcttgggggcgtgggacttgccccctggcctcgggcaggccctgccccatggtccctgccgtaatctggggacgtggatttgtctgtgtacgtggggatggctgtgctgggagaggacgatgcctcagaggatgggcaggggctgtgcggcagggaggggacacggagatgggcactggcaggcttacctggccgggaaggtggcctcgcctggcatcctgttccccacaggatcggcgctgcacccatcacacaggtgaggaaacccaaaataaaggtgtcaagtgtcctgtgagcacctacaagtgccctggaaggaaggagcctgggagtcttggaccctgccatgaggaggaggtggaggaggggccaccagaacctgggactggggggttgccgggatgtggggcatgaaccatggagcagaggaaccaaagggtctgaaggacggggggactgcgtggcaggcctttgcagaatgctctggaacagggtgtgggctcctctgcctggagccggaggttgagtaaggaggtggtaggaggcgatggggcctgagagcagaggtcctggccaggtggctgcagctgcaggcggcccgctctggtgttgggggtatgtgggacgggcaagggcgggtgtttagggaggtgcatccggtggctatgggaagctgacgaggagagcagcaggtgcctggcatgggcaacaaggcgtgagcacctgctctcacgggtggctgccacacaggcaggtgtgtcaggacttggcaggacgtggtgtccatgcgggctttagtagtgcagaagagcactttctgtatgcaccatgcttctgttgtggacttgcgaatcatattttcattatatttccttaggtgtgttctctttctatgaaattataaagacacaccttcctatattcatttgatacattttaaaattagtttttttcactgagactttaatacagctgaaggctgattgtataaggtgtgaggaggggcctgatttattttgtgaattcacagagaaagtgagctgcctgacttcatttcctgctaagatctggcccctcccctgaggtgtggctcctccctgaggtgtggctcctccccttaggtgtggctcctccccttaggtgtggctcctccccttaggtctggcccctcccctgacgtgtggctcctccctgaggtgtggctcctcccctgaggtgtggctcctccctgaggtgtggctcctccctgaggtgtgactcctccccttaggtgtggctcctccctgaggtgtgactcctccccttaggtgtggctcctccccttaggtctggcccctcccctgaggtgtggctcctccctgaggtgtggctcctccccttaggtctggctcctccctgaggtgtggctcctccccttaggtgtggctcttccctgaggtgtggctcctccctgaggtgtggctccttccctgaggtctggctcctccctgaggtgtggctcctccccttacgtctggctcctcccctgaggtgtggctcctctttcaaagctctgtatgcctctgtcccagtcatctcatagcagatcatgccactatttgccacagcgttgcagtaatcctgactctgggatagcatgtctttaaacctgccttttctagtcttgagcctttagcttttttgtgagtttaaaagccagtttttctagctccatgacaaatccattgataagaattgtattaaatttatagaaaaatttgagacaatggacacttttatgataatgagtcttctatgactgtatttgtcaacatttatttatgtcttctctttgtccttccctaaagttttataattttgttcataaagatcttacatttttaaataatatttattcctcaggtatttgataacttttgttatttggggtaattataacatttttttctttttcttttttttttttttttttttttttttgagatggaatttcacttttgttgcccaggctggagtgcaatggggtgatcttggctcactacaacctctgcctcctgggttcaagcaattctcctgcctcagcctcctgagtagttggaattacaggcatccaccaccatgcccagctaattttgtatttttagtagagatggggtttcaccatgttggccaggctggtcttgaattcctgacctcaggtgatccactcgcctcagcctcccagagtgctgggattacagacatgagccaccatgcctggtgtataacatttttttatattttcaatttttaaaaatatatataggggcattattaattttgtttgctgactttgtatctaacaactttattaaaccttctcgttaattatataaatgtgtttgtagattttctatgtaaataatatatattctgcaaataacaatattgtctttctccttacaataatcatgcctcattcctttttcttgccttattgtgctgggtaaattcttcagtgtaatttagaatattggtaatattaacaggcttccttgtttctgacttaatggaaatgctatcaacatttcaccattaagtatggtatttactgaagaaatttataaataccttttattggattaggaatgtttctatctagtcccaatttgtcaggggctgaatgctactaaatggtttttctgccattgattgagatagttataagatgtttcccctttagccaattagtgtgtgaattatttttatagctcctttagtgttgagccatccttgcattcctggaataaactcttctgttatatttaacgtactgctggagttaatttactaacattttacttaagattttaaaaaatctgtgttcaaaagtggaatttgcctataatttatatttcttgtactgtcttactttggttttggtatgaggttataccagtctcaatgaatgagctggtcagctttccttcttttctcttctttacaaagaagagaatgtttgtatgaggtggagataattatttgtttcttaaagtctgataatacttagctatataactgttagctctaacatattttgagcaagtggatttctttttttttttttttttttttttgagacggagtctcgctctgtcgcccaggccagactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatcttctgacctcatgatccacccgcctcggcctcccaaagtgctgggattacaggcgtgagccaccgcgcccggccgagcaagtggatttctaactactttatcttccataatgatttttcgaatcttatttcctgtttcttcttgggtcctttttagtaattgtaaattttctggaaaattataatttcatctaacttttgaaatgtattgtgtcacagatgtccataatattcttttatgatttaaaaaataatataaatatatagtaatttctcttttgagcattgatatttattatgtnnnnnnnnnnnnnnnnnnnncccgccaccgcgcccggctaattttttgtatttttagtagagacggggtttcaccttgttagccaggatggtctcgatcttctgacctcatgatccacccgcctcggcctcccaaagtgctgggattacaggcgtgagccaccgcgcccggctgagctggtcagctttccttcttttctcttctttacaaagcgagaatgtttgtatgaggtggaattatttgtttcttaaagtctgataatacttagcttataacgttagccaacatattttgagcaagtggatttctaactactttatcttccataatgatttttcgaatcttatttcctgtttcttcttgggtcctttttagtaattgtaaattttctggaaaattataatttcatctaacttttgaaatgtattgtgtcacagatgtccataatattcttttatgatttaaaaaatactaatataaatatatagtaatttctcttttgagcattgatatttattatgtatttctcttctttttttttttgattattcttgccagtggcttaattttataatcttttcaaaaaactaacttttggatttgttgattatcttaatttttcgatctcatccatttttgcttttattgttatctttccttcctttctacttcttatggatttgctcttgatttgtgtgttagagctcatttttattcaactttcctggttttctaataagggtacctaagactgtaaattctctctaagacctggtaggctgtaacccttaaattttgatgtgtagggattttattttttactttatgaatttcattataatcttcattttacacttttgttttgctcttttttttttttctttttgtggagaatgaggtcttgctctattgcccaggcggatcttaagctcctgggctcaagctatcctcctgcctctgcctcctcaagtgctgggattacagatgtgagccaccacgcccagcatagtcttcatttgattgtttagtgatgtacttttagctttttttatcttgagatggagtcttgctctgtaccccaggatggagtgcagtggtgcgatcttggctcactgcaacctccgcctactgggtcccagttcaagcaattctcctacctcagcctcccaagtcactggaattacaggcacgcaccaccatgccagctaattccttttgtatttttagtagagatggggtttcaccatgatggtcagcctggtcttgaactcctgacctcgtgatccgcccgccttggcctcccaatgtgctaggattacgggcgtgagccactatgcctggtcatgtgcttatagtttttaagccattctttgttatcaccttctagttttattgcatttttgttggagcgggattggcaacacgctgattcttgaaattgaaatgtcctccgtggcccgtctctaccctgggttgttgcagctgtttggctgtaaccctaaactaacacctaacccctaaccttaaccctaaccctaatcctaacccctaaccttaaccctaaccctcttggcccattcacaacagcagcctgtgtgagcttgtctgactcaagtcattcacacactcagatgccctttctggtataggagtgactgtccccacgtctgtctggggccagccccctcactgtattagttttctatggctgttgtaactaagtaccacaaactggggggcttaacagaaatggattatctcacagttctgagggccaggagtctgaaatcaaggaccacactccctctgagggcttgaggggagacctcttcctgcctctccagctcctggtgttcctggcagcccttcgtgttccttggcttgtgatctctgcctccctagccacatggcctctccctgcacgtgtctgtgtctcttctgttcttaggattataaatcgtactgggtttagggccaaccctattccagtgtagcttcatcttaactaattacacctgcagacactatttctgaacaaggccagattctgaggttctgggaaggacatacatttgtgggcattgttcaccccagtgcatctttgtgctagacccatctcccattgcctttcaaggacctcatcccgggaatgtcctgctcctcctgcacccgggtcctcctgccctcttgcattgctcctgccaacataaactaaacaagcccctgcccgcaagtcccttcctctttcgaatccactccacttgggctttgcttgccccctctttctgagatggattgaggtcaggtcagcaaagattctgccttgttcaacccataggccagctctccacccctcaacccacctgcatttctggagctgagtggatgagtgaatgaacgtgtgattgctgtagccagactgtcgctgtttttgcgctttggggttgtgtgcgtaggtttatggacgggcctatgccttgatgtcgtgatggaactaccgggcacgtggcagggagatgaggggttgagaaccatatggacgagatcatgaccgggggatcagagatcagggcacagtgagagcagctgaagactcaggtgtggggtgggggctgcggtgggaggagggcagcatggtggtccgaagcccctgctgcccggcccgctcaggctgactgagaagcaagggtgcagagtgtttgtttccctcctggcagaagcgagcgtgcatgtggtaggagctggcaggcccctaacctccctcctggctctgccactggccgactagggatggggacagtgagatgacagcagggccctggggcccagagcttcctgtgggggtggactcatgccaggcagagcgtgtggcctcctctgtgagcttcttgaccaatgcactgcactcagcacgaacagcagttacagggagacgaggcagccttgctcccagcagcacgacctctgccttcctctccttctggagctcagtgcagctctgcccagtgccgaatttgtccgtggccttggttctgggttctgcccgctcagtggcgtgagtgcaggaaggagaatggtggctggcaagggcggggtggacgggagtgagagacgggcttggggttgaggggaggcagcagtgaccctcgcagggaccctgactgagccccggccttcgagctgaggtccccaagccttgctgcatgtgttgccagctctgtagctgggtggggccggggctctggtttctgagcagcttctggggaggctgcctgggccccaccgtgcaaggccccccggccacagaggagaccgcagagtgagctgggagggctgtctgagaggcctggccaggtgggccctacacactgggcatgttctggtgcggactctgatcgctgtgggctcgggcaggtctgcgcagaggtgtgacgagagctgggacccctgacagctgggcgggaacagggtggctgctgaggggtaacagagaggaggggctgggtggaggcagggaggccagctggaggctgccccgccaggcagggtcagggacggtagcgcaggcctggctggtggccgccggtgctagaggtggtcagctgtcctggggcagccacggtcagctgtcctggagcagccacgcactgccgcgcagactcaggaggatggagtctaggctgtggggagaggaggccatgaggggtgggtcagaggctgcagctctgatggggtctggaggtcagagtggaatggtggaggaacgataccactgtccccactgtggcatggatggtggtggggactgtggtggggacggtggcggggacgctggcggggactgtggcagagacgctggcagggatggtgacggagactgtggcgaggactgtggcagggacgctggcagggatggtgacggggactgtggcggggacactggtgttgggaacgctggtggcggggatggtggcggggacggtggcagggatgctgtcggggactatggcggggatgctgctggggaccttctgtagacgtggatgccgcccccaccgcacgatagcggcggtgcatttcttccttctgttttagtggtacattcacaggaaatcacccgtttctagaacttgctgtttcatataggacctggtggtgtcagggagaccagcctggccccatgggaagcgtctgtggctcctgctgcccgtggttagcacactctgctgggggtctgtgtggcctatcatctgtggccacacggacgcagggcctctgggtgtctggcctggttcccacactgcccctcggaaggctgccaggatggaggccatgctctcgcgtgctggggcctttggatgcaaagtgctggcccgagcagtcggccagttccatgctccgtggggagaaggtggccactttagcccctcgctggcctgcagtggccggacttctgctcccagggagacccttcccccaccaggtgaccccaagttaacccagagccttggtctcactccttgggggtcccaaagggatcctactccctaggccagagcaggtctctaaagaagcctgcatgctgtcccgctgtgcgccggctcctgacgcccgctgtcccctctcagtccccctccctgccctgtcctgctcccccattggtggacggtggactgactcaacccctctgcatcccaggaaccccatgggccgcacaggactgcgtgggcgcgggagcctcagctgcttcggacccaaccacacgctgtaccccatggtcacgcggtgagttcatgtgtgccgggcaccagcacctcagcaaggcggtcaccccaccttcacaaggggcggctgccattgcccagtgctcaggggccgggagggcggctttgatgcttggcacttggtgcctactggggggatgcgggaggcgtctgtggataaacgtgaatatgcccgaaatggggcaggaatgtccatgctgcccatcctggaggaagatcccaggacccatcccctctcccggggctgccttcactttcctgccggtccctgcccattagagggcaccctccacggggacacagccccacactcacccctaagtctcactcctccattcccatccacggggacacagccccacactgacccctcagactcactctccacacccatccacggggacacagtcccacactcacccctcagacccactctccacacccatccacggggacagagccccacactcacccctcagactcactttccacacccatccacggggacacagccccacactcacccctcagactcactctccacacccatccatggggacacagccccacactcacccctcagactcactctccacacccatccacggggacacagccccacactcacccctcagactcactctccactcctatccacggggacacagccccacactctctcctcagactcactcctccccacccatccacagggacacagccccacactcacccctcagactcactctctactcccatccacagggacacagccccacactcaccccctcagaccctctccatactcatccagagggacacagccccacactcaacccccaccacaggctcattcctccacacccattcacacacagggacacagctccacactcaccccctcaggctcactcctctgcactccagcagctggcccactgctctcacccaaggcacgggccgccttctgtgcaggtgcagacgcctgcgtccctgaggaagctgccgggggctcttgctgcccccattgggcaggaatgggattctggggcccaggcccagctgctgtgccctgtgctctctggggcctctgcctccacagctgggacctccccccagcggaggggcctttggcttcagggtcctcttgctgcccagccactctcacccagtggcttctctggccgtgcagacatggccctggggtgcgagtcactctctgctccccagtcctttggcctctccttggcctgcccaggtggcactcggcaccccacgtcacccccacgtcacccccgcgctgcactccgcaccccatgtgacccccaggtggcacttggcaccccacgtcacccccatgtcacccccatgtcaaccctgggctgcactcagcaccccatgtcacccccacatcacccccaggtggccctcggcaccccacatcacccccaggctgcactcagcatcccacgtcacccccgggaggcactcagcaccccacatcacctcactggattcccactggcattttctaagagtggtcaaactgcaaagctgggtcaaagggcaggtacctctctaaggattttaatgtttaaaaaattctccatgaaggctgggtctctttctagttctaccagctatgatggaagtgaagaaggacgtcccctaagtggttactatctcagtcttttccctggggatgaagaacttgaaaaagaacacggtttgagcctgcagtgggcctgacactgccccgccccaggcagggccagccccgccgcggcgcaggggagggtggaggccgcagcgggtcctgggcagccatggccgctctctccgcaggtggaggcggaacgaggatggagccatctgcaggaagagcataaagaagatgctggaagtgctggtggtgaagctccctctctccgagcactgggccctgcctggggtaaggctgccgcgtgtgggacctctgtccactgggctgtctgtgggtcactcgtccattcatccattctgcccacggactggacaccagccccctgcagccccctgcagcccctgggcagggagggttcgagaccccgcctgttttgtctgtagaagacactcctcctcccttttcctcatgttgcagttaggaaaacccaggatcagaggatcttttggtgcataaacactaacggggcacctactgtgtcccaggcatgggctgggctgcggctggaggccacctgggctccccttgtggagttcagggtgttgggggcagaggtagctcttctcccgtgtctcagacaccaaccagctcctgaccttcagggccaggtgctgagccataaatataggacggtgtcatccaggggtaggggcaggtacaggagtaggggcaggggcagcgacaggggtaggtagggcccagggttgtgcacaggcccctcagctcaggggctggttgtggggctgaggctggagcgcaccccagcatcttgtggggaggggtgcacacaatcaggacagatggcctgggcctttcctgttcaagtgcctccaacagctcctgtttcctcccaggccagcctggcctccgcagccctccagcccgctcactgcaggggatggaagaggctggtcctgccaggaggtctgagtcctgccaggcctggccgtggcgcatggcctctggggtacagcctgccccgcagggcctctcctctgcacctgatccggggagtctgtgacttacaacaactcagcaagaagctgttgcatttctctgaccccgagctcacggcctggtggctgcctctgctgctgtgggagtgtgtgtgccaccacggtgtgcagggcagcagtgccacaagggcctctgggcaggaacggggactccggagcccaggcccagctgctgggtcccagtgctttgggggcctgtctccacagctggaaccacccccgcagcagagggggcctttggccttggggtccccttgctgccctgctgcgctcacccagtagcttctctgcctgtgcacacccggccctggaacacgagtcaccctccgctctctggcactttggcctctccatgcggggtgcgtggggttgggtttgggggtcccactcactggcatccctgtcagctcaggctggtcactgagaggggcactctgaggggcctcctgggttcctggctctgtagggcacgcacgcttgagggtgggagtgtcatggggctgaggtgggaccgtcttgacgtggcctgcaaagtcttcatgagaaacccacgggtgtttcagtgggactttgaatgacaaatagggtgggaaagatgggtgtggggaggaggaggtgcaggccggagctgggtccctgagtcaggtggcgctcgggagcgtctgggagcccagccagccgcagcacaggccggggtgggactgggagagacgggaatgcaaacagggaacccgccgtggcagcctgctgcactgggcgggagctgggaggggcgacgcgggggcaggcgccaggggagcgggaagggggtgccctgtcacccttggggagtctgagctcagggtgggtaccctgggggctgtccctgctcctcagaggttgtgtctgcagcccagtgccccctgctcgggccacggcaggcctcacagatgctgacgtggacggcgggttctgggcaatgtcactgcagcctgagatgccgcctgcctgtggctcccagggctgggccgctgcccacgccgggcaggaggccagtggagacgggtgccagggcagcctgaggtcccgcttcggtgccctgttgacctgcctccgtcctctgtctgtccagggctcccgggagccaggggagatgctacctcggaagctgaagcggatcctccggcaggagcactggccgtcttttgaaaacttgctgaagtgcggcatggaggtattcctggcctgtttgctctgttccacctgtgtgtccccagggctgcaggacaaacacagtgtgatactggggacctgccccagcaccactgggtggcagcggtcccacccagcttcaccaggtgacggtggtcccagcccctgcccccacgttgcacagctcccagaggacccggaagcatagctgtgtgcagggcccctcagacatctcgccctccctctctgttccattttctcctctctaaatcaagggggatgggctgaggacccttgctgccttcgagtgtgacagctgcttggaggcctggtgccgccctcctccccacatccacccttgcctcgagcacagctgcgcccaagggtgctgggaagccagcccctccctcagacctcgccccgactcccaagctctggaggggcccttcccacatgcatgcccagcctggggaccgactgtaccaggactttttatttacttctttagaaacctcgatctttccttagaaagcctccatctccagctctctcacacaaatgcatgcacactttttttttaatttttatttttggaaacaaggtcttattctgtcacccaggctagagtgcagtggtgcgatcttggcttgctgcagcctccacctcccgggctcaagcaatgctcttgccttggcctcccaggcagcaggggctgcagcggtgagacaccacacccgtctaatattttgtatttttagtagagacagggtttggccatgttgcccaggctggtcatgaactgggctcaagcgatctgcccacctcagcctcccaaagtgctgggattacaggtgtgagccactgcgcccagccctttatggacgctctttataaaagcaggctacacgggccgggtgcgctggctcacacctgtaatcccaacactttgggaggctgaggtgggtagatcacttgaggtcaggagttcgagaccagcctggccaacatggtgaaaccccgtctctactaaaaatacaaaaattagccaggcctgatggcgcacacctgtaatctcagctacttgggaggctgaagcagaagaattgcttgaaccaggcggcggaggttgcagtgagccgaggttgcaccactgcgctccagcctggggaacagaaagagattccgtctcaaaaaaaaaaaaaaaaaaaaaaaaagtgatcaatgccatggtgtggagcacttcacaacattgtgcagccaccacctctatccggttccagaacgttccatcaccccagtcacccccagctcctccccagcactcccgcatctgcttcccatctccttggatttgccggttctgggtgtctgttatgagtggactcctacaacaggtggcctttgaaactgtcttccttcactgagcagacgtttccaaggcgtttccaagatctctgcagggcaaggacgtgtctgtccaggatgaagcccgcattgggctgctccgccttgcaggcccaggcaggctggcgggggctggggagagctgggccggggtcctgtgtgtgctggaagctgtgctcagagctgggtcagggtggagggcacgaggtgggccggggcaccgctcaggtgtccctcgctgtcgggcttaccctgccctgcccatccaggtgtacaaaggctacatggatgacccgaggaacacggacaatgcctggatcgagacggtggccgtcagcgtccacttccaggaccagaatgacgtggagctgaacaggctgaactctgtatgtgcctggcctccctggaggcgggagtggggaggcagggacgggtatgggcgtggcctccggggagggggttggcagggatgggggtctggattctggcaggctgaactctgtatgggcatggcctccggggagagggaaggcggggaccggggtctggattctggacgtgcctcgagggcttccaagggagggacctggccgtgctcctggggcccagggccagaaactggaggctacagggtcagagtcttgcccagaaagtgacaaagggggcaccagggagaggccggggagccacctcaggtggccagagctcacagggctggccaggcgaccatgagggccctgtgtagttctgggacctgggtcctccagggaggcctcgaagatggcatccaggggtgaggctggcaaggccccctcagcccccggctgccggcttttagctctttatggggatgtggattcccagtacttggattaatcctgcatgctcctaattcagaactgggatgggaaattccataaataaccccgggctttaaatgcgggctaaatagctcccggcaaagctgcacctgcatcttcttcccctgaaggatcctcagggccttgtgggtgcatctctggtgcacctgacgcaggggtcctgcctcccatttcacagaggagtaaagggagggtgtgcaggccccaagccctcgaaggctgcagtccgtagggctcagctgggcagaggcagggctggcggggagggtcagctgtgcccttgttcttccagaacctgcacgcctgcgactcgggggcctccatccgatggcaggtggtggacaggcgcatcccactctatgcgaaccacaagaccctcctccagaaggcagccgctgagttcggggctcactactgactgtgccctcaggctgggcggctccagtccatagacgttccccccagaaaccagggcttctctctcctgagcctggccaggactcaggctgttcctgggccctgcacatgatggggtttggtggacccagtgcccctcacggctgccgcaagtctgctgcagatgacctcatgaactggaaggggtcaaggtgacccgggaggagagctcaagacagggcacaggctactcagagctgaggggcccctgggacccttggccatcaggcgaggggctgggcctgtgcagctgggcccttggccagagtccactcccttcctggctgtgtcaccccgagcagctcatccaccatggaggtcattggcctgaggcaagttccccggagagtcggggtcccctgtggccccctcaggcctatgtctgtgaggaaggggccctgccactctccccaagagggcctccatgtttcgaggtgcctcaacatggagccttgcctggcctgggctaggggcactgtctgaactcctgactgtcaggataaactccgtgggggtacaggagcccagacaaagcccaggcctgtcaagagacgcagagggcccctgccagggttggccccagggaccctgggacgaggctgcagaagctctccctccctactccctgggagccacgtgctggccatgtggccagggacggcatgagcaggaggcggggacgtgggggccttctggtttggtgtcaacagctcacaggagcgtgaaccatgagggccctcaggaggggaacgtggtaaaacccaagacattaaatctgccatctcaggcctggctggctcttctgtgctttccacaaataaagttcctgacacgtccagggccaggggctgtgtgacggctgcctgaagttctcctcgatcccccggtgagcttcctgcagcctgtggatgtcctgcagcccctcagccctacccccaagtttctcctctgacccatcagctccctgtcttcattttcctaaacctgggctccagcatcgtccccaagcccaccaggccaggatgcaggcatccacatgccctcctccttggcttcccctgcgtggtggtgccaatgtgccctggcacccctgcagaggctccggatggagcctggggctgcctggccactgagcactggccgaggtgatgcccacccttccctggacaggcctctgtcttccacctgacccaaagctctctagccacccccttgtccccaggtatccccctcaccccatcagcgtcaccaaggacacaactgaccccttatgccctgcttagaatcagtcccgtcaccaacttttgtgacggagtcaccttggggtttgataaaaatgtagatcttcaggcccctcttgaagctcagaggcagcagggctgggaggtcctggaagctgcatctgtggtcagcatccgccactcccaaggggctcgcaggtggcgggtttgaaccacaaagcagcctggatgtggcccaccccacccctctccagctccctctcctgctgcagccaatccatgctcccttccacggtgcaatgcagcctccacgtgcaatgcagcctccacgtgcaatgcagcctccatgtgcaatccagcctccaggtgcaatgcagcctccacgtgcaatccagcctccaggtgcaatgcagcctccacgtgcaatgcagcctccacgtgcaatccagcctccacgtgcaatgcagcctccacatgcaatccagcctccaggtgccacagggaaggcctgtgactcctcggttactggccgtgggtccagacctctgccagggaccatgttgtgctcagtgctcctgtttctagctgcaccatcgggctgagctcccactctctggggctggtctcggctctgtgtctgcaggatctagaaacacccatgctgaaggtggcacccagggaaggggtgggggctgtgcctgggggtcagaccagagagggacgccaccaaggggatgggcgtctgctctgctcacttgaaacacccatgacacgaacttcgccattggaaccatttcagctgcacagtgcagtggccgtagacactcacacggctgtcccccatcaccaccgtgccccctgctctgcccactcctagaagcgctgctcctccaacccggggctgctgcctactccagcagcgcccccagggggccccgtggctgagctgtctgtgggtgcctgcttgggcccagccacacaccaacagcggccctgtgggaggaagttttgcctccttttgtagagggacctggggtgcggagagggcagagggcttgctcagtcctctcagcagctgctggcaaagccaggcctggacccagctctcctcggctgtgccgtgcagcagccacagaggtcagcggctcttcgaaccaaatgggaaaccaggacatgcctggtggaccacggactttttgcgagtcaggcatgaggccttctgatcattcactcatcccttcctacctggttgctgagcctgtctgtgccctggggatggggatttgaggggtgcagtgatgaataaaacccatccctgcccgagggcctcacaatcctggatgaagtccactcaggaccgcaggagccggaccgggtcggaggccggggaagagcaggcattccagcggaggagtcagctggcttctccagtgaggcggctgagagtgaagactccaagggcagaacaaacagcaaatgggagacaggcaggggcacgttccacagcacagacgtgggccagcccgctgggggcagtgtggagcaggcagtgccctcatccaggacctcagcattgaaggaagcgagggttctgtgaaccgtggtctcttagaggtcactgccctctgagggaagagctcacagtgagcaagatctgggtgggggctggcgggagggtgagcggaagctggctgaatgcagacacgatggccagagctccagcagccttctggggccatgaggatgaggcacccgctgggtgtggtggagtgggaggtgacaggctctttagggccccgccctccagagtcctttcttatgtgagaagggaatactgtgtgttaaagccactgttattttgggtgccaaccaattttaacctaaaattggttaaatatgcagccaaccaattttcatggaatcactagacaacccagaaccatcaaatgtttgaggaaaaccaatcactaccaaaaaggggcccc

SEQ ID NO: 12213 - DNA, 6108 bp, Human
ccccaccccctgcaggggctctccaggcttcccaaccaggtccagctccaggccctgttccctgtccccagatcacaccgagtcagcagccttccctagacccgccgcttcctcgctccgcgctggccgccccctcccacccttgcagcccctctcagtctccgcctgccctgactgcgccctcccacgcagacacgggactcaatccgcgcctcggccgtcgggctccttgggactctggtgcgccggggccggggcgggctccggctggggctccgcggccccctgcggaagctggtgctgcagagtctcgtgccgctgctgctgcgcctgcatgaccccagcagggacgctgctgaggtcagcagcccccgacaccatcccacccctatgccatccaacactcaccactcccaccgtgcctcccctccgacaattacaggtcagggactcacccatcccaaggacctcagtggcaggtgtgacgggcggccaggttactactgctcttcccttgagcagaatcaatccggtctcctgccctgggctcttctgcccctcacccgatgcccttgctctccctcttcccaccccaccttttgcctttctacttcctggacccctgacccggctcacttcccctatcccagagctcagagtggaccctggcccgctgtgaccacgccttttgctggggcctgctggaggagttggtcaccgtggcccactatgacagccccgaggccctgagccacctctgctgccgcctggtcagtaggggaagcaaggtgaccgcaagggggtatgatcagcagcccacttgttccagggttcaccggggcccccaaccgtttctactgcagccaaaccagataggctactggtggggcaagtccaaggtctccgaccatgccacctgccctgggggctcccctggaaccccggcccctggattcagctctgcagcctcctccgcactcaggatcagccctcctgtcctgccactagcccttttgtccccaggttcagcgatacccaggccacgtgcccaacttcctgagccagacccagggctacctgcggagtccacaggaccccctgcgccgggcagccaccgtgcttataggtgaggccgcccggggtcacactgcccctggcaccggggctttgggagctgggccagcctccccctggggggctgtggggcctgcactcatgcatctgctgtggtccaggcttccttgtccaccacgccagccccggctgtgtcaaccaggacctgctggactccctgttccagggtgaggccccaccttgccaggggatggtgtcctggagacgtggctggtgctagggcggagtggacgggagcggtgggtggagggccagggacccgggcactcggccctcctgggctccccagcctgagcctcgatctcctcgcagacctagggcggctgcagagcgaccccaagccggccgtggccgcggcagcgcacgtgtccgctcagcaggtggcgatgctggcccgcgcccggggctgcccccgcggccccgccttctccgcatcgccccgcgccccgcccggcccccaccagtcttcgccgacagccccttccagcgccggagcgtcgcgggccgctggggctgctccggaccccgccgagcctgaggctcgggctggggccgagggccagggtccgactcgggcaccccacgcgcatagcagcctgtccccgccctgacggaggggctccctgggcctggtgctggacgccaatgccctcccccaccccccacccccgtgacccctcttcaggcacccaccaccctgatggtgacagagggggacagccagcacccatctgtccccgtcagggctcttgctctcacagccccctggagcatgccccatgccccaaccttgggcctggctcctggcccagatggcacctggcctcttgagtctgctgggggaccccaaagttggtggtcccatagcctgccctcctgggtctccacctcatgcctggacaggacgctgtggcctgtccgggccttggccagccctgcagctgcacccccgatcctcatccctcaccccattccctgccagcatcctaaggctcctggcgggcatcctctctgctcaaaattattgacctgtctcccggccacacctgctgtgccctctcagccaggccatcatcaccccctgttcattatgtcaggcctcatgggagcctggccttctccagaagctggccccggcgtcctcccaagctggaccacgtaggccccagatcacacctgggggtccagatgtaggggtcccgtgtgcacgcccaatcagaccgagcacttgtgacactaccccaacacctctcccagggctgaatgaggaacgcgccactggacacatgaggaagaggctgccctgggagctactgatgctgtgacctcacctctctggctttgggcggcaggtccctgcacctaggatgcctgcctggaaatgtccttgcattcgtggcctccttcacagcctcctcctcagagaagcctctgcgagtgcacagggagtgtgtgcagccttgtgaagggctgggaccacttgcccagactggggcccctcaggcacaggcgtggggtcctactgacctgtctccccagctcccacacagaaagcatctaaaataaacacacgtggatggaaagcgttgggcatctgttttgagtgtggttatgggagctgaccctggtccaagatctggctcaggctggggtaataggccatagtccctgatatggccccaggtagagtcagtttggcagcagggttaaaggtcaggcaggctccaggcacaggctatggccaggtcaggttgggttaaccctaagacagagaagctgcgctctggtctaacaggcatggaatggatggggttagagctgtcagcaccggggtgagtgtctctttgcaggtcatatgcaggaagctgaggatcaggtgaagggcccgggtcttcgtggagtcaggggcaaggtttggtggatgagtttggagcctccacagcagataccaaaacgggattcaacataccagaaacagatagagagaaagaggccagagaggccagaggccaccagatgcccagtgaaggtcagatagacggaagccccatggacgtccgtgctagccttcaggaagctctcaaaccagccatctgtccgaggtccgcacctcccaggacgggctaggagcacccatggggggcacaccctcggcactggcggggacgggtttcgggacacagccacatggatcgtctcagtagcagccccaaagagggaagcaagcccggcctccttgctcaccttgcaaccaggagccaggccccagggcaagcatgtgctgcccacctagcacaggcttgcccacaccccacagcacgctggacagtctggtgggcaaacccaacagtgatgccacgctcaccccagatgggggctgaggcggggagctggctgtggtgggcaggcagcacccctgcgctcctccccctccctcatggtgcccgggagagtccgcgccgtcctgcggcaggctgtgtgcagcgcaggcgggcttgccccatacagctccctgttaggagtgtgtccagccccgccttgctctggcactgcccagaacctggttgccctgccaggagtgagattcatgcaaagtccacatggcctctagagtgtgactcttccctgctggaattcctgggaggctccaggtggcacagtgggctggtccctccatggggatgctgtgtccccagggtccatcagatccacctgcagagagcccaccccagggcaaatattccaacggggtctaagattggagggcaagagggcaggtgcaccctgacactcattccctttccacctccagccagtgggccgggacagtcttggcctggatgcccaaacaatctctaacgggccatgttgccagagagctcattggtggtgcagctctcaagatggggctcaggtgtggcctgtcacatggcatggccttgccggtctcagggccccgaggctgtgccttgtgtgcctgcctttccaaatgctttctaggacccgggctactcccaccccactcaccctttcaagtcacccgaaagggttttcaaaggaggaccatgagtctgagaggcgttgagtttgttcctacactgtgggtaggagtgtctaggagattctgtaacttggatctgagatactggagtttgttttgtctcctgtttcaatgttaatgtcactattcatagcaataccccatctctacaaaaaatgaaaaaattagccaggactggtggtatgtgcctatcgtccagctactcagcaggctgaggcgggagaattccttgagctcaggagatcgaggctgctgtgaaccatgattgtcccactacacagcctgggtgacattgcaggaccctgtctctttaaaaaaaaaaaaaaaaaaaaaaaaggccaggcgcggtggctcacgcctgtaaacccagcactttgggaggcggaggcaggtggatcacgaggtcaggagaccgagaccatcctggctgacacggtgaaacccctgcagtgagccgagatggcgccactgcactccagcctgggcgacagagcgagactccatctcaaaaaaaaaaaaaaagtctgctgggtgcagtggctcacacctgtaatcccagcacttcgggaggccaaggtgggtggatcacaaggtcaagagatcgagaccatcctggccaacatggagaaaccccgtctccagtaaaaatgcaaaaattagctgggtgtggtggtgtgctcctgtagcctcagccactcgggaggctgaggcaggagaattgtgggaggtggaggttgcagtgagccgagatcacgctactgcactccagcctggcgacagagagactccgtctcaaaaaaaaaaaaaaaaaaaaaaaaaagtcactgttgggcctggataccaggttttctggtggatttaatgtcccagttgtagccaaatccactgttccttctcttttgcaagctctgcaagttgtgtggccattgtgtgccctgacagaagtggggaaggctggcgaccatgtgcaggtagactggtccccaccaaggaaggttgtccactctcccaggaacaatcactccccggccacgtcaagtgttgcgtgtccctccctggacgtggaggccacagctgctgagctcctgcaagtaagcaactggatgtgaccctggacctgcttaattcccacaggccggagacctcctctctccaggctcttagctcaggcaagcagatgtgggtgaaatgtaccaaaggtcagtttctttagtactgcttccccaggaacctcctgtgtggccccaggagggcagggcctgtcatcagtcacacctgcacccctaaagcccctgtgggccgaggatggctacacccttcagcacatgcctcaagctccctgaagcagaggttcctgccatgcctcagccacagacacgcctggtggaactgtctcacctaaatcgccctgcccttcctcacaggtagagaaacacacaggcaggggtgggcagggccatgggcccattactctagagagcggccaagcccagcatggggctccccttagctccagggtgcaaaagaagccgggcaatgcagacatcacctgcacttggccctgatgtccctcctgatcatgcatgggtactgtccccacccctacccaccctaccccagatccaggacccctcaaaaactctgctaccagcctttccttcgtatgccacctttattgtgtttccccaactcctgggccccatggtagactggccacatggctactgggctcctggccttcctagggctagcagctggtgggcaaacactctgccctgctggagagctgccaggccatgcccgggcacaggctagtggggctcctggctcagtcctgatagcagtgccagggaggcgtagagtgcacacatgcggccctgggcctgcggctcccagcacacgtggggagtgtc

SEQ ID NO: 12214 - DNA, 64610 bp, Human
  misc_feature (1)...(64610): n = A,T,C or G
taagaaaactgatctttttaacttagctaacactttttaaagaaacgacctcagtaaaaatataaatgatgttaaagaatctgtatgttaaaagcctagtaaactgataatgttttaatcttgaaatttgaatataattaagccatgtatcctatttggaaactactgctttaggcagtaggacagttacaggttggttttttggtaaaaccaagggttttagaaaacattttcttgaatcctctgcaaaaaagattcaaatgaatatactaggataacccataatgagctacacagctaacataaataacaattgtatatatagttgtctttttctttttaggcaaattttctcaaaagtttatttatatgagtatacattagatatcacttttactgcagacaaaaggagaaaatgtcagccattctcactggcagtatattaactgcccctgtctcactgagagagacttcaattgctcatagcagtcagtgaaaccttgaaggtttccttcctaccaagcaaatccattttaaccatatgtattttgctcttttttcaatgttacatttgttcaaatggcattgctagaataatgtggaaaataattttcctaccaataaacctgtcagtagttgaggtcataagtagggtgacagtgttttcggttattttcatagataaagatagtaatagagaagatgaatatctgttactgctcttttgtcatgagtaatctgaggtaaaagcttgtagaacttcactatccctggggcgtgctttattcattttgaatcagtcacttgacttcagtgtctaaatgtccttgattctaaattgtacttacaatgtttattatctgctggcttttgttctctgctattttatttttttttacataaaatatttgtaataaagatgaagaaggtactcaccatccaaagtcaaggaatgttaacatttttgctgtatttgtttcagggcttttttcttataagagataaaccatcatatatgcagtttataacagcttatatttattgagcacttactgtgtaccaggcactatagagctctacaggtattaacttatttaatccttacacagtcctgtgaggtatatatgctattgtttccccctttttatagatgaggaaactgaagcacatggaagttaagtaactgtgctcaaatcatttacctagggaagggcagatctgtacatttattctcacacaatgtagataccatgctattaactattatcttatgcctatgcagtcttctgtcttccttcacttcaaaaggtaaaactttgaagtcgaagggtctcatgcttacgttcttatgtttgccacctatttatgaatgcatacacattatacagtgttcgtggtttaattgcaggtggcatcctcattatgtagagctctgcaactttttaataatctcttgttttttgagaccctttccacattattacatggaaatctattttaagtgctttttaatagttcctcctatggatacgctttattcataccataaacccggaatcgtcagggcgaatatgtgtaagagtaccatatgcaatatattacagtccttttgtcaacagaacaacctcctgattgtttccagggagtgatggaaccttagacaagctctgcaccccacagcctgagttgcctcatctgttatgacgagattgcactagatagtctagtcagagtctgcgctgaaaatctatcagctcaacagtagagtgcatcagatttctctgcttttggcagaggtagccagagtttgagatttcaaatttatccaaaataatttctacacaggtattttagagtgccagacatttttcttttgctttcaaaaatgttttcagactttgctgggcacagtggctcacgcctgtaatcccagcactttgggaggccgaggtgggtgaactgcttaagctcacaagttcgggaccagcctagacaacatggcaaaaccccatgtctattaaaaacaaaacaaaacaaaaatgttttcagactttaatggtcttgcactatttatcctcaaaaccttatttaaaattacttttaaaattttatttgtattttattttttagagacagggtcttactttatcacccaggatagagtgcagtggtgtgatcatagctcactgcagcctcgacctcctgggctcaagcattcctcccacctcagcctcccaagtagctgggactacagatgtgagccactgtgcccagctaatttttttttttttttttttttcctgtagggacagagtctccctatgttgccaggctggtcttgaatgcctggcctcaggtgattctcctgcctcagcctcccaaagtgctgggattacaggcttgagctatgatgcccagtcaaaattttaatttgaatgactactcttaagggtcccagctattacagatagcctctgtggagctgagatgatcaaatacaggacgtgaggacaccctgccctttgataatattttccagaacattttggtgattaaagacttgtaggcatctttgccttttgtattttttctcataaaattgagtaaacacttgtagctgtcccttgtctctttgttcctgtttgaagtgaacatcatactctatgttttggttcatgttggggagtctttagcctaagtagctgttagcagcagtcattaaagtctctggccatttttccaggtgcggtggctcacacctgtaatcccagcactttgggaggccgaggtgcgtggatcacctgagatcaggcattcgagaccagcctggccaacatggcgaaaccccgtgctctactaaaaatacaaaaaaattagccgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatggagtctcgctctgtcgtctaggctggagtgcagtggcacgatctcggctcactgcaagctctgcctcctgggttcacgccattctcctgcctcagcctctcaagtagctggaactacaggcacccgccaccacgcccggctaattttttgtatttttagtagagacggggtttcaccgtgttaaccaggatggtctcgacctcctgacctcgtgatccacctgcctcggcctcccaaagtgctgggattacaggcgtgagccactgcgcccggccagtctctggtcatttttgagttggatttttaagaaacagactggagaaatgctctaagctgtgtaggaagaggaggggagaaaaatcagcttaattgcattattgtatttttttttgccttaggaacgtgttgtgggctttcacgtactgggtccaaatgctggagaagttacacaaggctttgcagctgcgctcaaatgtggactgaccaaaaagcagctggacagcacaattggaatccaccctgtctgtgcagaggtgggtcatctacacttatacagtttaaaatgtttaaaatgtgccacatagaagcacaccacccagcttatacatggcagatgtaggaccctgagtttgatgatgattcctcagaagagggctttgtctctaaaaattagtttttgtctttcaatactgattgctcatggtatgaactggaggcttccgtcatgtcgttaagtggtaaaaattatgagagtgatttatagagctgtgccttaaatattttatttatcatatcttctaaattattttcatggcaatcagttaatgatggaagagcttcaatcttagttattccacagctatcttgaggctaattgatactgtctgcctcttcagcttatggtatcagtgaatgagatttgaaaatgatgctttcaaaagatcaaatgacagtagaactagaaattgaccaatctaggcctctgggtgtcagtgtttcttcgctaccagtgatcatccaagagttgaatattgtaatacttaactgcataggaatggtaagccaaaaatgtgtttatattggagaacttgggaaggtgtgggaggaggcacgtcatactataccagcttatatatggagttgaaaattgcagtgattatctgttgtagccagtggcttccaaggtgtacattgcacttgcaaacacgcacacacacacatatgcacattgttgccagatttcatccagcagctccatgactggttgttctgtctgttcatggttgcttttgtacaactgaactcattgctgagtatgtggaatgtcagctttaagacctggaaaaacattttagctttcttttgctttgtcttctctgtgatcgagaatcctcctctattaataggcacctggctgggatataagcctaaaatattaacatgttgagagattagggcatcatttatttctttcatttatagaaagctgctgtttttgtgacggaaatagaattaagcttcaaaaaaatataaaaactgaagtcttgattaatgcctttaatgtgcaatagatcttttattcagtgtaatgactcaaactgcctgtgttgggaaggagccaattaactttgctttcttgagtacattagtttcccagggctattgtaacaaagtaccacaaactgggtggcttaaaaatagcagatatttcctccctctcagttctggaggcaaaaaagtccaaactcaagatgtcagcagggccaagctccctccaaaggcactagggaagaatcctcccttgcctcttcttctgtcttctagtagcaatggcaatccttggcgttccttggcttgcagatgtatcactttaatctctgcccccctcttcacatggcctcatcccttgtgtgtctgtgtccaaatttccctcctctttcttataaagaaactccagtcattggattagggcccactctaatccaacatgatctcattttcacttgattacatctgcaaataccctatttccaaattcacaaatactgggggttacgacttgatcatgccttttagggttatggggacacaattcaacccacaatagtgagtatatttaaaaatgtagatgccatttcaagatactcacaagcttcaataaccatttttgatagggacgaaggaaaagacgattttattgtcttttgtatatgagtgtctaattttttgtctgaattcagctctcagtgggcttgttgaaagactgctgtgtgctggcctctgaccccctcaggaggctattgtgctgtgatccagcagcagcgtacatggcagcatctggcagggtgactgccagctgagcagaaggatgcagtgaggacacaggacgtctcctgaagcccatggctgtggggaggtcagccaaaggcctgttctccttggtatgcctggcacatttgaggctgtgcatctccatctgttggtcctcttatgatgttgaagctcagaggctgaatgttctggtgctttgataggactctgatactttgttttccccaagctgttggctgattaagaagataaaaaaaattgggtgaaatcgcactctgtgaacacacttctcaagctgtgtacacagtgccgtgctggacactggggacacagcagggatttgagataagcttaggaggagaggaggcagctaggtgatgtgccagttaacaattctgcctgacgggtcctaggatcagggtagatataaagtgctggaggcactggggtgccacatttgtggtctttgcctcagggattcttgtgatctgtttttttactcacagagcacttctgaccccagatttgtgggggttttgctcacacgaccaattctccagctttctagacaccagctgggtgtctagaaacaaccaattgtctagaacaaccaattctccagctttctagacaccagctgggtgacctctaatgtaactcaattctgataccagctgcctggagttagcatcagatcctgcaagggctcattcccataagactgcctccactgcagaggccagtgtcaagcccaggcctcctgtacttctgacctaccagctataaagtcaaggggttcccatgataaattgctagcatggctcacagaactcaggaataaactttacttatatttacttgtttattataaaggttgcaactcaggaacagccaaatggaagagatacacagggcaaggtggttgtggggaggcgggggacaacagagcttccatgtcctctctaggtgtggcatcttcccagcaccttgatattcaccaacctggaagttctccaaaccccttatttaggggtgtttatagaggtcccattatgtaggcatgattgattaatcattgaccattggtaattacccaatctcctgctccctccccagatgtaggggaccagaactggggctaaaaattctacctctgatgacatggttggttcctctggcaaccagctgccatcttgaagctatctagggccccaccaagagtcacatcattagcataagctcaggtgtggttgaaaggggctcattatgaatagcaaaagatgctcatctcactagtgtcactcgggaaattccaagggttttagaagctcccttgccaggaaccagggacaggatggaagaccaaatacatatttcttctcatttcacaatatcgtaggatgttggggcaggatgattctggagggagttcttacctaagactagaacaatgtgtgagtgttagctagtgagagaacactgtacaaaaggcctgggtgggaaagcggatggctcattcaaggaactgaagaagaccctcaatattggcatagcttaaagagcttagagagttaaaaatatatatttattttttatttttttgtatatatatgctggagaaacaggtgggtaagtgatggtcttgtaaactaaggaagggtattttgactgcctttggggcattgtgattcagccaaaaggtctaaagcagggagtaatatgatcaggtacattgttcagaaacattcctccagctgcaccgtggaagcgggactgagcgagcaagtgaagtggcagatccagttatgtggctggtgaggtgcatgagaggagatgatagtggccggaggtgtggcagtggaaatggagtgacacggttatatttgagggcagagttgatagtacttggcagctggctgggaatgggaagagggagagctgaagaccactcaggtttgtgtcctgcagcaggaagtaatagcaagagcagactcgaggtgacagcgaggacgaaaccactgatgtgtgtgagggcctgctgtgtgctgggtactgtgtccctgcctgttgactaacttagtcgttgtgagcaccccatgcggtggatgcggtagtatatctatttgacagacgaggaaaccaaggacaaagaggttgagtaacttgcccatggtaacccagcctggtcatggccgagctgggattcaaacccaggcagcccagaccccaaagcaccacattgtgcagctgatacttcatctccacagactgtcctaccatatttggcatagaatttaaaaatggaaatgattcttggtagcaacacgaatgtagtggagacacacagacctgggttgtaatctcactcagccaattcctctcagtgagacctggccataccacccaggttttcagaagcttagtttccacattaaataaagtaagaggccaggcgtggtggctcactcctataatcccagcactttgggagcctgaggcgagtggatcacttgaagcccggagtttgagaccagcctggccacatagcaaaaccccatctctaccaaaaataacaaaaaattaactgtgcattgtggcatatgcctgtaatcccagctatgttggagaccgaggcacaagaatcacttgaacccaggaggcagaggttgtactgagccaagatcacgccactgcactccagcctgggcgacagtgagaccctgtctcaaaaaaaaaaataaaacaaaatggcctggctcagtggctcacgcctgtaatcccagcactttaggaggccaaggtgggcagatcatctgaggtcaggagttcaagaccagcctggccaacatggcaaaaccttgtctctactaaaaatacgaaaatggcctgatgtggtggtgcatacctgtagtcccagctactcaggaggctgaggcatgagaattgcttgaatctgggaggtggaggtttcagtgagccgagatcacgacactgcactccagcctggagcgagactctatctcaaataaaaaaaaaagtaaaataaaataagggaatatctaactgtagggttgattaaaatgcaacctgtaaagtgtgtaggagagttcctggcatttaatagatgccgaatagctgcacctgttagctgttttttccccaggatattatagatgtggctgtggcttgggaggggagacgatgtggctggactgaaaggtcatcatgccagtatttttaatgggggttggagagagatacatattgtgaaaaagctccagtgattttttttttttttaaaccctggttgtgaactacttgcgttgatactggattttgaaaaaccaaaggctttaaactcctggttatggacattttaaaaaattatttttaattgacacaataattgtacatatttatggggtgcatagtgatgttttgaaacacagagtttatagtgatcagattagggtaattagcctatcaatcatctcaaacattgaccatttctttgtgttgagaacattccatatccttctagctatttgaaagtatgcattattgtttaactgtagttatcctaaggtgctatagaacatattcctcctatctagctgtagttttatatcctttaacaaatctctccctatctccttctcccaacccttaccagcctctagtaatctctgttctactttttacttctgtgagtaagctagcacagccactgtggtcaacagtatggaggttcctcaaaaatctgcaaatagagctaccatatgatccagcaatcccactacttaactgggcatttatcccaaggaagtcttttaggggttcataggaggaactcttttctctgccaaatgctgggttctgacttggatagtatttggatttgctactggacccactgtttttatcgtccagacatattctgtggggaatgtgatattctgtggggaatgcggttcagaagtggtccacagaatgtttgttattagtccataatgatagaaggctagaaacgaagaagaaagtttagaaattttaacaataatttgacagtgactgatctagtaataaacaatggtgttttaattttacatgccttttaaaatttcatttccccagtacattgtcagtgaatttcacaagtgttagtccagtggatgaattagaaataataataatttttaaaccagtcctgagtactactttaaactgagtgctcaaaaatagctgcagctccagagccagctgtggtaggctggcacagtgactcactttggtaaaaatcctgggcaattgagagcagtctttgactctgaggagtaattacttacaaaagttgacaaattccttagcaaagtaatttccaaagggaattactagaattctagaattgctgtaagaggagaggctactcttgtttgtcctgtgtgagagggattctcagcgcctggggcattagcaatgcatttgccgtattcagtgtgagatggggttggtggtcatttattctgaacacctgagccgcagtcattgagtaggaaacggattacacatagttatgagtagtaatttcaactaatcaagttcacttgtagaggagaaaaacaatagttcaagaggaaagcatttgaaaatacttccttgtaatgtcttaaatgaattttagtgccaaatattaaaagtttttgtgttttttgtttgtttttaatttaatagtcaatataatcccactctaaagtgagggagccttctgcggctggaagtggtggggacagataagagtatgtgaggtggaaagcctccagcagctcctgacccttgtacgagtcctgtgtgttgggatggaagggcatggaggctgccccttctgctcattttttaaaaatacatgtttttataaaaattctaaaacagttgtgtacgaatgaaatctgtcaattgacccaagcagtttttttcatttatttgagatagggttcctgtcacccaggctggagtgcagtggtgtgatctcagttcactgcagccttgacctttcaagctcaagcgatgttcctgcctcagtctcctgagtagctgggaccacaggtacatgccactgtttccagctaatatatatatatatatttgagacagggtcgcattatgttgcccaggctggtctcaaactcctgggctcaagcaatcctcccgccttggcttcccaaagtgctgggattgcaggcgtgagccacggtgcctggccagttttttatttagactgatcaacgatggcagtttggcttcctccatctttttaacataagaacaacatcaatatgagaaaaaacagataagagctcattttggtggatttagttttgtatccacatctcctacaagttctatttctaaatcagtttctgagaaatagaacccaggcttgcaaattgataagcctggaatttgtttaaatgtattctttggctctttatttttttcctcattataaaaatggaaaagaaagcatgtttgaattgcccttaatacccctttctaacacagttatttttattatcatgtattgtttccccgtcctcatctgtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgtcccagcattgcatataagagtgctaattaaaatgttgcaaaattcagtgtcaatgttttttctataatgagtataaaaaggataactattggccaggcacagtggctcatgcctgtaatctaagcactttgggaggccgaggcaggtgggtcacctgaggtcaggagtttgagacaagcctggtcaacgtggtgaaaccctgtctctactaaaaatccaaaaattatccgagcatggtggcaggtgcctgtaatcccacctactcgggaggctgaggcaggagaatcgcttgaacctaggaggcagaggttgcagtgagccaagattgtgccgctgcactccagcctgggtgacagagtgagactgtctcaaaaataaaaataataataaaataacgatttcaaggattttagcatatctttgctaacaatgatgagcctctttcttcttataatgatttttttttttggatatgaattatccatattttctaatgcatttgtattttaaaactttttaagatactggccattagtatttggtctggatttttttgagaagtaaaggctttgtcaccctctgaggctaaaacagactaaagacttttctcagtattgttcctcccttacacaaaactgttttcccccttattcacaagtatttttgtttttacgtacaggcaatcttgagcagtagcaagtaaagattgtctaaaactgtcaagtccacaaccatcaaatgtttgcaaggatatgaaacaaggagaacttgttagtcactgcaaatgagagtataggttggttcaggtaccttgaaaatctagtcaagccaaagtttcacctgccctctgactcagcagttgtactccagctctgtgtgcaaggagatgtgctggaatgtcacagcatcgtattgcaaagagcatattggcaacagcttggatggccagcagaaggagcccaaatgtgtgattcatattcactagtcgaataattgaatactacaatatacaccatatatactagactgtatgtgttgttctatactatagtgattgactcgaactccattcagtgaaaaaaatggaagaattagctatttgtatccatatgggatacaaaaaagcagggtaacaaaagaatctacatcatcttgccatttgcaggtaaagcttcttaaaaaaacaagagaaatgcaggaagaaatgcctaggaatgataagaccaactcggtggagggaaaggaggaaaaggccaatggggtggcacacacagggctaactgggcactttatacccttctttatatccaaaatattttatggtgaatttcttttagagggttgacaagcacctgtgggtacctgatctgttttaatcatcctcatgctaacaaaattcttcagtagatataacctaaattttttttctctttcatcttggttttaaaatgtcttcccccttttattctctggagaaatagaagatatccttgatcatactacttctctgttttattcattttggtagtcgcctaagatggttttaatgcatatggcattatctgaactgttccctgttacctcatttgctcaggcatctgaagatgttgtgctttctcttcccctgcaggtattcacaacattgtctgtgaccaagcgctctggggcaagcatcctccaggctggctgctgaggttaagccccagtgtggatgctgttgccaagactgcaaaccactggctcgtttccgtgcccaaatccaaggcgaagttttctagagggttcttgggctcttggcacctgcgtgtcctgtgcttaccaccgcccaaggcccccttggatctcttggataggagttggtgaatagaaggcaggcagcatcacactggggtcactgacagacttgaagctgacatttggcagggcatcgaagggatgcatccatgaagtcaccagtctcaagcccatgtggtaggcggtgatggaacaactgtcaaatcagttttagcatgacctttccttgtggattttcttattctcgttgtcaagttttctagggttgaatttttttcttttttctccatggtgttaatgatattagagatgaaaaacgttagcagttgatttttgtccaaaagcaagtcatggctagagtatccatgcaaggtgtcttgttgcatggaagggatagtttggctcccttggaggctatgtaggcttgtcccgggaaagagaactgtcctgcagctgaaatggactgttctttactgacctgctcagcagtttcttctctcatatattcccaaaacaagtacatctgcgatcaactctagccaaatttgcccctgtgtgctacatgatggatgattattattttaaggtctgtttaggaagggaaatggctacttggccagccattgcctggcatttggtagtatagtatgattctcaccattatttgtcatggaggcagacatacaccagaaatgggggagaaacagtacatatctttctgtctttagtttattgtgtgctggtctaagcaagctgagatcatttgcaatggaaaacacgtaacttgtttaaaagtttttctggtagctttagctttatgctaaaaaaaataatgacattgggtatctatttctttctaagactacattagtaggaaaataagtcttttcatgcttatgatttagctgttttgtggtaattgctttttaaaggaagttattaatatcataagttattattaatattttgaacacaggtggatgtgaaggattttcatttaaaaaccaagtggttttgactttttctgttgaatgaacaactgtgccttgtggaatttttgcagaagtgtttatgctttgttagcatttcaacttgcattattataaagaggtattaatgcctcagttatgtgtttgtcaatgtactggctgaggattctatctcagctgtcttttctaactgtgtaggttgagttttgaacacgtgcttgtggacatcaggcctcctgccagcagttcttgaagcttctttttcattcctgctactctacctgtatttctcagttgcagcactgagtggtcaaaatacatttctgggccacctcagggaacccatgcatctgcctggcatttaggcagcagagcccctgaccgtcccccacagggctctgcctcacgtcctcatctcatttggctgtgtaaagaaatgggaaaagggaaaaggagagagcaattgaggcagttgaccatattcagttttatttatttatttttaatttgtttttttctccaagtccaccagtctctgaaattagaacagtaggcggtatgagataatcaggcctaatcatgttgtgattctcttttcttagtggagtggaatgttctatccccacaagaaggattatatcttatagacttgtcttgttcagattctgtatttacccattttattgaaacatatactaagttccatgtatttttgttacaaatcttctgaaaaaaaacaaaacaatgtgaaacattaaaattaaaaggcattaataatatccacgtgtgccttcttactgaatgatggtcttgggagtctttgcaagagtattgagtagatctctgatattgtgttgaaaagctagctgctgagtaggctccaatgatgctatgctgatttaagtatagaagaactaatcagttcattgccatttcccatcttctggcagtatcaggcacatagatggtcaataaatgtttccagaaatgttgattaccatgttcagattatgcattcacatgcacttaatcttcttaggtatcactttttaagcagaaactcctcttttatgtaatctttaccaaaaaccttcccagtttgtacttgtttttgtggtaagtacttgcagggtgctagtaataacaacagctaaatgagtgtttactgcaacacgtgcaggcactgtgcttgacacaccctggctgatgtgatccttacaacaatcctattagagaaggtgcttttgtacccatttatagatggagaaacaggctcagaagtgtaagtcactttcttaggattacacagccagttaatgcatcacgtttttgaggccagagttgggtctgtgacctcaaaggcgctacctcttagttacctcgcagtgcagcctcccattcatctctgacaaatggaagcttttaggtctgctgcatcaattcctgggacttcacattttcacatgccgtcaagcaatgctgtctacacgcttaataaataccttgtcttgagatgttctaacactttcctaactggactttccaccgccagtttacttcccactagagccaggctcttattgcctgaacttccctgtctcaagcctttgaggttttcccaaggcctgtaactagacccacagtcccctgccagaccctgaacctgttatctgcagctctagcctgcgctttcccttgcctgttctggctacacctgctctatgtccccatataactactagcctccctcaaaggtcacctgctctgcgtaacttccagctggttctctacctctactcccagggtactctgtattgtctctagagctctttgaattactctgcatggagtgtagtgtgtgtttctgtcaccaccactagataatgagggttctttacctctgtgtgccccacagcttctagcacaaggtctggcactacagaagcacttagaacattggtgtaattggattgacaggtagagccataactatcagagatggccatataggaagccttttaatttcttcctgttatgtcaggagccattgatttaaatgttaatgaaagtagaaagggcctaaacagaaaaaaagtcagcctcactagtgagggggaatgcaaattaaattgcagtgaaatgcaaatcaagctgaagtgagataccattttatacccactgtgagtggctactttttttttttctttgagacagggtcttgttctgtttcccaggctggagtgcagtggtgcgaacacagctcgctgcagcctctgaccttctgggctcaagccatcctcctacctcagcctcccaagtagctgggactacaggcatgcaccaccatgcccagctaattttttaagtttttgtggagattgggttttttgctctattgcccaggctggtcttgaactcctgggctcaagtgatcaccctgccttggcttcccaaagtgctaggattacaggcatgagccactgtcctagcctggatggttaattttatgtgtcaacttgactgggctaagggatgcccagagagctggtaaaatattcctggatgtttctgtgagggtgtttctgaaagagattaacactgattcgaatcaggagacagtaaagagggtcaccctcaccaatgtgggtaggcattgtctaatccttgaggcccaaatcaaacaaaaggcagaaaggtgaatttactctttgcccttgagcttggagatccatcttctcctgccctcagaccttgctgctctggttcttgggactttagactcagattaggatttgcacccttggttccctggtctcaggccttcaggtttggactgaaactccatgactcactctcctgggcctccagcctgcagatgggactgtgggacttttcaggctccataatcacatgagccaatccctcctaaaaatctctttccatattttatgtacacacatatgtataaaatccattgtttctgtggagagccctcatgcacccattgtatggcagatttaagagtgccagtatccagtgttggcaaagacatggagcaactggaacacttattattattgctggtggggatgtaaattattcaatcacttcggaaaacagtgaagatcagcatatcaaacatttcgaaaatgatttgaaatttttttacatgttttaacaaagccagtttattttgtagttttaataaaaaaggtgccctttttgtccctggattcacttagcattcataattttttttaatacaatgaatttaaattgctaaaagatcatggactggctttctggttggatttcaggtaagatgtgtttaaggccagagctcttcctcaatatttgtttttttcccaatatttgatttttaaaatatacacatagatgctacatttatagcttctggcttaaaattctgtcatatgtcacgtctagccttttagtatggtaaatcatgttttacttctacttaaacattaataatttggagtatctgttactagtaatagtaattctataattgtataattgagttttgtacttaacacacataggtcattcctcatctatcatttgcacccagtgcagtttcatttttcagataccatgatgcaaaatagagtttttcatcatttaggtgtaagcaaaaaccccccaaaccaaaaaatgatactggccgttacccagtagaattaaacgcatggatagctcatgacccagctgttacacgcttaggtgaatacccagcacaaatgcactgtctacgtacctaaagacttgtacaggagtgttcataacactgttattaattgcaaaacaaaataaatcccaaaaacaaacgtggaagcagcccaaatatccatcaccatgagaatgggcaaatgagttgtggtgtgtccatgtaacagaagactaacagcaggatatatgtaacaaaatagatctaagaaacagtattgagtgaaaaagtcaaaggagtatgtgcaatatgatttcattatgtgtacagagaggcaaagctaagaaatacagtgtttagagataaaattgtaataccctaagggaaagcaagagaattcaaaatgatgatcataaaatagaagctagtagttaccaatgaaggggtagaacagtggatggtgtattagtctgttttcacgctgccgataaagacatacccgagactgggtaatttataaagaaaaaaggtttaatggactcacagttccacgtggcgggggaggcttcacaatcatggcagaaggcaaaaggcacgtcttacgtggcagcagacaagacagaatgagaaccaagtgaaggggatctacccttataaaaccatcaggcctcgtaagacttactcactgccacgagaacggtatgagggaagctgcccatgattcaattatctcccaccaggtccctcccgcaacgcgtgggaattaggggagctacaattaagatgagatttgggtggggccaaacaatagaagatgggattaggaaggggcaaccatgactgaaaggtcgctcaggacttgtgcatttgtttatcagtattatctatctatctatatattttttatttggttctaccttaaactattaagggatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcagcctcccaaagtgctgggattataggcatgagccactgcgcccggccctacacccactttttagatgaaaaaagggaagttcagagtcagtcacttgcccaggctcacactgtgtggcttctgtggcatggggtgactccaaagcaaaagagaaggtgtgcctcctagtgtccatccctgtgaacagcaggcttccactttggtgttcagttttactggaacacactttgtttatgggcttgagtgaataaggtcacatagctaaaaaattttatagggcttgcaaatcaagggggatgggcaaacagtttagcagataattctgggaaaacttgtttgctatgtgtgtagctataaaactggatccctacctaacactggatgacaaagacagacttgaaacatattgaagacctaaatgtatgtggtacagccgtaaaatttatatggtacatataggaaaatacctctgtgacctagaggtgggtgagggtttcttaaaccatggtctcaagcacaaaccaaaaggcaaagcactgatgtgccagttgccccagaagttctgattcacgaagaccatcatggaaaaagtttaatagagagatgaccatgtgggaagggactgttctgtgtctgaaactgataaggaatttagacccaggtgacttcaaggaactctggcgaatcaacaagaagacaggaaccacaaaagaaaatgggcaaaggacattgaactgcttattcaccaaagataaaacccaaaagtcaaccaggataggagagctgtacaaacttgcgagtcattaagaaaggcaaattaaaataatgagagattgctttacagccatcagatttgcacacatcagaaagctggttaatgccaaatgatgagctaggcgaggggaccgtcaggccctgctggttggagaggagactgtttgctgctcagtgtttagacctcaagcactgtgtagcccatgacccagcaatacggctcttggctctcaaccccagagaaattctgtgtatccccaaggttaacgtgcacgaagacacccgttatggcacccgtgtgcagtgtggggaaattgaactccatcctgatgaccctcactggggaatagatgagtaggctgcggcagatgcaagatgatggagcggtacttggggagtactcatgacatgggtagaggcgagtggaaagaaaaagagaccgagccccctataaccgctttctgtgtactaaaaatgtatgcccatgaaaccatggtacatgttttacgagcagaatagcacacatgcaccgcatgagaggggccgtctatggagagggaaataggaagtgaatggaaataaagaggtgttgaagagaaagagcactgacccaggcaggctttcctacaagcagtggttacaagcccagcccctgcagcagggtaacttagcccccagtacctctgttttcttagcataaaatagagataataattgtgctcacctcccagagttgctgtgaggatcaagttaacacacacatgaagtgcttagaatagtgtggctggcacaaagggggtgctaggtgtataagggtgttcacagtgcttatattagtgaaaaatgaaaaataattgaaatatccaactgtgggagacagtttatccaaatgattggaaagatctaattgttcttctgtccttcttccctttgtctttttggtagtacaacctccccccgccccccccccaacctctacacatacatagattttagcaatgtgcttgggcacctagctatgtactgaatttcccagcctccatgatactaagttgctctgtggttaagctctgggatagaatggatgtgaaagtgttatgttccgtgtaagaaaaacacttgctctccactttctctttcccctgcatctgtgaatgacctgacacccactggagggctggaggccagccatgagcaagcagatgagtcaagaagcaagcagatgctgagcaacaagttggaaggaaccagggccctgatgacccacaccctgtagcatcctccacccccacctccatctgctgggtgggaaagaacaaacgtcttacgtagactactctttgaagacactgaattttgggtctctgacatagctgcttagtctgtactccaactaatatagccatttaaatcttgtttttcagaaagtagttaatgatatgagaaaaaagcttatagtgtatacctcagtggaaaaaaattggtatataaaaactagatttttttagggcagcgaaactactctgtgtgatactccaatgggggatccatgtcattacacatttgcgcaaacgcatagaatgtgcagcaccaggagtggcccctaatgtaaactctggactttgggtgatagtgatgtatcagtgtaggtttgtcaattgtaacaaatagaccactttgataggtgaagttgatagtgggggaggctgtgcatgtatgtgggcagggagtatatagaagtctccgtaccttctgctcagtattgctgtggtcttaaaacttctctaaaaaagaaagtctattttaaaaactacataggtgtctaccaaatgtataagactcacattttttctgtggtgtggcctcagccttctcaaggcttgctgagaagcaaggcacacatttatttgaaggtagtgcctggaacttggagcttttatctcccagtgaacatctctctgccagatgctcgggtaggtttctccaaagttcaactgggtaggagagtcacatgatccttccaaccaatgaatgagcaggaatccagtggctttaggaaaatcaaacctgttattatgtaagtgacgatcagtggtatatacagtgactatttgtggcagttgcatgcatttctgagtgtgtttttattttgcccttttgaaattaatctcagaattgttctgtgccatggtaaagttgtctcatcattttggaattcaacacagctcctaaagctgttgataagaattgtacgtgcttctgagttatgtgggctgatttcgacggtctgcttatgaggtaggaggtgggactctattctagaggcagggctcaaactccagaccagattggagactggctgaaacaggggaggggcaaaagcacctctccatatgacacacccaccagtgccatgccagtttaccattgccatggcaacacctggaagttaccattccttttctagaaatttctgaataacctgcctcttaatttgcatgtaataaaaagtgggtataaatatgactgcagaacgacctctgagcttctactctgagcacactgcctgtggggtagcctgctctgtgggagcagacatggagctgtaacattgctgcctcagtaaagctgttttcttctaccactggcttgctcttgaattctttcctgagtgaagccaagaaccttcctgggctaagccccaatttcagggcttgcctgtcctgcctcacacactctcctgaaatctgaatttagttatagagagtgatatgtgactctctgtaaactttgttcattagattcatgaggtgttgtatctgagaacgatatcattaattgtatttataatgaaattcattcatgcataagtgttcatgttttatgcataactattaaatgctgctgctggagagatcagtgctgtgctgagacagggagttttgagtcactgctttgtttctgcagcttctcctctcctttactgaggctcacaccctgggctcacaggcacacacgtatgtgtgttgtacacacctgcacccacgccccccatgcagcatggggagggacggcatccaggtgatacgttctttctggatgcaaatacacatcagttatgacctgacctgaaccgccattcccttggatgtagcaatagagacagagaggccccaaacgcttctgagcctttttggtcagggtctctgcctccaactgggtctttctgtccttcctaggtgaagaagggaaattgtcaggggctgctcttaagcagggggcctggatctaaacggaagaccttccaacctcccccactgcggagagcagaactgggagcagatgcccgtgggcttcgcagctcttggtctgtgtcatcacgtgcctcggtcatacattttgtcatcactgtatttactaacactgcacatcaaagcgattcctacttcttttaaatggaaacacatttattttaaaagacacccatagattgaaaccataaatggaaaccagtctgatttgccatacagactaatttttaaaataaatgcaaaaacacctatttctgtagcttgcatacgcataaggtatttctggaaggacatagaagaggtgcatagtgattacctgtggggagaagaacccacggctaggggcaggggtggggcccacttttaaggaacattcctgtgtatttccatttatactttttttggcttttggaattcaatcaaaacaaagaatttggggaagaaaagatgtgaaaacaaaacattggcattagattctggccagacgctgttgccagctgaagttgctaaacctgaggcttctctctgctgcggagcattcgtcagcagagggagatggtaaaggggctttcgcatccagttgaggtaacagaaaagctgacagctcgtgagggactctttcccaccctgcgatggtgctattcatgccgtactcagtttccatcttcagttgccctctctcccaggtctccgactcatggtttcccccacgaggccaccattgctccaggaacagaagttggaactgaaagcagtcttagtaggcctccagccaaatattcctcacctggttcgctcactcccaaaggggtcccctgtgaagcctctgaaaccttatgcaaaatcctgtgctcatgtatattttccagggagatggtggctgatctctatcagagctccaaagagggccatgatgcctaaaagtccctatgggattcagaaaggagtgacatctccaaggatgcctggctcgtggtatcgctcagcatattgtttctagatgcacttgtgcattcatgatgaggaggaggatggatcttggagctggaggaaagatgccacaaggacccattctgtccagcacaaaaggagaagccttcccagccttaatgtccaaagggaggcatagaggctcagggaagctaagtgacttcaaggatgctaaggctccagtatttatacagtgatcaaatatcacacttgtacaaagcaatctcaggtggaaagacccactcctgaccatggggatgtgggactttctggcattgctaactgctcggggacagccaagatggcaatagtggctcatgttccagggcccctgtttcattgagggtgtttggattgtgctcttgcccaagtgttcagatgacttaaagattagaatgtgcagccaggtgcagtggctcacgcctgtaattccagcactttgggaggctgaggtgggcagatcacaaggtcagaagttcgagaccagcctggccaacatggtgaaaccccatctctactaaaaaaatacaaaaattaagccaggcatggtgatgtgtgcctgtaatcccaactacttcggaggctgaggtgggagaattgcttgaacctaggaggcagaggttgcagtgagctgagattgcgccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagctcactgcaatgtccacctcccgggtcaagtgattcttatgcctcagcctccaaagtagctgggattacaggcgcccaccaccacgcctggctaatttttgtatatatatatatattttttttttgagacagtgtctcgcctttcgcccaggctggagtgcagtggcgcaatctcggctcacagcaacctccgcctcccaggttcaaatgattctcctgcttcagtctcccaagtagctgagattacaggcacccgccaccatgcccagctaattttttgtatttttagtagagacagggtttcactatgttggccaggctggtctcaaactcctgaccttgtgatccacccaccttggcctcccaaagtgctgggattacaggcgtgagccaccgcgcccggcctaatttttgtatttttagtagagacggagtttcaccatattggccaggctggtcccaaactcctgacctcaggtgatctgcctgcctcggcctcccaaagtgctgggattacaggcgtgagccactatgcccggcactatgtgggaagattctaaagtgcattccagaggacagggctcctggctggtctgcgtcttgtctagaggcagcctgggaatccggatgaagacgagtgggcagggcctgcagagaatccaagtgcatgagggcttgggcgaaagcagcgtccgggaagggaggccaggcggagcattgcagcatcttccagccctacaggcatgcgttccagggattgtgaacctaagccagggacatagtcatgaagagctattccctgcatccactgtggcttcaccccaggagggcaccgaaggagtaacactggtgctcagcaggctctccccatgtcacagaggatttggtgatcaaagccagtgtccctcagaatttttcttcacagtgctgatcatggtgggtgtgatggttaattttaggtgtcagcctgactgggctcagggatgccgaggtagctgataaaacatgatgcctgggtgtgtctgtgagggtgtttctggaggagattagcattttttcttttttcatctcttaaattcctttaccaagacattagcatttgaattaatctgggtgaagatccaccctcaccaatgcaggaggcaccatcccatctgttgagggcctgaatagaagaaaaaggtggaggaagggcgaatttgttctctctttggggcctgggatatccatcatcttgtcctaccttggacattggagctcctgattcgtagaacttcaggctctggacttacaccagtgacctcccctgcccacttgccatgggcttccctggttctgaagctctcagacttggcctgaattacaccaccagctttcctggctctccagctggcaggtggaagatggtgggacgtctcagcttccataaccatctgagccaattcccatagtaaatctcctatctatcatctatctatctatctatctatcatctatctgcctatctgtctatctatctatcatcatctatctatctatttacctgtcatctatcatctatctcctgtttctctggggaaccctgcctaatacagtgggattatttgagtaacaactttctcctcaacctggctggacgatccaaaatgatcagggccacgtctgttggacagtgagagcatttaggggagcatgcagcccggagtccaggttgaatcctggatctgccacttactagctgtgtgaccttgaaaaaaaagactgagcttcactgtgccccgaatcctccataaaatgaaaataatagtagcatctgctttagagagtgggtatgtagattagatgagatcatacttacaaagcacttagcacagtgcttggccatactaagaacttgaaaatgctaattgttattattattatttacctctatgcatatctcaaggtccaaaacaaaagctaagtcagaaaaggaggaaaaaatgccagatgccaggagaacatgccagcttctggagtgagatgcggagattgggggattagcaggaagaagaaagagccactgaaaccacccagttatccctgcatttatttatccaaagaccatcactgaaggtcttctacttccaagccccacctgggcttccagcctaataggagaaacaaaccttaaacaaacaatggtgcataaatcatgatttcattacaattgcgatgagtgaggcaacatacggtacagaggacttaagaatattttaacaggaaaatcaccatagcccagggctggaggttgggaactggggaactggggataagaatccagaaaaccaccctgcccagcatgcagaagggagttaatggagaagtcttgctgggtcggcctgtaagggatgagtccacacaagcatttacacaggcagaaggagggcaaggtcattacatcccttttggacacagtaaatgtccagttgtccttttccctgccactgtatagtaagatggtggtcaggacctgggggtgccaatgactgatctcaaccatacctctaagctgagaagggaaaggtcactgattattacttaagccagacttaaagaacagtcccaaagcttctgacagccaagacaatgtcctcttcgctttcaatgacaaaggcccaactgagtaacatatgaacattgagggagccaactgcacacagacacttggaccactgacccagggaaactccttaactgcttgaatgaagtaccagtcattcatggtcaatagattcttctgctgcatggaatttctgctgggctggtggaggcagctgagaaataatggggagaggccaggacaaagcatggaaaaacttcagttacgttttgttggttaacaatgggaccttcaacaagacactcattggcttgggtctcactttcttcatctgaataatggagataataacacctaagtaggcacgttcctggctttaagtaacaaacacccactaacaggggcttaaacaaatatatgttcatttttctgacataaggagtcgcagccagttgggtgtggacattggagaagcaactcagtaatgtcagaggttttggatctgcttctttgcaattttctcattctttccctcatggtcacaaaatggctgctgtagttccagccatcaagtctgtatttagtaaggcagtaagaagagggggtgaaagataggactgcctctctaccctttacacagccatcctggtgttgcctgacacacttttgcttttaactcattggccagatctctgtcctgggccatccctagctgcaagggaagctgacaaagtgagttttagcttttcttttctttttttttgagacagagtctcactctgttgcccaagctggagtgcagtggcgtgatctcagctcactgcaagctccgcctcctgggttcatgccattcccctgcctcagcctcccgaatagctgggactacaggcgtgtgccacctcacccagctaattttttgtgtttttagtagagacggggtttcaccatgttagccaggatggtcttgatctcctgacctcgtgatccgcctgccttggcctcccaaagtgctgggattacaggcgtgagccactgcgcctggccgagttttagcttttctaatctatagagcacatgaagagtgtctatctcagcatataaagcagagactccactaggcagtgaaggaaggtaggcaaaatggatgtgtgtttcatatctgtgccccacaccccatccagggtccgtctctccccagcagttgtcataaggactcattatcatttagccatcatgcagaatatcagagctgccaaaagggaaagcaaagtgaatcgtcctaaagcagcctgctttttcttttttctttttcttttcttttcttttttttttcctatttggaaggtttggatttgaagtaaatcatcattaagcagtctaagtatttcctttatttatttatttatttgtttatttatttattgagacaggatctcactctgccatccaggctcaaatgcagtggtgcaatctaggctcactgcagactcagcctcctcagctcaagtgatcctcccacctcggcctcctaagtagctggggctgcaggcacacaccaccacactggctaatttttgtatttttttgtagagagagggtttcaccacattgcccaggctggtcttgaactcctgggctcaggtgatcctcctgcttcagcctcccaaagtgctgggattacaggcatgagccaccacacattttgctttttaaagcatttactttaaaaatctcacctctttcaatcctcgttctgttcattgtttgctccaagtttgaggggcctgtcagttcttcctgcaaataaaatcagtgaacaaccctgtaggtacacttcaaggtatacaggggagcagagaatgccgcctgggtaggggcgagtgttacttcagcggcagggaaagcctctgtcaatatttgcgaggaagagacgtctccagaagtaagaaaggccacattatggaaatggcatgttttatgcagggagacacttgagaatcagggagagtcaataaaggggctaagaagggtcaagaacttgggtttgagaataaggcgagtctactagttgagaaggagaataaggcttcggtaagccagccccacctgccaccttgccacccctttttaggaaataagggacagttgccaggggctgttttgtgacataatctagaggtatttatgccaaaaggactgacggaaataccaccactgccaaccacgacagcatcctggttccctaaacggatgggcttctttgttttcctttgtcacaaggaattagaggaatgtggctacacccgcagcttctaacaccagctagcctgggttcacatcctggatgaatcacttactgtgtaacctcaggcatattgtttaacctctctgtgcctcagcatcctcagctggaaaatgggggtggcaatagcagcacctcccttgtgtggttgtcaggacaaaataagttaactcagggaagtaaggaaagttaattagtaaataagttaactctgggtaagtaaggtatcgaggacaggggctggcctctagaacgtgctgtgttagtgttggtgattcttacgtgtgaaccagcagcagatggaaggtctggccgttgagggatgctacttttttcctgacgatgactatgaacgtcttgtgtggtctaagacagcagtccctttttggcatcagggaccggtttcatggaggacgattttttccacggtcggggggtgaggggggtcaggatggttttgggatgaaactgttccacctcagatcatcagacattagttggattctcataagcagtacacaacttagatccctcgcatgcccagttcacgataaggttcatggtcccatgagaatctaatgccaccactgatctgacaggaggcggggctcagacgatgatgccagggataaggggcggctgtaaatacagatgaagcttcgctcacttgcccgcagtgactcgccccacttcctgctgtggggcccagttcctaacaggccacagagcggatgagtaccggtccacagcccagaggctggggaccccttgtctcagagacatcttgagaacctctttatttcctctttgttaatgcaagaagtggttttgaaagcaattcatgcattttcaggaaagaaggcaaaagagactagggaagggggtggggaaggcttaccaggtgctgtatacacgacaaagcagaaaggctgggaactacaactctggagtcagacacattttgggttgaactcagtcactgcccattagcatagtgatcctggagaagtcatctaccctcatgtgtgaaggagaaacaatgaatgctcctggaccctagagctgctcagaggatccaatagagcaaagatgtcaaaaggccagcgccatgcctggcacagaggaaggattcaatcagttaattcagccatgctgaagccaccatgatgtgacagaaaatcagcttgcagctgggggagcgggatttgcctcctgatcatctgccccggaatccaccaccttcctgaatggcagtcccagcagcgccagggtggaagcagatgctggctgaggagagaatcctgcccttccccgtccagccacttccagccgtctcccagcccctgggtgctgcacgggcagtaccaagacttccctggcccggaaggacctctgacaaggccctggaagcccagcagggccaggctgggctttgagaggagatgagtgttaggagtgcgtgtcaggtgggggaagggagctgtaagcagcagagactggccaaccttgcccatgagctttaggtctccatctatgtgtccatgcagaagggcccccagaggagagcagcatcccggcctctgtcaggagaggagagagttacccgatttaaggagctcaggagaaagagtgagcgtgctcagctcatccctcccctgtgggagccagctcccaccaagggtgaagagggtcaggccctggggttgggggtggatggaggtctgcagaggtcccccagcagcccctgtgaaggatgggcaaattcgtttgtgcactgcagtcttggcagccttgcacattgtccccagcttcccgttccccagcctacctctttttttttttgtttttgagacagggtctcactctgtcgcccaggctggagtgcagtggcgctgtctcggctcactgcaagctccgcctcccgggttcacaccgttctcctgcctcagcctcccgagtagctgggactacaggcgcccgccaccatgcccggctaatttttttgtgtttttagtagaaatgaggtttcaccgtgttagccaggatggtctcgatctcctgacctcatgatctgcccgccttggcctcccaaagtgctgggattacaggcatgagccaccacgcccggcctcatccccagcctacctcttgtaaacatgagctgccactttgctgtccatccctgggaccctggcaggctccatgagtaggcaagagaggggtgtggttcaccagccccacctccaacaatgtcgggaaactctgtgttccatctcctcctgaagctggcagccctcagtgtatactttctcagctgcaaatgctaccattttaaactcagaggattttaaaaaatatatttgagcctcacacaggaagacccaaaaattattaaaatatagaacatttagactgtggggcagagactgcatctgttctgttcacttacccctaggtcctaacatacatagtaggtacccaataaacataagcttagcaaatgactgaaaattaatttaagcagctcatatgtgaaaagagcatatacacaaagatgttcattgcagcattgtttataatggtagaaaattattttgtacaatctggttaagaaatctgtggtatatgaatgcaatgaaatggcatgctattattagaattaacaagaggactatcaaaccaggagaacaggtttacgggatgttgctaaatgaaatttaataatactgtgatttaaagaatgtaaacgtgtatatctacatagatgaagattgaaaggcccatttagagataaagtcattgctgtgtaaaattagcagcaattaagaaacacctttggtaatgttttacagtggattctagaatatgttttaaactcttttaaagaaacccctgcagtattttctaaacagatgagatggtggtttgctattttccagagtccattgagtgagctgtgaaaggccccattggatagggggcttctggaaatttccatctccccacctcctggtggatagcaactcagagctggcaaaattattcttggcaaaggcaatctcatgtcagaaagagttctcagtgcaaagagcctttagcaacagaggtgctagaatctgtgtcggtgaagctttgcaaacagcagggattccacagaggccttttcaggcctttatttcccactctgtaccttctcctccttcttttttttttttttcccaagttttgtaaacatcccagggatgatttttgtactcccccaggtctgtgggagtcggatgagatggaaagaggcctcgcattgtccctgcagacctgtatcccttccggccacccctgctgccctcacactcccctcccaccacagcacccacctgtggtctgacagaggacaccacacctttgcccattctcacaccccctcccgctggacagcccctgtccttaatgaagcagcttgatgttttgtgggacctgctggtgtcctgcccagggaggggtgtgaggggtggtgggctggcctgctcctggaactgtagcatcaaactgttcaggctttcatttgcaacagccacacactgggacaccaaaataggtcccggcggaggtgtgggtggggctggcctgggcttggccccacccaagtagggcgccagggagacagagtgccccagcaccaccaaggtgggcagaagccatgtggggccactgagagaaattccactgaggttcctgttgggccttccttccacccaaagttttggaccttctgcttgagtgaattatagtgggaattctgggctttggctttgggggctgccagatgagaagggtcttagtgttcaactggtcccacctggcactgcgggaaaagcagaagctgtcacctcccagctctgccatttactagcgcaagttgttgaaggccatcgattcaacgccatttaggtgtgtgctaagcgttacatacaccttatcctttgtcatctccacagctctggcatgggtgtactcttcagagatgacaaaactgaggcccagaaagggtgagtcactggcccagggtcacccagcttatcgtaggtgaagctaggatttaaacccagatctaattttcctcccaagcaggtgacttaatctttctcctgagctaccttctcgtgtcttcccgaagccaatttcccttgcaaagcagcagagcaacttgacattggtgcacatgttcccctccagaaatcccgcctgcaaaaactctgaaaatggaaagtttattcatgggaaaacttgccctgagctgccacaaggctcattgtggtcttgatttatctcacttattgtggacgttcacatgatttcctgaagaaatatgaatgagttagactgtggatctgttagaccttgctgggaatctgacagggtatgcagaaatcacattgtgtttctctaggaaatcctgaattctcaaacacatcaggtcccaagggattcagacaagggctgtggatctgtataaaatggtccactaatgctcacggcaggtggggggctgctcatacattcctcatagaaaatctttctgtaaggcaataactatcagcagtggttagcatgcacccgctctttgactcagcaattcctcttctaggaatttttcctaaggatttgaggataagaatattcattacagcagaaatctggtaccgccctaaaatctcaaagcagggaaatagttaagtaaagggtaatataccttccttagatggaacattatgtaaccattaaaaagggtgcttaaggctgacgtggtggctcacgcctataatcctagtgctttgggaggccaaggtgggaagattgcttgagcctaggagtgcaaggattcagtgagctgtgagtgcaccactgcgcccctgcctggatgggagaacaagaccctgtctcagaaaaaaataaaaaaggtgcttaatgtgtaagtttagtaatctggaaaaaatattcattatagctagtaagtgctggggggtgggggaagacacaaagttaccaaatagcatgtactatgtgacccaatttttgttaaaagggaaaaaaataaaatgacaacaaagaacactgtgacactgtgaatccgcttccactgctgaaaacaggtctcggttttgcaggtctctcttccacaaaaggcaggaccgggctaagaacagtagctggctgcactgctattgctctgccctgtaaaggataccttcagtccttatgtgactcaaagctggcctgtccccatcgctgcccctccgcgagggcaggggcggggaggaggcctagattgccacagcagtgctacaatggattttagttacggccccttccatagcctgatttggggtcatttagggatattcatccacttatttaacaaacatgtgtcttatttaccagacactgtgttaaatgccaaggaggcagagatgagtaagacaggaggtggctagttataaattcctcggctgtgtcttattcatctctgcttgccttatttagggtagtaccaggcacctcctaggtaggggttccctaaacaaatgatgaatgaacagggtccctgtccttcgaaaactcacgggctaggaaagggaaactgatgagcaagtttgttatagcgttggtagtggcatgtcccggagggacacacaggaaggataatccattccatagggcagggtgaggggaagagtggagtgaattcagccttcattgctttcacaagcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcatgccactgcactccagccctgggggacagagtgagactctgtctcaaaaaaaaagaaaaaaaaaaaaaagaatggacctcctggccttgtcactaattttgtgggggaaagcatttagtctttcaagcattaagtgtgttagctatagttttgtaagtttttttttttacaaatgggtgctgaattttgtcaaatgctttttctgcattaatttatatgatcatattatttctcttctttcacctgttaatatggtggattgcattgattgattttcaaatattcaactaccctttcatctgtggaataaactccagttggtcatcctgtacaatccttgagatatattgctgaattctatttgctaatattttgttaaggattttcatgtatatattcatgagggatattgatctgtaggttttttttactaccttggttttatttatttgtttgtttgtttttgagacagagtctctctctgttgctcaggctggagttcagtggcgcgatcttggctcagtgtaacctctgcctcccaggttcaagtgatgcttctgcctcagcctcctgagtaactgggattacaggcatgtgccgccatgcctggctaatttttgtatttttagtagagacaggatttcggcatcttggccaggctggtctcgaactgctgacctcaagtgatccgcccacctcggcctcccaaagtgctggaattacaggtgtgagctaccgtgcccagccagcagcctcaacctcttaagctcaagcagtcctctggcctcagcttcccgagtagctgggactacaggcacatgctaccatgcctggttaatttttgtaatttttatagagacagggtctcactttgttgcccaggctggtcttgaacccctgggctcaagtcatcctcccactttgacctcccaaaatgctaggattacagatgtgagccaccgtactcattcctatctgtggttttaatatcagggaaatactatcttcataaaatgaattggaaagtgttccctcctcttctattttctgaaagagaatgtagagagatggtgtgaattcctctttaaacatttggtagaattcttcagtgaaaccatctggatctggagacttcttttttgggagttttaaaattgcaaattcgatttccttaacagttgtaggcatactcaaattatctagttcacattgggtgagttgtagtcatttgtatttttcaaggaatcggtcctttttaactaagttgtcaaatgaatgtgtgttctcactagctttaaaaaattctcttccctccattagtttctctcacattgaaatgagatgctgattcctccacatgccttccctccctccagatcaatgacaaaacgcattctcctgtgccctaatccaggacagcattcttgacaggcagagcccaggatggggcagtcccgatgtaaacccacagtttcgaggaaccagttggccttggacctctctgaagagctctggaaccagaaggggctggcggtcctctaagtcaccttagcctacctggagagacctccgaggcgggaggtaggagctccgtccttaagggcaggtttgagaagtcaaaaacgctgggggccctgggtaccactaggtggcgctcaaaacatacagttgctcttggaggccaacagtggaccgaagaacctctgtttagctagatttggtctgtggggcatttgttctttaagtgagatgcactttagagtctagaagctgcaaggaccccacgagctctgggttggtggacttggtaatactttctctgacttccctactgacaaaggagggaaggcttgagaggtggtgctggttggaggctcctgcgagatgtcagaagcacctacctccgtgtgggctgctgagacaagcatgcccacgcggagcctctgtgtggttatgaagtgtcaacaccccggccaggcctgtaaagaatcttaaagaatctaccctgggctccacgtcccttccaggctggctcaatgcccacaccccttccagatcctgccccctgcagatactttgatctaccccaccacgttaagtatactttggggaaagagtcctctggagtcagttgggaggctcaaggttttgtcctgcctctgccgctagcagtgtgccttgggcaagacttgtacacatctttgctagattctggactgagtccaaatcctgtcttgaccacccacagctatggtgccctcttaggaatgttacttaatgttacttaaccttcgtgagcctcaggttcacaactgtcatctggagataataaagacactcatctcatctcatagtgtagtgaagttttattttttatttttttagagacaggatcttgctctgttgtccaggctggagtgcagtgatacgatcatagctcactgtaaccttcaacttttgggctcaggtgatcctcccaccttggcctcccaaagcactgagattacgggcagggagccaccatgccagccccagcatcgagtaagtgcttgatggacattggcagttattattttatcacatttatttatttatttattttgagatggaatcgcattctgtcacccaggctggagtgcagtggcacgatcttggctcactgcaacctcggcctcccaggttcaggtgattcttctgcctcagcctcctgagtagctgggactacaggtgcacaccaccatgtccagctaatttttatatttttaatagagatggggtttcaccatattggccaggctggtctcaaactactgaccttgtgatccacccgccttggcctcccaaagtgctgggattacaggcgtgagccatcacgcccggccattattattattattattgtttttgagacatagtctcactctgttacccaggctggagtgcagtggcatgatcacagtgcactgcaacatctgcctctggggctcaagtgatcctctcacctcatcttcctaagtagctgggattataggtgtgcactgccacatctggctaattttttttggaggggggtgtttttagtagagacagggtttcaccatgttgcctaggctgggtcttaaactcctaagctcaggtgatcccgccacctcagcctcccaaagtgctgggattacagacgtgagccaccatgccctgccattcctattgtcactaatttttgtacctctcccatcccagccctagcataggtttacttgttttcaattgctgctctaacacattactactaatagaatggctaaaaacagcacaaatttattctcttacagttctagaggtcagaagtctataaccaagatgttggcagagctgtgttctctccggagacctcaggggaaaatccattcccttgctttacccagcttccagaggccatccacgttgctggccttgtgaccccttcttacatctctccaacctctttcttctgtcaccccatcttctgctactaatttgatcctcttgcatccttttaaggatttgtaccttggacccatacagataatccaggatagttttctcatctcaagatccttaataacctgtctgcaaattttcttttaccatgggcagtaacatattcgcaggtttcaaagattaggatatggatgtctttgggggccattattcagtgtagcactctgcgaaaacagattcagttcaaaataaataaggattgggaaagggcttcatgtggttttatctttatatccccagtgctatgatttgaatgtttgtgtttcctcaaaattcatatgctgaaaacttaacccccaaggtgatggtatgaggaggtggggcctttgggaggtgattaggtttagacgaggtcatgaggattgggctgttatgatgggattggtgcccttataaaaacagccacagagagacctttgccccttccaccacgtgaggacacagtgagaaggcaccgtctaggagccaggaagtaggctcttaccagacactgaatctgttggcatcttgatcttggacatccagcctccagaactgggagaaataaatttctgttgtgtataagccacctcgtctgtggtattttgttatagcagcctgaatggattaaaacacccagagtctagcacattgcctgtttggcctggaaggtacttacttactgaatgagtgagtatggtgaacattactggtgctcatcaatacccagctctcctctccttctttgggtgggggcacatgactaatgactagctttggccaatgaaagtgagcacaagtgaggtgtgttacttccaggctgagtcagtggaagcctccatgtgacacttcagcctctgtccttccctgccatgataaatgtagaggccttctctcgagatggactgaagcagcctggattgtgtgtcactgcatggagaacaggcaccctggattgttacccgcacctacctgcttatataaccaagaaacaaacttaggaaatttggggaatgcttgtcactgtagcatagcctatctgaatctatccaatgcaatgagttaatggaactgcccaatctttaaggtccaaatcaaaactatgttataggtagaagaatcagccacacaacatacctaactagtggtctttggcatgcccaggtgggtgggtagttccctctgcttccatgttttgcccagtatctaatactgtatagcctctctgctttggtttcctcatctgtaaaatcaggaaaataatagtacctacttgagacaactgttgagagattatatgatttaatgcatataaagcattttaaacagtgcctgacatgtggtttggttgttgttgttgttgttgtttgtttgtctttttgaggtggagtttttgcccttgttgcccagactgaagtgcaatggctcactgcaacccctgcctcccaggttcaagtgattctcctgccttagcatcctgagtagctgggattacaggcgcctgccaccaagcccggctaattttgtatttttagtagagacagggtttcaccatgttagccaggctggtctcgaactcctgacctcaggtgatctgcccgcctcggcctcccaaagtgctgggattacaggcatcagccaccatgcccagccatggtaagtcttaatatatgtttgttattgtcatcaccaccatcatcaccactcccatcaccactcccatcaccaccaccaccaccaccatcaacatcaccgtcaccacccccatcaccaccaccatcaccaccaccatcaccaccaccatcatcaccaccaacatcaccatcaccaccaccatcatcaccatcatcatcaccattgttatcaggaggaggagcaggagaaggaagaaatgttacttgcacttccagtgtgcaaaggagagaataaatttgatcaaattcagtaaagataaatgctagtaatagcaatctcaccttgtcaactttaacaaatgaagccaatagaaattaattttaaggctaggcttgggggttcacgcccataatcccagcactttgggaggccaaggtggaaggattgcttcatcccaaaagtttgaggccaacctgggcaacataacaagaccctgtctctacaaaaaaaaaaaaaaaaagtcaggtgtggtggcctgtgcctgtagtctcagctacttgggaggctgaggtgggaggataacttcccaggaggtcaaggctgcagcgagctgttatcgtgccactgcactccaaagcaagatcttgtctcaaaaacagaaagaaagaaaagaaaagaaattcatttaaaaagtcttacacattgtcatgtttgtttcttcctctgagaccatcaaagtttctcgtcctcctcctcctcctctaactccttaatagacttatgactaattagaaatctttcttggaaaagtaagagaagctgggaagtgaggaagatagcctataatgagactttataaataaatttctacataatcaatatagttcaatgatttcccagagacactggcttctctgccatgctatcagtcatagtttcagccagtgaaagcaaggagtgtgttagaagcccaggtggcaactttaggactctcagctgctttgatgtagttgctcactgaagctggactgtccatttaagaaatcattcattcattcgccacatatttgttgagcactgctgagggccaggcactgttctgggcagctctggggtgggactggcgggtattaggacactccccacccccttctgatgattggttcaggaacagacatgtgacccatgcagctgaggaactgtttgctggaggtcctgagaaagttcctttcttttccacagggcaagaaagaaaatgaaaattatttatgcagtaggtgtataaaagtgccatatgcaaaaaattttcatcacagcacggcctgcaacagtgaatcactggaagaaatcatagagtttcgttaagcaagctgtggtatctcaataaaaagcaatgccatgctgttatttaaaataacgcaatgactataaaacatgaagaaatgtttacataaagatactaagagaaaaaattatacacaaaactatatagatatgctgtgaggaattaaaatgagaaagtcataattaacaaatggaagtaaggtctttgtaagactgctgggattatgagtatttaaaaacatcctttgaattattttacagtagtctctatattttatttcttctaaagaaccctcacagtaatttctaaacaggtgaatcagttggttgccatttcctagggcctcctcagtgagcacattactccgattttcctggaagtcactctacagtcgtgagggttccagccttctgatgaagccaacgctgagtgtggcagagaggagggacggaaagggacaagctccctcaggatctcagcgagctgcttgaccacgctgctggactcttcctgggtagctggcaaactgccaaattatttcatctggctggggttggacttgtgattgaggcagacagcattgtaacctaaaccctccccatagctgcgttcacttctttcatcacatgttaacacccctacaaaatcaatgtattaccttgcaaaagttgttgaaaaagagccacttttggagaaggtgttctgtggaagcaaccattccttatgctctttgtcactaagctctccagggcactgtactgctgccagatttgagaaccactgctcaggtgcaactctatttcagagtgtgcccaggaatcacaggcaaggcagcccagcgcagataaagagaagttgattgaagggaatcaacatcatgtgtgtttcttattcctacagatgcataatcaaatatataagtaaaaattgacatttcctttgagaactacttggacagtgacctgaacatctccagaaaaaccttggtggaattgcatgaacctgatttgggtcaaaattaagcaccacgctgaaaatcatgcctttgtgaaatgacaaattgaaagtgttcagaaattgcatttgaactagttgagatcctgatacaggttagtggttctttaccttaccatttgatgaaggggtgacattgatgattcaagcattttagcaagctttatttgctctatctgtaatgaaaatgtaataatagtaacatttcattggttctaagctgcaattctacggccccccaccccctaacccacatacatttttagcagctgtgtaattaggatgggtcttaagatcagtgtcttacagtcattgacacaaggtcataacatggttgtcattgccgacaccttctggtgagatccagaaagacccgggaacaaaatttgcagaatgagtgagtgtcagcagcctgggagaaacctctgagacctcaccatagcatctttgtaagaactgcttcctcatcaacgctcttgatggcaaagggtgattttgtattgaaagatacacacaatgacaagattgagctgaaaatcacaaacaagatttagactctctgaaaaagtttgggaataacttaaccaacctttttcacttgttttcctattttgagtgcccaagggtgacacatgagatgtctaaataagtctaaaaaattactttcaataagtcttttttaaaaattattatactttaagttttagggtacatgtgcacaatgtgcaggtttgttacatatgtatgcatgtgccatgttggtgtgctgcacccattaacttgtcatttacattaggtatatctcctaatgctgtccctcccccctacccccaccccacaacaggccccggtgtgtgatgttccccctcccgtgtccatgtgttctcattgttcagttcccacctatgagtgagaacatgcagtgtttggttttttgtccttgcgatagtttgctgagaatgatggtttccagcttcatccatgtccctacaaaggacatgaactcatcattttttatgactccatagtattccatggtgtatatgtgccacattttcttaatccagtctatcattgatggacatttgggttggttccaagtctttgctattgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtcctttctcagatctccagctgcgtcctgggagagccactactgtcttccaagctgtcagacagggacatttaagtctgcagaggtttctgctgccttttgtttggctatgccctgcccccagaggtggagtctgcagaggcaggcaggcctccttgagctgcggtgggctccacccagttcgagcttcccagctgctttgtttacctactcaagcctcggcaatagcgagcgcccctgccccagcctcgctgccgccttgcagtttgatctcagactgctgtgctagcagggagcaaggctccgtgggtgcaggaccctccgagccaggcacgggatataatctcctggtgtgccatttgttaagaccattggaaaagtgcagtattagggtgggagtgacccagttttccaggtgccatctgtcacccctttctttgactaggaaagggaattccctgactccttgcacttcccaggtgaggggatgcctcaccctgctttgtctcatgctgggtgccctgcacccactgtcctgcacccactttccgacactccccagtgagatgaaccggtacctcagttggaaatgcagaaatcacccgtcttctgtgtcgctcacgctgggagctgtagactggagctgttcctattcagccatcttggctccaccccctcaataagtcttaaaaattttgagagatctaagaaagtattatgtcataatttaattagtagcgtcttctgtttgcttcctcagtgatatataaaataatggtgcatgttataattaacaacatattgcatacaatgaaatacagtaacagttcacacatatagaacttctgatctgccatgggtcagtgctccattcatgttaactcattcaagagccattttatagataaggaaactgaggcacttagaagatacaaccacacagccagagattggtagagctagatgggattccaacccaggcagtcagccccagggtctgtatgatagcatctcactgagagaggtgctactttgcaatgtgtcagataataactggtgaattgttgaccagatttgtattttaacaagcataacactgattaagaaaaaaaaaagtgcaaatatgttgtgaaaacgaggccaattgtgtgattggtaaaaaagcagcagaagaaacttgcatcaacgctatttatcaccccgaacattccagaaggtgctgcttcctttacgtatggcctctcacaccagagtgtttctcattgtgttccatggagtgttgaaaagagtagaaataaaagtagtttgggtacttatctcttctcataacttatattgaaatggggagtgactttgatgacttctacacagatgtttgcagcctttgtcaagggaagaagcaatctcagttgtcgaggactgaattcaggcctgagttatttttgtttgccaagttttaagtagacattaggacaaagggtaaacctgtgaatttagtgtttgacctaataggaaagcctagccctcaatactgtatttagcagattttttaaaaaggctgaattagttcaaattttattttattttattgcttttattgtattttacaagattgataggatgacaatgaaatttgagatatcaatggctataattgattatggagactgagtctttggaggcttaattcattttcaggtgacaaaagttacagccttggtgataaaatagaacacaaaaaaaatcagtcatctttgttcatggaaataactttcatcttagttcatggaaatatcttttgaaaactgttttctaaggaggggaagagagagagagaaaaaaaaagagagaaagagcaactgggatcagagactgctaaattccaccatctgataccagcttcttgctgtctaagaggatgtttatggaattaatatggtttggctgtatccccacccaaatccatcttatcttgaattgtagctcccataatctctatatgttgtgggagggacccagtgggaggtaattgaatcatggtggcaggtctttcccatgctattctcgtgatagtgaatacatatcacgtgatctgatggttttataaaggggaattcccctgcacactctctcttgcctgccaccatataaaacgtgcctttactcctccttcaccttacaccatgattgtgaggcctccctaggaacgtggaactgagtccattaaacctctttttctttataaataagccagtcttggatatgtctttattagcagtgtgagaatggtctaatacagaatgtccatggataggagcctcaaagaggtgcatggtacttcctccctgacagtactttctcccctgagacttccttgctgtctgccatctgccttctgcacccaaatgtttatgagcatctgaattttccagctatcatgaaaagaaattgccctgaatctgcttgcagtatgcactcacttcaattcagtacaaattttccagaatttcttggtactttagcattgcattcattgactgaaaaaaaaggtagaattttttgaaaaaatgtgtaagtaatttaaagcattattgctgcattaaattcaatgcagctacattactggggaatatatgaaatccaggtgaatcttaaagtgaaaactaagatgagcagatacatttctaacttcctggtcagcttcagtctagacctccaagcccccagggttcagtgatcatttttgctgccccaaacgatactggtgtggaaaagtttgaggcgctctaggttacaaagagtcccttgagcctcttggccattggtcattaagcagaaaaatacacccggttccttctgtccttggctgcctcccattgctgtttacccatgaccatggtctgcccattggcaggcagggtcttttggagttaagggcttccttggcagagtgtcccctgtagttttagaccaggaggtccatggagtgtggttttcaaggctaagtcagagaccaccccagaattttgaggctgaaatggagcctgttcctttggccaatctcacctggttttggtataggaggggttaggaatgggtagtaggtggctagagctgtgatggtctccatttaggagcctagtgaaaccaacagagtctatacttatgtgtgtatagatgatggaatctttgacattctttgaataaggtgttcccttaggtttttttttaaaaaagagaacatatttccatgtattttaacatttattcattccacaatatttgttttgtgtgtgctgcactaggcctggggaatacagcagcaaacaaaacaggtaaaaaccactgccctcacagagcttacatgctaaggtggagagagagcaaatttaaaagacgattaaatatctggaatgtctgatggtgattgctgctataaagaaaaatgagggaagaggagtgggaatatgtgtgtctgtgggtgagttgcaattttaagtaagatggttaaatgccactgaacaggtgacatttgagcaaaccatcagcaaactgatgctgagtcaattgctttgaagttgcagcctgctggactgcctgaagtattggatagaggatatgagagaaggtgagaaattgaggatgactccaatgcggtaggcagtttatgacacagctcacagttacccccacctcctggtattcatgctcttgtataactttcttcttgagtctgtgatggacctagtgactttttttttttgagacagagtctcactctgttgcccaggctggagtgcagtggcgtaatctgggctcactgcaatctccaccctctgagttcaagcaattcttctgcctcagcctcccgagtagctgggattacaggcgtgcgccaccacgcctggctaattttttgtatttttagtagagacagggtttcaccatcttggccaggctggtcttgaactcctgacctcatgatccacccaccttggcctcccaaagtgccgggattacaggcgtgagccaccgcaccctgcccgcccttttttttttttttttaatcatgaatagattacggcaaagttgatgggatctcatttctgtggatatatcaccaagattgtgacttctgtcttgctggcagattctctccattgctttcttggctttaacacttcagtgaagcaatctgccttgttgagaggcccacatggcaaggaactgagggcagcccctgaccaacagccagccaggaactgaagatgtcagtccaactacccctgatgaactgaatcttgaaccacgtgagcttggagtgcatccttcccagttgtgccatgagatgagagcacggcaccagtcaacagtgtgactgttctttgagaaagacaccaaagcagaggggacagctaagccatatccagatttttcacccacaaaactgagataatacatgtgtgctttttaaactgttaaattttgggacaatttgttatgccacaatatataattaatacacaaggtttttggcaactggaagaataaaaatagtatttatgatatcacaagatgagtgtaggtagagggtttctttacagggagatttcagggtttctttttttttttggtgatggagtctcgccctgttgcccaggctggagtgaattggctcaatctcggctcactgcaacctccacttcctgggttcaggtgattctcccaccttagcctcctgagtagctgagattacaggcacctgccatcatgcctggctaatttttatagagacggggtttcaccatgttggccaggctggtctcgaactcctgacctcagatgatccacccaggctggagtgaactggcgcaatctcggctcactgcaacctccacttcctgggttcaggtgattctcccaccttagcctcctgagtagctgagattacaggcacctgccatcatgcctggctaatttttatagagacgggtttcaccatgttggccaggctggtctcgaactcctgacctcagatgatccgcctgcctcggcctccacaaagtgttgggattacgaggcgtgagcctctgcaccccagctgattgcaagttttggatatgtacaatgcacataagtatctatttgtgtgataatacgtctcactaatttttcaaatggtagttagctaccaatatatagaatctaaatactctccatgagccaccttaaaacaaagttatttaagtgcatcttcaaaaatcagattctatggccgggtatgatggctcacacctgtaatcccagcactttaagaggccgaggcaggtggatggcttgagcccaggagttcaagaccagcctgagcaacatacagaaaccccgtctctattaaaaacacaaaaattagctgtgcgtggtggtgcttgcctgtagtcctagctacttgggaggctaaagtgggaggatcacttgagcccaggaagttgaggctgcagcgagccgtgatcacgccgccgcactccagtgtgggtgatgggagtgagaccctgtctaaaaaaaaaaaaaaaatcagatgttataataattttagtcataattatttctggaaatggaaaacatcaaatacagtaccaacccatgaattctgatgtctcacttttagaatttctctattctttgctttcaatttgcacaaaaaccagaataaaatttatctttgtatgtctgtgacgaaaagattatttgctggagcaactggacaggacaaaccatttaagagaatgtgctttttagcatttaaggacttatatgttaatgaagtaattcactgttaaaagtttgcccaacttcctgaggttttgaatgatgatagcttaaatggagatcaaaagtaagatatggaaccaagagaaatgaaggaggtgaaatcagcaggctgtggtgattggctagaagttggagtaaggaagagggtagtgtacagatattgtatggtgctcatcgtctcttggcaggaaaggtgctcatcctttataaaaccaaaggattgttgtggagaacagctgctaggtctccacacaaaatccaaccgttattaatctcagccattctgatcattccatgggaagcccctgcccacgacttgtttaggaatgggcatgtgacacaatcctggcaaaagactattaagtagaaactttcctttctgtgtgtgttgcctggaaccaggcagccatcttgggactacagtggagttccatgaagagatcaggaagagatcaagccaagggctgagggcggtcaagtgggaagacagagggacttgggtccttagattgtgtggttgaaccaccacatttgccaatcctgaaacccccacatgtggggacttgtttttataggaagtgggacattttctagtggtttaagtcattttgagttgggttttctgttacttgcagctaaatgcactctgagacagggacattctagaagaagctccagttttctggctttatgagtggatccattttctataacagcacattcagaaggagaaggcaacaggccttgggaagtggggagaaaggatgaccttggttcaggacatgcttagcagtgctggagggacaccaggtgaggacatctgctgaaggtttgaggtgcagatctggaggtcaggagtgagttcacaggagatagcactatggcaatccttgaggggcacagagagagggaggttgaaacataggctttggcttggatccagccttacttcttaatacctgtgtcacctggggaaaggcacttcttttttttttttattttttttttttgagatggagttttgctcttgttgcctctaggctggagtgcaatggtgcgatctcagctcaccgcaacctctgcctcccgggttcaagcaattctcctgcctcagcctcccgagtagctgggattacaggcatgcgccaccacacccggctaattgtgtatttttagtcgagacagggtttctccatgttagtcaggcttgtctcaaactcccaatctcaggtgatccgcccacctcagcctcccaaagtactgggattacatgcatgagccactgtgcccagcctttttaaatttttttttttaatttttgttgttgttgtttttgttgttgttgagacagagtctcactctgtcacccaggctggagtgcagtggcatgatctcggctcactgcaacctcggcctgctgggctcaagtgattctcatgcctcagcctcctgagtagctgggattacaggcgcccgccaccatgccaggctaatttttgtattttcagtagagacggggtttcaccatgttggccaggctgttctcaaactcctgacctcaggtgatcctctcgcctcggcctcccaaagtgctgggattacaggcatgagttaccacactcagcagcacttcgctttttaaagcctctatttcctcccttgtaaaatggaaattcttgccttagtgtttccaaagtagaaattcttatctgtgtgtggcagagaccatgctagatcttcagcaaaacttgtttttctttcctccagggcccatggacaaaccacacatgccagtgtccccactgttagggaggggtcatattgatggactctgaccaatagcatgtgatgaattctcttcctacacctgtcagctgggagctgagaatccagggggaagcttctaaggctccaggaggatgagcttttagatggaaggaacctgagtccctgagtgacttggtggagaacctccaccccctaatcagctacactggacgtgacatgattgaaaaataaacattgggcatgttgcttttatagcagctagcattccttacccaggcccatctacccagcatttcccagtgtctgatacacaagatgatttcagtatacccaaacagtttaaaatgttcacttcttacacatttgttttataggtatgctttcttgatgtattacatatttgttttataggtatttctttattaacaaagaaccatagactgggtggcttaagcaacatttatttctcacagtcctggaggctggaagtccaaaatcagggtgccagcagggttgggttctggtgagggccctctcccagattgtagactgtcaacttcctgttgcatcctcacatgatggaaagatggctagagagctctctggggtctcttttttgaaaaaattttgtttatttatttatttatttatttttattttactttacattctgggatacatgtgcagagcgtgcaggtttgttgcataggaatacatgtgccatggtggtttgctgcatctatcaacccatcatctaggttttaagccctacatgcattaggtatgtgtcctaatgctctccctctgcttgccccccttcccccaacaggacctggtgtgtgatgttcccctccctgtgcccatgtgttctcattt

SEQ ID NO: 12215 - DNA, 7382 bp, Human
ccccatctctaccaaaaatataaaaattagctgggtgtggtggtgtacacctgtaatcccagctacttgggaggctgaggcagaattgcttgaatccaggaggcagaggttgcagtgagccaagatcgcaccactgcactctagcctgggcaaaaagaccaaaactgttgtctcaaaaaagaaaaggaaattaggttcttaaaggcatcttcccagacgtgagagtgtctgcttttgcctggtatagtagtgcctgcaaatgttcaaggaaataaacaggtacccctgttaagcctataggtaacttctcattgctccccatcttctctgtactcagcactttttttttttgttttgtttttgagacagcacctctctgttgcccaggctggagtgcagtggctgaatcatgggtcactgcaatctcaaacctatgggttcaggcaatcctcctgcctccgaagtagctgggactgcaggtgcgcaccaccacacctggatagttcaaaataaaacttttttttgtagagacagggtctcactatgtcttccaggctggtcgtgaattcctgacctcaagtaatcctccctctttgaccttccaaagtgctgggattacaagtgtgaaccactgcacccgccgtggcactttttttttttttttttttttttgagatggagtctcactctgtcacccaggctgggtgcagtggcgtgaactcagctcactgcaacctccacctcccggattcaagcgattctcctgcctcagcctcctgagtagctgggattacaggcacccgccaccacacctgaaaaatttttgtaattttttttttcttttttgagacggagttttgctcttgttgcccaggctgtagtgcaatggcactctctcggctaattgcaacctctgcctcccgggttcaagcgattctcctgcctcagcctcctgagtagctgggattacaggcatgcgccaccacgcccagctaattttgtatttttagtagagatgcggtttctccatgttggtcaggctcgtctcgaactcccgacctcaggtgatccgcacatctcggcctcccaaagtgcaggcgtgagtcaccggacccaggtcccgccctggcactttttaaccacccacaaatctggatcctacactgaaaagagacactgcagtggctcacgtctgtaatcccagcactttgggaggccaaggcgggcggatcacctgaggtcgcgagtttgagaccagcctgaccaacatggagaaaccccgtctctactaaaaatacaaaagtggccaggcatggtgtcgcacacttgtaatcgcagctactcgggaggctgaggcaggagaattgcttgaacccaggaggcggaggttgcggtgagccgagatcgcgccattgcactacagcctgggcaacgagagcgaaactccgtctcaaaaaaaaaaaaaaaaaaaatcctgagtcccgcttgacaccttttgtcaggcaccaccacctttctgggcgaatgcggtagtaccgtctgctctccctgctgctgtcctgaaatccattcaggcacagcggccgagagctttataataaccgattccaggtgttaggtgctttcccagccccgactcctgcgtcctggacccgcagtcctctgcttaatacctttgctttattagaaaacattctcctctactccgttcagctattcgctgagggcccgccaaccgccagcggttgtcagtggcctagaggcagcggacgcaaacacggggagaggtgcaatcgtctcaagtgactcggcgggcggggcccacaaccggaagcgggtgggcgaccttcacccacgtgcgctgcggcttcgttcgccagcatccaagatggcggcagggcggggcccaaggcgcggcgcgaattgtgacgcaggcgtccggcgtgctccgtgcgcaagcgctttcggcggcgattaggtggtttccggttccgctatcttctttttcttcagcgaggcggccgagctggttggtggcggcggtcgtgcgggttcgcgccgggccgagagcgggttgggggctgcgggaggctgcaggggcctgggcggcagaagaggcggccctgagctggctcatgcgggccagtctcggcagggtggctgggcagggctcgcgaggccacggctcggagcccagaccggggcccaggaggcgagcgccgttttggagaggagcctgcctgctctgcctgccagcgtgaccccacgaggcctcgggcgggaagaggtcctcggggcagatccgagttaatgagagaggggtattgagcgtgtagcgttaactctgccagtcactgcgtcagtcgctttggaaatactaaatttctcgagctgagtcttcatacctggctccattactacgtctgtaaggaggagctggtggtagtgtctgctttttagacttttctttagactatttgtatttttttcagatggagtcttgctctgtcgcctaagctggagttcagtggtgcggtctcggctcactgcaatctccacctcccgggctcgagcgattcttctgcctcagcctcccgagtagctgggattataggcgcctgccaccacgcccagttgatttttgtagttttagtagagacggagtttcaccatgttagccaggctcatcttgaactcttgacctcaaatgatccgtctgcctcggccttccaaagtgctgggattacaggcatgagcccctgcgcccggtcgattctttgtctttttaagtcaacttttatatgtgaacaatgcttggcaggtggttggtagatactaagtgatgttcgtggtttggggtcaaggcaagaagtggggtctggagagttttggtgtaattgagaaggaagctaagagtgttgggtgctccagcttggagttagagaggagagaggctgcgacaggaaggcatgtgtgttgtaggggatggcttcccatccaggctggcagcaggagcagcctgtgcagatcaggacctggctgccgtggaagagggtgggaccgccttcagggaagatggatctagcaagatgatgccaaagggtacttattccatcaggagatactgacgagtccttccgccgctaaacctaaggagaataaccacagtctgtgttcctgaagagcacccgtgcggtcaggagggtggaggacatgtggtctttagttccaggacatgtttagactacaggccagggtgtgtgagaagcctagcagggccaggcttggaggagtgaaaggaagacaggtactggggcaggaccagttggacttggtgcaggcaaagggatagcaactgtggtgtaggcacctgagcttgtgctactcaggcatgcattgctcaccagtctatcctgcctcccttcctcctgcagacgcaaacatgcagatctttgtgaagaccctcactggcaaaaccatcacccttgaggtcgagcccagtgacaccattgagaatgtcaaagccaaaattcaagacaaggagggtgagtagggctgggtgtgggggctctggctgtgaactgggagtccctctctgcccaggggagtctcagtcctgtgtgggttgtgctgactttagatctgttttgcccttgcttctccatgtgatctgaagaacgtttgttatcttctacctcagttggccttttgagaaactgggggtagtgctggagctcccctgcagaggacactgccagtaatatggtccgcagagcctctaactgagcctccctccccctcaggtatcccacctgaccagcagcgtctgatatttgccggcaaacagctggaggatggccgcactctctcagactacaacatccagaaaggtaccggggttggggttgctgggcagggacccaagatccccaggtcctaggaaaggagcattgatggcctcaggggttggggagcagttcaaatgacttgtgttttgtttaaaataatgggactgggcacagtggctcatgcctgtaatcccggcactttgggaggcttaggcgggtggatcacctgaggtcaggagttcaagaccagcctggacaacgtggtgaaatcccgtttctattaaaaatacaaaaatcagctgggtgcagtggctcaggcctgtaatcccagcacttcgggaggctgaggcgggcagatcacaaggtcaagagattgagatcatcatgaccaacatggtgaaatcccatctctactaaaaatacaaaaattagctaggcatggtggtgcgtgcctgtagtcccagctactcaggaggctgaggaaggagaattgcttgaactcgggagacaaaaaaaaaaagtcataatgtgaatttttttatcactgcaataaggaaattagtgtcacttgtgggagcgacaagaattcagtgtcctttttttgtgagacagagtcttactctgtcacccaggctggagtgcagtgacgcgatctcactgtgacctccgtctcccgggttcaagcgattcccctgcctcagcctcccgagtagctgggattacaggcacccgccaccacgcccagctaattttttttgtatttttagtagagacagggtttcactacgttggccaggctggtctcttaaagtgctaggattacaggcgtgagccatggtgccccgcctagacttcagtgtctgaccttgcctgaaccacttagaggtcggcttccatgttagaaacccagatggatgcctcagttggcatgtgtcagtctcagactccccccagggctcgtggtcagtgctgagatggagatttcctggggcaggctggctgggacagtgtatcttccacacgtagaacactcgggggatcccgacttggtgtccccatcacacttgagaaagcagcagactataggccctggagggtcctgcccctgtgactgaggagccagggctgggctcagtcgccgtccttctggctgtctcctgcagagtccaccctgcacctggtgttgcgcctgcgaggtggcattattgagccttctctccgccagcttgcccagaaatacaactgcgacaagatgatctgccgcaagtatgtgtgctccgatgcttggggggctgtgggggctgccggagtcggggtatgccctcacccacccctcctgtctctgtgcaggtgctatgctcgccttcaccctcgtgctgtcaactgccgcaagaagaagtgtggtcacaccaacaacctgcgtcccaagaagaaggtcaaataaggtggttctttccttgaagggcagcctcctgcccaggccccgtggccctggagcctcaataaagtgtccctttcattgactggagcagcaattggtgtcctcatggctgatctgtccagggaggtggctgaagagtgggcatctcccttagggactctactcagcactccattctgtgccacctgtggggtcttctgtcctagattctgtcacatcggcattggtccctgccctatgcccctgactctggatttgtcatctgtaaaactggagtaaaaacctcagtcgtgtaattggtgggactgaggatcagttttgtcattgctgggatcctgtcaggcactttgaggtgtccctcaggccttggccctgaagtgtctaggtgtgtggagatgggtagaaaattaggtacacccaatggtgtagaacgttgattctcaaatttttttattttatacaaatggggtctcactatgttgtccaggctggtcttgaactcctgggctcaagccatccgcccatctcagcccctcaaagtgttgggattacaagcaagaactgccatgcctgacccagttctcagttttttgtttgtttgtttgtttgtttgttttgagacggagtcttgctctgtcgcccaggctggagtgcagtggcgcagtctcggcttactacaacctctgcctccggggttcacatccttctcctgcctcagcctcccgagtagctgggactacaggtgcccgccacaactcctggctaattttttgtatttttagtagagacggggtttcactgggttagccaggttggtctcgatctcctgaccttgtgatccattcgccttggcctcccagaatgctggtattacaggcgtgagccagcacgcctggcccagttactcagttttgaatctgaggccgtgacatcactcatggtctgcagtcagtgctctgcccctgagctgtaccctctcctatgataatcactcttaagaagggcaacccttggtgttttccccttaaggtcacccaggctggaatgcagtggtgtggtcatggctccctgtaccctggaactcaggcttgggtgatcctctctcctttgcctccgaagtagccaggactacaggtgtgcacccaccaccacactcagataattgctttggtgtttttaaagcttgtaatgatcagtaggctgaggtgggcaaatcataaggtcaagagttttttagatggggtgagcacagaccaattcctgttttatttactgatttaaaattttgagacagtctcactgtcacccaggttggggtgcagtggtaggatcatagcttgctgcagccttgatctcccaggatcttgcctcagcctcccgagtagctgggactgcatgcttgtgccaccacactcggttaatattttgtagagatggggtcttgctatgttgcccaggctggcttcaaactcctgaacttaaaagcctcctgtttagttttggttttttatcactttttttttttttttttgagatggagccttgctcccatcgtgcaggctggagtgcggtggcgcagtctcggctcactgcagcttctgcctctcgggttcaagcgattctcctttctcagcctcttgagtagctggaattaccagtgtgcgccaccaccaccacgcctggctagtttttctgtttttagtagagacagggttttgctatgttggccaggctggtcttgaactactgacctcttgtgatctacctgtcttggccttccaaagtgctaggattacaagcgtaagccacagcgcctggccttgctacatttttttttttttttttttttttacagacatggtctcgctatgttgcccagaatggttttgcactgggtccaagcagttctgccgcagcctcccaaagtgctgggattacaggggtgaggcaccttgctggcccctgttttgattagggtgcagtgctggtgaagccggtgcacgaggccagtgatgcatcctaatgaggggtggagttggcgggacttcctgggccagtttggggactttcacaaaagacccccatgactcagg

SEQ ID NO: 12216 - DNA, 36759 bp, Human
tttgtcacttgaagctgaagctaatcctgatagaagctgtaaaccacatttctgaaaaataataattggaaaacatacagtgttctgcagtaagatgtctgaaaaagatggataaaattatgaaaacatcaagcatatgttgcagtgaacatcacggcattgacagtaatgctttattgcccacatctcccataactggaaaaggggagctgctctcctttaggagcactggacagactgccttggggtgtggggtgctgtctgattagagagagagcagctcttgaatgggggaggaaacacctccactgtgactttttgcacattgcatttgcacaaattactctctgaaacagtctcaaaggaccatgtcattttataaagcactgtggtcatttgaaaagatggaggtagactgaaattttgaattttggggaattttcctacactatgcatacttgtgaagtttgtattgttaaatttcatttgatttgacaaatccgtgttaagagtatacgatgtccaggtacagaggctgccccagaaacaagacagaagtaggcagggacccatggctctcatggaacacgcttttggttagaggcaacagataagggtaatacatttatagcatgccagtaagttctatagtacggtgtgttgagtaggtgttgcagagaaaaaggtatgcggtgaaggccgggtggtgacggcctaggccacactgaagaggcaacatttgagcaaagactgaaagagcaggtgggaagagtcggggacaagagccgccagaaagtgtttccggggagggaagagtcagggactctgaaccaggccagggcagctggagtggagtgagagggagggagggtctgggagtatggcggggtgaccggaggcagagcaaagcactgcaggacttcagctttactgagtgaaatgggcggagcagagtgtgaatgtgatcagacttcttttcaagggatcatctgcaatgctggaaaggaaaagacaaatgatagattattgcaacaaacagccaggcaagagatgcaaactttttttgcaaaggtgtgtgtgtatatacatccttgcaccggacagccacgaagcacctactgtgctgtgaagtcagtaaggatgtgggttaaaatcgctcacctcacagcgggtcaatcgggaaagcacacccactcactacagccattatgggaaaaagggctcgccccttacaggatcctcaactgtggagaggccgggagcccacgcggggcgctggggagtctctcagcaccccaggggttcgggcagggacctgagccgcgccctctctcccgggggtgccctggggtcgaggctgctcggcagagccggcggtcagttcgagccgcgggcccgaacagggctctccccgcggctctctccctcggagtagaaggtgctggacccgaactccagcggagccgcacaacacgtggaggaaaagcgccaggacagctaaccttcccaccttttcaaacctgaaacccggccggctggggacggttggaatgttcagtgcgtacccgcacctcaggccccttgtctccagccccagaccgccccgcgaccatcctccccaccccccgacctcttatctcgtccccgccctgtctccccaacctccatcctcccctccacaacccccgtcctcccgcccttcggccacgcgcggctggcacagaacaggcagttagcgcacacacactggaacaggcgccaccgttcaggaagtctctacaagaccaggaccctgaggcctctggaagtgccgggaccgaaccaaccccgcagagcgactaaggcgagggcaggagccaagagaaccgtagccgcggtcgcgggttgagctcccaccacccggacagcgcgcctcggcgatcgcgcacgcgccacgccccggaagagttcctgggcccgcgacggtggcccggaagcagtccccggtgtcggggcaggaggcacgcgcgcggctgaggcgaggtcgctcggcgcagctgttgcggggccatggcggggaccgcgctcaagaggctgatggccgagtacaaacgtgagtctggggacccgggccgtcagcagcgtcccgcgttcctgctcccgggcccgcgtcgtccggcggggctggggcagggagcctggcgggggagccgggcccggggcctccaccgtgagcccccctgtgggtcccgcggagtgccgcgccctgcgcccgctgcccactctcacgcgtgaagtcgtgaagagaagccttcccagcatcagtaaaggcagcgccggcgccgtgttagttgagagcacacacagttgagtctttgcgggcttgtttttttctcttctattttttcttttcttggcagccttgagaacgtgcagtgagagcttgaggaagaaggcctgacttgctgctgcggaattaggagggaaaagtgtatgcgttaaaaggggaaaggctcgttggtggagctttgaaaggtcagattttggctttccctctaatgaaggaaaagggtttttgaacagtgccacctgtcactcctcctaggtagtgttgaggaaacctcttgagtgctttcctacccggtaaattagatatttctaatgtctgaggagagcgaagggagaaatgagaacctaggaacactcggcattccatcgttttacaccgaatgcccgcttggaagaactgctgcgagaagtcttggaataccattgtgttgaaagcgccaggagcctgagtcgccgatggagacgagatagtagccggctaagagcagggcctgagttcagacccggcctctctgcttgttagctctttgaccttgttcctctctctgtctctgcagtttccttgtcttaaaaggttaaacttgatactgcaggtgaagtgcttagcaaaatacctgatgtgtaacccttaataaagttagctgctgcttttgtaattagattgaggataattttggaagaaagttaagctaaaagaatgaatgtgagaaaaaaaataagtggtgaatatacatgtagcttgatttcgtaaaactattggtgacaccgcccagtaagagttgatgtttggcttaagcagaccaaaacgttgcaaatacaggctcactcacgtatggtcattcttcccttggtatctggaggggattggttccaggccccgctgcagataccagaatcctcggatgctcaagtccctactataaggtggcgtggtatttgcatttaatgtatgcatagcctctcataacttttaaatcatctcaaggttacttatagtacctaatgcaatgtaagtgctgcacaaatagttacactgattttttttacttgtatttttaaatcgtcattttttattgttatttttttcaaatattttgtattcctggttggtcgaatccatggatatgcagccgcagatacacagggcctcctgtaaacgttcaaataacgctcgccacctagtgtctgctaaagcagaacataaaggcacacctcagtttcccgcgcgctttgctttattgagcttcacttcgcagatcttgcattttttacaagtttacaagttttttacaagcaaccctgcatggaagcaagtctgttggcaccatttttgctcgcttcgtgtctctctcttacattttaatctattactgtgatctatgatcagtaatctttgatgttactattgtaattattttggggcatcacaaactatgcccataaaagatggtagtcctaataaatgttgtgtgtgcttcactgactggctgtttccccatctctctcccggcctctctcttccctgagacaaaacaacattgaaattaggccaatagtaactgtacagtgggctcaagtgttgaagtgaagagttgcactctacccacttcaaatcaaaagctagaaatgattaagtttagtgaggaaggaatgttgaaagtcaagataggctgaaagctgggtctcttgttagccaagttgtgaatgcaaaggaaaagttcttaaaggaaattagaagtgctgctctgttgaacacaatgaatgataaagtgaaaaagccttactgctgatatggagaaagttttagtggtttggatagaagatcaaaccagccataacattcctttaagccaaagcctaatccagagcaaggtcctaactcttcagttttatgaaggctgagagcagtgaggaagctgcagaagaaaaattgggagctaacagaggttggttcatgagattgaagtaaataacctgtctccataacagaaaagcacaaggtgaagcagcaaggtctccagaagatctagctaagatcaagatgaaagtggctcctaaattaagcaatagatttacaaggtacgtaaaatagccttatacggtattgggaggagatgatgccatatacaacgtaaacagctagagagaagtcaatgactggcttcaaaggacagggcgactcttgttaggggctaatgtcggtcactttaagttgactgagttgaagccagttctcatttatcattcagaaaatcttagggcccttaaaaattatgctaaatctactctgagctctagagatggaaaaacaacctggatgacagcacatctgtgtacagcatggtttactgaatataagcccactgttgagacctactgctcagaaaaaaagattatcttcaaaatactattcctgacagtgcacctggtcactcaagagctctgatggagaggtataaggagataaatgtttttgtgcctgctaacacaacaccaattctgcagcccatggatccgggagcacttttgacttatttaagaaatacatttcataaggccatagctgccatgaaaagtgatttctttgatggatctgggcaaagaaaatcaaaagtcttctggaaaggatttatcattctagatggcattaagaacatctgtgattcatgggaggtcaccatatcaacaacaggcgtttgaaaaagttgatttcaatgctcatggatgactttaaggggaggaagcaactgcaggtgtggtagaaatggcaagggaactggaattagaggtggagcctgaagatgtcactcagttgctacaatctcatgatcaaacttgaacagatggggagttgagtcttacagatgagcaaagaagtgattcttgagatggaatctactcctggtgaaaatgctgtgaacattgttgaaatgacaaaagattgagactattccataaatttagttgataaagcagccgcagggtttgagggtattgactccagttttgactgaagttccactgtgggtaaagtgctgtcaaacaacatcacagactacagagcaatcttttgtgaaagtaagagtcagtccctgtggcaaacttaattgttgtcttattttcagaaactaccacagccactcctgccttcagcaactaccaccctgatcagtcagcagtcatcaatatccgggcaagactgcaccggcaaaaagattatgacctgctgaaggctcatatgattgttagcattttttagcaataaaaattaagcatattttggcaaataataattatttatttatttattttttgagacagggtcttgctctgtcacccaggttggagtgcagtggcacaaccacagctcattgcaagccttgacctgggctcaagctatcctttcacttaatccacctgagtagctgagactacaggcatgtgcccctacacctggctgatttttctgtcttcatcttgacctccctctatgttgtcagggtttggcgaaagtgactccattttgattctgacaatgttcatactcgaacagagggttggatgtgggggactattacttctgtgtcctcatgggaaacctggctggtgggtcagatgtgtgaacacctaccatttcttggtatcctggtttgtgtttgtgtctctgttttagttttattttagccctatttctagggttaggctagactgtgagcaggtattttctctttttttttttttttttttttttttttgagacggagttttgctctgtcgcccaggctggagtgcagtggcgcaatcttgactcactgcaggctccgcctcccgggttcatgccattctcctgcctcagcctcccgtgtagctgggactacaggcgcgcgccaccatgcccggctaatttttgtattgttagtagagacggggtttcaccgtgttagccaggatggtctcgatctcctgacctcgtgatccgccagcctcggcctcccaaagtgctgggattacaggcgtgagccaccacgcccggccttctcatttttattgagaagaaaatcattaaacccctgcataggaaattaagttcaggctgctgcttcaggccagtctttgcattgttgaacttgcattttctaaggatatttgcattagcaaagatatgttctcccttttattgtcctgacagaagcttcatctgttatttcaattatattgtcaattagtttgcagtaataagacctaaataatggttgatttccgaaggtttgtcacggaagtgtgttgtgtgtttttacatgttaacatgaaattttggactatgtgtagaaggtagaactctaaacatacctcactaagattcccatgcccttgttattcaagcactttctagtacttcggtggagggactttggagatgcaagtcaggttagtaatcagcagacctaaagagtgggagattattctggattaccgtgaaggatccaataataacataaggctcaaaagcagtcagtgaaggcaggatgggggtggtcagagagattcaacatatgacaagatctctaccttctgtggctggctgtgaagatggaagaaggagccatgacctaaggaaggcgggcagcctcaagaagctgagaatgatcccagaccaacagacccgtggaagtgaattctgtcagcaacctcaatgaacttggagtggcagccctggtgagactctgagcagagaactagctggcccatgctgtgtccagacttctgacgcttggaaactctgagatcatcaatgagtattgttttaaatcactaaatttgtggtaatttgttacagcagtgacagaagatgaatacagtgtgttattgaggggactttgtttttcctgtatcttaataatgtgataaaatttagtgggttttttttgtgtatcatttactggttttttttgtgtgtgtatcttaacatctagtttgtcctcataacgtattttaaggtagcacattccagtgtaaaggtggacttgacagaatcaatctctacatagaaggggtttagataaatttggttagatgttcatgcacactttattgtatttgggagtagtcatataactgcagaaattcagaggtggtgggaccttggctatgattctgttcaagccccctaattttacagattttatggaattgagcaacagacaagatgattttgcctaggttcataaacaggaaaaaaggagagccaggaaagaactcaattgttgtaaactgctgtcttgtcttgatgttctgtcttcattcatcatccagcctttcctaggagtgtcagagatagacccaggtagaagtgggctgcccatggggggcttagcacaacagaaatttattcttttactgttctggaggccagacatctaaaataaaggtgttgatggggtcattcttcctcttgagggctcgaggggagaacccttacttgcctcttccagctaatggtgattgttggtcatccttggcgtttattgtcattctcttgcttgaggtagtgtaattctaatctctgcctccatcttcgcatggccatcttccccctgtgtgcatgtcctaaatgtacatgtctttctgtggatatatgcttttatttctcctgtgtaaataaccagggttataatgggaagtgtgtgtttaatttttaaagaaacggccagttttcctctagttcacatttccctagcagtgtattaagtgttcccgttgccccacctccttgctgacacttcgcgtggccagttgttttttgttttcttttttctttctttctttctttttttttttgagacaggttctcactctgtcactcgggctagagtgcagtggtgtagtcatggctcatggcagcctctgcctcctaggctcaagcaatcctgccacctcagcctcccaagaagctgggattacagttgcatgccacctcgcttagctaatttttgtatttttagtagagatagggtttcgccatgttgcccaggcttgtctcgaactcgtgggcccaagcaatctgcccgtcttggccttccaaagtgttggaattacaactgcgagccactgcgcccttccagttttaaaaattttagccattctattgggtgtatagcagtcttactgaggttttgttttatttatttatttttttttattttttatttttgaggtgctctctctgtcatccaggctggagtgcagtggcatgatctcagctcactgcaacatctgcctcctggcttcaagtaattctcctgcctcagcttcccaagtagctggggctataggcgcgtgccaccacacctggctaatttttgtatttttagtagaaacgggatttcactatgttggctaggctggtctctaactcctgacctcaggagtttgcctcgcctcccaaagtgctgggatttacgggcatgagccacagcccccggcccttactgaggttttcatttgcatttccataagactcgtgatgttgagcatcatttcacgtgtttatttgccatccatatgtctttttagataaagtgacttgagtctttgcttctttcaaaattgtgttgattttcttaagttttagttctttggctgggcgcagtggctcacgcctgtaatcccagcactttgtgggctgaggtgggcggatcacgaggtcaggagatggagaccatccgggctaacacggtgaaaccccctctctactaaaaatacaaaaaattagctgggcatggtggcggacccctgtagtcccagctactcaggaggctgaggcaggagaatggcgtgaacttgggaggtggagcttgcagtgagccgagatcacgccactgcactccagcctgggtgacagagcgagactccgtctcaaaaaaaaaaaaaaacaaaaaaagaagggtttttattatttcgatgaaattcaattattgacttttaaaatatttcttgctattgtgttatatttaagaaataactgccaaacatcaggtggcagtaggattttctcctatgatttcttctagatgttttatagtttcagctcttgtatttaggtttgggatccatatcaaagttttccatatggtatgagataaaggccaaggtttatttgtaaattatttgtaaatggcagtgcagttgtttcagcactgtgtttgctagggctgctctaccacacaggctgggcacggcttaaacaacagaaatgtatttcctcatagtcctggaggctggaagtccaagatcaaggatagggcagggctggtttcttctgaggctctgtcctctatgcctgtgtcctcatctcttcttaaaaggatattagtcagattggattaaggtccaccctaatgaccacattaattttaattacctcattaaaggccctagtcacacacttttctccaccttcttttttttcatgtaatatgtcctgaagtttgttctgtactagcatgtagaggtatttatagctgcaaagtaccccactggtatatgtatcataatttgactggtcctctgttgatagacactcaagtcctttttaatttctttttgtttttacaaatagtcctgaaatgaatagcctgtgtatacattttttatcttcaccaatgttatctgtgggatggattcctagaaatggaattgctgggtcaaaggttatatttcactttgtgtggtagctatttgttaagccactattttaagtggcaaggaatggcctctgaaaatttccctgataccaagattcgtctctttttttgaacttgtttcttatcagtaaacatgaaactgtatattattttgtgtacgcgtgtatatgctttggaagcaaaaaacaaaatggaaaaaatcaagtgccctgaaccattccctccagcctctgaactcatttgctgcaattctttattgaccagtagaggccactgttgaataacaaagctggcgggaaggccagcgcacacccgggcaggtctctgtgctgagcctgcattgccaggagcaggtctggagctgcagtttttagaccaccctttcccctccctaagggagggtgtcacgcaggggagtgccaaaggggaactccagatgaagaataaagccagctctctttggtacgagctcttcttcatggtcccacgaaggtgatttgtaaagcttttgtgtgttctgctgccaggcctctacttagttgcccactgacattgtgtttctcccgcaccccacctgcttagcagtttacagtctatctgccttaatctgttatttttttcttataattaggcggtttggcttgagacacaagaatgggactagattttagatgactgggtgtaggaagcctagcaaattaggttctgtggttatttctcctgatctactccacatgaagagacacaaagggagaacatcagggtgtggcttgtgaaatccaaggtcttagtcggcttggtacttgacctcattcacattcagttcccacccacccctgaaatgtttaatgcacttggcccttggggccagcacttgcctttggcctgccttgctggcccctccttgccactctgccttctctcactgctgggtgtcagcacacccttgtgacagcacttaggtctcttcaggacctctgtttcctggatcagggcttctcagcaggtgttagtggtattttgagtgaaataatttttccttgggtaggccttgttctacccaaggttgtgggttcattaaacggttaatcggtacattagtccgttcttatactgccataaagatactacctgagactgggtaattataaaggaaagaggtttagttgactcacagttctgcataactgacgaggcctcaggaaacttatagtcatggcagaaagggaaacagacctcttctcaaggcggtaggagagagaagagcaagccaaggaagaacttgccacacacttatagaaccatcatgtctcctgagaactcgctatcacgagaacagcatgagggaaactgcccccatgatccagtcacctcctaccaggttcctcgctcaacactttggggattacaagtcaaggtgagattcgggtagggacacaaagccaaaccatgtcatttctccccctacccctcccaaatctcatgttcctttcaaaaccattccatttcaaaacaaatcatgccttcccagcaaggcccccaaagtcttaactcatttcgtcattaactcaaaagtccaagtccaaagtctcatctctgacaaggtaagtcccctctgcctagcagcctgtaaaatcaaaagcaagttagttactttcaagatacaatggaaatacaggcattggataaatactcccattaccaatggaagaaattggccaaaacaaagggctacaggcccccatgcaagtccgaaatccggctgggcagtcattaaatcttaaagctcaaaatggtctcctttgtgaccccgtgtctcacatccagggcacactgatacagggagtggctttcatggtcttgggcagctctgcccctgtggctttgtagggtacagccctcccacacccacccccttcagctactttcatggtgggcattgagtgtctttggcttttctaggtgcacagtgcaaagctcttggtggatctaccgttctggggtctggaggatggttgtcctcttctcacagctccactaggcagtgccccagtggggactctgggagctccaaccccacatttcccttctgcaatgccctagcagatgttctccatgagggccctgcccctgcagcagatttctgtctggacatccaggcgtttccctacatcctctgaaatgtaggtgaaggttcccaaacgtcagttattgaattctttgcacccacaggcccaacaccacgtggaagctgccaaggcttggggtttgtactctctgaagcaacagcctgagcggtaccttggccctttttagccatggctggagctggaacagctgggacacagggcaccaagtaccaaggctgcacagagtagcagcggggctgggcctggcccacaaaaccatttttccctcctaggcctccctgcttgtgatgggaggggctgctgccaagatctctgacatgctctggagacatttaccccattgtcttggcgattaatatttggctccttgttacttatttgaatttctctccagaaaatgggtttttcttttttattgcaccgtcatgctgcgaagttttcaaacttttattccctgctttcttttaaacacgagttccaatttcagatcatctctctcaagttcaaagttccacagatctctagggcaggggcaaaatctcaccattctctttgttgaaacatagcaagggtgaccattgctccagttcccaagaagttcctcttctctttttcagaccacctcagcctgggcttcattgtccatgtcactatcagcattttggtcaaaagcattcagcaagtctctaggaagttccagactttcccacatcttccttcttctaagcccttcaaactgttccaacctctgcctgctacccagttctgaagttgcttccacattttcaggttatctttatagcagtacccctggtaccaatttactgtattcatctgttttcacactcctataagaacttccctgagactggataatttataaaggaaagaggtttaattgactcacagttccacatggctagggaggcctcaggaaacttatcatgacagaagccgaaggggaagcaagcaccttcttcacaaggtggcaagaaagaagagtgaaggaggaactttcgaacacttataaaaccaccagatctcatgagaactcactgtcatgagaacagcatggaggaaattgcccccatgatccagtcaccttccactaggttcctccctcaacacctggagattacaattcaagatgaaatttgtgtggggacacaaagccaaaccatatcaatggacatttgggttgtttccagtttggggctattacgaatttagctactatgaacattcacacaaaagtctatggcaacataagacccagtagaattgctgggtcttagagtcaatatatatgtaattttagtggaaatggtcaaacttctttcccaaagggtaaccaaaccattttgcattcccatcagtggtgcatgagagatctacttgctaaacttgccagcactttaagtctttaattttggccattcttttgtgactaaagatactgataatgctgaagctattgagctgtatcttattgtggttttaatttgcattacccttatgattcacaatgttgagcattttctcatgtgcttatttgccatctgttttagtcagttcaggctgctgtaaaaaaataccaaagaccagggagcttaaacaacaaacatttattgctcccaattctggaggctgggaagtctggtgagggctgtcttcctggtttgcagatgactgtcttctccttgtgcccttacatggccagaggcaaatctctcgtttcttcttataaaggcactaactccattcatgagagttctgccctcctgacctaatctcctcccaaaggtcccacctcccaataccacatacattaggattcaacataggaattttggggggacgcaagcgtttggaccacagcatcattcgtgttgactctgacagtggctcttttcaactctgcctccatttttcttcttacctattttgatttttatatgtggtgtgagatggggaaagtttgatttttttttgtcttagagatgagcatcattcatggaaaagactgccctttgcctctgggccatagctctgtgttccctcgagtcagggtctctgttggtacaggtatgcttctgggctttctcttgtgccccattgttcaatttaactttgagccagtgctacgttgccttaatttccatagctctgtaaggaaggcttggtaactcatagatgaagctttctgtttattctttttttttttttttttttttgagacagagtcttgctctgtcacccaggctggagtgcagtggcgcgatctcggctcactgcaacctccgcctcctgggttcaagtgatcctcctgcctcagcctcccaagtagctgggactacaggtgcatgccaccatgcccggctaatttttctatttttggtagagatgggatttcgccatgttggccaggctggtctcgaactcctgacctgaggtgatccacccgcctcggcctcccaaagtgctgggattacaggcgtgagccaccgcgcctggccctctgtttattctttttaaagatagtgtcttggctattctggattgtttgcatttttatatatcttttagaaagatatatatatgcctcatattcagcaactgtgccaaactcacttttactaattatctttagattcttttgggctttcctgtatatatggacatagcatctgtgaataatgagttttatttctttttcagtccttataccttatatttatttggcaaggatttattaattttctgtctcttcaaagaaccaccttttggtttcattgatttttttttttctgtatgtttgcttactgttttattaatttccccagtctcactctggttgcccactggactccagcctgggcaaccagagtgagaccctgtctcaaaactaagcaacaaagtaaccagcaggaacagtttggaaagacagtgtaccccttatgtttgcttttgcatttgtaaaaagaaaaagaaaaagaaaagtctatgttttgttggtataaagaactatttgggccggcgcggtggctcatgcctgtaatcccagcactttgggaggccgaggctggcggatcacgaggtcaggagatctagaccatcctggctaacacggtgaaaccccgtctctactaaaaatacaaaaaattagctgggcgtggtggtgggcgcctgtagtcccagctacttgggaggctgaggcaggtgaatggcatgaacctgggaggtggagcttgcagtgagctgagatcacaccactgcacttcagcctgggtgatagagtgagactccgtctcaaaaaaaaacaaaaaaaaaacaaaaaaactttgtgtagttgttatcagaaccgttattgtactaggtattcactttgggcaaacagaattttcacttgttaatatgcatattctatggtttataggcttatatattttgtaaaggtgttttgttaaaatgacaatgtaacatttattctgtttggtaatggttttacttattaattttatagaattaacactgaatcctccggaaggaattgtagcaggtaaggtaccaaagttaacttccttataatttacttttaattgccaaagttccttcaaagttaaaatgttgtgaaattttttctcaccctacaggccccatgaatgaagagaacttttttgaatgggaggcattgatcatgtaagttaattttaggtgtactagtttttagggctttgctggaagtcagatgtaagaatcacatcagcagtgtgactgtgtccaaaagcatcagctggaaaaaagactgagttctccagtaatgcccagctctcgtctaggctgctggtctgaaagcagagaacctgagcattgatccaaaagaaatgagtgtttccttagagccagtcaaaggtttagttataattatgtaatatatgtattatatatttgagagttttaaggtggtaattttggaatgttgtatgatcgtggttaaaataacctcaaatggcgtaggtggctttggcttccagaagtagccccttcaggtgtgaaattttgacgagaaaagggtcctcaaagatgtgtctgaccacaccaggcatgttagcgcagccttgcctgccctgcctttgggccaggacttctttttcttctcctttcctcccagttcgtatcttcgtgtgctgcatctcctttttctgttgccttgtctggacttgttggccttgtgttctttccgacccaagacatggcttagtaagtgagcagtgtggttctgggattcgtggcatttaacttagggtgacgttgcttggaaagagaaacacatggacccctgattttagagtgttctatggccttgactcactttgctttttcttctttctaccttagatgtgcaatttttggccattcttagtgtattttcagcaaagtgaggttaaataaaatttaggaagttgaaatttgtaatcagtctctgttttctttcttttctttttctttctttcttttttttttttgagatggagtttcgcccttgttgcccaggctggagtgcggtggcacaaccttggctcactgcaactcctgccccttgggttcaagcgattctcctgcctcagcctccctagtagctgggattacaggtacccaccaccgtgcctggctaatttttgtatttttagtagagacagggtttccccatgttggccaggctggtctcgaacttctgacctcaggtgttccgcctgccttggcctcccagagtgctgggataacaggtgtgagccaccgcgccaagcccagtctttgttatctcattagtgaggtcttttaatttgcagcaaggtcttgggttggattttgttgcattgagaagtgctctagagggcaaggaccggaaaagtgagggctgtgaaacaagtgtgggctctggcttgaagtgatcttaagcttcatgatgcttttggaattcgccagttgcttggatcacattaattcttaatgctctatgggttggtctgagaaacagattgcagctaagtgttgtctgtggaggttaaattgatatgaaaattagtattttggataaacaaaatgtttttaaaaaatcatcaaacgctattcagatggtacagcacgcctgccatttcctgatcatttgtaatatcctaattgcttgggcctatggcacatgttttttcggtgtctgaaggtttctggaatctgtgtttgtgtgtaatgtggcccccaaggcagttatgagatggatggcgagtcccacagtctgggctgtcctcattagtggactgtgcggctgtatacttgtatcggggcagctctttttatttctgtagaagcaggagatcatatacatgaactgatgtgtaacctgcttgtttcatgtgttaatgcaggcgcacctgcactcatgccagcggggcagcacgcctgctgcaggggcccagagtggcgggaggcctgtctgtgtgtagaggttgaaggcgcctgtcgtgtctgcagttatttgtggggtgttggctcctccgtaggcctatttggaagctcattaaaggaacagttgagccgtccagtgtggttttaaaaaaatgttcattgttaaaaatcgattagggtaactattaccaattttaaataaacagtgtaaaattaaaccaatattttgaaaacctgtcttaaaaagtaattagaactatttttaggtagagcacttctgtgtttgaacaaggctttttgcattagtttggaattcccctgcttgaagatcctagtgagtttgtgggttttggtcctgttccagacccttcacaaacaagaggccgtttacaagtgcacttaaaatgcctattagggaattaactgtcctcccatcgatttgtctcaccctgctattttggcagacatctggccaagtctttgctccttggtgataagtttcttctttttctctttattctttgatggcttccagggccgcctctctaccctagtatttctaaaacccgtgcttgcctcacagaagtcgaacggctgttggtttttgctgttgtgcttgccttaagggccagtgaagaaaatgtcattttagatatctaagcaacaaacactaagtgcctttgatatgttagggcccttgtctgaagatacagacatgtcaaagatgcactgaaatctttaccttggaagaccagggttgagggattaggatggagaatagaacagattagtgaatgagaggactaaataatgagagtccgcaggctgtgtctttaaacaccgggaataactctgctgaccctgccacgctcatggtggagtctgagcctgcaatcaaatcgagcgtggctgggatggcggcacaccaggggatgtggccaccgtggctgtgggtgctagcatggcctgctgctcttggcccagtcactttgcctctctttgacttatttggatcaaaacagagaggtttatcagcatcttctagacagatggttacaggtcttgcccagctctagggtccatggcccgtgaccccattgccactaagccacggtgacgggggtgtagctgcagagagggtgggtgccctctttcattgatgcacttatgtgggacagaaggagtcctagacagctgttcatccccagtggccggacaaggcgtggagtcccttggcgcttgctgtcctctgtgtcctgccccagcattcccaaatcagctggcttggtgaccttcttgtctggttcatgcctgactgctgtcacctccccagaccagtggttctagaggctgtggtgaaataagaaggaccttcctttactgaatggtgtgtttggggcccagttggtggatggatgctcccaggttctccagctggctcatggcagccagcttgagggctcccaggctgccgcggcttctaccaggagcccttctcacactgggggccagtgtccggggcacagcagcctccctttatgtccaggtttcttgttgactgaagactgtcacagggcatctcttggcagtattatgccttgctgaaataaacccgagataataaaataggtgtttataatttgtattgtatgtaatctcaccatagcattttcttcaacaaaagtgtcacaaagatccctatatgaagaagttattgccacattcattgcagtaataataataaaaaaggaaacatcactgttccacataatttatggagcatctatatagagtaatgccatgtagctgtaaaacagttcaggtggaattttcatcctggcatggaaagatgtacacaatataaatggaaaaggcggattctagaataataggtctggaaccgtctgtccgtccttccttcctctcctctcctccctcctctctctcttcctttctcccctcctttcttccctcccctcccctcccctccctttcttatggagacatggtctagctctgtcacccaggctgaagttcagtggcctggtcacagctcactgcagcctcaaactcccaggctcaaacaatcctcccacctcagccccacaagtagctgggaccacaggtgcacaccaccacgcccagctagtttttaaaatgctttgtagagatggggtcttgctctgtttcccaggctggtctcgaactcctggcctcaagcaatccttctgcctcagcctcccaaagtgctgggattacaggcaggatccaaggcacccagcctaaacagctttattgagataatttacatactgtaagttttacttgcattaagtataaaagttagtggttttagtaaatttctagagttttgtagtcatcaccacagtccagttttagaacatttccaaaaagattcttatgtctatgtgcagacagttcccattccaacccccaggcaatccctgctctttcctctgactatagatttgccttttctgacttttcctatgtgtggaatcatacactgtctaatcatctgtgcctggcttcttgtacttggcagaatgtatttgcagttcatccatgttataccatgtatcagcagctccttccttttccattccccagttgatggacatttgggcttcctactttttggctcttttgagcaatgctgctgtaaacacttgtcttgtcacactgtctgtgtggacatggagttcatttctctagaccagatatagaggtgtggaattgctggggtgtggagtaaatttgcgtttaatgttttaagaaactatcagactatcttcctagagtagctcaccattttgcattcccagcagcagtgtatgagcattccagtttctccacttccacaccaacactgctgttgtctgataacagctgttcttgtgggtgtaaagtggggtctccttacagatttgacttggatttccttgacgactaatgatgttgagcatctcttaatgggcttattggccgttcatgtatcttctttggtgaacttcagaacttttccccatttttatattcggttgttttcttgttgatggaacgttaagagtttttaaaatatattttgatacaagtccttcattagacataggatttttaaatattttcttccaatctgcaactctccattttgttttcttaatagagtcttttgaaactaaaaagttgttaattttgatgaagtgtgattttgcattttttttcttatatagagcatgcttttggtgttgtatataacccaaggttgcaaagattttctcttatgtttgcttgtagaagttttgtgttttttcacttttacatttaggcctttgatctattttgattgacttagtgtcatgtatggagttaggtgggagtctgtttcattcttttgtatgtggttatccagttgtctcagcaccatttgttgaaaagacagttctttccccattgcataattttggcacctttgtcaaaaatcagttgactataaatgcaaggatttatttttggactctgaattgcattccattgatctatgcctatccttaggccattactacactgtcttgattactggagcttcatggtaagttttaaaattgggaaatttaagtccgccaactttgttctttttcaagattgtttactaggccattgcatttccattacattttagggtcagcttgtcaatttctacaaaatgcctggtgggattttgattgagactacattgaatctttagataagtttgagggatattgccatcatatcagtactgagtgctctaatccatgaacatggactgtctctccatttatttaggtgttttaaaattctcagcaatgccatgatacatttgaatttttagaaatccagttttgtagattagagtatgtgaatttatacacacatagagaaaagctggaacaataaccaaacttaactctggttacctcaaggaggtgattttgggagggggagtgagggaggtatttgctttttattttatatacttctgtatttgaatattttccaacattcttttattttcctagttaaataaggtcaaagtttatgttgtaaaagtgattgtctatgttagaatatactataaagttcttataattgatgaacttatttagtacactttatagttcaaatatattagatttaaaaattttaagaaacatctatattgcaaaaaataattagggtatggctgtagatgccttttggacaggtttaactatgaaaataattatatggagcaaaagctatatttgcccctactatgatttcataaaatggaaatgttcccccttttcttccgagcagttcttagcattggttatctacctgagtatcgcctggggtgcttagaacaccacaaaacagaaaggaaacacaggggatctctgggtttaaaccagagccagggccctgctctgggggtgagggtcaaatatgtcatcctggtggagaccaagtgctggaggaaagtgcaggaaggcacttccccaaatcacggcttcttacagcctcgtcctcttgctacgagggtattgggatcagtttctatttaactcctcactgcctggcacagccacaagcacaacctggcatagcagagccagtgtcctagggcttttaaagtgcccagtgtgggggctgtgtgtgcagcccaccttggtcctgctgtcctgggcattagtggggtgggaacatcggcaagaagcttttgctgaactgcagagcagggactgaaggaaggagacgcacccaagctcagatgccgggagccctcatgcccttcctgctgggtgccctctgtcgattctgtagcgtaagggaggtgcttatccttcccccagagtggagggtgcccatgaagcagtttgcccttcccgtctccagctcagctggctccagcttttggagggccatcgtcccttagtcatccacttcaggttttaaatactgatggatgagtttgcattctctgtgattttaattctttatcacatgtgcgttggagacttcttgtctatgtgctgtgacaaacttgataaagagaacagcagcaaaagcagtcggctttcccaacacctgcgtgcagctgaagtggcgagcgcaccagttcctggaacaccgcttgccggcgaagctcagggcacccacttgccctgggtgctccataaggcactctgacctgcctgctgcttctcttatctagaaagtaaaaagtgttagaaaggcaatgcaaagaagaacaatctctcccttgagttgagtgtggaaagacagaagaggctgatcttcgcttttcactggcatataagtgacccacactgttgctgaggaatggtcacaactctggaggaggacagtgacaaggcagttgtcctttgtgaggagggagaattgctagtcaggagtaggccatgggtgttttcaatatttgcttttgtatctaattcacccacaagacagcaaaacagtctgagctgttgcaagcgtgcctcctgtgtagagtgcagggtcattatgatgcttaatctaatgcttgtccttagctcagctccgaaagagtttaggtcatgatttcaatcaataaggcagcataatttgcaggctttgaaaaatttacatttgctttggatatatttgtgtcctccttgttgttgtttcttttgaagattcccaggtgaggccatcttcggtgaaagagaagtgaggttgtctgggagtatggcaataaaacttgtccaaaaacagcactgtggcgtctcccactcctggctcgggagttgcctggaaggcatgttccatggggtcaggcatgctgctgcacaccactgcccatctgccctcctgtctgggcgccaggcgttctagaaaagagaaagaaatcccagtttcaaaccagtagtaaaccggagcatttgcaaataactttgatatttaagatgtgggcgcacttcaggaaatgtttggtcatgcttctgaggctaggaacgacctggtggattaaaaaaaattttttttaaagaaagccctattatgagaaacaaagaactgttatcaaagtattgagcaaataccatttggctcattccaaaaacactacccagacattttttcttattctggactcagaggtgccagaaatattgagtgctggcaagcattcctgacatatgaacagtgttacttttaaagatagtatctttatgtgcctgacttctgatttcgcagtttgaactgtgttctcttaactctaatactaaattgatctaggaccttgactaagtcatttcatccttggattttccagccttgcttgacagtaaaatgaaaaccacaatccttggtgccctttcatcagagggcgtgtggagaatgaatgggtggtggttatcgtttgctctgagctcttgtactggacaggaggctcggggtggccacgcctcactctgatacatggtgtgtgcccaccctgtgttgagaaggcggggcttcaggaatgtgtttgttcaggccattgcagggggagcagagtaacccaggcttgaggcgtccccaggctgccgggcgctgggtgccagtgtgggccggggggggtactcatccgggcactgtcctctccagcgcggctgttgtaccagtagcaagagctcatgctcgtgcctccctcggtggcgttccctgtgctggtcatgctgaggctctggggactgtcacacagtaccccccccccaccccagctccccaaaacaaagtggccatattcgctatcttcttctgaaaaggtagcaaagacagttttcagaatcaaaatttgtcttttagattgaaaaatcttgtctccatgaagcaatcactgctttgttctcttctgactgttgcccgcagatcagccctgctagggccatgagccgtgctggcatctgctgttgctgccgacagccctgagtgccgcctccaggtgaaagctaaagctcttcgttcagtttctttttgatttttgtctttttcctttaattatagagataaatatttccaagtctgttgttattaatttcactgaaccaagataattttaagatttttaaaacaaatttttacttttaagaaatctattttttaactgaagatttaaaacgtatatttttttaaattatttttttcctgtgccatatcctggattctttctgaaggcagtaggtctggtgtggactgtcctctgctcatccaggcctcggcccctgcacgactgttctttctgccttagcctttgttgttagaggagcagagctgtttaggaagggacttgttctttcagttcgtagacggagaacgggtttactgacctatttattgatctgatgagtcacacccagtgcaacttccactgtttcgttgtctgccgctgtcattcagcagtcctgcttccttatcaaagaaagatggtgcaagatcttttagaactcctccaatgtgtgttttattaatgtgatttgtaggagaagaggagttcgtccctggtgtgaaggtacaggcatagtggctgacactcttcctctcctgtggccatcatgccttgaactgttggtcaagatagtgttaatttatacttgttgggttttaaaccttaagcaggatttctgaaatggtttcatctatttcttccatttacacgtgaggaaagtataggtccagggagactcagtgcctgtgtctgtgcccatgacggggagttgctccaatgttgcatcagtgggatgaggcacagcacatgggcctgcaggtgcagcctggagtggtggtgcctgtgtgcctagcctttcaccgagcatgcagcagtgatcacatgtgctcttcatctgcttcttgaaggttgcaaagatgccttcttgggcacgtttaaaaattaaaaatcacctttgaaatacaactcttagccccacatctgttgaaatacaatgtaatcttgctataccctgtgccgtaattcatacccttatcctaaaatgtgattgtaccacatctgcagaaaaaactcccagatcttagagcattgacattagttcttttctctgatccccttcttatcaagaggttctgctgcttgactcttaaccttcataaatgtgaaaactgcctggaattcagtctttgtacttgtacctaagatttagaccagattgaaactggagaatgggacattgctttccactgaaaagaaagtaccaattcattgttacttagataatctttttgtgtgcatttttattatttatttttatttttgtttattttttgagacggagtcacgctctgtcgcccaggcttgagtgcggtggcgagatcttggctcactgcaacctccacctcccaggctcagacgattctcctgcctcagcctcccaagtagctgggattacagtcatgcgccaccacacccagccaatttttgtatttttagtagagacagggtttcaccatgttgcccaggctggtcttgaactcctgacctcagatgatctgcctgtctcggccttccaaagtgctgggattacaggcgtgagccaccgcacccggcctcacgtgcatttttaaagtggtaaaaatgttcttaacccatttgtcaattgtggtcgacgttgaaaaatgtactttgaagttcagtctacgtattttatatcttctaggggcccagaagacacctgctttgagtttggtgtttttcctgccatcctgagtttcccacttgattacccgttaagtcccccaaagatgagatttacctgtgagatgtttcatcccaacagtaagtgcttttggaagtagtttttgtggtaccaggataggtacggagataatattatcagccacctgaaatgtggtatattctatatgtctatgatgtagatctttagaaaacacttcttatgttttgaaattcagccaagtaagcatggtggtattaagcacatgatttcaattttgaaggtcagtttaatatagataaaagacaacaggcacctaaaaccggatgccatttgacccagccaccctacttcactggggaggaagttttacacatgggtgtgtgctcagaaggggttatgctaatctttgtcatagtgttatttgtaatggtgaaaattttgacttaacctgggtttttaacacaagaataaattaagttatatattgtattagtctgttgtcacgctgctaataaagacatattcaagtctgggtaatttataaaggaaagagatttaatggactcacagttccacatggctggggagacctcacaatcatggcagaaggcaaaggagaagcaaaggcacatcttagtggcggcaggcaagagagtgtgtgcaggggaactgccctttacagaaccatcagatctcgtgagacttgtacactatcacgagaacagcacgggaaagatgtgcctccatgattcagtacttcccactgggtccctcccatgacatgtgggaattatgggagctacaattcaagatgagatttgggtggggacacacccaaactatatcatatatgttagaatgtgatgtagattttttaaatgatctaaaagaagaatcaatgatacaaagtagtatttgtgttatattgactgggaaaagcagtagcactgttataatttcctcttgaaaaagaaattcacatgtaaatgtatatataactggaaaagtaagcacaaaaatgttaaaagtgattcttttttcggattgaaattttttttcctttttgtaaatctttttttgccctaaaattaatatatattaattttaaaaggaggaaaaaaataaggtcatttaagtgaattgtactgtagcttatttgaaaatgtgtccagtagtaggaattggaatttctgaacagctgtagtttttattttttccttttacattcttccttttacatctttgccataggggttttcaggactacccccccacccccggccacttcactggtggaaatgccgtctgccaatagacttgctgtcctaaccctcgtttaggacttctcatttactgcagatattggtacacataggtagtgggcggctgcctgagagagaccatttggtacttcttttcttatctcaaagctgcttcagtcttgtgtgcacaggggatgctcagaagcgtgccttctttcagggagactggccatgcgcctgagttagatgataacatggaggttcatcacacgctgtctacttgagtgtgtttttggaattctccataataaaaagttaaaaaatacaattgataggtaagagtaattgaagtagtttcaaattggttagctataaaatgcaactatgaagaggattgtaggtaattaaaatactaagattgtattgaggagaaatatattattcagaacaatacctgtgacatggcattagtgacaaatatgaccaataaactgattaccttatgtgactatgtactacaggtggtctgattattatttttaatgttctggtaattatttttaatgctcagataatataaatttttgccttactgtaattggattattttgattttttaaaaattatctttgagaactataggtctaccaatatcataaaaactagtcaataaatactttaaaaacaattcaacacacgtactgaaagttgctggtatacagtggtgagcaaataatagcagaccttcaggagcttatattccaaggacagggatggacattgataggagaatcacacaaacaaaatgcaaagtcacatcaggaagttctgggcagcaccttgcagaggtggtggttggatggaccatctgtagggagtgaagcaggagttacctgagtgattcggggaggaggggcccttcacatgtgcaaaggcccagcgcaggaagtgacgggagaggaaggccggggccaaactacctcaggccttttggtcaatactgaaggttttgatgttttctcctgggagtggcggaactccattgaaagactccaagggagtggcatgaccagaatgatctctgacggctcgctctgggtacagtgcaaaggacaggtgggaggaagccaggcaggccctcggctgtagtggtctagggtagagacaccggcaacttgggaactaaatgtgggcactaaagataaagagatgtgtgtggatccacgagaggtttaggacatggcactgctgggacttggtgaaggaggggctgtggcagggacacaggtgcttttgatgcttctgtggatgcagtgtcaccctatgggaccaactcctggagaaggcaacacagaagtgggaaacttcctgattttgtggatgtggatcttaggtggacagcctgatgtccagggcaagtatgcatctagtttcttccactctccttgaatgagaagttgtggttcagttcctggatagtagagcgttcaccactgaacgttcaccactgaaacaatggatgagtggaaacacataggaccaggtatgaaagacaagactgtttgaaggtaagtgatcgccattcacatttgtgaattttcatgaaattcagagcttattaactcaggtgagttaaataaatgtattttaaaattgctatttctattattataactttaatggctttataattttacagttgagtctatctagatggattactgcatatctgagtatatatggagccatctgagaattcctcccaattatatgtaaaagaggactgattaaatgctgtgaattgaaaatttatttctctttatcagaccttgtgtatctttttaatgatgatatttggtggaaagggatttgatttagacacattgacctacattccaggttgtactgatgataatttacttattattagagtaagctaccaagagaaatcctggtgcctttctttttgtagatatttacataattccagttgcctttatcatagccatgtgaacatatattttacacagaccggttcagggatttaatgatagaattagaaatagctaaggaactagctctgaaaagtattgtaaataatcctaatcacattagatattttgataaaatatttgccagataacctttcatttagtctttttgtatatattgcttgaaaaaaattcatatgaaagtggattagactacgacagctgattagaactggctgggtcagcctggagcctgtcagtgagtgagcaggccccaccgggattcctgcagacatgaagcgtgacactcagggccccaggctatgccccagctgtgcaaacagcttggttgctgtgtctgcagtctttgttctcattatctgtggagcctgcccaagcgcggcgatgcctcgggcaccattcctgggctcacttggctgcctctgacccttgcagtctaccctgatgggagagtctgcatttccatcctccacgcgccaggcgatgaccccatgggctacgagagcagcgcggagcggtggagtcctgtgcagagtgtggagaagatcctgctgtcggtggtgagcatgctggcaggtaaggcccgagcctcctggcaggagctgccgtggacacccaggctgcaggtgttctccagccttgcgtcatcctgtctttagaatgtccttttcctcatttgcagttagtttacacatgctattgccatttaatgttatctgcctacacttttccaattgtaagcataccttctagcatagcctggggttgtatattgtattgtcggccataattaactggtctctggtccttgatcgtctttttccctcagtaggtgtttattgaggacccactacatgccacacactggactgggggtgtaaagcttcgtgtgacaaagaccccaactctttgttcctacgttctagggaactgtccaagcctaccagcagttagaggccagtgggatgcaccctaagatcagacacatgcagggactctcgggccacttcctggtggggctgtctggggtgtgtttaggacatgtaggtgttgatgaggtaggagggagggaatggggttttggggcaaaggaagcagcctgggctgaggcccagaggcaggaggtggctgacttgatgggggcactgccagctcattttggctggagccaaggctgcagggagaggagccccagcagaccctggggattggagttgggggtgtgatgtcctgtgagctgtgccttcgaagggccatccttgcagcagtaaccaatagtgtgatggaagacaaacagagacatcgtggtgttgcagtagcctggagagaaaagagaagggctgagtggtcccagggctaagaggaaggggtgggtttgggagaccttgaaggtacaggctctgggactcctggttctttgtctaccagaggtgctgctctgggttcaggagacagcaggatttggggaatagtttgaggtgtgtgggacaaggggcctccatccacaaaagggggtcagacatgagagtgaagatgtggggtcatttctggatgaggcagtaggtgatggagtaggacggagggtgacagcatagcagggaggggtcttccagggcagtcaggaggaagggtgtgggaaaggaaggcggcaagtccgaaaggaaagagcagacccagcagagggccaggggtcgatgccagagtgaggccactcagctgttctctgcagagcctttgggtgccgtggagtggggtctagagggatgtgaggtcagggcctgtgacgcgagtgtgtatcctgagagggctgaggcgtgaaccctcttcatgtgctgagtggagggagccaggccaggggattggagattgggagggaggcagtggctcaggctgtcctcagatgtcagctgtgggttttatcctcatcaactctgctctgaaccggtccccacgtgcattctgagcagcgccaccgccgcactgcacagctgctgcctcagcacatgtcatccagttctggtggtctctctccgttctgccttccggcaggccctggctactccctccgtgcctcctaactgcagttctgcagtgactgccagtgccgctggctagggggtgggtcaggtatcctggggtcaggtgtctaccttaggctgcacatttgcttgggattgtcttggtaggagctgtgaggggcagttttgctgagagggcgctctgtgagagagaagccacactgcagagtgtcttgagaaaggtgaaataagcagcaggtggtccccgtgtagcttgtccgggtgccagaagtgcagtggcccaggaggctgctgtgggaggccgtgtgggcctgtgcttaggtggttgtcgcatgttccacagcaagacagatgacaacttgtcctggtgtcttcagacactcagaacgcaggagtcatgagagtggctttcgttgagacctgcgtggccagcactctagaggtggggccgaccccatgcagttctcaggttctttgtttctgggacacagctcttgaaagcccccgccagtgttttaaataaatgggagaccttgccaggctgcttacgtataagactcccttttacatggagggtgttcccttttctttcagagcccaatgacgaaagtggagctaacgtggatgcgtccaaaatgtggcgcgatgaccgggagcagttctataagattgccaagcagatcgtccagaagtctctgggactgtgagacctggcctcgcacaggcgcacacacaccgccaagcagctcagcattctcccccggcacacttagtgacagtgatgctctgtgctggtaccaaacaaggcagacttgcaagaaccacggcatcttttttttttttcaaacctttcctacttcaaacaggcttctcttctgaaatgatgacttaatgtcgaatattgacagcttactgcagttttacagtattcctcacaaagggcttcaggtagattatcagagctgtcagcactacctctccccgctgaaaccagcagttcatggcttcctgtggattccctccctccctggagtgttgagggggttgtacctgccagacttccaggggacgatggaatacccagaacgctccttctgaagaaatggggccctgtagctgcagcacaggggaagggcccggcaccctttctgggtccttcctggttccctgtgggccccatgaggagtccattacttcctttcttccttcatattttacaggcagatgcttttcttataatctaattacatcttttcatttgttatatattacaaaccatcacacttagaaatacttccaggaaatgcttttttgaagtgtgaattaataagaaatggggtaaatagaaaagaaatttattgctgattggccaggtgcggtggttcgtgcctgtaatcccagctctttgggaggccaaggcaggtagatcacaaggtcaggaaattgagaccatcctggctaatacagtgaaaccccatgtctgctaaaattacaaaaaattagctgggcgtggtggtgcacgcctgtagtctcagctactcaggaggctgaggcaggagaatcgcttgaacccgggaggcagaggtagcagtgagctgaagtcccgccactgcactccagcctgggcaacagagcgagactcagtctcaaaaagaaaaaagaaatttattgctgatcacaaggacagacagttttttcccgaccatactcatcaaagatttacgtttgtatattagtaactagtgcattactagagcaggtgcaggtgaggtctttaaagtttcaatgaaagtttcttctggatctacagaaaaaatttttttttttcaatctaaaaactggaaattctagggtttttgtacattttggatgcactgggaatttattagcacaaaatcattctttgcaactcaaaattcagaagggactctaccatatcttagctcagagcacagaggagtgccttatccccacacttgactgggctgtggaggtgggcatgtgggcccctgggcccaggctggggacagagcccttgttttgtgacttaggattttgatgtggttcccatgttctctaacagggccagctgagcagcacaggccaggaggccacagtgtaagcaataacagatctgccacatgcagaagcaaatatcaggcctgtcgcacacgggcggcatttaaataggaatttctatttttgaaataagggatggtctatgaggcatacagtagatttgatgtgatccttttctccctcccttccataatggatcgtggtctgtgtgactgaacccacacagagtgtcatgggtgacagtttctggttgaagtagctccacgcctggcttctgtggacagcagattcttttccttctcacaaggggctcatttaaaatttggaggctgggtgctgtggctcacgcctgcaatcccagcactttgggagactgaggcgggcggatcatgaggtcaggagatcgcgaccatcctggctaacagtgaaaccctgtctccactaaaaatacaaaaaattagccgggcgtggtggcgggcgcctgtagtcccagctactctgaagactgaggcaggagaatggcgtgaacccaggaggcggagcttgcagtgagctgagatcacgccactgcactccagcctgggcaacagagtgagactctgtctcaaaaaaaaaaaaaaaaaaaatggaacgcagggcaagaactcgtatttggaaggagatgggggaaaggagcggtattatacctatgttgtatttgcaggcaaatgagatggagccctctctgtaaagaagagtcatttgtgcaagtagacggggtctgtgggtgcaggccctggaggggcacacaattgcctggaggcttctgtgagatcgggagagggaggagaggcagtctcttgacaaaataaagtatttttattcatttgtatttattaaatgaaaaaacaatcccatggtgtccctgttgtgtggtggaacctaatgactgttgaaataaagttctgtgttttccctgccctgcagtgtgtgtccctttgtcgtattgtcagaggagcctgtggccactgcccccagggagcacaccagatcatcccagctgggattcctcacggcgggggcttttctgcagacttgggttagctctggcacgttttcttctgtttctgatctcccttctgtcattctgtggtcttcctctggaattctcaggttagttggggtctgtgagacggatgtgttcactaacctataaatgacattttgcagctttttcagcagatgccattgtgtgagtggcacatttgaccactagaagccagcaggctgttccgactgcgcttccctcctgcagttgcttagaagcacagctccctgtcatcactcctctgtggtcctctgtggtcacggttggttgcgatgagacctgcctctgcgtcttgttacttagcatgtcaataaagaggcagattcctgtgtcagtgatttgctgtttctgttttggtagttggcggtcagctttcctttgtaatcctgtgaggcagggtccccaggcttccccaggtgctggcgcctcgttccctgggctggttcccaggctgctcctggtggggtgcactgggcgagtgcctcagcacaggcccccaggcatgtctgttctgccctttgcccagtgttctcactaagcattctttttaatgggtaagaactctaatgtgatactgagttggggtccccaagaccacccagggcggcgattctccaggaggacagaggccatgcaggtcacggtagtcacggctgtgatttcccacagggaggacactgagcaaaatcggccaagggaaaggttcctggggccgagtccaggggcaccatgctcagctttggaggcctctcctggggtgggggtcacgcaggatgcgcctcactcccctgcaagcagctgggactctgcgtgtgcgatgttggggatgccctgcctggtgatgtacccgggggctggtcacgtgagcagcttctgcctgggctgcgctacaattccagactctcagcagggatgtgagtgttctgcctaaaccaccttgtacaaatagcacaggcccagtgaggcggggttcagggagcccctcggaaatcccagttcccagacgccagccaagggccagcccggccagcgggcctcaggacggccgtccccactgtatggaccctttctgcgcagataaccttgggggttgacagtgatttttaccatttcatttgctctgtgtttctgggttttgtctgctggcactggtttgccacagttgtttgcctgtctggctgagtgccgtccttgcttttcccatgcaactgtctgcttcctgggatggggagggctgctggggtggccagggaagctctagggtctcatcttctgggtgttggggcttttcacccttcctgggggttagcggccccagttcactgcttgggccacagcaagggtggcgtccacagctctgactctcacttctgggattgctgcacctgctggggcttctccagtccagtctctgtgtagatgaggttgctaatttttcagaggagtgctgttctgtaccagtttcttcataggatatggaactgctccagctgcacagaaaggcaccccagggcagccccagcttccctcccctgggcgtgccttgcaccgtggccccctgagctgacaaggtttctgcaggctggaatttgtgctggaggcgagggccctggggatgctacctggacacaaggaggggacaggaaacaggtacaaaaattcggggctgccaaggggcagtgaacacactaaggacaggtggattctggaaaccctgccctggaggggaccgcggggccgcttggggtgggggcagggtttggagaggggctgtgaacaaagccagcccctctgggtgttggcctggggcctggaccctgggctggggggggcaccctgggaggaggtctcgtcgtgctgatgtggcgtggtggccc

SEQ ID NO: 12217 - DNA, 17472 bp, Human
gccccgccgagccgggccccgcgccgcggccgagctttccggggagcccgagaggccccgcgctcggcgccggctcggtccgcgctgctggcgccgctgggctgcggcccgagcggccgggccgccgcaggccttcggggccggggctcccccacttcgcccccgaggtgcgcctggcgcggggccggggcagccacctgcagccggggccccgcgaggccgcgccttcctcctgcgcggggagcggcttccggggtcacggtcgccccgcggacggataggatgggccgcggggggagagtcttggattgcaacatcgctggctcgcgggggtgggggccggcgagcgggcttgttttcggtgccttaaaaccaaaacaagtgtaagttttcttgtgcctctgaagatgctccgctggcgcttgctggggccctgaacgtgagcgcctcgctggagggggagttttattctgttttggacatctctttttatcggttgaatagtagttggttctggtagttaacgtgcgtaggaggaatgtaagggaatgattagttgggcttgtgatcgtggcctgtagtcacgcttgaatcgcagaatgaagtggttttgtttgtataattggaagttacgcttagtttctctgtttgcaaagtgcctgtctttggggagttcggtttgtttccttttacaggacctaccccaagtgtttcttgctcttcaagaaacgttgcctttgggtagagaacctatgcaacggaagacgggacggatcctcagtttgccctgattgctcattcagagaggtccgttccctaggccactgggtgattgctggtgtgcgcttgtatggtgtctcagggtttgggatcttgcttcagaaacattctcggggcctggggcagatcaggtgcggccaggtaagcgtctcccgactgcaggtgcttgggtcttgcagaagggaatacctccccaagcctgggagagtttgcatttgggtgcaggagggcctttaaaggcttcttgtgccagcctgtcgtggcgaccacccgttgtggagatcagtgcggtggagttgtgggaggtgagtgctttgctcaccctcagccaggaagttgctctgaagtcggtgctgtcaaccagcagagcaaggcggtgatccgagaagctaaagctcagccggttgcgggcgcccagcaggaggacagaaggcagactttcgggccgctcctggagtgcccggccctgtccccgtttctgcagtgtctgggccttgcctggctctaatagatgagggttgtttttgtctttgcatcataaaagtttcttgctctgaagcgtttagtaactactagccgttcactaagtgcctatctgtgaatttggaagggcaaattcgattttcagcggaattttgaacgcttgatctgtgttgtgattacattgtaacagattggccgctttctccagaaggccagtaggagggggtgcagggggaggggcctggcttctgtctgggacacggtgggtgtgcacctgtggctccttgccctggcggtgcagtgcctgtgagaccaccccgtggtgctgagtgctttggggcaggggacacagcagcagcagccaggtcttggcaggaggtctcgcaggaccacccctcacgacttctcacacctgagacagcaatagctaggtgctgggacgggggcctctaggcggctctgtccagtcctcagcaggagggctgcctgtggcagggtcccaggcccgtctggcctctctgtggcctggccttgcctggctgtgaggatagccttgcccatggtccttcagtgtctggagcactggcctgaggcttcagagacttgcctgatgcctggcctcgctcagaccccgggcacctgggaggtcgtgcctccttgaaatggccactcgccaggctgctttgcaccgcaccgggcacaggctgcggccactcaggaagcccatcctggggctggggaagcgagagctgtgagtcctcaagtcgcagctgggctgctccacgtgggagtggagggtggaggaacgtgtggagtttcggagtccagcccagtgcggagacagccttgaaaccgtggttggcgggcgctccactccgctctgggctcgaaccctgcctgaccctagctgtgccccccactttctccctgtctggcccctggctccccgccccctcacttagaggagggcacggggaagggcaaacggtccagagggcgggcggcctgcgggctcctctgcatcatgtgaggagggcgtggggaaggacatcccggtggggcccgatctggggctgcctccagcccgggctgcctgtcttggacttagtcgtggacctggaggccagtgcccggctggcccctgtcaccctctcgctgtgacgccagcgcctgctgactggaggacccaggttccttcgcctgctttttctcaggctgccctgaggatctgtgtttggtgaaaaggagccaaattcacctgcagggcaggcggctctagcagcttcagaagcctggtgccctggcgacactggacctgccttggcttctttgatcccaaccccacccccgatttctgctctgctgactggggaagtcatcgtgccacccagaacctgagtgcgggcctctcagagctccttcgtccgtgggtctgccggggactgggccttgtctccctaacgagtgccaggtgaggctgcggcggctccgacgcaggtggagctgctgacctggcccctttctgcggctgcgaggtgtgtgaggttcgtgggcctccacaggtgtgggagccatccaggtccccagggcccttgtggctattctaggacagcccaagccgtagtagggacggccccccacagcttagaagacctggctcagtcccccagctttgtagaggtggcccttgtttggtgttgagatatcagacttgggggtagtagcttcagtgttcccatggactttgaaaaccagcacacacttaggtttgaattcttgggcaagttttgtatcttgagcgctgtttttcgtgggtaaaggtggccaccagtagggtgacagttgagggtggcattgaggctgctggccctgtctgcctggtgtccccagtgacagtgctggccgacaggctcccgccgagaacgcaaaggcgaaggtgccaagcccccgaggtcccgtgcagatgtgtggagctggaatctggcgtgtgtgccgctgcctctgatcagggacctggtcccctaccccatgctcctgccctgccctgcaggacccgtctgtcccctgaagccacagggacgtggtagtggctgcacggtctgggaagggtgtccccgtggagggctcctctctcagtgaggctgagcctctgccctgtggtacttgttctgctctgtcttcaacatggtgaaaccctatctctactaaaaatacaaaaattagctgggcgtggtggcacacgcctgtagtctcagctactcgggaggctgaggcaggagaattgcttgaactcaggaggcggaggttgcagtgagccgagatcgtgccactgcattccagcctgagcaatagaatgagactctgtctcaaaaaaaaaaaaaaaaaaaaaaaaaagaataacaggtgtcccctggcccagcctgagtctcagttctgagcgcctgatactaaggcagggacccagcaccccacatccatctggggccccagccctgcctagtccccacctgatggtatggtgaggaccctgccatgtcagccaccacagggtggcagctaccccccagccgcagcggcccagcctctgaacatctgtctcctcaccttcgagcagaggccgcagcatgtgtcgcagaccagggctgggttggggccatggggaggggtcctacctgcccccgcctcccggtgatctgggcgccgctcacaaggcctcccctggtagacccccggggtcggacgacggcttgcaagaagagagtccctgctgggccaggccaccgtatgttaggagcaagcctgcctgctgcgggccacgtgcgcgtgctggggtggcaggagcccgctcgcctctcctgaccccgtgctctgcctcctgtgttccagggactttgaacatgtcggggatcgccctcagcagactcgcccaggagaggaaagcatggaggaaagaccacccatttgtaaggagggcttcatttctgtgtgcagtgccgcggacaggccccctcggctgaaaccgcgccctccctactgggagggagctggtcgcgtgcctgggctgggccggtgggactcgcaggccggttcttggtggttttgctcaaactagatgccgccacgctgatatgcttttgtggttgtttccttttctctcagggtttcgtggctgtcccaacaaaaaatcccgatggcacgatgaacctcatgaactgggagtgcgccattccaggaaagaaaggggtaaggggcgctgccggcctcctgcctgtcggggctcagcagatgcgtgcggcagtgccatggggatactccgctcagatccctgccgtccgtgacggccacccttgtcacaggccgcggtcaacagctcagatccccagctgtggcctggcccccgccccgtgaggacttgagctcagaaggtggtgctggcaaggttggggtgacagctgtgtccctaccgagggcatttctggttgagaaggaagcaggctgggcctggccgggcacagggctgagctgtggcagaggggaaggggctctgatgtgtgttgggagcaggcctgaggggcgggcagcctttgcgtgctggaacccgggattctgctgtgtccttccaggtgtggctccggtcgcgggagctgggtttgcaggagagccaccccggcctaaaaccgtctactggagaacctcctggggcacagggactggcggcagccacctaggatgcctgcttggggccccgtgtgtctgtggcaagcagggcggcccatgtgcctgtcctctttgcccggctcacatgaagtgcttggccagggactccaggccggcttgcacataaggttcatgctcgtggactctgaaggaaggagagatccctgaggtgttggtcctgcccgaggccttgttccctccggcccatgccagcctctgggtttcgctctgaaactcacagcagctccggccccctgagctgagcagtcccagcaggactcagctttgcccgagacaggatgtggcttggatttgtcacttgtctgaggctctgctgagaacgtcccttgcccttcacgttacggcgaggcaggtgcgcgcgcggccccaaggaagacaggagtggtgtcgggttgtggggtggcaaaggcgcctcatccaggcgggacctggggcaggggcttgcagaacacactggggtgagggcacaggtgtgctcttggcgctgccggccccagtgtgcggcactcgttgccccccagcccagcccccgacccccgtctcctcctctcctttccaggagggcctttccgactcactctctgggcatggcagaggtcctgaccgcccccttggtggggctggtccaggcttcaggctggtatgggagccgcctctgtcgggcctctggcccccggtgtcctcgcagtcctggaggttgtgtcctagaagcgatccccttcctcctgggccggcctgcggcaggcaagcagcccatctcaccacggtttatttccccacagactccgtgggaaggaggcttgtttaaactacggatgcttttcaaagatgattatccatcttcgccaccaaaatgtaagtagctccctgttcagtgtcctggaagtcggcctgttcctgcggggattggagtcctctccaaagaggcccgtggctgtggccgtggcgccctggtccgggcgatccatggagctgggagggagtgagatcacagatttggaggtcggctttgatccctgatccccgcctcaggctgcagatgcgagtctgtttccagctccacgggtgggcggtgcacgtaatagacttagtctctcatcccagctaattggctgggaagctccagagtcctttgcagggagaggctgtgagatccaggctggagctcctgggctaggagtgcctggaccctcagtgattgttggcgatgaagacaggatttggtgcccacaagaccccagccctggatgggatggacgtgcagaagcgccaccactccgagtctcactggagggtttatcttgccccacctcactgctcttcctgtgggctctcgcagtctctcccacccggggctgcgtctgcagccgggcaggcatagagcaggggagcagcagagaaggcgcgagaagaaagggctgaggccaggttcgacattgagcctacagctaagttagtgatctcagtcagttcagcaaaactcaggagagggaggagagggccgccacgtccctgccgtcccatagctggaaatcggcaggccctttctgtggtgagttccacgcattaacacgtgcccagcacctagacagcgcctggccacggtgaggcgagagtgctgtgtaaaagcttccactgcaattgtcactcaagacacacaagtgttttccacagtggcagtgaccagaggagcttgaggactgctgacagcaccagctggtcgagacttgcttcatttttggattgtcctttgctgtttgattttttttttaaaccatgagcaggtattacttaagatgacttattttaattaagaaaaatataagaatgagacacagtagctgctttcattgattctgttcaaccgttgattggaattccaagcaaatgcagcaagacaagaaaaagaagtcacaacggaagaggtggggaggaaggccaggacaacagctcagtaaagctgaggtgcaaggctgggcacggtggctcacacctggaatcccagcacttttggaggccgaggtgggaggatcacctgaggtgaagaccagcctggacaacatggtgaaaccctgtctctactaaaaaaaacaaacaaacaaacaaaaattagcgggtgtggtggtgggtgcctttaatcccagctgctcgggaggctgaggcaggagaagtgcttgaatccaggaggcgggtccagtgagccgagatcgcgccactacactccagcctgggcagcagggcaagaccctgtctcaaaaaaaaaaaaagaaaagaaaagtagcacaggacctggtaaaggaaacaaagctaaataataaatataaaaatgaagtcgagattgaggtacacaaatctgcttttatatcatttcagcgagcaaggttttaaaactgccatttatagtagcatgaaatacgttggaataaatgcaataaaagattggttcaggacctctgtaccgaaaactgtagaatattgcaagggaaaccaaggccggcctgagcggtagctgagctctgccgtgtgtgtggaggggaacacacgacattgtacagacagcccttctctccaggctcgtctgcagattccatgtgatcccagttggagtcaagcacatcttgttggaaactgtcccatggacccaggaaatgcagaaacgtggaggccttggcttcttggtggggtggcgagacccaggctgaggctccgtgggtgcagagcacacccacccacccccaactagacctgccacgggacacggtgatggagactgcaggattgctgagaagacaggcaggcagacccgcggacagaacgaggagtccggaggccacgcatgtggtggtttgggctgtgacaccctgagggatattccagcaggagagacgagctctgcctcccaccatagagaaacagcttccagatggcttgtggtgcccaagcaggacagcgtggagaggaagacccgggatggtgtccgtgagccctgggcaggcagggatctcttcaccagggatgcagtgaagtgctggccggagggagattgacgagttgactaagttgaaattaagaatctctctttatcataaagactgcagttggcgccgggcaggagggcacactacagtgtatgtacgtacctcagccctcaccctgaatctaccaagagctcctgggaatcagtaagaaggctgccatgacgtccagcgtgtccctcacaggaaaggcctccacccagccagcaaatgcggcagggatgcctggctttgccaaagagtgaaagcctccccagtgggatctgccgtagcgcacaggggagcagacggagccgcggcgcagggcagcgggagcctcagccaccgctggagagagcggatgttctgaacgtttcccctggacgctgcctgccacaccagtggaagctgagctcatgctgtaggacctggctgttcacttgagtcagtcgagattcacagaagcacatacatgtgtccaccagaggcacagatgggtgccggtgtcacccccacttgccccagcccagacgtcctaggatgacaggtagggaagagtgaagaggccacatgatgcctggcggacagtccagacaggagggcaccccctttgtgttccttctttgaagcgtgggagcggccaagccggaggccatgaggaagtaggaggcagcctctaccttgggagggacaggtggacctggcagtgctggcatccagcatctgtgcctttctgcgggtaagttgtgatcggcagaagaaacgagattgagaatcagattaaattgaaattaggcaatttttgtttttgccaaaagattcccttagaagaggaaaaggtcgggccgggcgcgttggctcacacctgtgatcccagcactttgggaggccaaggcaagtgaatcacttaaggtcaggagtttgagaccagcctgaccaacagtggaggaaccccggttctaataaaatagaaaaattggccaagcttgatggcgggtgcctgtaacctcagctactctggaggccaaggtgaggcgggagaatcacttgagcccgggaggtgaaggctgcagtgagccgagatccagcctgggcaacacagtgaaactccatctcaaaaaattaaaaaagcaaaaagtcaagccccaagcagaagagccctgtaagacgtatcgcttgaggaacttgtgcgaagcagtcgccaggaagcagcctgggccgaaaggggcgctcagcggtcaccagcaggcgcagcgtagcaccacggagtggccgccgtgcacctcacccagtggctggaatccgccagcgacgcagcctgcgtgagcagcctggaagcagcacggcttgagggccaacaccgtgaccccacattccacagcagcgcgctcacgcgtgttcgcactcaggacagccacgcagctgctggtgtcgcccgtgtgctcctgcggtgtgggatggtcgcggtgtgggacggtctgcggtggtgtcttcgcgttccccagggagtgtgccctgtgcatctccatggtacctgaagtccaggaagctgcctgcggatgttgcagttgggattacggggcagatgcagtggtcggtaggagcgagtgttcggggaagctgtaggtgttcgtggcgcgttggctttctggtaattcctccggctgcactagacatgccgcactgtgtgtccttccgtagcattgagagagaagagggaggatgcccaggtaaaagatgggaaatagcctagaatatcaactgtgatggtccctggtggggctaatggtggcaaacttttctgcttttttgtaaagaaataacacagggtcctaaaagcccgtgtatcctggaagcagagggtctgcgtcggaacagccgactctggaagggcgttggctatgtccctggacgtctcctgcagctcctcccatctcccctgagtctggcccagctggaaaggatgtgggggccacaggttaagtggccaccctggggcctgtgttcccagactgcctggctgtgctgggagttctgtcccgggagagacacagcttcgtctcggctgcggccgtgtccccaaggctctgttccctgtgtgcaaaggtggatatgtcttcctttagtctcctcatggccacaatttaatttttttgaaaagtttttggccaaataacctggctaccaacccggggccccagtgttgggaggagggtgatgtggggaaggacgtgactctgggacagtgcctgcctccaaaaagtgcttcctttcttcctcttcctccaggtaaattcgaaccaccattatttcacccgaatgtgtacccttcggggacagtgtgcctgtccatcttagaggaggacaaggactggaggccagccatcacaatcaaacaggtacggggcctccgcctccggcacgggcagggctgccttagtctcccctccggacacgtgggtctgtggtcattctctgtggctgaggccgagtctcacggtgtctccctttcaaactgctcacacccgtcttgtgtttttgtctctggcacagatcctattaggaatacaggaacttctaaatgaaccaaatatccaagacccagctcaagcagaggcctacacgatttactggttagtagcagccctggccccgctggtggcagctcctccccgtcccagccaaggccgcctggcaggacgggagtggagcacacaggctcaccctagggacagccagggtccgcgcctctgtggggaaggtcggggggcataaaccctgtgggcagcaggcaccgttgcacaccgtctgcggtgggcatggatggcgccggagccgtgtccaggggagggagcaggccaggtgacaggggctgtcttgggccactgccccagtgagttgtggccagctaggaggggaaggaccctgggcgtgggtgccagaggaggccatgctgagaggcctctccaccggctcagcctcccgtggaccccagcctcccgcgccgcccttgctgcttgtccccatcccctctacaacttggttccttctgtgggggggcccagcccagcagggctcagtgacgtgatgctgtcacacggaccctgggcttccaccctgtccctgtgaggtgctgctgtggctagaagggtccccgtgggcctggggtcctgtctgcaccgaggagggcctggtgtgagttaggatgcagacgacagccaaacagtgctggggaaagcagggaggaccctgccctgagcagaggccatgcgcccgcctgtcctgttccctctgcagctgttctgggcaggtccataagaaggtgggttggggcctccgacccccactgctccgcctgcagggttgagaaacccagccccatctcaccacgggtccccacacctctgaggaggtctcagggcccccaatggccagggacccagaaggctcacctgcagccaccccacacatccctgccactgtgggcatcagaggccctctccctccagggtgcatctcctggtcaggaggggggaggcccggttgccttaggcccggcctgcacaggtcgtgaggaaaagcacctggtttcggccgggcgcggtggctcacgcttgtaatcccagcactttgggaggccgaggtgggcgaatcatgcggtcaggagttcgagaccagcctggccaacatggcgaaaccctcgtccctactaaaaatacaaaaaattagttgggcgtagtggtgggtgcctctaatcccagctacctgggaggctgagacaggagaatcacttgaacccgggaggcggaagttgcagtgagccgagatcctgccactgctctccagcctggcgacggaggaatgctgtctcaaaaaaaaaaaaaaaaaaaaagcacgtggttttggagagatgtgtttctccctggatgcgggcccagcccaggtgtctgcaaggtgccctccctggtggccgagggtggcacagaggccccaggcagggagcaagtatcacagcagccaccccaggctcagcctggctcccctgcatggtggtgcacacctgtagtcccagctatttgggaggctgaggtgggaggactgcttgagcccaggaggttgatgcgcagtgagttgagattgcagcaccgcaatccagcctgcttgacaaagcgagaccctgtctcaaaaaaaaaaaaaaactcatagccgctcagtcagccaagccattgctggaagtggctcgtgggacgtggcgtgacctgggtttgtgtgctggcgtgctgtgccctaggagtccgtgaaatgcattcccttggacaggaagccacagtgctcgtgggtgtccacatggcccttgaggcagaaaatgttttcttttttttttttttttttaaacagagtctcactctgtcgcccaggctggagtgcagtggtgtgatctcagctcactacaacctctgcctcctgggttcaagtgattctcctgcctcagcctcccaagtagctgggattacaggcacccaccaccacacctgactaatttttgtatttttagtaaagacagtgtttcaccacgttggccaggctggtctcgaacttctgacctcaggtgatccacccgcctcgcctcccaaagtgccgggattataggcatgagccaccgtgcctggaaaatgatttctaggccaagtgtggtggcccaacacctgtaatctcaacactttgggaggccaaggtgggctgattgcttgaactcaggagttcatgactagactgggcaacatagcgagaccctatctctacaaaaaattaaaaaatgtgccaggggtggtggctcatgcctgtaatcccagcactttgcaaggccactgtgggacgttacctgagcccaggagttggagaccagcctgggccacatggcaagacctgctctctttaaaaaaaaaaaaaaaaaaaaaattaagccggggatgatggtgcatgcctgtagtcccagctatttgggaggctgaggtgggaggactgcttgagcccaggtggttgatgctgcagtgagccaagattgcagcctgggtgacaaagtgagaccctgtctcaaaaaaaaaaaaaaagcatgccgggcgcggtggctcacgcctgtaatcccagcactttgggaggccaaggtgggcagatcacgaggtcaggagattgagaccatcctggctaacacggtgaaaccccatctctagtaaaaataaaaaaaattagccgggcgtggtggcgcacacctgtaaccccagctactcgggaggctgaggcaggagaatggcttgaacctgggaggcggagcttacagtgagccgagatcacgccactgcactccagcctgggcaacagagccagactctctctcaaaaaaacaaaacaaaaggcaaatgttttcctgcctagcccttagatggtctgccatccccagcatggtgtgggcgtgagctctgtctggcctgcaccccatttgccgaccatctccagagctgggctgtggctcccatctgcggcgtgggctgggcagggttgcagtcccccgccccgtgtgactctccccagcgtctcctgggcttggtgcctgctgggctgcactgtacacttgcgtgcacgtaaacaaacgttctttctcctacacacatccgcttgaaaagcaccctttgtgaagcatgtttgcgggtttcagatcgtttttcctgggtttcctggaggccttggaccgtgttcctgccctggcaggtgccttttctcggggcctctgcttggtcaaggaagagctgggacgtgtagccaccgcctctggttccttccacgcccacccagctgagctgctctgccctggggccggctggtggcccaaggagggcgctggggtctgggctgcggtccaggcccttggcgtgggtgggggtggcaccggcgctgctgccgtcctgggctgttccaccatgcagagtgaggctcagtgtctcagaccaggtccaatcctggcgagactgccaggactgcgaccccaggagccacctccataaatgtcatggtgttcccccatcctcagggtcacactgcaccctgtgacccatcagcccctaggtgcagcctcggccgccctcccgcccacctgttttgcccgggcagtgtgtgccatgccactctcctgggcagctgcttgcaggctgagcctcactctacccagctccagacctgttcgctgatgcccctgcactgcccagctcgggcacagcgccttctcaaccaggcctgccttcccacacctttgcccctgcggctgagagcctcatggaaaaaccctccagaaattggtgtctatttttgggaattaacaaaaacagtggcaagcagtcagtgttttcagtttattaggactgtccccagacctacagaaaagagaagctgctgattactagttaggaccagacttggcatcggcaacgatgttgcaggccctggcgtgggccctctggggcctgagccctcctcgcagccctgcgggacccctctgtcccccttgaacaccacgttcacccagcgtgggttcctctcctccctgcccttctgcccccgtcagaccacaggacagtctcagccacgtcagagccagcatgggctccccaccacgcaggcctccctgcttctccgggcttctgcttctgttactatgacgagctccacactgccctcccccaggaggtcccatcctgcagcctggtctgcccggctggctccggggcgagcgtgagggccaggcagctcagccctctaacacgtctcttctcttttgacctcctcagccaaaacagagtggagtacgagaaaagggtccgagcacaagccaagaagtttgcgccctcataagcagcgaccttgtggcatcgtcagaaggaagggattggtttggcaagaacttgtttacaacatttttgcaaatctaaagttgctccatacaatgactagtcacctgggggggttgggcgggcgccatcttccattgccgccgcgggtgtgcggtctcgattcgctgaattgcccgtttccatacagggtctcttccttcggtcttttgtatttttgattgttatgtaaaactcgcttttattttaatattgatgtcagtatttcaactgctgtaaaattataaacttttatacttgggtaagtcccccaggggcgagttcctcgctctgggatgcaggcatgcttctcaccgtgcagagctgcacttggcctcagctggctgtatggaaatgcaccctccctcctgccgctcctctctagaaccttctagaacctgggctgtgctgcttttgagcctcagaccccagggcagcatctcggttctgcgccacttcctttgtgtttatatggcgttttgtctgtgttgctgtttagagtaaataaactgtttatataaaggttttggttgcattattatcattgaaagtgagaggaggcggcctcccagtgcccggccctccccacccacctgcagccccaccgcgggccaggaccaggctctccatctgcttcggatgcacgcaggctgtgaggctctgtcttgccctggatctttgtaaacagggctgtgtacaaagtgctgctgaggtttctgtgctccccgcatcttcgggctgtagagcgctgggcagctaagatctgcataggtcgggattggcatcgagaccctggcaactgcaccggtgccagctgtcttgggggccacaaggccaggtccagaccagggctgggggctgcctgaggactcctatccgggcagcctgctggcgggggttcccctcttcagtggccaggtcacagggatggagctgcgctgtgcatagggtgccacctcaggtgtctgtcccttgtgtcctcaggaggcagccttgctaccacccgtggcaaacgccaggtgctttttctgggagagcccacagccgtggccctccagggcttccccgacccttagcgccaggtggagggccctgggcagcctgtgtatggaattcttcgtcctgaggccgcctgagtgtggtctgtcctggggaggctgtgcgcctcagcagccgtcctgacgctgagccctctgcaaaggttgggccggccaggcctcttggggctgcctgagccactgcaggaagtggcctggctgggaagttgggtgccggtcacctcccagcaggaaggcacagtggacagagatgggaagccctgggggacacagcccggtgctcccagccctccaacctctggctcccaacccagtctccccatcctagcgagcttggccctcctcagtttcgtttcaagccttggggctggagctggccctgctgccctggcaccccccggtggctggagctgggtccccgtggcccaagtgcagggtcccaagagggcagggcggggctccccaaaggagcaaagaatgcagggagggcggtccaggcccctgggaaggggagctcggcaccctccaggtccgtgtgggaccccagccgctgttggctgggaatcgaagttagaggtgacttccaaaggccccccgagccggcagtgccccccaccacccccccagcgactctgcggtgccagtgccttgttggcttttccggctacgcaccctgcagtcactgagctctcggtctgacgtctgatgtttgtggtttgtttataacacggggccttacctggggaattcagctggtttgaatatttgtagcccgctcccagaatgtcttattttgtaatgactgaactacatttagtaatagttacacatgtatatggttaatacatatggaaattcaatatattttgtagttaacgtattctgaagtaacggatgtttctcgccaatcgtagtgacttcagctaacgaaatgttcttttgtagtaccacggtcctcggcctaacgaaggacgtgaaccttgtaagaggagagctctgaaacgcggtcacctttgtttagtggaagggaaagtgtgttcccggcatgaggtgcctcggaattagtaaagaattgtgggcaatggattaaccactgtatctaagaatccaccaattaaagcatttgcacagactgcggcctgccgggtgtgtcctttcctgccctgtccctggctcccctgggctttgggggtgggagcccactggggccacagggcgtcccccgaccccaaggcccagccctaccccccagggctttgttctggtcctgcttccagccccacgtcagcccctccgggtgacatcccctctagccagcctcggggtctcttcacctgcacctccctggcctgctctacgggtctcctccctgggactcaaggctgctcttgctgtccctggcaggggacctccttggggagcagggaccccaggtgtccagagagctctcctcacagggcc

SEQ ID NO: 12218 - DNA, 60304 bp, Human
gggtgacagagtgaaactgtgtctcaaaaaaaaaaaaaaaaaaaaaaaaaaaaaagagaaaaactccttaagaaggtctgagtatattctgaagctatgttcttctctctgcattgctacctgaggtccaaaccactgtcacctctttgcctgaatgattgcaaccggtttccaagtggcccctgctccccttcttatcctcttacccacctccattccccattttccaatcagagtactcctttttttttttttttttttaagatggagtctcactctgtcgcccaggctggagtgcagtggcgcggacttggctcactgcaacctctgcctcccaggttcaagcgattctcctgcctcagcatccagagtagctgggattacgttcgcccaccaccacacctggctaatttttgtatttttagtagagacggagtttcaccatgttggtcagggtggtctcaaactcctgacctcaagtgatccacccccctcagcctcccaaagtgctgggattacaggcatcagccactgtgccaagccccaaagtactctttaaaacatgcgtctcagcccaggtgtggtggctcatgcctgtaatcccaccactttgggaggttgcggcgggaggactgcttgagctcaggagtttgagaccagcctgggcaagacagtgagacttcatttctacaaaaaataaaaaaaaacttaggagggtgtggtggaacgtgcctgtagtcccagttaattgggaggcgaagcaggaggatcccttgagcctaggaggtcgaggcggcagtgagctgttatcgtgccactgtactccagcctgggtgacagatcaagactctgtctcaaaaaaaaaaaaaatcatctgaccatggagtcaatactcatatctatcaaagacctctcacagcacatggaatagaaaccaactcctcccctttctacaagaccctccatggtctgtcccctgcctccctcccaccctataatccttttactccattctggacactgagacagcctcatggtcttcgccagtgctgcttcctctgcttgaaacattctcctccagtcctcccagctgttccttcccattttccaggtcccagcattggctttggagccagcagcccacctgtgacaggagcctggctctgctcctagctggccgtgtgaccttgggcaagtcactggcttcttctgtgcttctgtttattgtgaaatgaggatgttaatgctaacgtatcccagaggatggtttcaagggttaaagaaaataaagcactagagagaggtctggcacttagtagggccatttcctcaatttggcttccttgacctctcaaagtatgtccccacagtcactttcctatcacccagttttcttcacagagcttggcagtgtgaagtaaccttggttattcaactttttttttttcccccaagacggagtcttcctctgtcacccaggctggagtgtagtggcaagatctcggctcactgcaacctctgcctcccgggttcaagcgattctcctgcctcagcctcctgagtagcagagattacaggcgcccgccaccacgcctggctaattttttgtatttttagtagagaccgagtttcaccacgttggccaggctggtctcgaactcgtgaccgcgtgatccacccgcctcggtctcccaaagtgctgggattacaggcgtgagcccccgcgcctggtcaactattttatgcaatcagtatttattatgctcctactatgtgccaggcactggttgtaactgccatctgattggacgatccgtaaacgctgaggcccagtctgtgcggttcacttgcgttcctccacgcgccccccagcacagtgggaagcacacagtaggtgctccgctctgctcctgtgccccgccccgcggcccctcccccgctccaggaagtgcgggggctccagccgcccggccggccgcgatgcattctggggaaggagcagcaccaaatccaagatggcggccagcaggaggctgatgaaggtaaaagccattctctggcagcggccgggcgtggggcggcgtcctaggctccggatccccgaggcaggcggcggcttctcagggcgctgccgtctggcttcctgccctacacggcctcgtcggttccctgggccgcgcgcaggctcaaggtgctaacggggctggcctaggccgcagcctgggcgggagcgcaaggccgcgctgggagccgctgtcggcccctcagcccggcccggggcgttcacgccactctccgcccggagcttggccgcgtccccctgtcgcggaggccgcggtccgatctgagggcgtcgttaatgtgagagcccggttgggaggctccaaaccgggcgccttcggggaaggcccgagcgccggagcccctgcccggagcccgcgccgcggaaccgccccgccctgggccgcagcgcgccgggcttgcagctccgcttggcccggccgcagctcgggagtctgggaggttcgggctaggaaagagagaaggaggccaggcggccaaagttaggtcagtttgttggtgggtcgtttggaattgcgctgggtcctagcaaactgtcgccttgtgactgcagagtcacacagcgggtaagttccaactccaggaaggcctgaggtcggccccgatcgcggcgcggttctgcttccctctcctccactcagtcatcccgatctcccctccctgataaagtgccatttttggggggataacggttgatttcagtcgttcgaatcaaaacgggccaaagtttataataataatttggtactttggatcttgaatgcagcagggtgctttctcgctaattggcaccttttggtgaggaacacatgctaaattggcttagtacttttgccagtggatttgccaaggtcctctgtagcccaccccgccagcatctgtgagtcggcggctgggtagtgctgccggcctgcaacgggccggaaattaaaaaaaggcccaggagccagtttcctgaggggagataaagagctggggttcgttctaggcggagcagtgcttggtagagctagacattgaacttggagccacagtctctgagcattccctccgtccctgggaacgtttcctttcttttgttccctaagggctagagaggacattaactttataaaactggagtggaagtgggcacaaaagaacagtcagaggacttcagacctctcctcatctcttaagctagtgacaccaccattcaccagataaggggtcggttaatggctttctttcctaccctactcccaggtgcagtcgtccattaacccttgtggatttaaatttagaaagatttctggagtgcaggccgggcgcgatggctcacgcctgtaatcccagcactcctgggaggccgaggcgggcggatcacttgaggtcaggagttcaagaccagcctggccaacatggtgaaaccctgtctctactaaaaatataaaaattagctgggcgtggttgcatttgcctgtaatctcagctacccgggaggctgaggtggaagagtcgcttgaacccggcaggtggaggttgcagtgagccaagtttgcaccactgcactccagccagggcgacagagtgagactccatgtcaaaaaaaaaaaaaaaaaaaagatttctggagtgcatgccttgctttctaatgttactgaaattactctgaatctatatcctcatctctcaggtgccctcccaagtgctctcctccccagactacccctgacggacaccagagttcttttaaagcagataactcaattctttcactcctgttaaaaacctctatggtgttattgtcctcagcagttaatcctaacctcttacttggcatgcaggacctttctgagactggctgaaagcaatcccttgagcctcacctcctgccctttggtttcccacagttcttgcacctaatcacagtagctactatttttccagcttttacttcgtgctttatatgcatgatcatgtttaatccttcctgtgaagtagacattgtgatttccattttgtcgatgagaaaagattctttggcttgcccagggttacctagctagggagagtgagttgtgatcgaattcggttctttctccaaagcaaagtctcctgctcttacttgctgtctgatgtccctttgcacgtgttgtttgctctacccaagaaaagctgccttctcctcacttctcccttccagagaagtcccaggttcaactccagtgccaactactctgtgagcccgtgctcccacatcccccttcagaatgtgttgtttcctcctttgtgtgaccacagcgctttctttatatttctctttgagcacttgtcacaatctctttgtgttacagacttgtctttcctgtactgggttctgagatcccgaagggcagggatcttgacctaattcatcctggtagccccctagcctatcccagttgacccagtttggaatctccaggctctcaggggtctaagaggggacttattatggttttaaaattattactctgtttctaaaaaaaaacagaccttggaaaaaaattgtaacattaactgagtatttattaagtattaggttatttacgtaagtcatcttttcaacactcaaagttagtgtattgtcatttgtattttttataaatgaggacattgtgaggttaagtaggttaagggagttacctaaggtagaattgtggaacgtggtggggagagagaagacgctgactcttcctggctccaggatccaaattccatgcctcttgtcaggctgtctttcttactcaaaggctgcatggagcggtgtgttgtttcttaagttgaggatggaaaggctttcagttcactaggggaacaccagttatgtaatgctgatcattggctgtgagaatcaatgtttaagactgttttttttttcttttaaaggaagaaaaattattgatacaagttgataaacagtcttttcagtacatagggtggtaataaagtgattttcgttggtgaaaagttggggcttagtgcatggaacagtgccttaggcatagcaatctagcaaatgttgaatgatcaaattaattacatcttaaagaactttagatttctgttaaaaatgttttctaggacattccacagcaaagatttctttgtaacaatggactgtctgcagatagtgtaaaacacattattaaaagtagagtgatttacatatactacactgagaagttattttaggcaaagtgagtatgataaagtcttttatttcaaaagcacttgccaggaggcttaacctcttttagaagcctttttaggaattacagtgttaataaaacattaagtacattttaatttgcaagcagctaatttagcattgttggctacaaccagattgtaaccattgcttcaatcaggatggggaaattgctgcaaaagccaaaagtgaaacctttatgtgtggcttaggcaactgattgccatctgatcatttctttgcagcttcacactgcacacatttcccctaagggccctcctgttgagtagcttcccagaagggcttttctcagaggggaaatctgtggatttagaggggtgtgtgtgtaatgtcttattacttatcatgacataactgttgagttaaggagtttcactcttgttgcccaggcttcagcgcgatggcacgatctctgtgcactacaacctctgcctcccaggttcaagcgattctcctgcctcagcctcccaagtagctgatactataggtgtgcaccaccactccctgctaattttgtattagaaaggaggtttcaccatgtttgccatgctggtctctaactcctaacctcaggtgatctgcccgccgaggcctcccgaagtgctgggattacaggtgtgagccactgcgcccagcctaatgctatttaaaaatgttcactcagaacttcatattgttatattttctcccagttcatagtcatagtaggaggaacctctaaaagttcattccttgggtttcgttgtattaagcagtgaggtagtttgcttttgagtataggtttagattctgaggttgggtgattaaggagatagagcaatgagtatgtcacatgtttcaggaggtgaggggagttttatatgtgatgttatgccagtgtaaatgtcctgaatccactgaggctttgtgaattgagaaaaacgttgcgtctttttttctaaattcatgcattccagtaagttgggactgtttcagcctcccttaatggtattctttgtaaatgtttgggacaggtgatgggaaggagtatactcaattattgcaacatttgggaccttttaaggtatttactagaaaactctgaggcaggccaggcgtggtgactcacacctgtaatcccagctctttgggaggccgaggtgggcggatcatgaggtcaggagttcgagaccagcctggccaacatagtgaaacccccgtctctactaaaaatccaaaaaattagctgggcgtggtggtgggtgcctgtaatcccagctactcgggaggctgaggcaggagaattgcttgaacccgggaggcagaggttgcggtgagccaagattgtgtcattgcattccagtgcgagactccgtctcaaaaaaaaaaaaaaaaaaaaagaaaaccctgagacaaaaactcttgtctcagggtactggggccttttctgatcttgttaaaactctaaattaggagactgttgctttaaaattttattataagaggacacttgaaagtattctcattttattggaacatttattacgtttaagatatttctatattctttgctacagcagtaaatgtgagagccacatttctttgcagcttcacactgcacacacactgcacacactgtgcacattagagagccacagagacgttcctcctgagccagactccaaccacttccagagttttcttgggaacggcacatagatctgtaggcatctgagtcttagctcctcctgtgactctctccctctggccccatgcatctcctcctgtcccaccttagttaatggttcacttgtctactcagttgctcaaggaaaaaacgccagcggagcccttctcggctcttcctcccttgtctagtcacctggcggattctgctgaactatgccttcagtctctcttctctgcctgtcttctctccatccccactcccactcccaatgccactgccactcccactgcctcagttcaggccatccctgtttgtggtagacacctgcatcgagctccttaatggttcatctaaactccttactggtcagcgcactctctgtcccacactactcctaaccagcagtgcatcagagtagtgtatggtgtggtgtgcagtagagaagtgcacatgagcaggccctgctctcagagattggagcagaatttagtagggtgaggatgaggctgggactctggattacaagtgcacattccttagctttttccttcaaggtcttgtctcaccagccttgtctctccccacttgcccgttgagtcccctaaaaacagcatgctttgcacacacactctggatctcgtgattggcatccctgtctcttctctgtaccagggtaactttttgacctttgagactcagctcaaggggcaattcctctgcccttgaggagctcaacaaaggagaaaaatggcacgtacctggaacaaagaaatcctgggctggccactgtgtgctagatgtctgccacctgaataatggcttgcaggagagggaaagaccccctctgacactgaggaggaggtcgaacttggcctggccctttaagcacgagtagggtttcagcagttgaagaagacggactgggtggccagtgaggttgagtctctctcatccctcaggagggctgtgggcagtgcctatgggaaatgctttgaggagccccagagaccatctgcctactccccagtgctgcttgcgtctgaccttgtgccgtcccgctttgggttttagttaggccagcccctgagatgctttccagaagtgttgaggcattggcttgattttaccccagattggcatgtccagtgcacctggttcctccagagctaggagacctccctctgccaggccagccttggagggtgagctacctctctatagaggggtcactgagggcagtgctgatggatttaaggacaggtggcagagatgccatagcctttaggttgaggggccagatctacatatctcctggatgctacagctatccaggagaagtggcatgccactcactcagaaagggctttgcatgtatctcctgtggccagcttcatcatgcctgttcttgggggacataaataagcctaacctccccaagccccccacccctataagaaagggaggaaggggcttttgctcagagcaaagctgtttagaggaagactacagcatagcagttaaaagctcaggttctggagtttcaatcctgggcctgccatgtcttagctgagtgaccctgggcaagttactttacctctctgtgccttagttacttcgtccgtgtgtgaaggttaaatgagttaatatataccaactgcttagaagagtgcctggcatatagtaagtgtgagctacttgtagatattattgggaataaccaagacatgttccagggcagggaggtgaccagcctgacaggaggggaggatttggaggagtgataggagatggtattgcaaaggtgttttcgggacaggttggggccagtctgcctggacataccctcatcactgagagcccattctcttacctgtggtactctcttattctgtaggttggagaaagagttactgagacagctgtgtgaatgtttgtttaaaaatgttggctgggggccaggcgcggtggctcatgcctgtaatcctagcaccttgggaggccgaggtgggcggatcatgaggtcaggagattgagacaatcctggccaacatggtgaaaacccatctctaccaaaaatacaaaaattaaccaggcctggtggtgcgtgcctgtaatcccagctactagggagggggaggcagaagaattgcttgaacctgagaggcagaggttgcagcgagctgagatcgtgccactgcactccagcctgggtgacagagtgagactctgtctcaaaaaatgttggcttggcgcagtagctcacacctgtaatcccagcactttgggaggctaaggcaggtggatcacttgaggtcaggagttcgagaccagcctggtcaacatggtgaaaccccgtctctactagaatcacaaaaaaattagctgggtgtggtggcatgtgcctgtaatcccagctactcgggaggctgaggcaggagaattgcttgaacccaggaggcagaggttgcagtgagccaagatcatgccactgcactctggcctgggcaacagagtaagactccatctcaaaaaaaaaaaaaaaaaaagaaaaggaaaaagaaaaatgtttacttggctgggcgtggtggctcatatccgaatcccagcactttgagaggtcaaggcgggtggatcacttgaggagaccagcatgggaaacatgacgaaaccccatctctactaaaaaaaaaaaaaaaaaaatacaaaaatcagccgagtgtggtggtgcatgcctgtaatcccagctactctggaggctgaggcaggagaatcgcttgaatccgggaggcggaggttgcagtgagctgagatggtgccactgcgctccagcctgggtgatagagcgagactctcgaaagaaaaaagagaaaagtttacttttcccaacaaagttgaatagcttttttttttttttttttttttttttttggagacggagtctcactctgtcacccaggctggagtgcagtggcaccatctcagctcactgcaacctctgcctcccatgttcaagccattcctcctgcctcagcctcccgagtagctggaactacagatatgcgccaccatacccggctgatttttgtatttttagtagagacggggtttctccatttcccaggctggtctcgaactcctgccctcaggcgatccacccaccttagcctcccaaaggattacaggcgtgagccactgtgcccagcttaaaattgaatagctcttgaactcaaaatttgtctttctaatatctcagaaatttaccttgcatattgtaaacatccagtgtagtgtgacagtcactgtgtccaaagatgagcataggtgctatggaaggctcccacaggtgctgaactggggcaggggtggaggtttgaaagcaactttttttttttttttttttgaggcggagtctcgctctttcacccaggctggagtacaatggtgtgatcttggttcactgcaacctccgcctcccgggttcaagcaattcttctgcctcagcctcctgagtagctgggattacaggcgcacgccaccacgcctggctaatttttgcatttttgtttttttttgttttttttttgagatggaatcttgctctggcgcccatgctggagtgcagtggtgcgatctcggctcactgcaagctccacctcccaggttcacgccattcttctgcctcagcctcccgagtagccaggactacaagtgcccgccaccatgcccagctaatttttttgtatttttagtagagacggggtttcaccatgttagtcaggatggtctcgatctcctgaccttatgatcctcctgcctcggtctcccaaagtgctgggattacaggcgtgagccaccatgcccggcccccaatttttgtatttttagtagagctggggtttcaccatgttggttaggctggtctcaaactcctgaccttgtgatccgcccacctcggcctcccaaaattctaggattacagatgtgagccactgcgcctggccgaaagcaactcttgattgagaagttgaggtctcagatgtaatattcttgcttcttgtcttctctttccttttttttttttttttttttgagacgcagtctcgctctgtcgcccaagctggagtgcagtggcacgatcttggctcactgcaaccttcacctctgggttcaagcaattctccctgcctcagcctcctgagtagctggaattacaggcgtgtgccaccatgcctggctaattttttttttttttttgagatggagtctcgctgtgttgcccaggctggagtgcagtggtacagtcttggctcactgaaagctccgcctcctgggttcacgccattctcctgcttcaccctctcgagtagctgggactacaggcgctcgccactacacccagctaatcttttgtatttttagtagaaacggggtttcaccatgttagccaggatggtctcgatctcctgacttcatgatccacccaccttggcctcccgaagtgctggtattacaggcgtgagccaccgtgcctggcctgatttttgcattttttagtagagacggggtttcatggtgttggccaggctggtcgtgaactcctaacctcaggtgatccgcctgcctcagcctcccaaatagctgggattacaggcgtgagctaccgcacccagcccttgtcttctctttcaaccttgaagcagaaagttaagaaagttgcttctggtggctgtgtagtttctccttctgacccttgctgcacacatactctagaattccagagctgtgtgagggatcttggaaagcagacaccagtggcctctgtttacagatgaggaggctgaagtcagtggtggagccaggcccaacatcaaggtcccctgctctctgggccttgctcctgctttttagatggttgcttttggtcttgaggaagggacaagatggagaagaagagggttcatttcagattcggtggctgtttgggttttgtttgttttggtttttaacacttccagggctgtgttgattatagttttctgtatttcactttcttgtcagattttgtccctactttcctagcataggtaggcagagcggggaacattctcttttgacagcccttatcccagcaggcacatctgcaaccaaagcaggtgctaatgtcaaagggctcatgggctaatgtcagggctcatgtgatgctccatctttctgagaggagaccacctgactcacggtgaggaagagggtgtaactcagaggttgaatagcctctgaacccgtctgagatggcttataaaaaagtgtttcacaccagcacgcctctcattaagaacagtcagcggccgggcacggtggctcaggcctgtaatctcagcactttgggaggctgaggtgggaggatcatgaggtcaagagatcgagaccatcctggctaacacagtgaaaccctgtctctactaaaaatacaaaaaaaaattagccgggcgtggtggtgggcgcctgtagtcccagctactcgggaggctgaggcaggagaatggtgtgaacccgggagtcggagcttgtagtgagccgggattgcgccactgcactccagcctgggtgacagagcaagactctgtctcgaaagaaaaaaaaaaaaaagaacagtcagcataagaaaacctaagcttcctgaaggattctccacgagttttacacaggcagttcccgtcgtgcccatttgtcctgtgtcaggctttgtgtggttgagtctgttgtggacagacttgaagaggtcggtgtcccagccctcaaggagctgtcagtctggtaggggggtgctggactctggagtttgtaatggaggtcaggaatgccaggcacacccatgtacagatggacacggaaacaccttccaggaatgaggcccggcagccagaagctggtgtcaaggcctgctgagttggagctttggccatgcttcccccatgcttactgtggaggttgtgggcagtgcgttcctctaagcctctgttgagtgttttctttgtcatgtcctcttagaatgaccacctgagaaggagtgtgctgtaacctctgagaagcactgtgctgtgatagagtaagagttcagatgtagatttctgcctttgactccttagtgttgtgcctttgagcctcagtgccctgatttgtccagcagatgatgagatgacttcataaagttatgatcatagctaagtgtattatttatttatttatttatttatttatttatttatttattttttgagatggagtttcactcttgtcacccaggctggagtgcaatggtgtgatctcggctcactgcaacctctgcctaccaggttcacgcaattctcctgcctcagcctcccgagtagctgggactacaggtgcccgccaccacgcctggctaatttttgtatttttagtagagacgggggtttcaccatgttggccaggatggtctcgaacttctgacctcaggttatccacctgcctcggcctcccaaagtgctgggattacaggcgtgagccaccatgcccagccccaggtgtaattagttatgatgataactaaatgtaagatagctaccatactgctgacctatggaagggatgatgtcttggcatgggtcctgcccccttagctaaatgttagttgaaatgagagaattgcattagaaggccatgaggcttatgtttagattttcagtatattgaattacatttaagtcatgatttagtggccaggcacggtggctcatgcctataatcccagcacttaggaaggctgaggcaggaggatcacttgagcctaggaatttgagaccagtctgcccaacatagtgagaccctgtctctgcaaaaaataaaatgattaactgggcatattggcacatgcctgtagtcgcagcttctcagaaggctgaggtgggaggatcacttgagctctggaggttgagactgcagtgagccgtgatcatgccactgcactccagcgtcggcaacaaagcaagaccctgtctcagggggaaaaaaaaaagtcatgattttagtgtcattgctaacggttgtcttatgcaagcttggaaagtttgcatttctgttacaattatttactttgatagaccagttatactggaatttggtagatttaaggcaggtttatgtaactttcctcagatgtccagctccatctgccaggttttgttttgcctgagcagtaggagcctagaaatattccttgcacaacacaggcacataatgactagctgtgcaggactagggaaaatactgaatatgttcatgtttttgttgatgtaaatattggtcaatactattccagagcaagctaagccctcctgggatcccacagagtaaacaggaaaacctgctctgtccgtttctaatgggagcattaactcactgctttgggtggctgagatagtcaaaaaagagcaatttcagtgcaggttctagtcctgggcatgctctatacaagttctttgacttggacatctctgagccttggctttaccatctgtgaaatggggctaatatgccccacttgcccatctcaggactatgaattgtaaacagtgcagaatggccttataattgaccacttcctctcaagccatggctacccctttcccagcatctctttgttttctgttcttgttggaattactcttttcttttctttcttctttttattttctttgagatagactctcactctgttgcccaggctggagtgcagtggcgcgatctcggcttactgcagcctctgcctcctgagttaaagcagttctcctgccttagcctcccgagtagttgggactacaggcatgtgccaccatgcctggctaagttttttgtatttttagtagagacagggtttcaccatgttgttcaggctggtctcgaactcctgaccttgtgatccccccacctcagcctcccaaaatgcgggattacaggtgtgagccattgtaccggacttaatttttgtatttttagtagagatggagtttcaccatgttggccaggctggcctcgaactcctgacctcatatgatctgccggcctcagcctcccaaagtgccgggattacagacatgagccaccatgcctggcctcttttcttcaagagacaaggtcttgctccgttgcccaggctggagtgcagtggcatgatcataactcattataactcattataacctcgaattcctgggctcaaaggatcgtcctgcctcagcctcttgggtagctgggactacaggtgtgtgccaccatgcccggctaatttttttttttttttttgagatggagtctcaccctgttgcccaggctggagtgcagtggtgcaatcttggcttattgcaacctctgcctcccaggttcaaacaattctcccacctcagccccccaagtagctgaagactataggtgaacactaccatgcacagctaatttttgcattttttggtagagatggggttttgccatgttttccaggctagtctgaaacccctgggctcaagcagtccacctgccttggcttcccaaagtgctgggatttgagccaccatgcctggccattttgttatccttattatttgtagagatgggatcttgctatgttgcctaggctggtcttgaactcctggcctcaagcgatcctcctaccttgacttcccaaaatgctgggattataggtgtgagccactgtgctggccggtgttcacttaaaggaaaaaaaaaccttcaggctgggcacggtggctcacacttgtaatcccagcactttgggaggcctagatgggcagatcacctgaggtcgggagttcgagaccagcctgaccaacatgaataaacccctgactctactgaaaatacaaaattagccgggcatggtggcgggcgcctgtaatcccagctgctcgggagtctgaggcaggagaatcacttgaacctgggaggcgggggttgtggtgagccaagatcacaacattgcactccaacctgggcaacaatagtgtaactgtctcaaaaaaaaaagaaaaaaaaattcagaacaagctgtgcccagtagctcatgcctataatcccaccactttgggaggctgaggcaggtggatcacctgaggtcaggagttccagaccagcctggccaacatggcaaaaccccatgtctactgaaaaaaaaaaacaaaaataattagccaggcatggtggcacctgcctgtagtcccagctactcaggaggctgaggcaggagaatcgcttgaacctgggaggcggaggttgcagcgagccaagatcgcaccactgcactccagtctgggtgacagagtgagacttcatctcaaaaaaaaaaacaaaaaaacaaacaaaaaaaaaaacagttcagaacaacgtctgggtttcggtgcttatagacttgtagtcagagggattttttccatgtgcttagctcagtgggaggttttagtccttttaggagcttgtttctagctgtagaaatgacactgcattcatcaaggctccagttttttccttgccaagaaactgggtggtatgaatgtggtgggtttttttttgttgttgttttttttttttgcgatggagtctcgctctgtcacccaggctggagtgcagtggtgcaatctcggtctactgcaacctctgcctcccaggttcaggctgttctcctacctcagcctcccaagtagctgggattacaggcatgcatcatgactcctggctaatttttgtagttttttgttttttgagacggagtttcactattgttgcccagcctggagtgcaatggcgcgatctcggctcactgcaacctctgcctcatgggttcaagtaattctcctgcctcagccacccgagtagctgggattacaggcgcttgccaccacgcccagttaatttttgtatttttagtagagacgaggtttcaccatgttggccaggctgctgttgaactcctgacctcaggttccacctgcctcagcctcccaaagtgctgggattacaggcgtgagccaccgtgcccggccctcaatatggtgattcttaagcagagcaggggttgcacatcacagtcatctgggagcactcccctcagaaaggtacccatcttgtactggaggctgatgcaataagcaggtcctagatggcgcctaggcacagtcagctctccttccttctcccctgtacccatctaagcccttcccctgcctctctgcataggggtattaaacagcccccaggggcttggccatgcaccctggctgaaagttctggccctgatcatgagtgccctgagttggtaaacactgcagctaaactggtttcctttctgcttccctaacgcccccactgatttctgccctccatgtctctgcatacacatttcccacacatggacacctgttctctagcagttctgtcttcccccgtctttcaaggcccatctcagagcctgtcttccacaaagctgttccctccactggtgtctgctagactttcctcactgtgacctaaaggttcctagagcagcgtttctcagttcttttaacccaccctcaacagccaagaaaagtggccttaagctttactttcctttagggatactacaggccttttgccatttaacagatataaaatgacacagtggtatggaatatgcttgtttacattgtaccagtgtccttgcattgagacttgctgcccatagtactgctgtgacatctgaagcatccctgactggccccactggttattcttctgcacgtctgttcacctgctcctggcactgacttcagaggagactcaagagggtgtatagtacagtcttgcccagtgcaggtggcttctttctgacagccctggccactggcagccctgtctgccccacccatttgagtatctataatgacatgacgactgctgccccgagtcaggggggcttagaccacgtgaaggtagcattaaagagtttggcactgagtcaaaagctgcctgggatagtgaacacttactggccccaattctttcttctttactcatatagaaggttgaatcctttgcaggtgaactttttaaattttaattttttttttcttctgaggtggagtttcactcgttgcccaggccggagttcaatggagcgatcttggctcactgcaacctcctgcctcctgggttcaagcgattctcctgcctcagcctcctgagtagctgggattacaggcgtgtgccaccatgctgggctaattttgtatttttagtagagacggggtttctccatgttggtcaggctggtctcgaactcccgacctcaggtgatccgcccgccttggcctcccaaagtgctgggattacaggcatgagccaccgtgtctggcctaaatttttttttttttttttgagacagagtctcgctctgtcacccaggctggagtgcagtggggtgatctcagctcactgcaacctccacctcccgggttcaagcgattcttctgccttagcctcccgagtagctgggactacaggtgtcaccaccacgcctggctaatttttgtatttttagtagagatggggtttcaccatattggccaggctggtgttgaactcctgaccttgtgttctgcctgccttggcctcccaaagtgctggaattacaggcgtgagccaccacacccggcctcggcctaaattttaaattttaagttttattttatttttatttttttgagacaaggtctcactctgtcacccagactggagtgcagtggcatgatcatgggctcaggcaatccttccgcttcattttttaatttttttgtagagatgaggtcttactgtgtggcccaggctggtctccaactcctggcctcaagtgattttcccgcttcggcaacccaaagtgctgggattacaggagcactttgggaggccgaggcgggtggatcccttgaggttaggagttggagaccagcctggccaacatggcaaaaccccatctctactaaaaatacaaaaatgagctgggcatggtggtgcgtgcctgtagccccagctactcaggaggctgaggcataagaagcacttgagcctgggaggcggaggttggagtgagctgagatcacgcctccacactccagcctggagagcgagactccgtctcaaaacaaacaaacaaaaaacaacaaaatgtggaattactggcataagccacttcgtccaaccagcaggtgaactttttaacgtttgaagacagatgtatgtcatcttcacatttctttaggccataggttcctggaccttttgattgttcctggtaggacatggtccttgctgttcttgtcctgagcagcccttatttgatgtggtcttctaaagtatggtgtccagaactggacacagcatttggctctgaatagttcagggtggcctggacgctaaacatggcacaaacgattggtcagctaaaccagtcagtttttcatgctgctgctaaggttcatgccttgtgcttggtgaaaaattaagtgtttggaaccaagtccaggtctttactggatctctaaaatatttcattctgtgacttggggtgtggttttgctatccaggatccttagaggtttggtctttaagcctgtattcgttccttccctgatatgtggtacctaactacatctctctcagcccacttcccaccagggtgacttcaggccaccagttctaaagccattcgattctcctcagctcttcttgatccagcctctgtttatccattttgtacagaaacattgtagtggctgttgagagaaaggagcatcccttttagccagggcttggggagctccttagaggaacaggcatttgagagaggctttcaatgatgagcatgttggggatgtggggctggtgataggcaggacagttagggacatccttccagaagacatcctggggaaagacatagaggggggaagtcaccaggctgacttggtaggattctgcacactgctcatttgggttgcaccaagagctttagttggaattactgggttgcaccaaagagttttagctggaaatattggatgggaggattcctacatattttgttgggggaagggtcgtctagtgctgttggatttcttttctagtttttctttttttgagacagggtcttgctctgttgaccaggctggagtgtagtggcaccatcatggctcactgcagcctcaaccttttggactcaactggtcatcccaagtcagcctcctgagtagctgggaccacaggcatacatcaacacacctggctaattttttaatttttttatttttgtagagatagggtcttgctgtattgcccaggctggtcttgagttcctgtgcttaagtgatcctcctgccttgaccacccagtgttgggattacgggtgtgagccaccgcccctggctcctggcctagatttattttatttattttattttgttgagacggagtctcactctgggagtctgcacccaggctggagtgcactggcgtgatctcagctcactgcaacctccacttcccaggttcaagcgattctcctgcctcagcctcccgagtagctgagactatatataggtgcacgccaccatgcccagctaatttttgtatttttagtagagatgaggtttcaccttgttggccgggctggttctcaaactcctgacctcaagtgatccgcccacctcggcctcccaaagtgctgggattacaggcttgagccactgcacccagccttttttttttttttttaaacggagtcttgctctgtcacccaggctcaagtgcagtggtgtgattgcagcttaccacaacctccacctcccggattccagtgattctccaacctcaccctcccaagtagctgggaatacaggagtcaaccaccatgcccggctaatttttgtatttttagtagagacagtgttttaccatgtcggccaggctgctctcaaactcctgtcctcaagtgatccacccgcctcagcctcccagagtgttgaagcgttggaattacaggtgtgagccactgtgcccggccttttttttttttttttttttttaagataggttctcgctctgtcgcccaggctggagttggagtacaatggtgtgatcttggctcacggcaacctctgtctcacttgttcaagcaattctcatgcctcagcctcccgagtagctggaactacaggcatgcacccctatgcctggctaatttttgtatttttagtagagatggggtttcaccatgtcagccaggctggtctcaaactcctggcctcaagtgatccacctgctttggcctcccaaaatgctgggattacaggcatgaaccaccacgcctggcgctggcatagattccttttttttttgagacgaagtcttgctctgtcaccaggctggagtgcagtggcgcgatctcggctcactgcaacctccgactccctggttcaagctattctcctgcctcagcctcccgagtagccgggactacaggcaggcgccaccatgtccacctaatttttgtatttttagtagagacggggtttcaccatgtggtctcgatctcctgacctcgtgatccacccgccttggcctcccaaagtgctgggattacaggtgtgagccaccgcgcctcgcctagatttcttgattagtggctcctgaggggttctgaaacctggccttgtgtgagggttacctggggagattttgaacagttttctaggcctcattgtagaccccaaaaagaagcaaaagaggaactttgttaactgctttgccaagacgcaggtgtgtacatctgagctgtgtgactgagcactggctatatacagcagtgtcctgttctcccatctcctctcaggacttgagtccgtggccttctgctggggcccagggcccatctctcctgttagtgcttgcaaagctgttaagtaaccatccctctctgccatgcttcacactttgccctggagtgggcatcaagctctctggggttgagtttggggcatgggtgttttccattttcaggagctgggtggcacccctgggctttttcagttcccctctatacactgaagtctacttgggctccgaagtggacctcattctgagaagcattgctctctttctcctgcaccacctgccctggttgggaagcctgctgtccccatcaagagaaggaatgtgtgagctgcctggtgctttcccttgaactctctctttgtcagcactgcaccatcagccctgagcagctgacttgggttgcttcttgctctgagcagaactgaaacaaacctttgtgggagtgttatttgtaagcatctgtcattcttggctttggtcttcctaactctgttctagagctgggctgctcttgcggtttttatcaggtcctttcttctgtcatttgtaacatccttttgaattccacttcttggaatttacattggtttccttcaattccttccctaattcttcactgtcaggaccattctcagttatcggggcacagttttgcttgagggtttacaaccatcttgagggtttgagtcatctggccttttgagtctcagatattcagatggaactgatctctgaatgattccaatttttcttctttcttttttttttttttttttttttgagatagggtctcactctagttgccctggctggagtgcagtggttgtaatcttgactcactgcacagccttgactgccagggctcaggtgattcttccgctttcacctctcagcctcccaagtagctgggaccacaggcatgtaccaccatgcctggctacttttttttattttttatttttatttatttatttttgagacagagtcttgctctgtcactcaggctggagtgcagtggcgcaatcttggctcactacaacctccgcctcctgggttcaagcagttctctgcctcagcctcccaagtagctgggattataggtgcctgccaccacgcccggctaattttttgtatttttagtagagacggggtttcaccatcttggccaggctggtcttgaactcctgacctcgtgatctacctgccttggcctcttaaagtgttgggattacaggcgtgagccactgcacccgggctgtattttttttagtggagacagtgttttgccatgttggccaggctggtcttgaattcctgggctcaagcagtctgcctgccttggcctcccaaaatgctgggattacaggtgtgaaccactgcgcctggcctgaatttatcttcttgaagttgttttcctcagtggaggcatgattggaatttttttttttttttttttttgagacggagtctcgctctgtcacccaggctggagtgcagtggcgcaatcttggctgactgcaagctctgcctcctgggttcacgcctttctcctgcctcagcctcccgagtagctgggactacaggcgcccgccaccatgcccggctaattttttttgtatttttaatagagacggggtttcaccatgttagccaggatggtcttgatctcctgacctcgtgatccgcccacctcggcctcccgaaatgctgggattacaggcgtgaaccactgcgcccggcatgattggcattttgggctaaatagtttctgtccacaggaccgtcttgtgcagtgcaggtcttttagcatcctggccactcatagtgcccgtggttctcagtagaagctgtagaggatgttgggaaattggggtgggttggtcacagtgcctggcatctgtctcagggtaagggcttgggaggctcaagtgcagagtcgtatctggatgccagcaacaccctgttgagaaactttctactatggtatgctcatcattctctgaagatgtcagggcctgtttgtttgtttgcctgtttctctcacttttgccttataatcagttcttccttgttggttagaatcatgtaaaggaggttgccttttctgtctttggagagcttaacttgacggcaaggtaagttgggagtttatgtgataaccctacttaggattctctgagcttcccaaccctgctgtcattagcatcctcagggttgcccattcttctttctggccaggtgtgtggctcactcccatggcagtatttcttttatctttgtctgtggatcccctggatctccttgataccaaagcaccagtaagtgtcctttctgcacccctgcccttagtgctcctcactgactgcttcctctcctttttcttgagcaagatacagtttttcactctcatgttacagttgagttccatcttgccatatttttataattcttgtgaaatttaccttgtgtttatcatccctactttatttttttatttttttattttttcgagacagagtttcgctcttttcgcccaagctggagtgcagtggtgcgatcttagttcactgcaacctctgcctcccgggttcgagcgattctcctgcctcagcctcccgagtagctgggattacaagcgcccaccaccacacccggctgatttttgtgtttttagtagagatggggtttcgccatgttggccaggcttgtctcgaactcctgacctcaggtgatccacccaccttggcttcccaaagtgttgggattacaggcgtgagccaacgcactcagccatcacccatactttatactgttggagtgtggatttctgaaaccataaagtatatttacagatgattttaaaatttgttttgtcccataaatgttagatatcttcactgttgtttcttctttttttagttgtctagtttcaaagttctgtgtggcatatttttttcctatctgtatttggtttaaaacattttgtttgctaggactccagccttaagggacgtgcatggtataccctgtccttagccaagaatcttactctagtatcttgagccaaggtcaaaaaagccaaacacagcattggaactgtatttatagaaaatccttcccaccccagattcctttttcctcccaaagccccagcttcccatccacccaccaacctggtcattaagcacatgtttgagcaccactgtgagccaggcgctggcaggaccagggcttcctgatccctgcccttgttgagcttacattctatttggagagtggaaggaggtggcagtgtgggtgtgagatctcttcccctttctgagtctgcccaggcttcataatccccaggggagcatttcttatgagtcttgtgagcaggaggaccaggtggcagttggcaggttggagtggtccctcaggttccgtacctccttatgcagggaaagaggggcctcatgcaggtggagaggggccaggccaccccattcctcactgcaggaggttgcagcccatgccgctaacgcctcctcagggagaaatggatccatcatcgctcccagcagtgcctcttctctcaccacagctatagcctgtgagaaatccctatgttcaggctccacccacacttgctggaccagaatttctggggctgggcccaagtccaggtgattgtggtgggcagatgagggtgacaggcaggagcaccctgtggggggaaacttgtgcctgttgcctgctatgaagcaccagtgtgttccacctcttccgtgtattcattcactgcactctccctctctgctgctctgggccgggcgcccagcacatcttcctactcagaaccagtaacctgggctccggttcccccttccttgccaattgtttccttccctgcctgtgtagcctcagggtgccttttaaactaccactgtgtgatggaagtatgaggtgcaaggatcttttgggcttgatgtgggggctgatagggagcccccaagccactgtgagttgaagtaccacgtaaggaggttctggagggtgctggagctgggccagaggaagcagcctggcgaaggaggcagggctcagctggatggtgctcgggctgcagaagagaaggtgcctgacaggtgtggaggcggcttttgtgccactggatgggaggccgggctgaggcgggtagagtggcacttcatgtgtcagagtggaggaatgttggcgaggctggtgttctggcaggagggcattgctgggtggtttgggttatagcgcctgccaggcattcactgagatgttggaggcaatgggaaatgtcaggctggtgcacagttgaaaaacaggtgacagacagttctgaagacatctcaggcaggaccctgaagtcgtaaagttgtgctttctgggtgaaatggcacttgctgcattgactgtttatacaacaataaccccacatatttgcaaggggtcctgttgcccacaacatggcttccctttccttttctgcactctgggtctgttttgcagctgaggaaacaggctcagtgaaggtttcccgtccccacccccccactcccaccccagtcccagactggatggttctctttgctgtgtgcccatgttgaggtggagtccttctgaaatcacacttatagcactgggtagaaaactggatatgcgtttgtgtctggtttgttcccagtccccagttttattcatctttagcttctcagcatccggtgcataatcagtgcttaatgaatcttgattggaaggtatcaggtgtagagcacctcaggatagctcctgccacatgtctgccctatgcagggtgctgagggatttaaacagccatggtgaccaacccaaagaggaggtggtacgtctgcagaagcatggttccccctgtcctattcaggggggttcactgaggtgggggcttgtcttggtctggggcatggggagaggcaacaaccttgcagaggggaccgccatggcagctccatgcctccttaaccactccaagcacagtttagtcctcactgtccaattttgtcattagcatttttggcacttggtttaatttgagggcatcaggagggatcttaatatgtggtgctttcccctatttgacacccctttatgctttgtcaatcaacaggagcttgaagaaatccgcaaatgtgggatgaaaaacttccgtaacatccaggttgatgaagctaatttattgacttggcaagggcttattgttcctgtgagtattgaacacttccacttcctaccagattattctttaaggtgatgtgtgtgctgttgggcttgtttttctgctccttagtaggctcttagtctaggcagccagcagatgcacagaagtggctgtcgctctagggtgataaggtagggagtgtagccttgggtcctgagtagagtcacatcttggcactcgttttgtcaaattcagggagtcctgagctttgcagatctgtagacacagagaaaaggagtgtgtctgtgctcctgctctttcctgacttccctgcgcctggcctgatggatcagcaggaccttcttctctgagctcctcaggaggggacaagcattcccctctagatattttgctttctctcttggttttgcattcatgtctctaaccctttggatacctgtatttcgggctttattcctggtcccctccaacctgtgccttccatttgtctcaagtcccttttcctaattgcccacatgttcccctcaccccatgtcttttctggggcttatgcctccagtgtctgcccccacagcccagctcccccatctcacagtcttctgccttctgatgggctcaaggccctcctaacgatggctttccttagcaccctcttagtgcctactcttttctgcatcctttgatcccctccccttcaagaggcttgtcttataattaactccagtttgcaatcccccttcctctcactctcctgaaaccacgtcacacccagcccacaggctgcccccactgttgtcacacctctagctcggcagtgctggcatcatggcccttgcttgcctcctgagcttttggagcacgggcagcattccagcccccagtcctgtgaccagcctgccactcgctcctgttctgccactccttcctcctcactcttaaacatgactcttgttggtctcctgctgttctcctgttctgttttgtctcgggaccctactactttcggcatcatagatgattatgccagacatgaaggattcccacacctgtctccattcctgccttctccccggaagctgcaccatctgtccaccaggcggcctcacttggtcattgtgtagccttcagctacctcagctcacacccttgtcctgcgtgagtgccctcctttcctgttcttcctcatccactcaccttctctgttccttttcattcccactttgcacatctgagcctctggcccttgccctgtgcctgccgctgtcctgtatataatttgttctcatggatggattggctgctttgccaaagcagagcatggagcatgcttcctcctgtagatgcttcttcctgatgctggttataaggtcatgagcatggagcatgcttcctcctgtagatgcttcctcctgtagatgatttctccctgtagatgctttcttcctgatgctggttataaggtgagcatggagcatgcttcctcctgtagatgctttcttcttgatgctggttataaggtgagcatggagcatgctccctcctgtagatgctttcttcttgatgctggttataaggtcatgcttttttttttttaagtccctgaatttgatcagcagttattggatttgtagtttatttccataatcatttggataactaaggaaagatatgctttgtaatgatttagtatgctcagaatgtttaaatctgggagcttccagtctgattttgaagatgagtcctttagatttctttaggcttgatggtgttagggctcagggcaaagggtgtgggtggcagagacacctctgcatgggaggggttggcctgtgagtgcagcccttgcctactctagggacctgaagatggccgggaccatctgacctcttgtcccttttctaattgagattgtgtagtctactgagcaaagaaatgaacagttaatctgtggctctttggaaaatgataaaaatgaatggaatggttttaagtggtaaggcttgggcagtctggccctgagaatttagtggcctgagagcctgctagccagctccacgggtagattgctgctgggcatgctctgccccaactcatgcaaaggcctccctctggtttcacgctggcaggggctatggagcagtgggctaagatcttactagggcaaaggtggaggctggctggtagaatccaagtgtgcttgggctgaggctctggggagctatccaggccaaagtttcaccttggagacggtaagcaacagccagggctgctcttgtccctgtgtataccacttcttctcggtcctctcccttgctttcttccagggcccctgggtttgtatgaggaatgtttcaatgaagtcttcttccttctccagagcagttaaggcattgttgacatctgacatccccagggtccacacttgtaccccaacctgggctttaggtcttcctgcattggacgggctgggccagcatgggaatctactatacaaactcacctgaggtctgcccagttggggtaaaagtagagccaggccgatgaaggcatggcagcccagccctggtccttagtggagagtggtgctgtccttgggtagccacctagcgattgccctggtcgtagtgcacagaggagggcaggtgggagggaaggctggggaggtacttcctagagacttcattgttgccaacgcaactctggtctattccctttaaacatttgtttttctgtaattttttttcatctaagatgctaaggtaacgtctaaggaagaaaatattacccataatcacatcatcaagaaattcagttacattttgtgtactgccctttaggaactagaggtgtggtagtcacccttcttgaagcttctagcccagtgaatgtgtttactcttaaccttcagcatacttcctctcagccttttttcatgcagtttcttttttttctttttaattgagttggagtctcgctctgtcgctatgcagtggcacgatctcggctcactgcaacctccgcctcccgggttcaagcgattctcctgcctcagcctcccaagtagctgggactacaggtgcgcaccaccacaccccgctaatttttgtatttttagtaaagacggggtttcaccatgttggccaggatggtctcagtctcttgaccttgtgatccaccctcctcagtctcccaaagtgctgggattacaagcgtgagccaccacgctggccttcatgcagtttttaataaaccatttcataacttcataataatgttttggttttttgaggcagggttttgtgctgtcacccaggctagggtgcagtggtgtgatcatggcccattgcagccttgaatttctgggctcaagcaatcctcctgagtagccaggactacaggtgtgtgccaccacacccagccaatttctttttattttattccattttattttattttttgagacagtcttactctgtcacccaggctggagtgcaatggtgtgattttggttcactgcaacctcagcctcctgggttcaagtgatgcttatacatcagcctcccgagtagctgggattgcaggtgtgcaccaccatgcccagctaatttttgttcttgtttttgagacagagccttgctctgttgcccaggctggggagtgcagttatgcgatctcggctctctgcaacctccatctcccgggttcaagcaattttggctaatttttgtacttttagtagagactgggtttctccatgttggtcaggctggtctcgaactcccgacctcaggtgatccacccatctcagcctctcaaagtgctgggattataggcataagccattgcgcccatcctgtaacgtcttaaatttccactacaaaggttccagttcatccacatccttgctaacatttgttattttactttttttttgtttttacgttacagccattctagttggtatgtagtgctgtctcattgtggttttgatttctgttttcttcatactaaggatgtagaacatgtttttgcatggtgtgttttttgtttttttgtttctttttgagacagggtctcactctgttgcccaggccagaatgcagaagcacagtctcgtctcactgcaacctctgcctcccgggttcaagtgattctcccacctcagcctcccgagtagctgggactataggcgtgcaccaccacacctggctaatttttgtattttttggtagagacagggttttaccatgttggccaggctggtctcgaactcctgacctcaagtgatctgtccgcctcagcctaccaaagtgctgggattacaggcttgagccaccgtgcctggcctgatgcactaaagttttaaattttttaatttaatttttatttttagagaaggggtcttgctctgtcatccaggctggagtgcagtggctcaataatggctctctgcagccccagactcctgggctcaagcagtcttcccaagtagctggcactataggcacatgctgcaacccccagctaattttaattattttttctgtagagatggagtcttgctgtgttgcccaggctagtcttgaactcccaggctcaagtggtcctcctggcttagcctctgaaagctctgggatttacagatgtgagccatcacacctggccttaaatttttaataaagaagtccaatttatctatttttaattttgttgcctatactttggtttgatttttaagacactgttgccaaatccaaggtcatgcaaattttcctgagttttcttctaagagttttatagttttagctcttaaatttggatctttgatccatttatatgtagattttttttttttttttttttttttttttttgagacaggctctcgttctgttgcccaggctggagtacagtggcatgatcatggctcaccacagcctcaacctcccaggctcaagcgatcctcccacctcagcctccagagtagctggtactgaaggcatgagccaccacgcccagctaatttttgtatttttttttttttttttgtagagatggggttttgccatattgcacaggctggtcttgaactcctagactcaagtgatccgcctgccttagcctcccaaagtgctgggattacaccactatgccctgcctcatttcttattttaataatatgagtcttttctctttttccttttatcagtctagctaaagttttttcaattttgttgatctcttcaaggaaggtttcattaatgtgtgtgtgtgtgtttttcatttatctcctctgtgcttactatttacttctttcttgtgttattactttctttgttccttaaaatatccagttagattattgatttcagacttgctttttcaatgtaggtatttaaagctgtagattccctttgagcactacttttgctgcataacttaagttttggtatgtcatttttttttctgaggatattttctaatttcccttgtgatttcttctttgacccattgcttgttagagagtacgtttaatttccccataattgtgagttttctagttctgttattgatttctagttccctttccttctccctttccctttccttttttttttttttttttaaataaatagagatgggggctgggtgcagtggctcacacctatattcccagcatgttgggaggctggggtggaaggatcgattgagcctaggagttcaaaaccagcttgggcaatatagcaggaccccgtctctattttattaaaataataataataataaatgggttctccctgtgttgcccaggctggtctcaaactcctgggctcaagcgatcctcctgcctcagcctcccaaagtgctggaattacaagcatgagccaccatgcccccacccgcctagttccatttcttttttttttgagacagagtcactctgtctcccaggctggagtgcagtggtgtgatctcagctcactacagcctctacctcctgggttcaagcaatcttttgcctcagcctccctggcagctggggctacaggcatacaccaccacgctcggctaattcttttgtatttttagtagacacagggtttcgccatgttggccaggctggtcttgaactcctggcctctttcacctttttgcagttacatttgtagttagacctctcaccttctttctgcaagcttatttgcacagcagttgctcctaaaatccacgccctccggatgcctcattcctcctttctgcattgcccctctggcctttgatgggagctgcatcctgcctccctgggctcagcacttgcctgtaattgtcagttcttttctgcttcctgctaattgtgccactctgccttctctctcccctacttccgtctcctgtagctgtaatggttgagaccaatgagggcagccctgttttctgagggcacactggagttgttttggggagaaagagtatccccctacattgatggggctgttgagctcctatcacagccagacacaaggttctatggacagaggccacagagaagccaccctcctggaatccatggtctcttaagcactgagtgtggctccacctgcaaggcacttaagaccaaacagaagcagggcagcggtgggtgggagggtgacaatatctggactgcatagtggaaggcagtgtgagcagaaactatgaaaaaatataggcagtgtgaggacatatgtgtagtttgcatagatgtacagaaattaaggcctttgagagcaccatgtatgcacagagaacgttcttgggctgtgcagcagaggcctgacggcatcctggggaatggggtgtctggtgggattttttgtttgttttgtttttttcacttctatttttggtgtgagtgctgtattttttccattcttgggagaaaagtgaattatgtatgagaagtactcatggctatttgagcccaaaaggaaggaatggtctttgtcaaattcggttaatggagattgtgattttaattgtagatacaattcagaaggtagtttatgaacattatgaaatgaaagattggaaaaccagttctaaaatacttattcctggccgggcgcggtggctcatgccagtaatcccagcactttgggaggccgaggcaagtggatcacctgaggtcaggagtttgagaccagcctgtccaatgtggcaaaaccccgtctctactaaaaatacaaaaaattagccgggcctggtggtgggcgcctgtaatcccagcaatttgggaggctcagccaggagaatcgcttgaaccggggaggtggaggttgcggtgagctgagatcgtgccattgtgttccagcctgggcaacaagagcaaaactccatctaaaaaaacaaaacaaaacaaaacaaacaaaaaaacttattcctactatttacttccaaagggaatacgattgaactctttagtgttgaagtatttgttgccggccgggtgcagtggctcatgcctgtaatcccagcactttgggaggccaggggaggcggatcacttgaggtcgggagttcaagaccagcctggccaacatggcaaaaccccatctctactaaaaatataaaaattagccgggcgtggtggcaggcatctgtaatctcagatactagagaggctgaggcaggagaattacttgaacccaggaggcggaggccgcagtgagccaagatcgcgccactgcactccagcctgggcgacagagtgagactccatctcaaaaaaaaggaaatatttgttgccaaagaactgtattatgaaaaatccccaaaaccaagttgttgaaaacagtacaaagaagtcatcttcagaaaccaatattagaacaagatgaatctcatgtggcagattttttgattcaaataaccaaaaagcctgttttcagaagagacaataaatacttaaaggcaaggagggacgtggtggctgacacctgtaatcccagcactttgtggggctgaggagggtggatcacctgaggccaggattttgcgaccagcctggccaacatgatgaaaccctatctctactaaaaatacaaaaaattagctgggtgtggcggcaggtgcctgtagtcccagctacttgggaggcagaggcaggagaattgcttgaacccaggaggtggaggttgcagtgagctgagatcgcgtcattgcactccagcctcggtgacagagcgagactctttcaaagaaaaatcaatcaatcaatcaatcatacttaaaggcaatttacaaagttaagttcttgtgactttcgaacatggagtaaggacatattccatgttcagaagtcacaagaacttaacctcctaaacttaactcttttgggtttttttgtttttttgtttttgagacagagtctctctcgtcccccaggctggagtgcagtggtgtgatctcagctcactgcaacctctgtttcatgggttcaagtgattctcctgcctcagcctcctaagtagctgggattacaggcgtgtaccactacgcctggctaatttttttgtatttttagtagagatgggatttcaccatgttggtcaggctggtcttgaactcctgacttcaagtgatccactcacctcagcatcccaaagtgctgggattataggtatgagccactgtgcctggcctaactcagctcttgacaaggttccagagtggatcacgaaggcttgagagcatagaaaccagcctggggcagggccaggcacggtggctcactcacgcctgtaatcccagcactttgggaggctgaggcaggcgggtcacgaggtcaggagatcgagaccatcctggctaacacggtgaaaccctgtctctactaaaaatacaaaaaaattagccgggcgtggtggtgggcgcctgtagtcccagctactctggaggttgaggcaggagaatggcgtgaacccgggaggcggagcttgcagtgagccgagattgcgccactgaactccagcctcagcgacagagactccatctcaaaaaaaaaaaaaaaaaagacaaaccagcctggggcactccgagcagggcaagccgcgtccccttgttctctcttaacaggggactggactgtgtagggataggcagcccacagggctggtctcagtagacatccctgtggcagggaaagcttcagctttgttagttcactgggtgaaaaaggttagccacagggaaaggatgctgctgtggagtcgccaccaagctaggcagaagtgacaacagtgcacaggacccttcagtccatctgaagcctggcatgaagaaggagcagcatgctagttagatccaaactaggatccagctcttcaggtcagccatgagtcctgtctgtggtgtcctacagccagctaggaacacaccacaaggacgtgccatgtagcagcagtccaagtcagacaaccagaagacaccttgacttcctctgtggctgccagagagctgtatggtggtcttccctgcttcacagcagtgacatgaaacggtgacttctgtgggatgaaggactctgggtctttacttgggaagggaaaacatgaagtggaatggggttttaggattcttgaaaggttgccatgggaaaggaagattagatttgaccacagggttagagctaggacaagtgggtgaaagaccccagatagttcggtgccatatggcaaagagcttcctcttagtcttagctgccacaaaatggctttgtgccatgggaggttgatatcaagagctgtgaaggatctgagatttttaccctacttgcagcctgaaaaggtgtcctgccaatttattggatgttggtggaagactcgagaaaagggccagttcccctcgtccccgcatcccacaaaggtgatgaggatgggcccagatggatacctgcagatgtggggggttgtgttccgggacaggaaggctgagtttaggggaggtctcaggccagtcactcaatcgtacttcacttgctccatttccaaatgcaagtgatggcagcactggcttcccagggttggtgttaggggaccaggaggggcggaatatgggctggagatggcacggaaaagcacctggcatctaagtacttgagaaactttggtcaaatttttttaaattggctttcccaggttgaaatgatcaactcttatttacatgcatgcattataatgactagaagcaaatacaggaaaatgttagccatactatatataaaagaaaatccactttaaaaccggtatctttctttctttataaatagcaagtgggccgggtgcggtggctcacacctgtaatcccagcactttggaaggccgaggcaggcggatcacctgaggtcaggagttcgagaccagcctggccaacatggtgaaaccttgtctctagtaaaaatacaaaaaaattagctgagagttgtggtgcatgcctgtagtcccagctacttgggagggtgaggcaggagaatcgcttgaactcaggaggtggaggctgcagtgaaccgagatcgtgccattgcactcctgcctgggtgacagagcgagactctgtcttaaaaaaaaaaaaaaaaaaaaaaaagacaagtgggctggtcgccgtggctcacgcctgtaatcccagcactttgggaggctgaggcgggcggatcatgaggtcaggagatcgaaaccatcctggttaacacggtgaaaccccgtctctactaaaaacacaaaaaattagccgggtgtggtggtgggtgcctgtagtcctagctactcgggaggctgaggcaggagaatgatatgagaggcagagcttgcagtgagccgagattgcgccactgcactccagcctgggcgacagagccagactctgtctcaaaaaaaaaaagacaagtggataaaaagtctgtcctagaatttagacatggattgaaaaggtgttttttgattttttttttttttttttttttctgagacagggtctcactcttgccgaggctggaatgcagtggtgtaatcatagctcactgcagcctcaaactcctgggcttaagcaatcctcccacctcggccttccaaagtgctggagtttaagtttttgaactagtttagagtgtgtaaaattatcataaggaattaatttacatctcaaatgacttcctcaatacagcagtatgagcttagggagcacaagacagtcaaaggcaggcataacagaaaaacactagtcgtgttcatgtgaagataatgctgaaatcagctgggcgtagtggctcacgcctgtaatcctagcactttgggaggctgacttgggtggatttttgagctcaggagttcaagaccatcctgggcaacacggtgaaaccccgtctctactaaaatacaaaaaattagccggacgtggcagcctgcgcctgtaatcccagctacttgggaggctgagagacaggacaatcgtttgaacccgggaggcggaggttgcagtgctgagatcccaccattacactccagcctgggcaagcgtgagactctatctctaaataaatagataatgctaaaatctttggtttatttgacattgaaatgttgcagcttaagttggaggcaaattttctgcaatgttttataatatatatattttttacaacaaaaccatgttttttcattaacatcccttgttatttctgagtggccttcccaaagggcaagtttagctctaatgttgaaattcacttgtagagctgtaggcctttacccggaaggtatatcttatgttttaatttttgcatgcctctttcaccaaaaatctctgggacaggcacatagtttgtgtgacttatgcacacctgagccactcctttgaccatccacagatccccagactaggaaagaggcccagagaagttcagatgagtttggccaagttccctgggtggtgagaggcctggcctgcctcatgtagtaacagaactgcttcttttttttccttcctctttttggaagaaaaaagaggcaggatctcactgtcttgtccaggctggaaggcagtggcgtgatcatggctcactacagccttaacaactaacaacttaaaactatagcctcaagcagtcctcctacctcagcctcctgagtggctgggactacaggtgtgcaccagcagcacgcacagctaatttaaaaaaattgttagcaacaaagtgagatcctgtctttacaaaaggacttgtttttgttttgttttgtttttttgagagaacaccttgctctatcgcctaggcaggagtgcagtggtgcagtcttggctcactgcagcggtgtgatcttggctcactgcagccggtgcctcctgggttcaaccagttctcatgcctcagcctcctgagtagatgtgattacaggtgcgtgccaccacgcccagctaattttttgtatttttagtagagacagagtttcaccgtgttagccaggatggtctcgatctcctgatctcgtgatccacctgcctcggcctttttttagtatagatagggtttcttttttttctttttctttttctttttgagatggattttcacttttgttgcccaggctggagtgcaatggcacaatctcagctcaccacaacctctgtctcccaggttcaagtgattctcctgcctcagcctcccaagtagctgggattacaggcatgtgccaccacgcctggctaatttttgtatttttagtagaaacggggtttcaccatgttggccaggcttgtctcaaactcctggcctcaagtgatctgcacatttcagcctcccaaagtgttgggattacaggcatgagccactgcgcccagtctgtttttggcttttttgagacaggttctcattctgtcacccaggctagagtgtagaggtgtgatcatggctcactgcagcctcagcctcctgggctcttgtgatcctcctgccttagcctcccaaagtgttgggattacgggcatgagccactgcacccagccaaatctgcttctcttgagctttgcccatgtgtcaggcatgtaggactttatagtccttatctctcatcataaactctgggtacaggctgttgctactcccattttacagatgtacaggaacattctcagactctttaagctaggaagaggcaaagtctgaggctagacctgctaacttggggccagatggcctcattcatgcttcaccccagctcctcggacaggacctggcccacagtggggaacaggggaggttggtcagtcctggacaatcagtgaagacctttagcagatttcaccaaccaaaagtcatgcaggaaagtgcgcgcgcgcgcgtgtgtgtggtatgtgtgtgtgtgtgtggtgtgtgtgtgtgtgtcttactctgttgcccaggctggagtgcagtggcacaatcttggctcactgcaacctctgcctcccaggttcaagtgattctcctggctcagcctcccagtgtgccaccacacccagtgagggaaagctatttttacatggctcaagcagtgtaaatgacaatgatgtttacttacttccccccaccaccaccaccatttaattctcctcttgaaaactaaaagctggctgggtatggtgcatcactcctataatcccagcactccagcactttgggaggatcacttgaactcaggagtttgaggccagcctggacaacatagtgagacgccatcactataagaaataaaaaaatagctgagtgtggtggcatatgcctgtagtcccagctacttgggaggctgaggtgggaggattgctagagcccgggaagtcaaggctgcagtgaaccgtgattgcacctctgcactccagcctgggtgactccccacagatgaatatgctgacagtggtttcagctgctcggtggtgattcagacctggacgcgtggcttcagtagccctggggccacactgcctgcccgcagcctcctgtcttgctctatgctattccttccaagtccctgccatctagtctttagtcctctctgcctgggaggcctcttccactcctcagccttatgtcatcttatccatcctttaaggcccttgctccatgcctcccctcccagggcagggcttggatgtaggagaatgtggagaactggcgcacgccagccttgctccccagcagaggagctctgtttactggagtgcgtacttaggccacggcttgaagatatggggctggggtgtagggctgtcaagattgttcctggggccaggtgcagtagttcactcctgtaatcccaacactttgggaggccgaggccggcagttcacctgaggtcaggagttcaagaccaggctggccaacatggtgaaaccccatctctactaaaaatacaaaaaaaaaaaaattagtcgggcagggtagcgggtacctgtaatcccagctacttaggaggctgaggtgggagaattgcatgaaccagggaggcagaggttgcagtgagctgagatcgcgccactgcactccagcctgggcgacagagcgagactccgtcttaaaaaaaaaaaaaaaaaaaaaaagattgttcttgggctctctgtgaagcttggatttctttgggttgggtgtgccatggcaagtgccatggcagacctgggtgagggaaaagggagtacaatgggaagggcttccccagctctggagataggtagggttggggagaggccaaaagactctttgctgagtcatctctcaggctcctggggccatcagagtgtccaggccccaaaggtggttttcgggtggttctaggggcaaggggctagggcatggtgctggccctgcctggtgatcacctgttgagtgaccagctcaggtccccagggtccagccattgagctgactactgtttctaccctgggaagattgagctggccaggacttggcatcaaggcagttatttggacttctagtactcacagtgtattctggttgggttgtaacttacctctggtacaactctacttgtatcttcagaaaagatcaagagatatttgcaaaaacataatatgataaaggactgtctaaaggacaaagaacacttaaaactctataataagaaaacaacaataaataacaccgtgcatctcttagaatgaccaaaatccagaacactgccaaatgctgctgaggacgtagagcaacaggaactctcgctctttcctggtgggaatgcaaaatggtgcagccaccttggaagacaagttaggcggtttctttcatttatttattcataaaatctttttaacaaagaaattgagtctctctcttgcccaaaatggagtgcagaagcgtgatcacagctcattgcattctcaaactcctgggcctaagaagtccacccttcttagcctctgaagtagctgagactacaggcacatgccaccatgccaggccaatatatttattttgttattattttttgagatggaatcttgctctgtcacccaggctggagtgtagtggcgcaacctcagttcactgcaatctctgcctcccgggtttaagcaattctcctacctcagcctcccaagtagctggactacaggcgtgcaccactacgctctgctaatttttttgtatttttagtagagacagggttttaccacgttggccaggctggtcttgaactcctgacctcaagtgatctacccagcttagcctcccaaagtgctgggattacaggtgtgagccactgagcctggcccaggctaatatatttaatttttttttttttttttttttgtagagatggggtcttgttatgtttcacaaactggtcttgaactcccggcctcaagtgatcctccctccctggcctcccacagtgctcagattacagacatgagtcactgctcctggcccagtttggcagttttgttttgttttttttttgagactcagtctcgctctttcgtccaggccagactgcagtggcgcaatctccactcactgcaagctccgcttcccaggttcacaccattctcctgcctcagcctcctgagtagctgggactacaggcgcccaccaccacgtccagctaatttttttttgtatttttagtagagacggggtttcactgtgttagccaggatggtctcgatctcctgacctcgtgatccacctgccttggcctcccaaagtgctgggattacaggcgtgagccaccgcgcccggccggcagtttcttacaaaactaaacatatgtcttaccattggatccagcaattacattccttggtatttagccaaatgaattgaaaacttgtatccacacagatgcttataacagctttattcattaattgctaaggtttgaaagcaaccaagatgtccttcagtgggttaatggataaataaattgtggtatatctagacaaatgacattcaacactaagaagaaatgagtctgggtgcagtggctcacacctgtaatcctagtactttgggaggccgagacaggcagatctcttgagcccaggagtttgagaccaacctggacaacatagcaaaacccagtctctataaaaatacaaaaaaattagctgggggtggtggtgcctatctgtagtctcagctacttgggaggctgaggtgggaggattgcttgagcctgtgaagtcaaggttgcaatgagccaagatcacgccaccatccagtgggcaacagagcaagaccctgtcaaaaataaataagtaagtatgaagtgggggaaaaacaagtaacggctgggcacagtggctcacgcttataaaccctgcattttgggaggccgaggcaggcagatcacttgaggtcaggagttcaagaccagcctggccaacatggtgaaaccgcatgtctactaaagatacaaaaattagctgggcattgaggcgggtgcctgtaatcccagctacttgggaggctgaagcaggagaattgcttgaacccaggaggcggaggttgcggtgagccaagatcgtgccattgcattctagcctgggcaacagactctgaaaaaataataataataaaaagaacaaatagcttctaacgacaaatttatttctcacttattgaggctgggaagtctgaagatcaaggtgccaacagattcagtggcaactgagggccggcttcatggtttatagatggtgccttttcactgtgtctttatatgatggaaagggcaaggcagttctcaggggcctctttgataaggacaccaatcccatcatgacctaatcacttcccaatggtcccaactcctaataccatcacattggtgattaggtttcaacataagatttttggggagatacattcagacatagcagctacatattgcatgattccagctatcatgtctgataaccacacaaaacctatagaatgtgcaacaccaagtatgagccctaacataaactagggaagctgagtggtaatgatgtgttaaggtaaaaggttcattggtggtaacaaatttgcccctctggtgagggatgctgatagtgggaaaagctgtgtgtgttcaggggcagggggtatttaggaattctctgtcctttcctctcagttttgctgtatacctaaaggtgttctaaaaagtaaagtctattttttaaaaaagtatgaagagaccaggacatcaatctcaagccccttctcagtttagcagatagcttgctctagaaatacttttgggtggctgggttgtcctgaaggtggcagggcttcagttgatacttgaatcccttgaaataaattgatttttcagataaacaattaaaacattcctgtcttggccataggtttatgaaccatggtgtgttcattttgatctctctttccttccaggacaaccctccatatgataagggagccttcagaatcgaaatcaactttccagcagagtacccattcaaaccaccgaagatcacatttaaaacaaagatctatcacccaaacatcgacgaaaaggggcaggtctgtctgccagtaattagtgccgaaaactggaagccagcaaccaaaaccgaccaaggtaagacatgtgcctgtgtcttcctcggagggggtctttgggggtgctgctctggggtgggggcttctggtaccagatcagacagaatccagagaatctttcaggtacacgaaaaatgtagctgaggtcctgtcagaccttgtgggaatggctcatctcagctgaacttttgacctgtatagggtttgaggaggcctttccagtgctcagccctgggctgccatccacagtgggaacacacatggacagacaagcccagtggcttgctgctggtgcagagaggtgcaggcactggtccctggaagggatgaaggactgtggggctgcctacaaggggaagggagagtgggatttaaggtggcctcatgcagtagttagtgcctgaactcagacttgaaggaggaaaggaggttggagagggccttccaggctataggaagggcatgggctagagcctagttgctcgggtgatgtgaggggagggacagaggcagatgtaagggcagtattcccagatgaaggcacgtagttggctttagtgggcctgggattccctggagttggatgtggctgtgcgtggtgcacatgtctgtgtgtggctgtgtgaacataaacatgctcattcttctgggaagaatatttgagtcagtattgtggttgtcctcccttttgtcccctagaagtgactagtttgttatggactgtgtctggttttcatttaattctagactttcttttgaagtcctaatctcatattttgatggcttccttttaagtacctaaaccagtataaagtctgtttagattagagtggatgaagctggcacttgagaggctgcaagtggagggtttcttttaggggtgctgctctagggtaggggctcatgggtccttcctgatgccagatcagacggagtccagagaactcctaccttaccaggtgcacgcaaagtatggctgaggtgccaccagtccctgtgggaataactcagctgaacttttgacctgcacagggattgaggaggtcccttgttttagtgattgaaaaaagccttggaaggtggagttcaaagccttgcgcaagaaaaatcaagcctcacttgttggaagtaatcaccatgaaaggtgcccattagactcccacactgagtagaagaaaggagtgggtgctaaacattcagtcagggcagaacagtctctagtgggcttggtccttgtttgtgtacaagctgatgtttataaaagcttgacacagttcttctcagtgcctggttttttcttttcttttcttttcttttttggaaacggagtctcgctctgtcaccaggctggagtgcagtggcgcgatctctgctcactgcaacctccgcctcccgagttcgcgccattctcctgcctcagccttccgagtagctgggactacaggcacccgccaccacgcccggctaattttttgtatttttagtagagacggggtttcaccatgttagccaggatggtctcgatctcctgacctcgtgatccgcccgcctcggcctcccaaagtgctgggattacaggcgtaagccaccgcacccagccgattttttcttttcttttcttttttttttttttttttttttttttttgagacggagtcacccaggctggagtgcagtgatgccatcccagatcactgtaacctccgcctcccgggttcaagcaattctcctgcctcagcctcctgagtagctgggattacagccaccacgctcggctaatttttgtatttgtagtagagacggggtttcaccacgttgaccaggctggtctcgaactcctgacattaggtgatccacctgcctcagcctcccaaagtgctgggattacaggcatgagccatcatgcccggcgagcctggtttttttctgtacagattcctagcactgtcgaaaacctatagctgcatttgatcaagagtgttcagtaattcctggagtccttgccgagtcatgtctgttaacccatcgtgcctggggagtggcagtccttccaggccaggttgcccaggaaagccctgcacctcaggttctggccacaaagagttctgaggctcctcccttacctgtagactgagagggtggggctagggccagggaggctctcaggagatggatgcacgtgctttgccacctctcatggggctgctgcatagaaggccgtggcagggttattcactttttaccttcctatccaggtgcactgccaaaatgctctgctttttcagactgtggctgcttctcccccacccccaagagccaaataacttaggggcagcttttaatttttttttgtaaaaagtactgttgacttgggatttttaaggtaaaaattttggtacaggagctattctgtgtgccatgatggacagaactggaattgctattttgtgatttgggacagttgaggattccttcctagaacattattatgtagattgtttgtggcatggccttgatccccatcctcacatacatcaagaatgttgttccttgcacttgacggccacattcccatgtttgttatctattactgcattataacccctatcaaaactttgtggcttaaagtaataccagtttattagtttttactctggaggttggctgggcttagctacatggttctacagctgactgttcattcctggggtcactcatgcagctgtattgaggtgggaactcaacttggctgggaagagctggtaggcatagtgcacatgtgcggaaatggtattagctaaggcacttcggttctctttgtgttctcttattttccacaaggctacattggaccccttcatagcatggtggtctcagggttccagggtgaaggcatagaactggtacggtgtcacttctgtggattcttttggtcaggcaagtccagatttaatgagagggaaaatagacttcagctcttgatgggaggagtatgcaggatgggagacatgatggcagaggtgggacaggcaggcaaggttgctgagtccccttgctgcctcctcaggcccacttgggcctgcttttcccaaatggcagctcctctggacatgccattccttctcccacctgcctgattcttcatatgttgggtgtccctgtttttctggtgctatttcctgactgctgttcagctgccactgtcctgcaaagcctgcctttttaaatgcctcaccattccttcatttgtttcttaaatatgggaagtgaaagtgccacctgaggccgggcacagtggctcacgcctgtaatcccagcattttgggaggctggggcaggcagattgcttgagccaaggagtttgagaccagcctgaggaacatggtgaaaccccgtctgtaccaaaaaaaaaaaaagaaagaaagaaagggaaaaagccacttgtgccaccctcctgctgtaatcttccagcgctcttcctttgtctccagagcacctgctcatgatttttgtctcctgcccttgtccttagaaacttcagcgttcccaattatggcttctctcagatccagccttgaagttctttgacctcctcaattcacaacctgtagctgactttagccacccacaagtacagaaaagtaagcataatggaagaaatagtaatatgaaaagatgctcatatgacccagcaattccactcttagctatatctacccaagagaaatgaaaacatatgcccaataaaaacttgtacacagatgttcatagcaccattattcacaatggataagaagtgaaaagagcccaaatgtccatcaattggtgagtgaataaacaaaatgtgagccaggcgtggtggctcacgcctgtaatcccagcactttgggaggctgaggcgggtggatcacctgaggtccggagttcaagaccagcctggccaacatggtgaaaccctgtctctactaaaaatacaaaaaattagctgggtgtggtggcgggcgcctgtaatcccagctacatgggaggctgaagctggagaatcacttgaacctgggaggcagaggttgcagtgagccaagattgtgccattgcactccagcctgggcaacaagagccaaactccgtctcaaaacaaaacaaaacaaacaacaaaaaatggtgtatctctacaatgaaatattatttagccataaaaagcaatgaagtactgtcttatggtacataaaccttgaaaatatgctaaatgggccgggcgcggtggctcacgcctgtagtcccagcactttgggaggccaaggcgggcagatcacaaggtcaggagattgagaccatcctggctaacatggtgaaaccctgtctttactaaaaataaaaaaaattagccgagcttggtggcaggcgcctgtagtcccagctactcgggaggctgaggcaggagaatggcgtgaacctgggaggcggagattgcagtgagccgagatcacgccactgcactccagcctgggcgacagagcaagactccgtctcaaaaaaaaaaaaaaagaaagaaaatatgctaaatgaaagaaccatccatggaaggccacatattgtatgattccatttgtagttgagcctcattgttcatagagtctgcgtttgcgaatttgcctactcactaaagttttttgtagccccaaaatcaatactctcggcactcgtctatcacagatgtgtgcgtgtgcagagcagcaaaaaatttgaagtaccccatgcacgtgttccagctgaggttgtgtggttgaacagtgcgatgccctgccttcttgtttcagctctcaactgaagcaagtgggctgtctaatgccaaacttcttggattttgtgctttttgttggtgattttgctttggccccaaacgtggtgctgaagtgctgtctagtattcctgagcacagaaggtcatgatatgccttttggagaaaatacatgtgtgagataagctttatttgggcatgagttatagtgctgctgagtcaatattacctattaaataaggtgtctttaaacacacataaaacaaagttatatattaatcagctggcaaaaatgtgagcagaggcttgtttgaacctaaacctctgtttcccttaggagcaatgattcagtatcattaattcaatgttcatggcaagtttatagaacataagcactacagataaaattcagctgtatatgggatgctcagactagggtggatccattgagacaaagtagattagtgattgtcagggtctaggaggaggagaataggaagtgactactgagagtgggttttctttttgggggatgaaaatgttccaggctgggcgtggtgggtcacgcctgtaatcccagcactttgggaggccgaggtgggcggatcacaaggtcaagagatccagaccatcctggccaacgtggtgaaaccccgtccctactaaaaatacaaaaaaaattagctgggcacggtggcgtgcacctgtagtcccagctactcaggaagctgaggcaggagaatcacttgaacccgagaggcggaggttgcagtgagctgagatcacgctactgcactccagcctgggtgacagagtgagagcgagactccatctccaaaaaaaaaaaaaaaaattagccaggcgtggtgacaggcacctgtaatcccagctacttggggggcaaaaaaacaaaacaaaacaccccccccctttttttaaagcacattccatggaaggctacaacattgcatatctttttgggttgaaggtacattgacattttattctttgacaatgaagctccctggatttttatgaaaaggaggggaaatcacaaatattgtttacatccgctattgcagagaaactgtcattaagaacaaaagggccaggcacggtggctcatgtctgtaatcccagcactttgggaggccgaggcgggcagatcacgaggtcaggagatcgagaccatcctggctaacacggtgaaaccccgtctctactaaaaacaccaaaaattagccgggcgtggttgcgggcacctgtagtcccagctgctgccactgcactccagcctgggcaacagagcgaaactctgtcttaaaaaaaaaaaaaaaaaaagaaaaggaacaaaaggaaggaaatattataggctttattctctgatgagaatatagtgagagtaaaaggtaaaattggctaatttgttgtgtgggttttttgttttttgttttttgttggggggacagagtctcactttgtcacccaggctggagtgcagtggcataatcttggctcattgcaacctccgcctcctggattcaagcatttctcctccctcagcctcccgagtagctgggactacaggcgcatgccaccacacctggctagttttttgtattttagtagagacaaggtttcaccatattgcccaggctggtcttgaactcctgagctcagacagtctgcccacttcggcttcccaaagtgctagggttacaagtgtgagctgctgcgcccggcctgttgtatgtttttaagcccctacattttgcagaaaaaaaaagtacttctgaggagcatttgggtcatggaagagaccaagaacccagggctggatgttttataaaatataattttaatatgctgtcctatatatgaaaaatgttgatagagggccacagttgtaatttgtaaagcagacaatctgtcaggtgttcttactagcaaaataagttcagctcagctgaagtttattatagtttagctaaggagccagaaatgcacccaggggaacagcgaaagaatgaaatacttatcagaactactaagtaaatttaaaaatactcagacttgaggccgggcatggtggctcatgcctgtaatcccagcactttgggaggatgagatgggtggatcatgaggtcaggagatcaagaccatcctgggtaacatggtgaaaccccatctttactaaaattacaaagaattagcaaggcgtggtggcggatgcctgtagtcccagctactggggaagttgaggcaggagaatcccttgaacccaggaggtggaggtttcagtgagctgagattgtgccactgcactccagcctgggcgacagagtgagacgccatctcaattaaaaaaaaaattcagacttgatcaaattagtgaaactataaaaaataacgaaatagacaaatggcatcttttgagaaataggtctttaaatttttattttgccaggtgcagtggctcacgcctgtaatccagcactttgggaggcggaggcaggtggatcacgaggtcaggagatcgagaccatcctggctaacacggtgaaaccccgtctctactaaaaaattacagaaaattagccgggcatggtggcaggtgcctgtaatcccactacccgggaggctgaggcaggagaatggcatgagcctgggaggcggagcttgcagtgagccgagattgtgagctgtgattgtgccactaactcagcctgggcgacagagcgagactccatctcaaaaaatatatatatatattattttttttttgcgatagggtcttgctgtgtcactcaggctgagtatagtggcacaatcacagctcactacagcctcaatattgtgggctcaagcaatcatcccacctcagcctcccaaggagctgggactacaggcatgtgccaccacaaccggctaattttattttttattttttgtagaggccaggtcttgctatgttgcccaggccagtctcagactcctggcctcaagtgatccttcctccttggcctcccaaagtgctgggaatacaggtgtgagccaccaacctctgcattagttaccaaggtgatgatagtgagaagtagagagcctaagtattcatatcagagagtgaggtgaaaactcctgagcgtgcccctaacgaagtactcagcctgtccttagcccagtgaggtttctaaaatgctaatgcggtagtaattctcctgttacagggccatttctaatcatgggaaaggaaggggagccacctatttgtgctcttaggcgactgtggctcaatttccagccctgaagtcaagaacagccaggaaaagggagcagtctcacaccgagggtggtgtgcactgaaatacactgtggccagtcagccaagggtgggcttcgtttattaaataaataaataaatgtttattaaataaaaatatacctccagggcctgctgcctctagaggtacaggtggcttgtacagggaggtgataccacctacccctgaagaggcttagagactgaattagaggccaccctggcctgcagagagctttccaggccccttgcccctgcttgctgttcacagtccaccctccttgcccatccacccccaacaaacgtggaacctgtcagcattgcatgcgcaatgccctcctcgcctctgccccactgcttcacctctacccactgtggtcacaggagccctctctttcccattctcaccaggcacagtaaaaagcagaggttaggcaggtgggttttggacaccaggccaggagtactttgtgctgtggccctcacttaatgtgtgctgttgaatgattatgcctttgcatatgactcagccagcatcagcattttgttttatttatttacttttgagacagagtctcgctctgttgcccaagctagagtgcagtggcacgatctcggctcactgcaactgccgtctcccgggttcaagcgattctcctgcctcagcctcctgagtagctgggactctaggcatgggccaccatgcctggctaatttttgtatttttagtagagacggggtttcaccatgttgcccaggctggtcttgagctcctgacctcaggtgatctgcctggctagcatttgcattttaatccatttcttgtaatgctgaatgaacaatatgagcccttaataaaggaattgaccaggtgcagtggcttcatgcctgtcatcctagcacttttgggaggatgaggcggtaggatcactcaagcccaggagtttgagaccagcctgggcaacatagtgagaccccatctctacaaaaaactaggccaggagcagtggctaacacccgtaatcccaactactctcaaggccaaggtgggaggattgtttgagcccaggagataagactgcagtgagctgtgattgcaccactgtactctagcctaggttaaaaaaaaaaattagctggacgtgatggcatgtgcttgtagtctcagctactcaggaagctgaggcaggaggatcatttacacccaggagtttgagggtaccgtgcagtaaagtatgattgagccactgcactccagtctgagtgacagcaagactgtctaaaaaaaataagaaggaatttgtggcatcagcagttcggagaagaggggcactgttttacagtgggaaggaacattctgagggtgctggtcctgacagggtcagggggcaactgtggcaaagtatgtgaggaggtgtgggtagcagctgcttctgattccccactatccttccaccctggggcacgtctgggctacggcacctagggggagtactgtggcacccatcagagccatcagcgtgacatctgcctgtggtcttgacaatgtgatgcgatggcggttgtcagcttcccattggctggccccagtgaccctttctagagggttcagaaactcctaagggtcttccagagttgggtcattgcgcattgacaagtgcagcgccatcacatacccttctctctagtgcccactcagtcaccttaaccgaaacttccctgagccgagcatggtgctgggtgctgggctgatgcagggaagttctacccggtcctgccctgaagaaagtgaccctgtgtgcatgcatgagagtgagcagtcagttcaatactaggcctcctatctccagagtacacaagaggactggattagccgggcatggtggtgcacgactgtagtcctggctacttgggggactgaggctggaggattgcttgaggtcaacccaggaggttgaggctgcagtgagccaagatggtgccactgcactgcagcctaggtgacagagtgagaccctgtccctcctccccaaccccccgccaagaaaaaagggctgggagtgactgagggctaagacctccccaggtgttaggtcaggaaggcttcctggaggcggaagcacatcactgtgaacaattatccactgtagtgttagctatttgttgtccatcagtgtcttctaatcacagaggaaagatgagttttctggcagtcagaattttggataaataggaggcagctttggcttaaaagcacattagctgtaaatcagttgtaaagccagagttttgttcccggattagctgcctcttgcctgtgccatttctgagactgtgttaaccccccatgccttgtccttctcttggcagtaatccagtccctcatagcactggtgaatgacccccagcctgagcacccgcttcgggctgacctagctgaagaatactctaaggaccgtaaaaaattctgtaagaatgctgaagagtttacaaagaaatatggggaaaagcgacctgtggactaaaatctgccacgattggttccagcaagtgtgagcagagaccccgtgcagtgcattcagacaccccgcaaagcaggactctgtggaaattgacacgtgccaccgcctggcgttcgcttgtggcagttactaactttctacagttttcttaatcaaaagtggtctaggtaacctgtaaagaaaggattaaaaatttaagatgttctagttctgctctctttgttttaaaaatcactgcttcaatctacttcaaaagaatggtgtttcttttcttgtccaattttatccaaaatcttcaagttacatttaacccataaggtttaaaaaaaaggaaaaaaaacggttgtggttccctttcttccctacccttgccactcccactttctggcaccgagtttatttttcacttacttacttccccagaccccgggctcgcctccacaaaggagaagagactgccctggcggtcctggtggcttttcttagcatgtgtggcactgttgcccagtgtgggagttggtttaaattctcctgactccagtttataacatccttttaaaaaatttaaaaacaaacagccacacccctcctccagtccttctcctcagttcttgtgtgaaactccagctgatgttaccacagtaacatcagttaattgggcaagccctgatgtcagtgtgtgtaactgacctctggcctggcctgcacagagaagccctataatcacaggtctgtggtggccccgaaatggggggcctgctagtcaggaggatgctgtgcacactgtgtgtgatgaatctcgccagaaaggctcctgaggtcccaggttggcacttctccctgcagccattgtagaagatctgctggtccttgcaggcaaagctacagccagaatgtccgtttgaaactcctagctcatctgtcaccgagcttcatccgaatgtgccacggagcttgctctccacttcctccgtgcagtggccctgccacagccctccctcggcacactttgaccctttgtaggattggaattagcaggactcggctatttaaagcaccagtctggggtcgcctgggcccctgctgaccccctcctccagagcagccagcccagcccgggaacaagacggacttcctctcccttcggactcacagcctttgcagagtcaagctccacttgaagctcactcagtaatatcctttcaatgtgttttatattgttttgactgcctttttttgtagaaataaaaattgaccttagaatttatcgtcagataaacttgtaaagatttgaatattaatgtcttttcaaggcaaatgggattgtccccgcactagtagagaatccatgtcgctctgacaccccaaggaagccgacgatccaaatgccgtgtgtcaccaaccccgcttctgccactggcggcttcccttcttggctcttgggggggactagatcctgtggagaagatgacttaaactttgctttttgttttaattttaattctataacttgagatctttccggggcctacaggcgtgtaagacagcttggtctggtctgtgcagaagtggggagtgatgggcaggttcggcagcctaacattgttcaggcgcatggcccctgcggtgtgtacacgaactcggcttcttttgtcctaggtacgccaagggcaggtttctggagactcccttgtgcccgggatggcaagggcaccgggctggcgtttccacatctgtcttcattagcagaaaagtgatgatggattttatttcactcacactccagtttgtaataaaatgccaaattctgtcagctatccaaacaagccaccatttgttcttgttgcttctctggatccagaaatgttgccattcttggaaactgtcccattgcttcgtatttctgccaacgtagctctgcctgcctgtcaacccctcactgcactctgctcatcacgggaggatacctgtgtgccggcagcccctcagggactctcagccctggcactggcaccccagggttggccccgtcagcagaggcttggctttcgagccagtgggtgtctctcctttgggcctgggcggcttgctcctgccagccatgccttcagggtaggctctgagcaagctggcgaacagccctggctgctccaaaaccaaaaagctgggtcctctggaggaggggcgagctgtggagcagccacccactgctgccccaagctcactcaggaattcacacccgcctggtttcttgaagtgtgctgggtccttccctctgctccctactccccaccacggcagagaataggctttctaagatgctgcgatcccgttctgctgcccgtaataaaaatgctctcagacactggttagtcgtgtgggtttcttccttcctgggagcgggcagtgccaggggcctatgctcttggagatgggagggctggctggggcccaggtcctggggcttctgatctctctccccattcccagcctctccaaaagaggtacatagaagtgttcctgcctccctagagggaaggagatgaggtataatcagcaagaaagccggagacttcagacagtcggggcctgcagagggcgctcttgggcgtctcgttgaggggacagggactaaagtgtgggtgcatcacttacatgcgtgggtcatcctggagcctcctgggagtgttaacaatccatgtttagaagaggcaaacctgcggtcccaagaggtcacagaattgataagggtgtgcctgtgggtggagctgggccatgtccatgaatggtgccagccagaaacactctgagtccccagtacagcccactgccagggtgctgcggcagtggtgctaactcagcaagggctcagccagacccaggacttttttggctaggccttccctgcctggaatttgacaccagctgagactaggcctgcactgttcagctggatctgcaggtcttggggaaggaaacttcttggggtgtcattttactagcctttaacatacctagcactttaccctctgagtctcaggagagccctgtggcatccttatccctgcttttaaagacaaccaagacccctggcctgtttttgttcacattctgactgcagagcctgttgcattccaccatttggcatatttcttcccacagggtccctctgagcccagaaacagccagttaccaccctccccagagccagagacctttaagcccctctgtcaacttcctcttccctacagccaccagccaccatttttggccttgttcactattaattgttcagcatgaaataagcatccatttcatcactcctgtacccgctgcagcctgacttctgtcacctgctgccccttgctgcttctcctttcatttggtgccatctaacccagccctgaaagaagccagagctgctctcagcatttcccaccctgtcctgcctggctcttccttctctctctgcttcctggatatggcatgggggaaccgggcaccaacccagaacagaggggagctgagggtaccattgctcccagtgcagtgcagtgcctagcctggtccatgcctggtaagtggccatttcccagattattggaacgtgttcttgttcatagagggcccctagggaaccctggaggcctcagaggatcagagtagaaaggaccaccgtgcagaggcgataactgaggccttgggaaggaagtcacttccagagagcattccccacccggtgctggccaggttcagaaacccccctgtggctccacatgttgccgtgggtttctcctacatcttcctctgtgtgtcactggatgacactggatgactgtccctgtatgtaccagactgggagctccttgcagaccaggccatgtcagctccagccctggcctagcacagagtggaccctccagacacgaatgccgagtgggcggataacagtgaaccgcttggctaagacactgttgctgcccccacagcccctgtggcccaccagtcaccaccccaacaggtccttatcactttcacctcctcgtgagatgggcctcattataatcaggtgggcctgattatcctaccagtctatgccccctcacttcagtttttttttttttttttttttttgagtcaggctcactctgtcacccaggctagagtgcagtggcatgatcactgctccctgcagcctctacctcccaggctgagtcgatcctcctatctctgcctcctgagtagatggaactacaggcttgtgtcactacacccggctaatttttgtattttttatagagacagggttttggcatgttacacagtctggtctcaatctgctagcctcaagccttcctcccgactcag

SEQ ID NO: 12219 - DNA, 32594 bp, Human
gggcagtggtgtgatctcggctcactgcaacagggagcctcctgagcagctgggattacaggtgcccaccgcctcacccggctaactttttgtatttttagtggagccggggtttcaccatgttggccaggctggtctggaactcctgacctcaggtgatccgcccgctatggcctcccaaagtgctgggattacaggcgtaaaccaccgtgcctggccaaaggaattgagtcttaatcccttttgcatcttcagtctttaggataacgtctgacacacaacaggcattaaatatttgttggatgaatgaactgaactgcatagaatgcagaaagcctacatatactggccaggcacagtggctcacacctgtaatcccagcactttgggaggccgagacgggcggatcacctgaggtcaggagtttgagaccagcctggtcaacatagcaaaacccggtctctattaaaaatataaaaattagccgggcatggttgtgggcgcctgtaatcccagctactcgggaggctgaggcaggagaatcgtttgaatctggaaggaggaggttgaggtgagccgagatcgcaccactgcactccagcctcggcgacaagagggagactccgtctcaaaacaaccaaccaacaagcctacatatcctgccacacgtgctacaatccacagcaaactgtttcatccacattcaaccactttcttaaagtcaccatcatgatcctatcaagaaaaccgtaatttatatggtattttaatgtgcctttataaattactaatcactttcttcatgatgtatgttaaaatggcttatgtcacctgatgtaatccttaatgagggaaataaaaggccatgattatgcctggctttttttcttatatgttagatttgagtgttaaaatgacctcgaagcggcgaaagaaaggaacggaactgccctccacattaaaaatgagcaggctccataggttaattttactcttcctcacgcacggcacttacatgttgcaaactctctgctccacagcacgcacagacatcccaaatcccggattgggcctgaggaacatctctgcaaagagcgccaggagggcgtgggggtcccgcctctctcgccagggaccagggagtggacactcactggtccagtcatgaggaactcagcatcctcctgacgggaggcgcctctttcccagaagcggtgggtcaggaggaatctgactaaaccctgggttgccggcccggagggcgcggttgaccccggggcctcgaggttgtgggcgaggagtaatccgcccgccgagaccgacccgcagatccaggagaccgaaacccgagggcggcgctccagggtgctgaggagaccggaaaggcggccaggaccttccggtcgcctcggcccaccacccacccagtgtccgcgcagccctaaagcctggcagacgcggagcgcacgcggcctttgcctcggccaggacagggcagcggggagagggctgctagacaacaattcttgacccctcctcgacccacgaccgccaggtaggcgcgcaaagctcctacacctgcggcgcgcccccgtcccctggtccagcggacacgccacgcacgcagccccgcccagcgccgctcgcggtaggggcggagccgctgagctggccaaagcggatttgcccagctaggccaggggcggggcaggccctcccagccaggaccagccccagtctccccgcccctgagccgtgaaggaaatagggacctggccctgggccttgtgtagcgggagggggagctaggaagcagctgagggcagaatccaggagggcctggctgcgggggaatgaagcctccgccttcgcaggcaaaagcctttaaatacgggctcaggcccgggactcagagtgtaacgcgtggcagcctgagggaggggcgtgcgccgagagggagctcagatcgagcggggcgcgggtggagaagctgcggcagcgcggcccgtaggaaggtgctgtccgaacgatcgggataggagcggtccctgcgcttgctgctgggaagtgggtaagcgccgctcccaggctggccccgccgcccgggcgggatgctcccaggtctgggcgggatgtggagggagcggggctggggtgtgcgcgctgctcccggtcgctcgctgcgctgggtcccgggcttcccgtctcacgaccttcgtctttttggggcttagggcgggaaccgcattttggaactgctgtcctggggatgtggtcgtctgggcttcttattcaagactcgtgagtcttccagccccttctctttctgcctttacccactttcctgacttggatgagatttccctgccgcctccaaagccgaacgcccaccacaggaagcggttctctcgttggggacctcattttggccgcagagtcgtagtcttttgtttgtgtttaagagtctgctcacctgaggggctcctgcttttctcatgccgcccctcttaagaaaccaaagagaaacgaagccagaaagccctcttgagagcaaaatactaagactgccgtgatatctgtccgggatgtcctggaatccattgttggccccctacaccacagaattgctctgtttgatgtcggggaaggcctttcctgggtgcctcgggagaccatgtttgtgtgagatcttgaaaaattatacgtcctataaatatataggaagataacttagtagggttaggaattctagtatagagaaaagaggggttcgctggtagggatctattcatgggcatacagagcagtagctgtctatcgacagacctcaaagacacagtgagcctttgagtttcttcaaatcccttaagaaatggagaacagtagtctttcttcaggggggttctggaaatgaaagagctgactgtctgctctgagatgtgcttattagtggccaggatccagtttaaggtaaggggtagacaaccctgattgaaaagatctcatttcttctcccgttgctgtactcctttttctaacaaaatctataactggataagcataatccatcttccttcttgtttacttccacagctttacatgataacccttagacataaaattaataccggctttcttactgattaaatatttttctctggtcaggcatcttttactgtttaatttctggaaatgattaaaatgtgtgaagctgatgtatccaactataatgcccatcgttagctcctgggtacctatgcaaaatatgctgtagagagctggggctagaaggattatattccgtttagattgtagtagggcatttgttatttgttagtgaccccttctgggttggaatgtttatttgaatttatgaaattttacatgaagagtagttttggaacggtttggtttgttgtgactctcccaaaatacagaggtaaaaactcatttcaaaataacccatttaataaggaaacactcctatgtctctgacagcagaatagagggccagagggtacataaaagtagaaatagaaaatgggggccgggcgtggtggctcacgcctgtaatcccagcactttgggaggccgagacgggcggatcacgaggtcaggagatcgagaccatcctggctaacatggtgaaatcccgtctctactaaaaatacaaaaaaaaattagccgggcgtagtggcgggcgcctgtagtcccagctactcgggaggctgaggcaggagaatggcatgaacctgggaggcagagctttcagtgagccgagattgcgccactgcactccaacctgggcaactgagcgagactacgtctcaaaaaaaaaaaagaaaaagaaaagaaaatggggctgggcgcagtggctcacgcctgtaatcccagcactttgggaggccaaggtggatggatcacctgaggtcaggagttcgagaccagcctgaccaatatggtgaaaccccgtctctactaaatatataaaaactagctgggcgtggtggtgggcacctgtaatcccagctactcgggaggctgaggcaggagaattgcttgaacccaggagacggaggttgcagtgagccgacatggtgccactgcactccagcctcggtgacagtgagactccgtctcaaaaagaaaaaagaaatagaaaatggagttggcagacatctgtgtcatgcaaagtgtgtcactaacactatgtcaaactccatgttaaagcttattgaagattttattgaaacttccaagtgagcatttatttggacttgcacagattgtacatcagccttttcattgattctcccattgtcatcggtaagccgtatttcatgggaaatagcaaggcgagaatacccaaaataaagcttgtgtaaaacacatccagttctgtgatacaagttcacctgccatcagtagtctatcccagctgatgtatgtaaagcaagttgaaatgtggtctcacaatcaaggcagataagaagtaactctggggaaacatgctgaagttctttaggtaactcaaaaaaagaacttggccagatgcgatggctcacacctgtaatcccaacactttgggaggctgaggcaggtggatcaactgaggtcaggagcttgagaccagcctggcccacatggtgaaaacctgtctctagaaaaaatacaaacattagctggacatggtggcggacacctgtagtcccaggtacttggtacttgggaggctaggtgggagactcacttgaacctgggaggcggaggctgcggtgagcccagattgtgctgttgcactccagcctgggcaacagagtgagaccttgtgtcagaaaaaaaaaaaaaaagttgatagtattctggtcaattactgcaaaaatactatgatcggcaatctgaactaaagctatttacacagaagtcttcatctcaaaaagagacgcccttgtggagagttactcattcattcaattaataatcattgagaggctgctattctaggagtcaaggatacagcagggagcagcagcaaataactgttagcctggctgtgccttattaaactatgaactccttaagcccaggagctgcaacgagtagacactgattctacatttaataaatgtgttagcagaacctgtcctggttgagattaagagtaaaggctgccctaataaccttttggctaggagattaagtggtaaccttaaaagatcctctggtccaacattactttgagattctactctttaggtattctagatatactgggtttaattaagtgaaaaaagccaggtgttaatagtatatatggtattctattgaatttagaaagacaagattattagaatatatatgtatatttacttgtagctgggaggatatacaagaaaacggattgcttgtgtggaagcaaagtaggggatagcaaagtagataaggaaggggttggagtgagacttctcatgtgtaccttgttacaacagatttaattttgaaccatatgaacattattcagaatcaataatttttttttttttttttgagatggagtttcgtgcttgttgcccaggctggagtgcaacatggcacgatctcagctcactgcaacctccgcctcccgggttcaagcgattctcctgcctcagcctcccaagtagctgggattacagacatgtgccaccatgccccgctaattttgtatttttagtagagatggggttttgtcatgttgatcaggctggtcttgaactcctgacctcaggtgattcagcctcctcggcctcccgaagtgctgggattacaggcatgagccaccgtgcctggccagaataaataatttttaaaaatttatttcatatggctaagaatactatttgaatacagattcaaatagaatactgttctatttaattgaatcatataattcaaaattctgtccatttttactattttaccaaagttctatttcttttaattgttttttaaaagtcatgaggggcctggcacagtggctcgtgcctgtaatgctagcactttgtgaggctgaggcaggcagattgcatgagctcaggagttcgagaccagcctgggcaacatggcaaaaccctgtctctactaaaaatacaaaaattaacctggtgtggtggcatgcacctgtagtcccagctacttggcgggctgaggcacgagaatcaaacccaggaggcggaggttgtaataagtgcagctgagatggtgccactgcacttcagcctgtgtgacaaagtgagattctgtctcaaaaaaaataaataccgtggtggctcatgcctgtaatcccagcacttttggaggctgaggcgggtggatcacgaggtcaagaaatccagaccatcctgaccaacatggtgaaaccccatctctactaaaaatacaaaaattagctgggcatggtagtgtgtgcctgtagtcccagctactcgttaggctgaggcaggagaactgcttgaacccaggagacggaggttgcagtgagccgaggtcacattgtactctagcctggcgacagagcaagactctgtctcattaaaaaaaaaaaaaaaaagtcatgagggatcagactccatgagttgatatctataccactaaagatcaatgcataagccagattggtagtttattaacacaggctacaaacaatccaggatacctacatggattagtcagctcattttcttctagtagggaaatctatccagagaaccaaacgaaaatttagaatattgtttaatacagattcaaaccaaaaagaattggataatcttaattatatgatttgtcttttttcataatagggatattcttcttgccaggcattcaaattaggccagccttccagagtgcgttctctgatccatacaggagtatactaaaaaattcttaaactctctgattaccattttccttctctttggaatctgtgaatgggttagattagatgatgtctgaggtcttggcaaggcaaaaccattctttgcttttaagaatctgatcagtttgacagttctcattataacggataaatgagcatacttatgtataaatcagttccttgtcattttgattagtgtgaatcagttcacctaatgcttttgaaaatctatcaaaatctgtgtaacccacttttctgctggcattgggaaggaaaaaaatctgtgtaacagctttggtaattacagaaattacattttctttaaccaccttatggtttctgattaaagttgaaatggagtttaagattattgcctagtacctaaaagtaaactttgaaagccaaagtagtgtgtagggcatataatctcatcagaggccaattctggactgtggaactaatcttattctatatcatcgtaatctaaacctgttataaactcatctttgtacactagcatttatttaagcaagaatcgtacaagtatgttcatcctggagctttctctcagcaatcaaagttgtcctagtgtattatagacctaaggaaggttttactttgattctttactttctaaatattaggtcattataatctttgtggctccccttcagtaatatcagttactgtaattatttccatatgtttcatgctagtgcagctgagaacaggctaggtcatccaattggaatgttattttttaaatcactatttccataattcctcagagcgaatgtaggaaatctttccagatatctgtcaccttgacagtttttataaagtataattaatgtacaatattatttctttaaattttctgttttcaatactagaacagtcttactgttttccttctagtacaatcatgtttgaaattaagaagatctgttgcatcggtgcaggctatgttggaggacccacatgtagtgtcattgctcatatgtgtcctgaaatcagggtaacggttgttgatgtcaatgaatcaagaatcaatgcgtggaattctcctacacttcctatttatgaggtaaacatattaaacatctctttgtttttatgcttttttcttactgtctttattatatcatttatatgcactattaatataaaaatctataacagcaactggtaagaaattaaatgaaaaaaatctggatacaaaacacatggacattaaaacacattacttcgggtaatgtgggtaggaaaaatgaccagaaagaagtctatcagaatggtgtattagtgcagtgagattatggataattttttctctttcctgttttcttttcttttttttttttttttgagacggagtcttcctctgtcgcccaggctggagtgcaatgacgcgagctcagctcacggcaacacccacctcacgggttcaaacaattctgcctcagcctcttgagtagctgggattacaggcgcccaccaccacacccagctaatttttgtattttagtagaggtggggtttcaccatgttggccaggctggtcttgagctcctgaactcaggtgatctgcccgccccggcctcccaaagtgctgggattacaggcgtgagccactgcacctggccttcttccctgtttcctaattttgtctgttagtatcattaccatattataataaaattaaaaagtggtatcctgtaaaaataaaataaatacaacttttaataatattaatataaatttaatatatttttggattattttactaacatcacataaacattagatggacaaatggcatctttcatatttagagtttggtgccacaaatatttttaactggaatttcaaaattttgtgaatttagagaatttagaaaaatatgcttctaactattttactgagctatctggtttcctttttttttattatttcactgtaaaatgagttcatcatattatgcttttgaaactcaacagaaaagcatttgcaaatttgatggtagcattttctagctaacattaatatgtttatatttttccccaagaaaagcttggttattttttatttgttttttgagacggagtttcactcttgttgcccaagctggagtgcaatggcccgaacttagctcactgcaacacctgccttccgtgttcaagcgattctcttgcctcaatctcgttagtagctggaattataggtgcccaccaccactcccagctaatttttgtatttttagtagagacgaggtttcgccatgttggccagggtggtcttgaactcctgacctcaggggatcacccctcctcagcctcccaaagtgctgggattacaggtgtgagccaccatgcccggctgaagcttatttctttatgactattatcaaccatagactttagttgccttagacttttagaaggaaagtctcaatccagttttatctctaagataggtctgcctgctatctataggaatataagatatggaaatctatgaaaaagcatctatagactaatagtcactcaaaaacacagatttacttattatatctgaatcagatttaggattgaaatattggcggcacggtggctcacacctgtaatcctagcactttggaagaccaaggcaggcggattacctgaggtcgggagtttaagaccagcctggccaacatggtgaaagcccgtctctactaaaaatacaaaaaattagccgggtgcagtggtgcgcacctataatcccagctactcgggaggctgaggcaggagaatcgcttgtacccaggaggcagaggttgcagtgagccgagatcacgccattgtactccagcctgggctacagagcaagacttcgtctcaaaaaatatatatatatattactactatatttggtttagggtaatttttaaaaatgttttagaaagataacttgatggtgagttctataatgctgatattgataaaagggttgcaagtcatttgaaaccccataaaccatacttatatccaaacattcagtaatgaattctgccagcagtgtattctagtcttcacaaataagccaggcatggtggcatggccttgtagttctggctactcaggaggctgagacagaaggatcatttgagccaagggtttcaagtccagcctgggcaacatagtgagactcccatctccaaattaaaaaaaaaaaaatacggccaggcacagtggctcacacctgtaatccctgcactttgggaagccgaggtgagcagttcacttcaggtcatgagttcgaaaccagcctggccaacatggcaaaacctcgtctctactaaaaatacaaaaattagccaggtgtggtggctcacgcctgtaatcccagctactcaggaggctgaggcgagagaattgcttgaacctgggaggcagaggttgcagtgagctgagatcgcaccactatactccagcctggttgacagaatgaaactctgtctccaaataagtaaataaataaattagaataatgacacccatcagaatggttaaaatgatattactgacaataccaagtgtttagcaattagaattttatgcactgcttggtaagaatatcaattggtacagtcacttggcagacgtgtttgatagtatctactaaagctgaaaatataggccaggcacagtggctcatgcttgtaatcccaacagtttgggaggccgggcgagaggattgcttgagcccaggagttcaagcccagcctgggcaacattgcaagacccctgttccttttcttttttttttttttttttaaaggccaaccgcggtggctcacacctgtaatcccagcacttttggaggccgactccatcctggtcaatatagtgaaactttgtctctaaaaaatatttaaaaattaactgggcattgtggcatgtgcttgtggtcccagctacttgaggagttgaggcaagagaatcacttgagcccaggaggctgaggctgcagtgagccctgttggcgccactgcactccagcctgggcaacaaagtgagaccctgtctcttgaaaaaataaaaaaaaactattagtctgtgatccagcaattccaagtgtatatccaacagagatgcatacatatgtgcactaaaagacagaaggaacaacctaaatattaatcagcaatagaatggatgcatgaggctgggtgcggtggttcacgcctgtaatcccagcactttgggaggctgaggtgggcggatcacctgaggtcaggggttctaaaccagccttgacaacgtggtgaaatcccatctctactaaaataatacaaaaattagccaggtgtagtagcacatgcctatagccccagctactcgggaggctgaggcaggagaatcacttgaacctgggtgggggaggttgcagtgagccgagtttgcaccactgcactccagcgttggtaacagagtgagactccgtcttaaaaaacaaacaaacaaacaaaaagaatggctacatgaattattttataatactgcaacaaaatactgtactgtgttgaaaatcaatgaaactactcctgcacttaagaatatggttaaaatcttacaaaagtagtgttgccagacacaaaggagtacataccgtataattccatttgcgtaagtttcaaaaataggcaaactaatctatgattatagaattcagcatgatggtaatttgggaatagtagtgactaggagagggcatacagtgggctttgacttactgttaatgttctttcttctctcattacatgaattactgagaaaatagtagattctattaatatttaacagttaaaacacttccttttgtgttgtcgtgtttattgaatagacattgctttttaaactttgttctttaaaaaatacagtttaggccgggtgtggtggctcacacctgtaatcccagcactttgggaggccaaggtgggtggatcacctgaggtcagaagttcgagaccatcctggccaacatggtgaaaccccgtctgtatttaaaaaaatacaaaaaaaaattagatgggtgtagtggctcgcgcctgtaatcccagctacttgggaggctgaggcaggagaatcgcttgaacccaggaggtggaggttgcagtgagccgagatcgcgccactgcactccagcctagcaacagagtgagactctgtctcaaaaaaaaaaaaaaaaatttagtagtaactactttaaaaaaaaatggataatttgctttgctttttttctgggtaaaatttttattttactgaggataattttaccctgtgaaaggatttgagttcttctaataaaagtaccatataaattctaaataccaattatgataattacataatgaacctaataacagatagaacctatattattaactgcttctgcatcagttttggctttaatataattatgtaagtcttcattttgaggttttattatatgtatatgaattctgcattgctctgattttagtaactttaaatattaggagattatacacaggactgaattaaattttattctctgcaaatcctgactctataaaacttttccctcattttctagaatctagccaaaataaccaaggaaacccattactgtgattggtgacatcatattcatggttgtagtggttcatatatcttgcttgtcctgttattttaatcaaactaatggaaattcatatgtacatttttcacatcctccaattacttatgttaagagacctcggaaccattgaagaaaagggagttgcctctatatgtaatgccagacctatggcccctgaagggctttcactttgctatagacatagttttctaaacatccataatattatggatggatattgtttgaagtttctcccctaagagtgagcttcagtggtttaggtatgttttctttttgctttttgttgtggaagatttcaagcatgtaattaaagataacagtacaatgaatctccgtgtgcccatcatcttgtttcaacagttatctacgtggccagtcctccttcccaactaccaccatgctgattatttataatttcatccataaatactttatcatgtatctctaaaagataattttgtttttctttgagacagggccttgctctgtggcccaggctggagtgcagtggcccgatcttggctcactgcaacctccgcctcctgggctcaggtgatcctcccacctcagcctcctgaatagttgggactacaggcaagcgccaccatgcccagctattttttaaaatttttttagtagaaatggggtttcgccatgttgcccaggctggtagcccacaatagttgtgcttcaaccagtatctattggttgaagaaaccagtttgtttattggctagaaattatcacagtctaggccaggcacagtggctcatgcctgtaatcccagcactttcggaggctgaggcgggtggatcgcttaaggccaggagttcgagaccagcctggccaacatggaaaaaccccgtctctaccaaaaatacaaaaattagccaggtatggtggtgtgcgcctgtaatcccagctgcttgggagtttgcggcacgagaatcacttgaacctggtaggtggatgttgcagtgagacgagatggtgccactgcactccagccagggtgacagagcaagactgtctcaaaaaaaagaaatttttcagtctagattttgctggttcagttccttggagtttttcaacttattctttatttaatgtaaattggtagttagatctaaaggtacaggtccaatcagatttaggcttgattttttttttataagaatatttgttaagtggttttatacccctccatattcttaacataaatatatctcctgttaaactgggattttttttttaaataaaagggttccttgcaataggacttagaaaaatttatatttatttaagcatatagaaaaatttatatttatttaagcatatatggagtaaattgactttcacagccagttctatggcctgaattattgggagtaaaaatgtgcattcataatgacaatgcaaaatcatatatttgcttgaaatcacagaagaccttgaattttctgaaaattgtgttgatactcatagttaatggttaactcttatgagttagtcacatggtaaacaatgacaaagcattaaatgagctgctcttctgattgtagcaagtttaatggcaatttccattttactttatttacttaagtgtacttatgaggcagggcgtggtaacttactcctataatcccagcactttaggaggaggagcagggaggattgcctgagcctgggaggtcaaggttgtagtgagctgttacgcaactgcactccagcctggggaacagagcgaaaccctgtatgaaaaaataaaataggccaggtgtggtggcttgtgcgtgtaatcccagaactttgggaggccaaggcaggtggattacctgaggtcaggagttcaagaccatcctagccaacatggtgaaaccccatctctactaaaaatacaaaattagcccagtgtggtggtgcatgcctgtaatcccagctacttgggaggctgaggcaggagaactgcttgaacccaggagacggaagtcgcagtgagccgagatcataccactgcactccagcctgggtgacagaaagaggctctgtctcaaaaaaaaataaaataaaataaaataaatgggctgggcatggtggctcactcctataatcccagcactttgggaagctgagatgggaggattgtttgagcccaggaatgtgagaccagcctggacaacccagtgaaaccccaaaaccccatctctgccgaaaaaagatacaaaaattagccaggcctcatggctcctgtggtcctagctacttgggaggctgagatgggaggatcatttgagcccaggaggcggaggctgcagtgagctgagattgcaccactgcactccagcctgggtgacagagtgagaccctgtccctatttaaaaaatgagatgtgcacttatggcctttggtatatgatccttaacttgtctacaaaggtaatttgagcacaacctagacctttaaattacaatattaccatgccctttaacaaatgtaattctatactattaggttatctcatatcactggcaagctatatgtacaattccttttcttttttctttttagccaggactaaaagaagtggtagaatcctgtcgaggaaaaaatctttttttttctaccaatattgatgatgccatcaaagaagctgatcttgtatttatttctgtaagtattttcctttgttgtgtgaattttaatgtattcttgtctatataaaagtttcatcatactttaatagtaaatccattggtattaagcctcaacattgcttagtatagagttgtccggtgaattttggttgtcactttgtctgacagttcacaaaaccccgtaatcatctagtcaaatatgtcattacaagtcattgaacaagtaaactcaaagttctaatttgagatttagaactaggaaatgggcgggtgcggtggctcacgcctgtaatcccagcattgtgggaggccaaggtgggcagatcacaaggtcaagagattgagaccatcctggccaacatggtgaaaccccgtctctactaagaatacaaaaattagctgggcgtggtggtgtgcacccgcagtcccagctactcaagaggctgaggcaggagaatcgcttgaaccaaggaggcagaggttgcagtgagccgagatcgcgccactgcactccagcctggtgatagagtgagactctgtctcaaaaaaaaaaaaaaaaaaaaaaagaactaggaaatgctggtaacatgagagcacatgtgatgatagtatatttcatatttatttcattatttcttgtttccagtggttggcagaggtgagatgaagaaaatcagtttgcaaacttacaggcatctcctctctaaatgaattttacattaattgtttgtaacttggcatatgttggttagattatcaggctaaccaacagacacctttacctcataatgtggctgaactgtcctacctttataatgaaaaaaacagaaccaacacttgagattaaactctagtaaaccactatttgaaccaaagcaacttacatcttgctgtcctagtaaccatctactcaaatattctgtatgtaatgatatagctatcaccagttggaagctgagtgagggtgttatatgacttaagatctttacgagctgggcatgatggctcatgcttgtaatcccagcactttgggaggccaaggcaggcggatcgcttgagcataggaatttgagaccagcgtgggcaacatggtgaaaccctgtctctacttagctggccgtggtgctgtatgtctgtagtcctgactacttgggagactgaggtgggaggattgattgaaccctggaggttgaggctgcaatgagccattattgtaccttgcactccagcctaggtgacagaaggagaccctgtctcaaaaaaaaaaaaaaaaaaaaattcagtctcttctttttgacctccttaatcacttcagagaaattgatgcagcttttatgacttacctacccatcccctatttaaacttgcagaaagttagagtggaggcataaaaaaataagaaaatattttggagtagctaggtacctggaaaaaatcaatgagttacttagtctaatttttaggtgaccagagcctagaatggtaatagaataattttctgcagaaaggacatttaaaaataatctgtttttgaatgccagacaggaattattttgtagcaatcagttttcaactgttgttttcaaagctcctttaccaggggaagctgtctgatcatctcccatctctagccagtttcaccctacatcatgagctgtctttgcctttccgtacaccattacatgtaactcttgccctaagttgttccatgcatgtaaacaactttttcctcctgcttttcacacctcaactcaatcttcaagttttgatttattttcacttgattcctttatttagtctcccattgggttataatctcatcaagagaagagagttagtactacttactattagttcaaaaataattcctattccctttaagttttagacttttcagagcactttcatttttgtcagagcattataacattcatgtgttagtttttagagagctcactatcctcattttccaatgaggtcactgaggcagaggcagccacacttctccaaggttacatgtaatccaaaactaaatgcctagactctgggcccatgatttttttttttttttttctaaatgaaagtcttcgcccattggccaggtgcagtggctcatgcctgtaatcctagtactttgggaggctgaggcaggcagatcacttgaggtcaggagtttgagaccaccctggccaacatggtgaaaccccgtctaaaaatacaaaaattaggcgggtgtggtggcgcacttgtaatcccagctactcaggaggctgaggcaggagaatcgcttgaacccaggaagcagagattgcagtgatccgagatcgcgccactgcactccagcctgggtgacagagcaaggctccatcttaaaaaaaaaaaaaaaaagcaagtctttgtccacatagtattctatatcctgaagatgataggtaatgtctagctttaatgaactcagaaagcatttgtaaatgatattgcaatattttaaaagactgttgatataggactgtaaaaataggggaataagaaaggaggccaggtgcggtggctcacgcctgtaatcccagcactttgggatgctgaggtggacagatcacctgaggtcaggagttcgagaccagcctggacaacatgatgaaaccctgtctctactaaaaatataaaaaaagtggtggggtgtggtggcgcatgcctgtagtcccagttacttgggaggctgaggcaggagaatcgcttgaacctgggaggcagaggttgcagtgagccgagattacactactgcactctagcctgggcaaagaacaagactccatctcaaaaaaaaaaaaaagactttaaaacttatttttaaggactataataatatattatgtacaataaagaaagggaataagaaaaggcttacatttcatttcagattgtgaagtcctttaggataaccgtctcattcatttatgtatcttcagggcttagctggaatctgcctgccctagttatccggcatatagatagtagcttcctaacaaaaatttattgaatgagttctctagatgcttcaagctatttcttctgattattatatttataaaatgtattatttctatggaactaacagaggattaaatcagggctactgatgattgttaactccacactttaaccagtagttcagggtatatcttgaaatccctatctcacaggcactctgttctttatcccatatacttacatcaggtgaatactccaacaaaaacctatggaatggggaaaggccgggcagcagatctgaagtatattgaagcttgtgctagacgcattgtgcaaaactcaaatgggtacaaaattgtgactgagaaaagcacagttccagtgcgggcagcagaaagtatccgtcgcatatttgatgcaaacacaaaacccaacttgaatttacaggtataaaaaatgaagcattagaatctggttattcttatgtaaatactgatgtgttaaagttgcccataattaattctagcttaaaactttcctttgcattgggattctaggtgctgtccaaccctgagtttctggcagagggaacagccatcaaggacctaaagaacccagacagagtactgattggaggggatgaaactccagagggccagagagctgtgcaggccctgtgtgctgtatatgagcactgggttcccagagaaaagatcctcaccactaatacttggtcttcagagctttccaaactggttagtatatagcattcaactcttcattaaattaaagccaaatatttatttatttcaagcctgataaactacacagatacttttttaatagtagtaagaggttatgcttttgaagatcatattcttgcacattcaaattatgaaataattttcacaagggagatcatatatgagggtataaaagattctgaaaaattctgaaatcttaaaatagtaatttggtttttatcactctttccctctttaccctttttcttaatcatctgtcctctctaatttaaaacattttccctttctaacccatccattgtctcctcaaattgagctcatcagtatcttatatatctccctcagtaatttgcgtcaacgcaatgaaatataaactagatgtataaaattgctgttttagcttatcttactcttctctatgttttttttttttaaggcagcaaatgcttttcttgcccagagaataagcagcattaactccataagtgctctgtgtgaagcaacaggagctgatgtagaagaggtagcaacagcgattggaatggaccagagaattggaaacaagtttctaaaagccagtgttggtaaattcaaatttttctctagtagaaagagctagtgtttatttactgaaggcatattatttgctggtaccagcgctttatatatctcattgaatccttataacctgttaggtagatgctgttattttcttttttagagatgattcagactcagggaaatttgtgcaacttgctcaaagtcatgcagctgagtgactagatgtttctaacgccaaagccatattattccttactgcatactgcattgcactagagcaagggtgggcaaactatggcctttgggtcaaatccagcccacaacttgtttttgtaaataaattttattggaacacagccatgaccattagactacatattgtctatggctgcttttgagctacagtggcagtttaatagtctcctcagaaactgaatggtccacaaaggctgaaatacttactgtctggccctttaccatgaaagtttgctgacccaggccaggcacagtagctcatgcctataatcccagcactttgggagtctgaggccaaggcgggcaaattgcttgagcccaggagtttgagaccagcctgggcagcatggtgaagccccagctctgcaaaaaaaaaagacaaaaaattagtcaggcatgatggtgcacacctgtagctccagctacctgggaggctaaggtaggaggatcacctgagcccaggaggtcaaggctgcagtgagccatgttcatacccctacacttcagcctgggcgacagagggagactctgtctcaaaaagagaaaaagtttgctgaccctgtgctaaagaatgtggggcagtcatactagatgaatgagaaaaaaaaggagataaaaggaaacaatataaaaagttaaacgtagccataatgaaattttagttagaaaattatttggaagttacttgtggagttgtttagttgcctgcaaattttacataatttataagcccattatttatccatctgaattttattattaaaaaatcttagtataagctttctgatttagtataaagaaatttgtcacatgattgagttttctcgttcttacatgaaaatattgttcatttttttctttctgcagggtttggtgggagctgtttccaaaaggatgttctgaatttggtttatctctgtgaggctctgaatttgccagaagtagctcgttattggcagcaggtattaatctctataggtaataatttctgtttagccaggcatagtggttcacacctgtaatcgcagcactttaggaagccaaggcaagagcatcacttgaggccaggaatttgggactggcctgggcaacatagtgagaccccatctctacaaaaattttaaaaattagccaggcatggtgttgcacacctgtagtcctagctacttgggaggctgaggtgggaggatcacttgagcctaggagttggaggctccagtgactgacttatgatcgctccactgcactgtagcctggacaacagagtgagaccctgtctctgacataataatagtaacagcaataataatagcagtttctgtttagcttctcattaagcatgtcactttttgtccatgaaatgtttttgatggaatttatttattccaggaagtcaaaaattagtatattcaatttgcttattttatgtttatttattgggtatctgtgtttttaatttatctttcctgctaatcaatgttgatggaagtttgtgataagccagtattctaatttgctcccagagtaaaacaaaaacaattatccttaattataactcttctctcttttttttttttttttttttgagacaagatctcactttgtcacccaggctagaatgcagtggtgccatcgctgctcactgcagtgacctcctgtgctcaagcaatcctcccacttcaacctcaacttcaggaacgcaccaccacattggctaatttttttatttaaaaaattttttttgtagagacaaggtctcactatattgcccaggctggtctgaaactcctgggctcagcagtcctcccatctttgcctcccaaagtgctgggaatataagtgttagccagtgaacctagcctaattcttctctatcttgaaaggcataaaatcaaaataaaataagaacctatattataacgttggtcgggcatggtggttcacacctgtaatccctgtacttcgggagcctgaggtggacagatcacttgagggttgggagttcgagactggcctggcgaggctgaggcatgagaattgcttgaacccaggaggcggaggttgtagtgagccaggattgtgtcactgcactccagcctagatgacagagcgagacttcgtctccaaaaaacagaacctatattgtcatgctttcaagtggttttgtatctgctgatatttgttttggacctttcagactcacagagctaaaattagaaaccccttccaaattggaagcattaagtgagctctgggaagtagagttgatgtttattgaatgcttaccctgtactgggtactcttttgggcactttgcatacagtatctcatttaatcctcatcactaacattatcctctttatttgatgagggaactgacatggagatattaagtaatttgccccaattactagtcggtatatgtgcctttcccaaatattttccccgagtttataatttttcaggtttcagcagtagatatgggagggaatctaaagaaatgcacgtttctttttttaaaatgttttactttttagagacagggtctcactgtgttgtccagcctagattccaactcttgggctcaagtgatccttccacctgagcctcctgagtagctgggactacaggtgcaccaccctgcctagccggaaatgcacattttaaagtgaaaacagatacaattagtgtcattccagtcaatccatcatgatggctttatctcactgttcattgtgtgaaaaatgcagataaactcttgattttccaacactttgggctaattgcttaagctctcagggtttgattgagatggtccctgaaagcttaaagccttaaaaaagtttcttttgctttgcccacctggttaccaacctaaatttaacagattaagtgatcagagactcttataacatttagttagttaaaaaaccttgtcaaatagttgtggtgttatggttcatccagaggcagctagaactctgcacattgtttgttgcctgtccactttccactgaaactgaatttttgtgaatagtggggcacaagcaaatgaaggaatactttggggtttcattgcttgtagcttgtttccacagaatttggagacacggactaaggatagtatggtttcctatgtgccttatttaggttggtctcatagctgaacctcaaatgcgcttagaattaaaacttggttgtgcgctccacttttggcatccatcctagccttatgcatagaaaatcaagccaaatgaaattagaaatttttagaatggctttttttttttttttaaatttacggcagggtctggctctgtcgcccaggctggagtgcagtggcatgatctcggctcactgccacctctgcctcctgtgctcaagccatcccacctcagcctcccaagtagctgggactacaggcacatgccaccttgcctggctaatttttgtattttttgtagagacagggtctcgccgtggtgcccaggctggtcttgaactcctgagctcaagcaatcgcccacctcggcctcccaaagtgctgggattacaggtatgagctaccactgctggcctaggatggctttaaggaaggggatgagtgatttttttttttttttaatccataggcactagagtttggttaatttttgcctcttgttaatatgtaagcattgtatttgtacaatagcactcaccataaaattctgagtaatgtgtgtcataggctgtgcctcttttaactaatcattgcacaattgtacatgtaatttcaggtcatagacatgaatgactaccagaggaggaggtttgcttcccggatcatagatagtctgtttaatacagtaactgataagaagatagctattttgggatttgcattcaaaaaggacactggtgatacaaggtatcagtttttaaaaatatttcaacccttttgagattgtgttaactcctcatcttaattttttgattggggtaggtgtacataaaatacatgtatatatataaaatataaagaataaaaataaatatccatatcttcaccactctaccagcttcagaaatataattttacctgtatcttaaactccctggtattagaatataatgccacataaagcttaccaatactgattttttttttcctatagagaatcttctagtatatatattagcaaatatttgatggatgaaggtgcacatctacatatatatgatccaaaagtacctagggaacaaatagttgtggatctttctcatccaggtgtttcagaggatgaccaaggtaaggctttgagtctcatgaatcattttgagtccagacctgaaaactttttatcttttggaaaccttaggttgttcagttttatcatgtatatcattggtaggccctcttttcaacctcatttctctgaaattaaagtcttaggcataatgtcatcaacattgatttgaagtgatcagctgtggattggtccattgatttttccaacatactccacaaatccccaaaattccaaagagatgcttccaaagcagggtttggggcctcccaccatcactcccattgatactgcaatcagattattcccaactcttcctgcagtcctagtgttagaatacctatagtactatccccttatgtgtggttttgctttccacgggttcagttatctgcggtcacttgcagtctgaaagtactagaaggaaaattccagaaataaacaattcataagttttaaattgtgtgctgcttcatcctgcctgggacatttatcattcctttgtccagcatatccacattccatatgctacttagtcacttagtaacttttggcaatcagattcaaaaaacaggtatgtgtgtaagtatatatagggttcagtactctccacagtttcagacatctactgggggtcttggaatgtatccctgcagataaggggggaactactgtaatgtcatataactcctttcttatttctgtttttttgttgttgctattgttacagtgtcccggctcgtgaccatttccaaggatccatatgaagcatgtgatggtgcccatgctgttgttatttgcactgagtgggacatgtttaaggtaaggtaacagaaaagatactaaggaaaattctagaggtgttccactatcagctggggttgagtatgtgttcatgtatgtgtttttttgtttttttgtttttttttttgagatggagtctcgctctgtcgccctggctggagtgcagtggcgcaatctcggctcactgcaagctctgcctcctgggttcacgccattctcctgcctcagcttcctgagtagctgggactacaagctcctgccaccacgcccaactaattttttgtatttttagtagagacggggtttcaccatgttggccaggatggtctcgatctcctgacctcgtgatccacccatcttggcctcccaaagtgctgggattacaggcatgagccactccgcccggcccacgtatgtgttttaattgttcctgtggtttgtctttacaggaattggattatgaacgcattcataaaaaaatgctaaagccagcctttatcttcgatggacggcgtgtcctggatgggctccacaatgaactacaaaccattggcttccaggtaatcatgatcctggattgttttttttctttttgtttggtctttagtgtttgattcaacaactggggactataatctagtcaagttgacatcaaaagaccatcacagcaggtcagaatatgtttggctaattaagatgataccttctttctagggaagttcttttggggaaccaaatcaatatcagaagtttatttcaacaattaggaaagtgctcatttgctttttaaacccattgtgtgggttttagaattttcttattttctttagcagtaacgtaactctggggcaacatgtcagttctttaggaagtccctatgggatttttctgactactctacttctctacttcctccctaaatttgcgatctaaaggtagagaaagaaagaggtcttggtcaatcagcaggtgttcatcctataccttctgagtactcagcactgtgccagtgctgtgaggggtctgaatgaaacatatgggagtttcaatggtactggccctcttctgattcaaagtttgtcaactggccaggcatagtggttcacacctgtaatcccagcactttgggaggctgtggaggtagaccacttaaggccaggagttcgagaccagcctagccaacatggtgaaaccccgtgtctattaacaaatacaaaaattgctgggcgcggtggctcacgcctataatcccagcactttgggaggctgaggcgggcggatcacaaggtcaggagttcgagaccagcctggacaatactgtaaaaccccatctctactaaaaatacaaaaattagctgggtgtggtggcacacacctgtaatcccagctactttggaggctgaggcaggagaatcgcttaaacctgggaggcggaggttgcagtgagccaagatcacaccactgcactccagcctgggtgacagagcaagactccgttttgggaaaaaaaaataataaaaattagtcaggcttggtggcctgtgcctgtaatcccagccacatgggaggctgacgtgggaggattgcttgagcccagcaggcagaggttgtaatgagctgagatcatgccattgcatgccagcctgggtgacagagcaagaccctgcctcaaaaaacaaaaaacagtttgtcaattatggaacatttggaaagctgacagaagcctccacccagaacagtgtttttgtatgttacatctatttcagttctccaaggagtcccaaaggtattaataaggagctattttccatttcctcagagcagtatgtatatggggataggaggatggggaggtggagtaagttagggagaataaaaaaatatgccagggggttgttgtcaatgtagtgcccaagcaagcagaaaagcagcagtgtttgacagcttgctatgcacatctcagcaccagctatcttggagaggtatcagtaaggcctaatctgctattcaaaaatatctgatctggttctcttaacctctcaccaacttgttgaaggtccttatttagaattcagtgcccatttctcattcatgagagatttacttgtggaaagaatcaaatggcatccttgtctgtgaactcttccatccaagaccttggggactcttctattccacccctccctagtgagtaacaacatgactgtttttcccagtcatgactaaactcaggaatgttatttttaaaaggttatttgcaaggcatagacacattttctctcattcctgttttactcatctaagggaaaagatatgtagagaaatacatattttaaatgattttaagttattgtaaaagttaactttcctagtgagaaattaaaaaaaaacaggaatggaatcactaaataaggagaatttgtaagtcactgagacaactggttaatataaagcagaagccctttctttgtggtacgagtcagaattaaatattagtttttaattcaaaagacatgaaaagtgagtagtatgtttatctctgctgtggaggggagataaattcatgactgttgaagtagtagtgtttttaatgataagatgatgattttgaatatatggaataaatgaaaaatgtaataggcaaaaccaaaattgattatcatttagtgaaggctggcttgctgtatgctaagcactttacctaatttaatacttaccacgaccctttgagttaagtggtggtaacacaatttacaagtgaggaagaaagacctagagagtttaggtaatgcagcaagtgccagtcaggattccagctggggcctttcagactctgaagtctgaattcttaagaattatgctggccgggtgcggtggctcacgcctgtaatcccagcactttgggaggccgaggcgggcggatcatgaggtcaggagatcgagaccatcctggctaacacggtgaaaccccatctctactaaaaatacaaaaaaattgccgggcgtggtggcaggcacctgtggtcccagctgctcgggaggctgaggcaggagaatggtgtgaaccgggaggcagagcttgcagtgagccgagatcacgccactgcactccagcctgggcaacagagcgagactccatctcaaaaaaaaaaaaaaatttatgctgttggcagggcacagtggctcacgcctgtaataccagcactttgggaggccaaggcggatggatcacgaagtcaggagttcgagaccagcttggccaacatagtgaaaccccgtctctactaaaaatacaaaaacattagcctggtgtggtggcgggcgcttgtaatcctagctacttgggaggctgaggcgaggagaatcgcttgaacctgcgaggcagaggttgcagtgagccaagatcgtgccactgcactgcagcccaggcaacagggcaagactccatctcaaaaaaaaaaaaagaattatgctgttaccattcgggcacagtggctcacgccggtaatcccagcactctgggaggccgaggcaggcagatcacttgaggtcaggagttcgagaccagcctggccagcatgtaaaacctcatctctactaaaaatacaaaaattagccaggtgtggtggtgcacgtctgtaatcccagctactcagaaggcagacaggagaattgcttgaacctaggagacggaggttgcagtgagccaagatcaggccactgcactccagcctaggcgatagagcaagactccatctcaagaaaaaaaaaaaaaaaaaagagaattatgctgttagcttttgcaggttttttagtacaagggaaattgaaatgagaatggagtttgaaataaaatatgaactcactggaaactggtaggttaatttcatacatgtttctaaagacagtggtggcacataattgactactttgagggagtcaggtgtggggaatggcaggagtgagaaagtctagatatgaatattacgatggagtatagattaattctaggaacaaaaaatagggaagaaaccaaagatctctcatagcaactcagacaacttgagaatccttttctaagaaaaaaatctagattccccctgctcccatttcagtacattataaattcttacacttatataattgttaatagttctcttaaattttatttttttttcagattgaaacaattggcaaaaaggtgtcttcaaagagaattccatatgctccttctggtgaaattccgaagtttagtcttcaagatccacctaacaagaaacctaaagtgtagagattgccatttttatttgtgattttttttttttttttttggtacttcaggatagcaaatatctatctgctattaaatggtaaatgaaccaagtgtttttttttgttttttttttgagacagagtctcactgttgcccaggctggagtgcagtggtgcaatctcggctcactgcaagctctgcttcccaggttcacgccattctcctggctcagcctcccaagtagctgggactacaggcacccgccacagtgcctggctaattttttgtatttttagtagagacagggtttcaccatgtgagccaggatggtctcaatctcctgaccttgtgaaccacccgtctcggcctcccaaagtgctgggattacaggtgtgagccaccacgcctggcccatgaaccaagtgtttttaaggaaacaaaactatttttttaatcatcagatttatactagctatatggatattagcatatctggtaattatgaatctagaatttttttacatatttttataatactgttagctcagttattggatgagtgaaagataatcatgttggttttaatagtgtcaatttttgtaaaataaaaattaaacttcaaactctttactttataaattgtccataggccacactttaatatcacattataaagggaaggacagtcttcattcctcctggttattggtttgtttgtcattaaagatatattttgaatccatgaaattgctatgctaaacagcctttacatgtatggtctggttaaagttcctttgttccttttgttttaataaaatgtgtcactgattttttagctcaaaatcatcactgttaatttccagtcaccccaaatatggttaaaagattttttttttaatcatgaagagaaaattagtagcatttctttctctccccattatttattggttttcctcactaatcttttttttttagtccaaaagccaaaaatatttatcttggttttacattttaatttccattcttaattgtaatttttttctttaaataaggaaaccaatataatctcatgtataaaaacttaaatattttacaagttacatatagcatcattctaaaataagaattttttttgttttctgtctgcttttttcttatgtctcttgttgagttttatattttcagtggttatttttgcttgtgttagatcattattaaaatatatccaatgtccctttgatacttgtgctctgctgagaatgtacagtttgcattaaacatcccaggtctcatccttcaggaattttgcagttcaatgagaagagggagacaaatataaagatgaggacagaagcatctctacagatgaaaattacataaataaaacattctccatcaacaactatatgggtgtaatttttgtcaattcacaagtaactgagtcatgacagcctgacattagatgggaaaaaaatgacacctcactttttagagaaaatggtatatcattctctcaaatgatgcaacaaagggagggaatttagcaaataaacattggcaaactgtagcccctgggtcaaatctggccagccatgagtgagctaagaatggttgttacatttttacatggtcatatgttaaatggtttgaccaggcatggtggctcatgcatgtaatcccaccactttgggaggccaaagagggaggatcacttaaggccagtttgagaccagcctgggcaacttactgcctaggcaataagtaagaccccatttctacaaacaaacaaagcacaaacattttaaatggttatacaaatccctacataatatcctcaactttacctcttggctggcaaagcctaaaatatttcctacctggtcctttaagaaagtctgcatacctctgaaagagacaaatgctagagttcgaacataaggtgagcctttactcataagactttgaagtgaggatgagtttattaattagaatttgctttacatttctgcttgaaaatattattgtattctgcttagtaattttatattctagtaaaggcattgtaagtccaaagatgtatgaagatgtatgctaaagcagatagaattaggcacttgtcctgtccaaatgaggaatttttaaatttttaaatggtttttttttctatttttagacatctaatgctatagattcaaactttttctactcttgtctagatatgccaaatgctggcaaaaaattgcttttgttgttgttgttgttctttttttttgagacagagtcttgttttattggccaggctggagtgcagtggcacgatctcggctcactgcaacctctgcctcctggggttcaagccactgtgcccagcctaagaattgctatttggatgttgccgaatttgtaaaaacacagcaataagcaaaatccttttgaacaaagaagtcctgagttcatctcattggtggactgaagcaattctgtagcaaataaatcctttgaaagagctccaaaaagaagaaaaaaagaaataggtacttgtgccgggtgcagtggctcatgcttgtactttgggaggctgaggtgggggatcacctgaggttaggagttcgagaccagcctggccaacatggtgaaaccccgtctctactaaaaatacaaaaaaactagccaggcgtagtggcacgcgcctgtaatcccagctactcaggaggctgaggcaggagaatcacttgaacctgggagcagaggttgcagtgagccaagatggcgccattgcactccagcctgggcaacaagagcgaaactgtctcagaaaaaaaagaaaagaaaagaaaagaaagaaataggtacttgttttaaattgcaagatgtttcaatgcctggaactgataagtaaacaattattgtaagatataattactggccgggtgtggtggctcatgcctgtaatcccggcactttgagaggtcaaggtgggtggatgcttgagctcaggagttcaagaccagcctgggcaacatggcgaaacctcgtctctaaaaaaatacaaaaaattagccatgagtggtggtgcatgccagtagtccaagctaactgggaggctgaggtgggaagatcacttgagcccaggatgtcaaggctgcagtgagccgagattgtaccactgcactctagtctggatgacagagtgagaccctgtctcaaaaaaaaagaaaaaagttactggtaaatggaggaaaatgggcaaaagagggctcatagagccagataaacttgctgtttgaaatgggaggaaaaactcagtaattaggcatgtaacttaacagcaatttgagactttcatgtgaaaagttgaaagaaggtggttagtctttttttctctcctcaaccagttaaaga

SEQ ID NO: 12220 - DNA, 14688 bp, Human
cctgcagccatgagtgaagtcacctccctccacgaggacgactggcgatctcggccttcccggggccctgccctcaccccgatccgggatgaggagtggggtggccactccccccggagtcccaggggatgggaccaggagcccgccagggagcaggcaggcgggggctggcgggccaggcggccccgggcccgctccgtggacgccctggacgacctcaccccgccgagcaccgccgagtcagggagcaggtctcccacgagtaatggtgggagaagccgggcctacatgcccccgcggagccgcagccgggacgacctctatgaccaagacgactcgagggacttcccacgctcccgggacccccactacgacgacttcaggtctcgggagcgccctcctgccgaccccaggtcccaccaccaccgtacccgggaccctcgggacaacggctccaggtccggggacctcccctatgatgggcggctactggaggaggctgtgaggaagaaggggtcggaggagaggaggagaccccacaaggaggaggaggaagaggcctactacccgcccgcgccgcccccgtactcggagaccgactcgcaggcgtcccgagagcgcaggctcaagaaggtgagggccgccctccctggcgtccagaccgtccctgggcccccagccggtccccgcggctcatacccttctttctttctcccttgcagaacttggccctgagtcgggaaagtttagtcgtctgatctgacgttttctacgtagcttttgtatttttttttttaatttgaaggaacactgatgaagccctgccatacccctcccgagtctaataaaacgtataatcacaagctctggagagaaccatttgttcggccgcgcggggcgggggaccggggctgctcccgtatgcgtctgtaaagcgccgcgtcccgggggcaccggagtccggggccgggaggaagagacccagcctggcccggcccgcgcccgcgccgccggccggagaacgtgccccgcgcagccgccgcccgcctgcgtgcgcgccccggccccgcccaggcgtgcgcatgcgccccggccctccgccttcgcgcaccgcaggctggccgtccgggacgcgcgcgcgctcctctccccttccagcccatcccccccagccccccaccgacctactttactgtctccaaactcgggcagcccacctggcccccgacgaccccagcccctgcaccgggtaccccgacgttccatccagacccgcgtttcaccagggcggcgcgcggcgacctcgcgccccgcggagccccgggctcgcgcgcgcccgcccgcccccggagacagaccagcgcgcgcgccccgggccgcctccccccagcgcgcgtccgccccggggctcgcgccgccgccgccgccgccgccgcgcgcgcgcagctcaagtaaaggaggaaaaaaaaaagggggaaaaatagaaagcggcggcggctgcagcagcgatccgccgccggactgggccaagccgggcggcggccgcgcgagccggcgatccagggcactggcggcggccagccagggcgggccgtgttcaaaaaaaaaagtcgcggcggcggcggctgctcagggaaggaggcctgagggccgcgtgcagcgggcgggcagctgggtgggctgggggcggccgcgcggcgtcccggagcctcgggccgcccggagccggcgggcgggcggaggcggaggcggcggcggctgcagcggctgcaggagcggcggcggctgcggcggcggcggcggcatctcctcctcacatgaccccactgtttgtccccgtgatcagcgcgagcggctcccgtatctcctccgtcccctcctgccgcgcggcgtgagcgccgggctcggggcccccccggccgcccgccccctcccctccctccctcccctcccctcccctcccccccgggccccgcgccccccccgcccccgccccccccatggacatgctggacccgggtctggatcccgctgcctcggccaccgctgctgccgccgccaggtaagatccccggcccggccgtgcccccgcgccccggccccggccccggccccgcggcctgcaggccggggccgccatgatcccgagcggccgcgggcccggctcaaaatggaggccgccggcgcgggggggacctggcgcctcccgcccccggcccccggcctcggcggcgcccccggcctcaggcgcggccgggtgggactggggccctgcagctgggcgcgggggcgggggcgcgggcgcgggccgcgctgaccctgctccctcctgtgcccctggcagccacgacaagggacccgaggcggaggagggcgtcgagctgcaggaaggtgagtgcttgccgggccggccgcgcccggggagggctgggggcgctcggcgcggccctgaccgtgccccgaccctcctcggccccaggcggggacggcccaggagcggaggagcagacagcggtggccatcaccagcgtccagcaggcggcgttcggcgaccacaacatccagtaccagttccgcacagagacaaatggaggacaggtgagcggcgggccgcgagggcgaacgggcgggcgggcgggcgcgccgggaaggctcggacctggccccagcgccggcctcgccgctctgccgccccctgcaggtgacataccgcgtagtccaggtgactgatggtcagctggacggccagggcgacacagctggcgccgtcagcgtcgtgtccaccgctgccttcgcgggggggcagcaggctgtgacccaggtgggtgtggacggggcagcccagcgcccgggccccgccgctgcctctgtgcccccaggtcctgcagcgcccttcccgctggtaggtgccctgccacccctgggtgggggggggagggagtggagaggggacactggctctgctcttggggagccccgggggtggggcaggtgtcgcccagcggatgctgccttcaggcctcaggctgcatggggccagatccctgttgtgcaccgtgaaacctggggacagtgctcttggaatttttttttcccgcaaaatgggaatgatgtgtcttaagaggaaagtttcttagagtgcgaaacggatttgctcagcaagtgatcgctgacctcccgccatgttccagggctgtttgaaacacaggacagaatgctacacgcagaaggagtccccactcctgttaattgcagagaatgcagtaaaccccaagcacagcaatgaggggacgggatggaggaacagagaaagctaagggtagcctctgccctcctactccccaggctgtgatccaaaatcccttcagcaatggtggcagtccggcggccgaggctgtcagcggggaggcacgatttgcctatttcccagcgtccagtgtgggagatactacggctgtgtccgtacagaccacagaccagagcttgcaggctggaggtgaggagtagaagtcagattggcaggtgggggaggcaacgggcccagcagggagggaagcccccccagccagttctgacttcaccctgccttgccactaaccccccactctccctgcaggccagttctacgtcatgatgacgccccaggatgtgcttcagacaggaacacagaggacgatcgccccccggacacacccttactctccgtatgtgcaggggacacctggagggcctggtgttgaaatggaaggaagaggggtttctggagtagaagctgggcagttagcatgaagtgggcacatggtgtaatgttttttttctttgcctgtttctgctgctctagtgcacataaagtatcatgtcttttgtttttgcagatggatttaccttgcaaagataattttcaaatctaatacttagcagatgcttgggcaaacagctctgcgataatacatgccccctttttttttcctcctcttgtagaaaaattgatggaaccagaacaccccgagatgagaggagaagagcccagcacaacgaaggtgaggacaaggtgtggctccgggtccccctgaccaccaccctcacaggctcagccagccctggagtgtggagtgacagagagagaagccactcctgggcaggccacaagtgctccagagggctttgctggacgctgtaaaggtagaaagtgagcaacgaggggagagtacagtgtcagaagtagagggacagggagtgtgaattggaactggccatttgttgacccggctggtgatcttgaattcatggcccacatctaagatggtggacttcacactcccatacggattgcctgccccacttgaaaaatggggctgaccgggctcacgtgggctgacctttccacgtggcagctgtcatgctcacatcccgcactcccatgcctgcctggcctccagaagtaggtctgttcccccagggagcacatctgagggagaaactgcatgaagttctgcctctggctacctaaggccggagcatcctgccctttccagaaacaccaggtctcacctcaggtcatttggccttcagcactgtcccgccccgcctgtcagtagccactgcagtgggcacagcactgtgcaagtgccaggagagtgcttacacccaaacaaccatcattcaacaaatatttactgcccgtgggttctgggctgagcggcacaggccctgtgccaggtctggagtctggcctggagcgtcagggaggctcaaaggcctgagggcttatgtctcatgggtctcatgggacattgatggggggtgggctggggtgacgcttccctagggagaggggagtgtgggtcaggttactttgtggggtgctggtttggttgtgggagaagttccatttagaatgcctcaggagggaagatcgggaaggcctcgaatgcccgagtgaggggctgaatgctgagtcctaaaggtggtgatgggactggggtctgtggcccaggtagttgtgttctgagcagctcctccctgagttcaggcgttcattcagcgcgtgcatactacgaccagccccccttttgcgtcctcagatatggcaatgcagcagatgataggacagacaaggtctcagctctctgtgcgcgttctggtgggagagatgggagtcacacagccgcatcaggcagtgcaggcagtcacaggcaggagaggaaagctggggaagaaggtggcgggtgatggcggcatggtagtgtgctctgaagggctcttcgagaggtgacattgaagcagatccctgaagcgacctgagggaaggggcctgttgagaacctcaggagagtcccgggcagagggaagagctagaacacaggccaggccctgagccagggccgccatggtgtgtctgcagaagagcagaattcaggaaaggaaagaggaagttggcgcagtggagggggctgcccaggccagatggtggaggaccttggaagaagtccccagtgtggctgtctgggctcctgtggttttattccagggtgatgagaagccagcagaggggtttgggttgtggaggctgttggcaagagtggtgggaaggggctgggaggtaggagaccatacgactgtcaggcctgagacagggcaggggttgggggaaatgtggggaggactccaaggctggagaataagggtttcgtgctgaactcccctccatgcttggaagggaaggggtgcatctgagcttggttttgagatgcagtgagtttgaggggcccccagagcagccccagccccacgacttacctgtggtggggcgtcagggtggttcttaatctccgtacctgtcttccctctgtgaaatggtggaagcacagccgccccgggcacctggtggggatgcagtgagtcttggtggccacacagtaaggcgaagagaggactcagaaccctcccaccccactctcacccccgcctctcccttagttaatctgactccaggcagccttgaaactttctcaccctgtgaagcagtcttcatcacctgcccacttctccagctccgtcctgtctccgctttcctgacttgcagagcatctgccccaatctgctcatcctcccagtaccctcagccatctggctcatggctctaccaaaacagctccacttccggtcacccgtggtgaccccattgccacatccactggcctcctttgctgtctgggctccaagcatctgatgctgcctgtttccctctgttcctttctggaatcttcctttctcctccatcctctctgattctcctgtgatctttgcctttcctaccccactgttaacagtgaaatttccagggctgtcccagttccaagtgagtagatgggggtgccggggaatctgtgttttccatcagctcttcaggtgatttgtcatagtggacaagcttgagaaactgctttggctgcgagtgtttctttttttttgagaagggggtctcactctgtcacccaggctggagtacagtggcacaatcacagctcactgcagccttgacctcccaggctcaagcgatcctcacacctcaggcttctgagtggctgggaccacaggcaggcgtcatcacatggggtaatttttttttatctgtagagtggaggtcttgctatgctgcccaggctcgtcttgaacttctggcctcaggcagtcctccggcctcggctacaggcctgagctgccacacccagtcttgctggtgtttcataaggtccggcccctcccgtcggcctcaggtgtatgacttgtgaggcccagcgatgggctcggaagctcttggtcagtatcccccaaactctgttcccccttgtaggtgttcctcttttttctttgctgcagaagagtgtgtgactcacaaaaagttgaggactgttccttgatgtcctcccaggcttcgcccaccacctggctcctggtaatgcaaggaactgtgtttccatccattcccttcctttcactgcaactccagccccacgttttgaactacctattcgagatttctgtctctggacatccctgtaatgcctcaaactcaactcgcccaaaagagaatgtgccatctcccgtctccaaaggctttcatgcaaccttcttctttgcagagcagcaaaagctacccctgtcacagctgcccaagccagaaactaagaccagagccgctttcaactctgccctcttcttcccttatggccacaaaccccaagtttctcttctgtggtgatttcagatccgcttctctcacttctttttccctccttcccaccacttcttggtactgcaggagcttatcccagagtcacagactcaaatgcctgcaggggcctgagggagggaggtgcacttggcatctcaggaaggggtgtgtggctgggtgtggtggctcccgcccggaatcccagcacttttgggattacattttggccaagacggacggatcacttgagcccaggagtttgagaccatcctaggcaatgtgacaaaaccctgtctctaccaaaaaaattaaaaattagccaggcctggtggtacatgcctgtaacagtcccagctacttgggaacctgtggtgggaagatggcttgagtccgggagacagaggttgcagtgagctgagattaccctccagcctgagcaacagacccagaccttgtgtcagaaaaagataggaaaggttgtggggggcccccagtgatctggggcatgtgtgcgctgcctgaagggtggcccttgcccagtgccttccccttgctgccctgtcagaatctagggccactgttgccagaaactctgagaagctagaaatcgagacttatgtgaaatctgatttttaggtgccagattagattgctttttccgtttcattgatttctactcttaatgttactaattcatgcttctactcacttggttttttgtttgtttgttgttttgttttgagatggaatctcgctctgtcacagtggcgcaatctcagcttactacaacctctgcctccccggttcaagtgattctcctgcctcagtctcccaagtagctgggactacaggtgcccgctgccacacctagctagtttttgtatttttggtagagacggggtttcaccatgttggccaggctggtctcgaactcctggcctcaggttatccacctgcctcagcctcccaaagtgctgggattacaggagtgagccactgcacccggccccttctactcactttggattcaatttgctaggtttcatgctttagcttccctggcacaccccaaccccagctttttaaggtaattctttttttttttttttttccaattttctactaaaatctttattttacaggattaatgtttcacagcagggattgagatgattcttaacctttctctttgcttaacaacatttagagttgccagttcactccagcatcactttagctacatcccactgggatatgttgtttttgttatcattcagtttaaagtgttttccaattttccttgtgatttcttctttgacctttctgttatttggaggcaggttgcttaatttctaaatatttgtgggtttttcagatatctttttgttattgatttttaatttagttctgttatggtcagagaacatactctgtatgatttcagttccttgaaattcgatgagacttacccgacgggcccgaatgtgtcctagcttggcggaagcttctggggcattgacgaggacaggtgtctgctgctgtcaggcagaatgtccccccaggtcagtgaggtcaggctggttgagtgttcaggctttctattctgatttttgttgttgttgtttacttgttccaccaatcaatgagaaagatgtccatgtctctcactatatttgtggatttgtccatttcttccttcagtcctggcaggtttcgcttctgaattttctcttttttttttttttttttttgagacagagtctcgctctgtcacccaagctggtgtgcaatgatgtggtctcggctcactacaacctccacctcttgggttcaagcaattctcgtgcttcagcctcccaagtcgctgggattataggcatgcactgctatgcctggctaatttttgcatttttagtagagccggggtttcgccatgttggccaggctggtctcaaactcctggcctcatgtgatccaccctcccaaagtgctgggattacaggcgtgagccaccccacccagcttctgaattttaagtttcctatggagtaactgaagtgcttctgtggaatgaacgtggccttggtcctaatgggtcttcctgtatttcaaatgtgccatgatggtcttccgaagccacaggctggacagcattaccgcctgctaatgtcagggcctggattcaagggcctgggactctggaggaggaggagatgcggtcctgacctgcgagcagagcacacaaggccttgacaaccgatctttacaaccttttcccacccctgcataccctgaaatggttttcaggccaccatttctgggatcttcccagctgcctgccttagagtctttctctcagaaaccagcccgaatgtttcctggatctctgaggattcatcccacccccattcccatgcagaggccatggctcggcgcctggcgttcccgaggcactttgtaccatcttcagtgatgacacgaatgcaatggggttagtgccacttgcccacagtggtgctgcgagtgcccatggggcgcaccggggctgcttccaccctggaccccagcctggcggagggcctggcacatagtagggcggggagtaggtgtgtaagaagtaagctcgctctggagaggatgtagctgcagccggcgcccagctctcgagaggactgtgggagggcagaggctaaaacgaggccgcctgccgagttcctccacagacccctgggcgaggagcgctctgctggggactgcgccagcggtgcctccaggcctggactctcagctccgctgctgcttttggccagagttcccaaaggcgggtgtggttgtctttggtgggaaggttcagcgcaccgcgatagtaataggggagcaagcactcgctgagcccagtgcagggcctggaccgtgctccatagcaagcactgatcttgggctattggttttggaggaaagagggagcacaaggatggaaggggccagggaagagaggtcacggtgggagaaggagagtccgcatccatcggagggtttgtcactcaggcctgagtgggaggcactggaggcagggagaggccagtcagcagcatgcggccacagcccagagaagccagaggggtttgctggtgggtgggccccagccttttcaagggaacggcaggtctggggagctgccgatctcggggtgtgagggtaacgggcaggctgtggcccacccctccttctcaggctcactggacccctgaccggtttcatcaccattatccaaggctttgaaaagaccccctggccttcctgccacatgtgccctagctatagggcttcgttcccctccacaaatggtgcagacagcatgagccaccctggcagggggctgggggtccgtggggtaggagttgggggtagctgagcgttctttcctgtccccacggtgcctggtgctggggcttggcagccagggttgggacagcctggctttagcaggtcctgagtcaggggtctcaggctccgcagcacacagtccccaggcaggtgtcaggatgggatgtggccagagaaaggcatgtgctctgtctggggatagctgccacccagctgacacagttggcatgagattgtggagttttatggagtaaaatcacaaatctgggttttttaagtaaaaccttctatgagttgccatctctggccttcaacataggatttgggtctttcctgggtgagctggtgctttgtgggccaggccctgggagctgcaagtaccagttgggatctgccattgccctgtggaaggattttaagcaggggtgaaacatggtcagacttggatttagagatgaggaaaaaaaacaaaatcacggtgccagagtctctggggagactggagaatgcagtgcaggggccgcaggagccaaaaaggggcactggtcctgcgaagagtggctctgtccatccctgccttccagtatgtgcccactgtgaccagagctccatttctcaaaagaagccagtgatgccaattaccatgagaaatttccttatttttaactgtcgattaaaatttgtacaagtatggtggggcaggcctgcaaaatgatctccaagtgcctggcctttgatgcccgtcctaaaagcatgtgtggcactggagggcccacgtttctttgttcctcttgagaagctggggtgggggccggctgggctcagggtgcggcccctcacttcccagggctgtggtctcggtggggcctgcactgttcctgggtgtccttgggctgagcctctgccctgtgaggacggccgctcaggcatgatccgtcagcgaagccgtggctgtgactctgttttccgcagtggagcggaggcggagggacaagatcaacaactggatcgtccagctttcgaaaatcattccagactgtaacgcagacaacagcaagacgggagcggtgagcaccccggaccctcagtgtctgcggtggtcccggcccccgacccttgcatgcagaaagtccaacagccatggggctcgggagtcatccctggggtggaggccggtgggcggtgcctgccctaaggctcctggtcccctcgccccccagagtaaaggagggatcctgtccaaggcctgcgattacatccgggagttgcgccagaccaaccagcgcatgcaggagaccttcaaagaggccgagcggctgcagatggacaacgagctcctgaggcagcaggtgggtgcggggcctggagcgggtcagggcccaggagccccagatgcaaggcgctggccctcagctcccttgacctccgtcgtgtccgccagatcgaggagctgaagaatgagaacgccctgcttcgagcccagctgcagcagcacaacctggagatggtgggcgagggcacccggcagtgacgcccgccaccaccacgcagccgccgccgcccacgccggcctctgctgcccccttccccagcccttagcacagagagggacacatgcccctcccccagctgcgtttttttatagtagatttttaacaaaaaacggggagaaataatgcatttctgtggatacagtgcccaccgccctcctccacttggaaacggtatcctccctgcccatccgtctgtctgtcgcccttctcccggccctcactaagccccggcacttctagtggtctcacctggaggcaagagggaggggacagaggccctgccacgtcccgctgcctcctgctctctggaggtactgagacagggtgctgatgggaaggaggggagcctttggggggccacccggggcctggacctatgcagggaggccacgtcccaccccacctcttgtttctgggtccctgctcccctttgggggtgtgtgtgtgtgttttaattttctttatggaaaaattgacaaaaaaaaaatagagagagaggtatttaactgcaataaactggccccatgtggcccccgccttgtctgcttgtgtgtttgtccatctcaggagtggggagggggcctggggtctgcagagctccacgaggcatggttctgctgttgtgcacatggctgtgcatggtccctgccagctgcaccacccattacccagtggttggttggatggatggaggaattaaggaatgaatgtcccctttgaggccctagacgtgcatgagggtgtggggagctggggtcaaggacatgtcccatgttggagcagaggcaggggtctccgtgtcaacagttcctgaaaacacaaccagcccctggccctgccctgctgggccaaagccctcccctctgcaccagccaatagtggggcctggccttgagcccctcacccccagggagggcagatggccagggcgccaagcttggcccgtcagcctgtcgccttgcaccaaggctctggcgcctgtgctgtgacccctgcccctgctgatgatgaaacctgtcctcagctgagatgcagcgatgcctggtagggctgggggctgctcctgtgtctccccgggtgagcacacccctattcactgggccctgcttcagcctgcagcacccttcaactcccaggagctgggcttgccactctgctcaccttgtggagctccatctgcctttcctccccaattccccccctccctgcactcgtctcttcccacaagagccctgtctccttttcctagctattcccatctgaggccatctttattcatttagtttttagagacagggtttcactctcacccaggctggggtgcagtggcacacaatcacggctcactgcagccttgaccaactacaggtgcgtagcaccacagccaagtttttgtatagatggggtctcgctttgttacccaggctgtgacaagaggagcctcccacgtggtgtggatgaggaggcagatggcagggcctgtgcatttctgtgcttgagtgggccttgaaagtggttcagcaaccaggaagaagtgttcattcctcgacaacaacatccccgggctctggtgacttggctgacactggatggccctggaatgaaaaaggcaaagaggcaaaatgtgcaagggcccatctggaaccaaggtttgttgatcccctgggccgtgtgcaccctgagctgggcctggtagtggaaaggaatgaaggcactgcagtcaggcagcctgggttcatcccccagctagtggtgtcctaaggaaccggctccccaaaaacatccctggcttgtagtgcttgccaatttctgggtgtcaagactcccactgctgctgatttcaggataccagcatgatgccactgaatgcagagtttcgagatgtgcatggtctgctatgttgagccaggtctagcataccgctgtgccctgctgtgttttaggggagatggggaaacctggtgggtaagagcaaaagccctggagtcaggctgtccaggctagaatctcagctctgcctctggctgagcaagcttgggccatgccctgatctctgccttcagtgccttttctgtaaagtgaaggaaatgagtgtccgacggggaggaggttcctaaaagggagcagggtctggggagcccaggcctctggggttgggtgactgagaaggcagcccctgaatacagagcagagctgaaggtggggcagtaagtgctgctgggagaacaggcagcacaggctgagttggtgcagaagtgagtcaacatatgtgccatcgtataaaatgtattcatcggactgtagatgttagctattactattactgctattttatgttttatagacagggtctcactctgtcacccaggctggagtgcagtcacacaatcatagctcactgcaacctcagcctcctgggcttaagcgatctgcctcagcctcccaagtagctgggactacagatgtgtgccaccacgcctggctaaatttgtttaaaattttttttgtaga

SEQ ID NO: 12221 - DNA, 53915 bp, Human
  misc_feature (1)...(53915): n = A,T,C or G
aagcagaatgcagcgagtgaccatatatgatcctatttgtgtaaaaaagtggggaaatgtacatttttgcttctttgaggcctgaaatgttttatgaagacatttacatacagaggaaatacaacattggaggaaactcagtattggttgcaagtgggatggaatgagtgcatggaagatagtgaagggaaagagatttctcattgtatgcccttttggttttaaatatgtgtatatgcttgtgtaatatgtatgaatatatattatatatttaaaataaaattaaaaagaacaaaatatccagtcctttaagcctgatcaaaagccacatcaaacaggtcttgcccttcactgatatttattatatactgccttatgtttttttttttgtttgtttgttcgtttgttttggagacagagtctaactctgtcacccaggctggagtgcagtggcatgatctcggctcactgcaacctccacctctgattctcctgcctctaagtagctgggattacagatgtccaccactatgcctggctaatttttgtatttttagtagagacgggctttcactatgttggccaggctggtctcgaactcccaacctcaagtgatctgcccaccttggcctctcaaagtgctgggattacaggcatgagccaactgcgcccggccatgtattggcttattctgccaatgtttgtgtcttgccttagtaaagtatgctcctcgagagttagaatagtgctttttacatctttatatacatacctacagtgtccacagcccagtgctttttatgtagttgaaattcataagttggtttaattctacttgttaacaatgtaatactgctttaaacttgtggagtttctgtattacttcatttatcctcaaaagaacctggtgagataggcttttatttgcaggtgacattttctatgttttcaaatgagactgtataattctggctaagcattttaactttaagcagtttgttccttatctttgtaagttagtcagtcacaacataatggctatattgaatatgagactagaggagatgatctattaggttattttcaactctgtggggatgagtaattgaatgaatgaatgaatacattttattagtacaaggaaggcaaactgaatacttggtgtatgcattttgggttcctcttttaaatgaatcccccgcccagctccccttccaccactcaacctttggctgatctggttacttatattaatattaaactattaataactggcttagttactaataatagtgacctttaattaacaatatattttcattttaatttttaaatttttgtttttattttcttttaacaatatattttcaaatggtccaatggatttatcaaacaaatttatttagctagatgaatgagtgagaaatttatgcattgcctcatactttttctttgtgtttcttcctattcctttgctttgtttagttattaaatttcacttaacaccatgctttggcattttatttccagatgttagatctgaaaatgatctaacatttcagcaaagaactgaaggatttcagttctttgtgcagtgtcttttaatagcagtgtgtatagggtggggaggaataaggaaacaaaggcattgcagagatagagcaacctgaagtcaaagagcccagatgttttctcgtcattttttgttgtcaggaaataaagaataagggcagtgcactgaatgaatgtgctgcttttacctgtaattttgtaattttctttttgaaacagggtctctcaaaatgctgggattacaggcatgagccactgtgtcctgcctaaattgtaaaatctaaaaacgtaggttctattatcaattggtcttggctatttttcatgtagggaaaaaaactgtgaatttacatgcatattctctctttgtatttgcatatggtattcttctgtgtggttctgccggtgtgttaacctgtgttcttccctatagggttgagaatgcttgcaccaagcttgtccaggcagctcagatgcttcagtcagacccttactcagtgcctgctcgagattatctaattgatgggtcaaggggcatcctctctggaacatcagacctgctccttaccttcgatgaggctgaggtaggcaatctgagacaaaaagcctactcttgaagataataatggaagattgatgattgtttagaatgaaaatatgttgaatgctgcacatctgtgttaccgtgtttgctagttgtccacccatgtgattgaatactctgaaatattttttcaggtccgtaaaattattagagtttgcaaaggaattttggaatatcttacagtggcagaggtggtggagactatggaagatttggtcacttacacaaagaatcttgggccaggttagttttatccaatttctataacattttttaaggattgtccatgttggagccaaaggaaagggtaccctcttcctactttttgcagaagataggtgaagatgcattgggctttcaggtgtctgctctgttgatggagatgatgctgtgctttgaggtgatgtcattatctctggtatctgaatctgctttctatatattgccttgtcaaatgaattaaaccaaacattgcaaatactgctattggagaatgtaggaaatacttttctgttactgtaatgctgaaggccatcctgcatcctgacctctccattccacattacacagcattccttcactgtctgccagctggcctgtagttctttatgacctcttagcttgctaattagcctgcctactattatggattcatgccctaacccaaggctgcataatataatcagacctaggagagaagagctattgtggttaaatcttattttgaaatgattattcaggcatctgagcattaaatattcaaaatatataaacggataccagcttttgatgttacagacatataacatgaacttgagggtctttaaagtatgaatgagaccaatgacaagatatgttagatgtttaacctgcttaacttgattgttatcactttataaaattcatttgttttatgtgaaatgttgatttttaattaacagcatttttatgaggttccagtgtaggtgttctgtaaaacttaatggcagttaagaatttgagccatcactgaagatcacctggaaataggtttctctggtggctttagagtagtcctcttaaaatttctcataatactggcgaaaattatatttccccaaatggaatcttatgcagaatccccaaacaaaaaaagacaaaatggagctactttaggtgaagcaggagcagccccacctctgcttctctttggtcttgatggtctgtgagacaacttgagaaatcctaggagtaatttgaaaatcaaagctttagagaatcacatagcgcctttgaataacaaccaacataaacaaaaagtgctagcagagtgattccaaaacaccagatgctttcaaacactgtcatccctataattatttttataatatttctatttgtttctaattataaaactagtacatgcttattttggacaaattggaaagtacagacaaatagaaatatgaaaacaaaacatatcattgttattcttagaacttttttcagccactagattcagtactaggctcatgtgagatttttagcacagagttcagagacatggcatgaaacctgtatgcatagaagcctggcaaaatgtttttcccttacctgtgaatttctttttaataaatatatatttattcatttagatgtttaatatttgtgaatatatttatatcaaaatatgaaaatgtttatcacatttagtgtttacatttaatacattactttcattgaaaagagtaatgttgcataaattagagttcagtgatggtgtctgttgtttaaataagtgagcaatcggtttgaactttcatagtatttcataatggatttagactgagaaagccagacccgggattgtttcactactcaccctgcacaatttcttctttgtgccccaggaatgactaagatggccaagatgattgacgagagacagcaggagctcactcaccaggagcaccgagtgatgttggtgaactcgatgaacaccgtgaaagagttgctgccagttctcatttcaggtacttcctgcctgtactttattttataggggggaaaaatgttagcatgttctaaactctgaggttcattttgttttcttttgttttcttttcttttttttttttttgagatgaagtctcactctgttgccaggctggagtgcagtggtgcgatctcggctcactgcaacctctgcctcctgggttcaagcgattctcctgcctcagccttctgagtagcaggcactacaggtgcgcactgccatgcccagctaatttttgtattttcagtagagacggggtttcaccatgtgggccaggatggtcttgatctcttgacctcgtgatctgcctgcctcagcctcccagagtgctgggattacatgcgtgagccatggctcctggcctgaggttcattttcttttgtggcttcactgcatgtccttcagcctaggtaaaaatgagacccgattgattggttatcacatgatggctgtagctgattggctgagaaccagtcttcttctctaatgctgtccttctcctgttctttgtttgaaattgcctttctgtggcctaattctgttctcctaaagctctaacaagcccctttgctgggaggtggactctcctctataaactctagcctaggatattaaattttcacacctttgtgttatagaaaaataattaggagctggaatggatattatagagcatcatatgataaagacatgaactcagagccctttttagtgtgtattaatccaatttttcctaaaagatatttaactgttgtttacatcatgagtagatcagttctttagtcaccagctgggactaccttcccattgagtagtgctctgaaatgcaaacatggtagctgctctctcgactagcaaaagggagtagcacttattgagtgtctagtatatgccagacagctcatggtttatatgaattatcttagtcaagttgtgggttaattagttatttctcagaaggcaactttattataaaaatctggtgactcatgtcattgtgacttccagctacctgctttggtgtttcaagtagtagctaaaaaaggacatatgagtataagagttcaggaggctgggcacagtggctcactcctgtaatcccagcactttgggaggccgaggtgggtggatcacctgaggtcaggagttcgagaccagcctggccaacatggcaaaaccccgtctctactaaaaacaaaacaaaacaaaaattagccaggattggtggcagacggctataatcccagctactcaggaggttgaggcaggagaattgctcaaacccaggaggcggaggttgcagtgagccgagatcacgccgaaagtgttgggattacaggcgtgagccaccatgcccagacattatttttttcttctttatgtttgggggttggcaaatccaagctacatgttgagagaaatctcggatgataaacttgacatcttgggatcttctgctgggatcaggggcagcaggatacgccattcagagtattactgacagttttcatattgtcccattaggtttgtagtagatggagccagggtgagggccaggatgataactgatttagaaggatattagatattttgtgattgcaggtcatcagcatatgcaggttaaattagttacttaatcatgttgtgatggtgtctttgtaccttgagttttctttttctttttttatttttacaataaaggttgttaatgttggaactttattgtcaaacttgtagtgtttgttttgtatactcattttaggatcttaaaagcccaaaacatctaaagtgtagaacatcttttgtgaatattgttatacaacaagattaaattccaagcttactttctgatcttttatttttacagctatgaagatttttgtaacaactaaaaactcaaaaaaccaaggcatagaggaagctttaaaaaatcgcaattttactgtagaaaaaatgagtgctgaaattaatgagataattcgtgtgttacaactcacctcttgggatgaagatgcctgggccagcaaggtacgtgttcttagtggagaaataagcaaaatccccaactctccctggctgggggttttgattggcacctgtctcatactttatcttgtaatttttgtagcataagagtactcagatattgtgaaagtaatttcttcttcatttctgtttcataggttacttgctatctttgctaatttcctttgttctaaggtagaacaagtaaataggcatgtggggtagatactggtttaaggctgagatttatagcttttccatcaggctggagtcttattggttggactggtggaagagtatattcccgtggatgggagctctgccttgtatatgggtggttcttcccagctgactaagtaagatacagatatgcctgtaattctgaactttatggaaaacttttctttaaccaatctttgatccagagaaatctacagaggaaactcttggcatttctagatgtgtcccttgatcattccattttccccaaggaaggtttaattaaaatattagtcttcacattggtcagttagtttgagggatcccttcaccctttttctggaatctcttttaggaccccagaggggctggcagattccttctagagcctgttagcagtggttttgtgttgctgctgctctggtctgctgctccctgtttaatgactgtgaaccaagctttcaggtctgggggaacagagatacttgggttcatactttccttgtaggagcccaagatgtaggcagtggggggaacacactgtccccaagatctagctttcccatgtgtgaccccaatgtctccagggccagccagaaggctggtagtcaactaaagaagggattttgttgtatgacttccattgggtgctcagtagaacggtatgttctccgggatctgtaaggtaatgtaaaagctggggcctgaaatcaccagccctctctcttgttgccctgaaagctaatttaattatatagagtaagttagcttattttaactatggatttatttacagagacattttctcattgatgtgaagttcttgaatagattctaagactgtattttaaatctatatggtaaaatctttttaactctgatattttatttaattttgcttttgcatagttgacaactttcacttccctgttatgacttctttatgcatctttttttgttcttttgttttattctttttctcacgtttagaaggtaagctttctcttgccctctagtttctttttcgcttaaaaagagaaaagcatgtctgtgaggtttttttgtgctgtgtgccgtgccttattctgtgtataacactgtgcttgaatgtgcgtcagaatgtgatttaatacgggactctaggcagtgctggggagactgactgtggctcatattgagtgatttctttgggaaaagctaaaggaaagacattactgtgggctatcaggctgcctatatttggtgggtgccttcatttctttgggtaggctcctgggatcttttttggcctggtctttcccattgacttcatttgaggagcaggattccccaggtagctgggagacccctgagttacctgtggaccctgctgttgggaaaggagacttccagctgatgctatctctgtacctgcctctcccaccagtcttctttgcgggctctgaaattttgcttttggagatgcatcattgaggttttaagccataatgaaagagggtaggctagagagcttagatgaggcacctgtccttcataataatcctagccttcaaaatccaaaggaaaacagaagtgaagtgtgtctaaaggtcttcctaacttcattctgtggctcactgcatgttttgctgtccaaactgaattagctgtagttctccatgacctcatgttcccctaacccaagctcttcgcttattctctttcttttgcttctagcagatgacaaaaagtaataaggaggaacaggcattttaaccttaatgtttctctattttcagaagggaaaagctatccatcatttagtgaataaatgttattgaactttattttgtgcaagtgccatcaagagctgcttctctcattaaaaaaatgtagtcagttgagttttcagggctaggattaggcacttggggatacaagtgaaatagacctggtactcaccgtgtacagtcttgtagctgctcccagttttatgctgaggaaaaccaatttgttaggatgctacaaaactaacttcatctgaaatgaaagaaggtaaattaaattagctcaactcaagtacacgatgacatcagaatgaacaagagatgtttatgttttaatctactgaccataagaatgaaaaagagatgcttattttttaacctaatgacatcagaataaaaaaagaggtttatttttaacctaattttgcttttgttttacatttatgtggttcaaatatcaaagtgctgcaaaaagatatacctgataagtcttcctcctaacctggttcccatccactctaccgctcctcaccctctaagagtaatcatttctattggttaccaaaatagaaaaaaattttaccctgaaaatagaaattggtagctaggattttggctctttttcagttttgtagcattacgcatctttcattgctccactgtaagcagtgaattaatcagaccttttgtctgactgtgactgctgggttcccattctgtttaatgcatacagtgtctttcacctcttctcgcccctaccaataaataattaactttgtcttaccatacttgtttcatgcctccccattggtgcagtattcttctggaaagtgatgattcctctagaaaagtgggggaagaaagtaagtggaaaaaattcttggtaaaagtgcgtcttgccgaataagttaagattttaaagaggcaatgcaataactgattattttaccttttatacctatattcaaattgcacatttacaaatttaaaagtaactttgactttaaacacttcacttattttaaaagtaaaaagtttccttttcttaaatcaacaatcattttatagtgatcattaaaaattaggttagcatttttttctgaaaatacattatttattaaaagaatttgagttaaacacaattctaattctaccctttgtaaatttagtgctctacatttaatttttttggtatttatattacttgtatcttgatgcatgctgagaattaagaggaagtgagataaaaaattaaaaaaaaatttcactgctaagactttgaaccctacataggcactcctgcagctttgcaccgtgaatcattaaattctattattcagaattagttcctgtggtgggtctctccccactgtggtcctgggctggtggtgggtaaaagtagtaagtgactcagatgccttatacagaagattagcaaacttaactaaggcaggaaatgttggttagaacttgtgagtgtgtaatactacccccttacttgcagaccactgggatttaagagttgatttgttaaattaaaaaaaggtcatttgtgggctttctatgagcaagtgttctagtgttttgtttttagcagctaatagaatgaaagatctctaagagcttgagagaaatagttaattcaggcatttatgatattttatctccctgctccccatgaggagaaaatcccaaaataaattgatgtttcccttctgatctaagttatctttggctagtacatctgatcatgcactcataggtagcatagatttttagagccaggaaggtattcttagagatgaggaattgagacccagagaaggtaacttgcatgaagtctcaggactagacaactttctcttgtttaaatgtagtttgtaagattttgttctactgcccaatctatactttccagaaacatcttaaaccagaaacatctggtttaaaacattgacttgcaggtggaaatgaggttagaaaggggatggagtgggaagacaggtgttggtggagggagaagggagagtatggtgggcagtcatggagagaggttcttattccccatatttaaaattttcaagagcctaggattgcaggactttacttttttaaccgaagttcctcttgattgtccatagaaggaggtcattattattcacaggtgttctgaggcctaaatctatgtttaatttaaggagtgtttcagttcctaggaaagcacgtacaaatggtttagcttgtcgttccatcttttggtatgcagggaagagtgccaaggcactgtatttttttcatttaaaacatgaattcataagaattttatgttaagaaggagcataacatggtgggggaggacccagatagattcaggccagctgtccccaaagccacatgactagacctggtctttttatacttcactctttcaacacccacaaaccccctgaaaaacaaaccaaaaacagataagaaattggtagagacttttctttttcccaaagttgagcttttacagagaagaatactcaaatgaaggtgcagtttttctctcttctatttcatatctgaattatactgacctgaaatatacagacctacatgacaaggtttagcaaaatggtttgtggtacaaagcatggctgaccacaagggttacgattattttcaccctttataaatatatccccaaattgacttctgtcctagttgtccagtgaatttgtttatgtcatattcattgtttgtatacttacatgcttatgacagaattctgtcaattctataataaatattgcctttcaaaagaaatatatatgaaagtcttaggagaaaaaaattcccttagacatgtttgtttttactagatatgactaacataaaatggttacttataacctactgttttccagaaagaatttaagatggctctttcagttattgttttaaatctctgaaattgtctaaaattaatgctgttaaaaattttggtaacttattgaaagtcgcagttattaaatgcagcttcattcaaaattggctattggttccttttaggggaaaatgaacatctcttaattttaacttcttgacggtgtcacacctcccactgagcagtaaattactcacttcctgagaattacattctttccttgcagtactggccattagagctttattaaggagaaaaaaagaaatgatttttgaggatgctgaatagacaaaaactattttttccattgtgtttcaaatcatttttgggcattggagaataaaagcagtcatttttgttagtgtagattatgaatttgatttctggagcttattttctctgcagtattaaccaaagtcaaaactgacaaggcagagatttgctgactattgttggagattagtagaatctttagcaactctccttggtaaaagaaaaaaaaatcttgtttcatttgataagcaatgaggtttggagtcaacaaacctgagatcaaattaggtttgtaggagtcagttcctgtttcttaatttgtagtattatttaaatgacatttaaatttgagattcaatgaggtaaggagggggaaagtagctaaaacagaacctaacatgcagggaatgcatattaaattcaatgcatgtcagttgaatttagtttcctaactagtagcctttaatgttagagtagacataaaaatttctgaccttcgtttccctttgaatttagatttttgaaatgtaataaatacctattgcttttctcactgaaaataaaagtgtgttaggaaaatggtttaacaggttttaagtgaaatatttttacattgacataattattctccaggatgtccacacacttcctaagtaagagtttgtgattaaaagaaaacctatgcctagataacttgtgttagatcctgaaggctacccagttctctgaggttaggagttgcctggcctcaagtcttttaaaaagttattgattcaggccttgctaatttggaattaagctaaagttgacctttgcattaattttgaaggcaacgttttctgcacaaattaatttaagacatgataggagagatttgctgatattcaaaccatttgagaatcaaagcacttaaaaataccacatatcttcttctaattacaagtggattttgaaatagatcctcttatgattctgccttttattgacagctaccatggttacatataacttgataataaaaatattttgttttcaatttttttggtaatttagttcacttctttttcattgctatagctgagaatttgctatttagagccttagatagccaaggattcaacaggagaatcatctgtgtctgtttagaaggggaaggagggattccgacagttgagagatctgtcttttgaatagggggctttggaacagttgtggaccttgagcctaactatgggtgctgccaatgcttatttgtgatagtgctgtatctttttttgaattggaagtggggatgctcctggtgcccccgtgtggaaaactagtggtgcaacacctttaagaaccccagttgtgcaggattggaaactgaaggaagctaggacattgcctagaattttagaggttaactttgtgctttgatggcttaactctgtaagagtcagtttcctacagcaaaaaggaggatagatggtctttgaagatgctaaatagagacttaagagatggctggtgttatattgttctctgtgtttttatgtgtttaaaaaaatttacggaaatacttaaatacatttaaagtgattagtctgttgtttcagcttctcctgatgtatcctgggagattttatgctagtttcctgatagtcctcgtgaatcctggttgtaaaaaataagctgagacccatttattctatcctgcatcttcttccaggtgagggatagtaagggaactaagaaggaggaatagcagggaaggtcagaaaacacttctaaattatattactttgaggggtttatttgtagaattaaaattaaactgctagattaacattttcaattgtttcttccaaccagtaattccaagtttttcaggttaattgaatatagtgaaatatcatccagtgtgtgcatttcaaaacaagatgtaaaagaactgtgatttgtggcaccacatactaacgaggcttccctgaggtgggaagggctttggcaaggctgcagtagatgaatgttgactagtggaaaggctgacaatgaggcatgtgacaacagggctttttcctgctgaagacattaaacatattctggcttgagcaattttaccagttttcacagttttagcaatagggaacccaattccactctgtttagcaacagagtagaattaactgaatatttgcatgcaagatgctgcattttgacagaaatgagaattgtggtgtggtgacaatatttttaaggccttcgtaggactgactaccttagctatgtatgttaatgctgtaacttcttctctgtcttacgttctatcatggtatctcaacttttgcaaagaaaataatggtgggatttcttcccaaaaggacactgaagccatgaagagagcattggcctccatagactccaaactgaaccaggccaaaggttggctccgtgaccctagtgcctccccaggtaaccctctagttctgcttttctgatcaatacaacgagaagctaaaaaccaagcaaatgaaagaaagaaattttcccataatctcatcatctgagagaactactgtaacattatggggcataccccattatctgatagttctgagtaactgaagcaagtagtaggccttacaaggatgaagggaatagattcgatcacctctaatcacggaggagtaagtcatactgagctgggcattctttgcaaaatttttggttctccccttccctgaatccaaaaggtaattattttgaatgaaagttcttctcttccagttcccattgagcagacttccatttatgtcaacagagttcttaattaagcagattaaatcatgatgccaatgagaattggaaagttgactgtataaagataagacccaaataggttattgaactaggctttattgattttctaatctaatatttattctgttttagattaatatttgaatgaatgtgaaaaacctaaagtaggttggaggtgctaaatactattaaattgttagagtctgttttcatcatccatattcttaccacaagctacttagtatctccaaatagatacagttccaagtatctttttttgcgtgtctgttgttgaaacctcaccctatggtttaagggcactgcttggctgttagctatcagatatgttgccttctattcactcgtcttgtttaaaatcatccattccttggtgaatgaaatgacttgtaaagtatcctctctaaataatgaatgtgtcaacaatgtagatattgaatatctctttattttaggggatgctggtgagcaggccatcagacagatcttagatgaagctggaaaagttggtgaactctgtgcaggcaaagaacgcagggagattctgggaacttgcaaaatgctagggcagatgactgatcaagtggctgacctccgtgccaggtaaaagttcctctgtccttacagagcagtagtgggtaactcactcctaacagggtgattcagaaaacaagcctctgccagttttgagttatctctttggctagtagataacagagatattatagtctattaaattcttttgagatggaggtgaactttccctttgctgactttatttatttatttattattttttgagacagagtctcactctgttacccagactggagtgcggtggtgcgatcttggctcactgcaacctccacctcccaggttcaagagattctcctgcctcagcctcccgggtagctgggattataggcgcccgccatcacacctggctaattttgtttgtttgtttgtttgtttgtttgagatggagtcttactctgttgccaggctggagtgcagtggcgcgatcttgggtcactgcaacctccagctccgtggttcaagcagttctctgcctcaacctcccgagtagctgggattataggcgcccgccaccacgaccagctaatttttgtatttttagtacagacggggtttcaccatcttggccaggctggtcttgaactcctgacctcgtgatccaccctccttggcctcccaaagtgctgggattacaggagtgagccactgtgcccggccacacctggctaatttttgtatttttagtagagatggggttttgccaggttggccaggttgggctgggattacaggtgtgagccaccatgcctggcctgactttatttaaaacatgtttttatttatttatttatttatttatttagagacggagtctcgctctgtcacccgggctggcatgcagtggtgcaatctcggctcactgcaacccctgcctcccaggctcaagcaattctcctgccttaacctcccaagtagctgggattacaggcatgggctgccacacctggctaattttttataattttagtagagacagggttttaccttgttggccaggctggtctcaaactctcaggtgatccacctgccttggcttccaaaagtgctgggattacaggcgtgagccaccatgacctgccaaattttttctttttctttttctttttcttttttatttttttgagatgggagtttcgctcttgttgcccaggctggagtgcaatggcgcgatctcggctcactgcaaccttcgcctcctgggttcaagtgattctcctgcctcagcctcctgagtagctaggattacaggaatgcgccaccatgcccggctaagtttgtatttttagtagagacggggtttctccatgttggtcaggctggtctcaaacttccggcctcaggtgatccacctgccttggcctcccaaagtgctgggattataggtgtgagccaccatgcccggccaaattttttatttttaatgacatggccttgctctgtcacccaggctcaagtgcagtggtatgatcatagttcactgtaactttgaactcctgggctcaagcaatgttccttcttcagcctcctgagtagatagaactataggcatgtgccactatgcttggctagtttttcaatattttgtagagataaggtcttgctatgttttgtggtctcaaactcctggcctcaagtgatcctctcaaaagtgttgagattaaaggcgtgagccaccactcctggcttgaacttttaaaatacacaaatgcctaatagtaaagttgaaacttgttccgtaattgaaactgaaacacaaatctagtttctaatttactagccataggcttatgaaaaataaaggggcagtggtgaagtctggcatgggtaaatacattttacggaggatggggagaaagaaacatagcgtgaaaacattggaattatttcacctcataaaaaaatcatttaactaggttatcctctaagttggtaatttctgggcttttttgagtttccttttcatgattatttattcggattcataattatttaccttccttttaccctcctaaagccttggcctttagagcttttctccccataaactaaataaacatagtttgctattgagaaaactcaatataatataaatttgtttggaattcatacagatgaactcatccatagtgataatgaagttctaaaagatttttatagaattttatggtatggacattacgaaaacttggaataggatgagacactcatgaaacatcatgagataattaggatacacagggtctacatacaaacagggctcagaaacactcctctacatgcagtgcaccattatacctggtctccaatattagtgcaatagacataagaatgcagatcttatttatttatttttattttattttattttatttttttgagacaagagttttgctcttattgcccaggctggagtgcaatagcatgatcttggctcactgtaacttccgcctcctgggttcaaggcattctcctgcctcagcctcttgagtacctgggattacaggcatgcgccaccatgcctggctaatttttgtattttaatagagacggggtttcaccatgttgatcaggctggtcttgaactcctgacctcaggtgatccgcctgctgcggcctcccaaagtgctgggattacgggtgtgagccactgtgcctggccaagaatgcggatcttaaaggcgtggttcttaaccttttgtggaccaagatcacttctatcatctgatgaaaacattcatccttacctaaaaagatgcatataaacatgcccatacaatattatgtataatttctagaggttcctggattccctgcagccctggaagctccaggactttcaggttgcgtctctatgttgaaggggaaagaaacagcttaaataaatgtgatcccattgagttcagtgaatcttttctcctgctgagaagcagtctcctctgtcatgagcatggtaagaactttgcaaaaaggacaaaaagaagttttgttctcattcggagaaatgccagtgcagtttgataggattcttggctcttctgatttctcacttttgtgtcttttgtctgcaaccttttcccagtgtggtagccagttttcacttggaattctcaaatacacagttgtatgtgtttagagaaagatgagtatgagcaagagaatgaggtagttattgtaggggttccaccattaatctgtaaagagaaaaggctagaacagtgaagggtaactatggtcctgcttcacagtggagcctgcaatatcctttcctgatgaaagattagaaagttatctccctgtagtcctttcttaagtgtacccagctgtttaatattttagtggctgaaatgcggtaacaatttcttcttgatattctgttcagtcacacagggtttctaggttgctagtatatatttttacccccatgagactcaataaaatctttctgttttgaatgaaaaaactgtgtagcccataaatagttttactttttcacagttggactcttttttaaaaaaaaaatttctaaatttccagcctcagagaagttattattttgtaatatacagttggactcttttaacaaaaagatctctcatcatgaagtagtagatttgaagaaaaaaagcacattaaatcctaaagactatgtttcctaaaagtcttcccctcttctgccacataaaaggaaggcctcaacttcaaggaaaaagtgtatatataccttttatatacccggcaataaatgaatgattcattacctcaagttttggtatagatgaaaaacagaataattttatttatttatttatttatttttttttttaggtttttcttttttttttttttttctttttttgagacggagtctcgctctgtcgcccaggctggagtgcagtggcgtgatctcggctcactgcaagctctgcctcccgggttcacaccattctcctgcctcagcctaccgagtagctgggactactaggcgcctgccaccacgcctggctaattttttttttttttttttttggatttttagcacccccccccccccccccccccccccccccccccccccccccccccccctccccatccctccactttacgcctcctcacagcccccactcccacaccccccttccacccacccccccccctcccactcacccctctcccctcccacccaactccctccattcctcacctcactcatcccactccaccaccccacctcatctacccacttcctcaccccttccacactcatcccatctctccaccatcccactcaatcccaccttccactcccccacctccaccagcaaccacctctcactttacaccacttcttctctctctcacctcacactacctacctcccatcaaccctcgnnnnnnnnnnnnnnnnnnnnagctggaggtcaaggctacagtaagcagggactgcgccaatgcactccagcctaggcaaaagagcaagaccctgtacttaaaaaaaaaaaagaaagtgaaaaataatcagataggggcttttaccagaagtactgcacataatgtagtagcaaaagcatggtatatagcagattttcaataaatgttagaaggaataaatagcaagaggtagaggtacatagggtaataattggcttaaagtaaggcattatgagttctgatttacatgtttggcagacctcaactagtggttatgaaaattatatgtaacctatgggcaaaataaacagatttatgggccaggtgcagtggctcacgcctgtaatcccagccctttgggaggccaaggcaggtggatcacttgaggttaggagcttgagaccagcctggccaacattgtgaaaccccgtctctactaaaaatacaaaaaattagccaggcatggtggcacatgcctgtaatctcagctactcgggaggccgaggcaggagaattgcttgaactacttgagaggctgaggtaggagaattttggctcattgcaaccactgcctcccaagatcgcgccacttcattccagcctggaaaacagtgagactccgtctcaaaaaaaataaaaaaacccacagaggctagatagatgaatgacagatcaatactattatgaagggaagcaaaggtgttttggagtttatcctaaaaatagaagttctgattaggataatcagccatgccattctaccaaatggtaaagttactgcccctatcattgagtttaccagcctgcttggattaaaacaatctggattgtaaaatgagggcaaatcatactttgtgacttggaaagtaaataaggaaaacaagtaaatagggaaagtaaatagagaaacaagtttccatgaactcatatcatttttagtagtaatagcatatcatttctgagagaggaaaatagtgaaatcagttctttaggaacttgatgggaaacagtggtttcctatcaccatgtgctcagtattagctagtttcgattatttatatatttataggttgcctaggaggaaggtaggcatttaagattatcattaggttcattataaaaatgatgataattcagtaataatgatagatttttattgccagtgttttcaagtatattattttgatgcttgaagccactccataagataagtggggaaaatgtattacctaccttcattatatgttaccttcactatataagttagaaaatggaaacccagggaggttaaacatcataaacaaggttccacaggtaccaagagtcaagatttgaacacagatctgcttgttcccagtctggtacactttcattaacactatgcatgcttcctcctgaaacattttcaatgtatacttgcccataagaagacaatttaatggactatttatttcagaagcacacattactatggtaacaaagccctccctagcaataagatcaccagcacattttcccactgaagtttagattggattatgtaatcactaccaagaggagaataattatcaaaatttgctggcctggtcttcaaagtggttatgcagttccgtgaagctaatgtgcatttttaaaagaaaaagtacttgatttgggcgtcttgctttgtttatgtctgttttcttgtgctgtcccagatttactgggaaaaaggaaaaagccaagcatgttcatgaaaaccacatgtactgtgctattgggaatattttgtcattaagtatttgagggtgtacaatgacagcatgtgtctgttttgagcagaggacaaggatcctcaccggtggccatgcagaaagctcagcaggtatctcagggtctggatgtgctcacagcaaaagtggaaaatgcagctcgcaagctggaagccatgaccaactcaaagcagagcattgcaaagaagatcgatgctgctcaggtagtcacagtgattttcaggaggggtgggaaatatttcataaatatcctaagtcataaatatcctatctttcttctctgtctcttatcatttactgtggttggataatggtttctaagtgatgagtgacttccagcacttaccaatgttaacacctcctttaccaccacaggtttagacaaatgtttatctatattttgaaataaagatcttaatttacagcacttcagttaggtaaaagtaagctctcagagtaccaagggaagattgcagtacattggaactattccttgtcccagaattcacaactcttgggtcattgtaatgtttaggggttaaagttttccgatactgctctactgtaaaatgattttcaagcatttcacaaacacacatgtttgaggaactgaggaactaataaggtgtggttaattcagagatgagataaagcttgggaaaatattttatgctaatgggtgtaaaaaaattgattttaaaaagatgagagattgagtttcttatctaagaacctccatacaataataaagatcagaattataaaaatgattactggtatattacttttgaaatccttcttctggccttgttaagtttagtagaaaggagtgtgtgagtagatcacagcgtgctgcttctccgtttctatgtgtagaactggcttgcagatccaaatggtggaccggaaggagaagagcagattcgaggtgctttggctgaagctcggaaaatagcagaattatgtgatgatcctaaagaaagagatgacattctacgttcccttggggaaatatctgctctgacttctaaattagcagatctacgaagacagtatgtatttaacccttacattgccttttcatatcttttcttctctttctctctcccttccctctccctttctttctttcttcccccaagaacatacatatttcaattcccctaggttaaatgcacttatgatgctcttccactatattctcattaattctaggtcagatgttaatttgctgtatcagtgatgtaactgaggtttaatgatttattgctggtcacatagttataaattgataaatttaggatgctaagaactccttttttgagatgctttttaaatttctaagctagggctttctttgatacatcatgtttatgacctatctgtttcccatacataagaggaaaataatttttgtggctagctatgaaaagactcctatgtgtatatggaggggaagaagcgtaagaatgtactttcctccttccccagcaatgatattttgtaagtagcaagtataggagatacttaaattacatttcctggatgatttttcttgtaacaacagcctccccacagcctcctctcctaaagtctctcatggcacctactttgatgatatggaaaaggggtatttcctctttttttttttattttttatttttatttttttgagatagggtctcactctaccacccacgctggagtgcagcggcatgactatgcctcactgcagctttgaactcccaggctcaagccatccttccacctcagcctccggagtagctgggactacaggcacgtgccaccatgcctggctaatttttttattttttgtagagacggggtgttgctatgttgtcagggctggtctcaaactcaagggctcaagctatcctcccacttcagctttccaaagttttgggattacaggcatgagccactgcacctaactgctttcttctttcaatagatatttttcacttttaagaaaaaaacccctgcagcacatgctaaaataacactaaggaagggtttaatgtcaaatgtaaaagttgctctctatactcttaggacctaatggaagtccatatacatactaggtactctttaatgtttcttaatgatgaagaggtaatgaatggtaatggtgctaacagcagaccttcatgtgtggtcattcatgccatcattacttaatactatagcacacacataaacatacatctatgtaacctcttgccaggagtagccacgatcagaatcatgttaaagaccctctttgttcacctttataaaggagaatgttataaaaatttagaatcataaaggaactcttaagagaatatctaagctgggcatggtagctcaggcctgtaatcccaacacttggtgaggctgagggcgtgtggatcacttgaggtcaggaattcaagaccagcctgccagcctggccaacatggtgaaaccctgtctctactaaaaaaaatacaaaaattagccaggcctggtggtgggtgtgtaatcctagctactcagaggctgaggcaagagaatagcttgaacccaggaagtggaggttgcattgagctgagattgtgccgctgcactccagcctgggtgacagagtgagactctgtctcagcaaaaaaaaaaaaaaaaaaaaaaagaaaagaaaagaaaaaaaagagagagacagagtatctaaattagctgttctggcgcggatgggctattatttttatttatgtatgtattttatttatttatttatttatttttgagacggagtcttgctctgctgccaggctggagtgcagtggcgtgatcttggctcactgcatcctccgcttgccaagttcaagtgattctcctgcctcagcctcccgagtagctgggactacaggcgcacaccaccacgcccagctaaatttttgtatttttagtagagatggggtttcaccatgttgtccaggatggtcttgatctcttgacctcgtgatccacccacctcagcctcccaagtcctgggattacaggtgtgagccaccacacctggcctattatttttatttttacagatgagacagataaagttagcctgaaagttacctttctatggctgagaggacctgagatggaaaatgagtcagattctttgtatttttataatggttagaatttgaagtctttggaataaggtgttgggggcagtttttttctttgtgatataattgtggttgtctttttatttctgtgttgatacttggttgaggttctttggttggaaggacctggtcaagtaaaaagtagaggattattgaaaatagaggcacctcatcaaacccaatagcttgaatgtggccagatcttgggcaactggaagcccctccctccacctcttagtcgctgtgtgggatcctctatgtctgtttcaccctgtgtgttgacttagtttatttatctgggggttttgtctctggctgtgagctaccacggcccaggcttaatcactttccagctccagataccatcactggttgactatgcagtgtttttgaaatatggacccaggattatctgcctaagaatcatctgagaaggtcgttaaaaatgcagaccccttgaccccaccgcagacatacttaattggaatcgcttttgatggtgggtttaacaatctgtatttaaaaataagatctccagtgacttttatccacactggactttgagaacccccagaatctaattgagtgccttgcctgactgtgggtatgttgtccttgaggtagataaccacccagtttaatcagttatggcaaggactggggattatgtgataccaaatgtatagtagtttatgaatgaaggctgggcacggtggctcacgcctgtaatcctagcactttgggaggctgacgtgggcacatcacccgaggtcaggagttcgagaccagcccggtcaacatggtgaaaacccgtttctactaaaaatagagaaattagctgggtgtggtggtgggcatctataatcctagctactcaggaggctgagacaagagaatggcttgaacccgagaggcagaggttgcagtgagccgagatcgtgccactgcactccagcctgggcaacacagcgagactccatctcaaaacaaaacaaacaaaaaaaagtgtggcgactctgaagtcacggtgctgggtttgaatcctgactctatcaaagtaaataatgggacattgggcaagttatccaacctcatacctccattttgtttctttaataatgaggataatactgttatttacatcatagggttgttgtaaggattaaataatataaggcaactgcttatggctgggtgtggtaggtcatgcctataatcccagcacaggactctgggaggcccaggtggtaggatcacttaaacccaggagttaaggaccagcttgggaaacatcgggagaatgtttcctatctccacgaaatatttttttttttaattagccaggtgtggtggtgcatacctatagtcccagctacctgaaaggctgaggcaggaggattgctgcagtgagccctgggaggtcaagcctgctgtgagccatgatctcaccactgcattccagccagggtgatggagcaaaacccctctcaaaacaaaaaacaaacaacaacaaaaaattgcttgtaacagtacctggcagaattaggactcaaaagatagtattactactagtttgactataactgtttcagctgctcctacaacaaacatggctgcctgggcccacccagttccagaggaaactggtgttttcagaggtggcaggcagagggtgccgctaacctagtgatgattgattgagctccgctaaccaaatgattgatctgagctttactgatgcaaactcatatttaatgtcttaactaggacaaaataatctgaatgtaaattattaatttcttatgtaagggccaaataaataaaccactcctttcaaaccaaattaatagtaatcaggagcaatttgtcatcctattagcatttgtcattagcagctaagtgatctcaatgtaaatagtgtttatgtgtgacaggatggctgtctttttctctgtagggggaaaggagattctccagaggctcgagccttggccaaacaggtggccacggccctgcagaacctgcagaccaaaaccaaccgggctgtggccaacagcagaccggccaaagcagctgtacaccttgagggcaagattgagcaagcacagcggtggattgataatcccacagtggatgaccgtggagtcggtaagggcagcagtgcactataacctcattaaattggtctcagtgcaaataagcaagttgttgataggggtcctgtaacatctgtaattaggtaagggttctttagctgctgataagtaactgtgattccatttccaaatgcagccagtaaaattcctgtgatgtaatcaagaagcagaccaggcatggtggctcatgtttgtaatccaagtgctttgggaggctaaggtgggaggatcacttgcgcccaggagtttgagaccagccaagcaacatagcaagaccctctctgtacaaaaataaaagagtaaagaattggctgggcatagtgatgctcacctgtagtcacacctttccagctacttgggaggctgaggtgggaggatcgcttgagaccaggagttccagtctgtagtgagctatgatcacaccactgcattctaacctcagtgacagagagagaccatgtctctttaaaaacaaaacaaaaaagaacaaaattctaagttagttatgcccagtgttgtgaggagttggagaattgggcacatatataatttactggagaaataaattagtacaaactttctaaatttggtattagatgtcaagagctttaaacaaagttcatacccattgactcaggaaattaagggtttcttccctaagaaataattagagatctttctaagaagttgcatacaggaatatatgcatacagcataaatgtttaataataactgacttgtgaaataattattgttaatatgataaaatattacatagattttagatcatgattttaaaagatagtgaaataaaaataaagtgttaaataaaaagaactggctgggtgcggtggctcatccctgtaatcccagcactttgggaggccgaggtgggtggatcgcctgaactcaggggtttgagaccagcctgggcaacatagtgagaccctgtctctctaaaaaaaaccaattagccaggtatggtggtgcacacttgtagttccagctacttgagaggctgtggtgggagggattgcttgagccggcaggtcaaggctgcaatgagctgttgttccactgcactccagcttgggtgatagagcaagacgccacatcgcaccacagaatggcattgcaattgtctcctctgggtcttgtaagtttcattgtttttctcttggtccaggtcaggctgccatccgggggcttgtggccgaagggcatcgtctggctaatgttatgatggggccttatcggcaagatcttctcgccaagtgtgaccgagtggaccagctgacagcccagctggctgacctggctgccagaggggaaggggagagtcctcaggcacgagcacttgcatctcagctccaagactccttaaaggtagaagtcaggagcacatatcattttactttttatgcttcctattattgaaagacgagggaaggaagagagagttttgaaaaatacataatttctggggtctagggaaaatgaaaagagtgtgaccaaagatataaggaaatctagagcttattaggaaaaagcttgctggtatatagtagcaactaaatttgtgttttccaaattccactcagtcaagagcccttttgtgatttttgctctatccacatatcatctgtacttttatttagccaatatttttcttaaaatggacttctttttttttttttttaaatggacttctttttaaaacttaaatttatttaagagaaaactctgtgggccgggcatggtggtacatgcctgtaatctcagctacttgggaggctgaggtgggagaatcacctgaacctgggaggcagaggttgaagatcacgtcactgcactccagcctgggtgacagagcgagactccatttcaaataaataaataaataaataaatgaaagaaaactttgtaatcctgaaatcttgggtttgataagctagttgtattttttctattatcctttaaaagaaacacataattattaaaataaaaacatttgcccatgtaacacctaaaattatctcaggtatcaccagctagtttatgctgcccaccttgcaaaacaatgagggtgatggagacttctttgtatatatccagaaaacttaaattggattaaatgtgatgactatgaaaaagagcttgttcatggcttctaagaatactcttatttagacccatgttgagaaattgatacagatatttgttattgagtttttctagaaaacttaattgaaagaacctggattaaaaaattcccattcttgatttctttcctcttaagacaataaattgcttagaatttggcactacatccaccaaacaatccttacagttactgtgatcgttatcaggccccgccagcactggcaatggtgtggaactctagcccatctctgggccttctttgggctcaacctcatgattctcagtatcatttcatggaggccaccaaaaaaggaagtagggttccttgattgagtggaacagtctctagggacatgtgggtcatgtcttatttctactacaccactaatgtcttacagggcaggattcataaattacacctgttctgtgctagctcagtgctttgtacacagttaacaaatatttattgaatgaaagactgaatagatgaatgaatgtcagtgaagtaagggcattagtagatatgctttgaggatgtatctggacattttcatatgtaaacaatgtttttaaggatctaaaagctcggatgcaggaggccatgactcaggaagtgtcagatgttttcagcgataccacaactcccatcaagctgttggcagtggcagccacggcgcctcctgatgcgcctaacagggaagaggtgggtatctgaggtcttccatttttctgtcagcctgtgctataggtatatgtaaaggtgaaatgtgattacagtggacatcaggatcagtggttgggaaactgtagatgaagggtggaagagcagaacagggaaagccctaccacctctacttttagtctccacgtatatcagtgaggaatatctttagttgcaagcaatagaagacctgaccatcagagatgaaaacaaccgggtttgttttcatcacaaaccaagaaacatggaagtaggtggctttggcattggttcagcagctaaatatcatgaaagctggcatttctatgattttctaggtcattttctcagggtgtgggatggcatcatgttaaatgcaggaagaaatgaagaatgggggtactccagtcacaactgtgcctttcgagtcaggatgatctttttaaatcaatcgatgtcattcttatactcagacccttccaatgactccccgctatcccagagtaaaaccagagtgctaacaatgaagaaaattgccagcgatgtgctggtaagccaactctccaggaaaacgaaaaaccttgatttgtaatgtttgttgatttccattatgtaaatactcccacggtggctgtttcaacatgaagtcactgaaacctgagttgggaagagatggacatgtttcgctcctgtgagctggcacgagtcggtacaggtggctttagcacaccactggatctggtccccatccatttctttgctctcgtgtggtaccactcttccccctcatgctacatctgtatgtacctcccttgaattgtattcctagtgtgtatttatatgttctaatcttggggcctttgcactcgtttgttccagtcttctccagataaccatatctattagttactgtctttcttcagctttctactgaaatgtcactttcgggtgaccactaagataacaccaccaccccaactactatccccatggatttcttcatctccatatcctactttttcacttagcatttatcaacatttaatgtatttacccatttttcatttttggtttgtctgtctccctcccactaccatgaaagctccatgcagggagggactttattctgtcattgccttattcccccttcttggaacagtgcctgccacattgttggtgctgaatgagtgaaaatagaggctttcttagaaattgtccaggagagctttgctatgcctcattggcttgaactctgtctcatggccaccctagctgcaaaggagtttaggaaagcaagtatttggttttccagcctttatagtattggcagcgaatgagaaggggtttgggtcaggtacccaagacagtgtagaactggtaggtggaggtttttgttattatgtgctgattaccccagttttctttctgtaacctgagttactaggcagttcagctgattgttcccttaggctgagatgatttgctatttttttaattccagacttctctttcaggctagtagatacatctaggtgggcctctccacctacagtcttcctagttacctcagcatatgttgtccttctgttctctctcagaaatttgtgagttgtcattgacttttcccttccccacacccgttcatacaaataaacaactaaggcacactcatttaatctcacatccattttctgttcatattgccagagctctaattattttcctagtcccctagtccccctagagctatgactgcatagctctaactggtcttctttgactctttcactaggccatcaatcaaataaaaatacaacctgactctgacattctcctgcttaaacccttcagtggggcctgtactttcacagaggataaggccagggctctgtgatctagctctgacacttcccatacctgtttcctacaaacccctccctctcatttctggccctagctatacctagttgcttgtggtttcctgcacagtctgtcttttccatgtctttgttttttctgtgtaattatcttccccttcttttttggtgaattactatttatccttcatcctattatcctttgtttcctagagaggttaagtgctttttcttttgctcctacctatagtatcagtgcttagctctattattgtacatagcacactgtattgtaaatctgttttcgagtgcttttttctcactgggctgtgagttccttgagatgaggatattgtgttttactcatttttgtgtcctcagcacctgtctcagggtctggcacatagtaggtgctcagtaaattttggttgagtgacgagaaaagcaagttaagcagttagttaaatcagaaggagcagcagtcatggtctggcattgagatggtcaaccaaggatattaggtaggtaaaagcccaggagatccagagtgtgggagaccagctagggtaaaagaactgaggccacgggaaggaggctaggagatcagggattttaggcagagattctcagcattaaatggcaggaacccatgtagttaaatccaaacaagaggctggcgtggggaagagacttgagaagatagacacagaacactggcaatgatttggaacctgctattgaaccaagagacctttagagattgtctagagccagaactgatctccaagttaggcagaagttgacaaaaaagaggacgcattccactaggcagctccagacatgttcgtgtagtgtataaacctgacccagtgctgttgggaagcatcagttctaataatgcagtaagtaagtaactgaatgtgaagactaaataaaccccattctccaaagcttatcttctagtttgaagaagataagcttttgcaagaatctattctaacaaatgaccaaagatctcttgctactttaagtttaatagtcccctccacagtatgcaaccttgcacagtatccctgttaaaggaaacattaacttttttagaatttgagagctgaatgaacaattaagtagatgattttgcatttggggttaataaaagtcagtcatccttgccctgaggcctgagtgtgagcaccagctatcatttttcccttggaggtcaatggcagagtttttacaacattaatggtaatgggatatatgaaggatgctgctctggggagcctggagctcaatttaggactgtgtggatgttctgggcttttaatgtacccagctgcctacaatagagcctggagtgggcttgactgtcttcttcaaactagaagataagcttttgagaatgggggttgtttagtcttcacattcagcaaattactgcagagtatataatgctcctgcttgtacctggtaagcactggttgaactggaaatgaaggttatgtgcgtgtgtgtgtgagtgtgtttgtgtgcatttgcacatgatggtgatggctaaacgtctgaggagatccatcaaggccaggatttggagtttgactgttgttttattaactagggtttgatgtcatctctaaagtctttgagcagttgctgcccttcttaaaggatgaaactttttcttaggctgcctgacccattttattgaaataaatgttcttaatatctgttttttcctcaaggtatttgatgagagggcagctaactttgaaaaccattcaggaaagcttggtgctacggccgagaaggcggctgcggttggtactgctaataaatcaacagtggaaggcattcaggcctcagtgaagacggcccgagaactcacaccccaggttgggttttgctcattcctcatacagtgttcagtaaagaaagttaattacagaacagtttctatacatttttgaatacttaccgtaagatggcataaaaaaacatatacaggccagcacggtagcacctataattccggcactttgggagggtgaggcgggaggactgcttgagcctgggagtttgagaccagcctgggcaatacagcaagaccccgactctaccaaaaaaaaaaaaattagctgggtgtggtggcgcatgcctgtgaacacagctatttgtgaggctgaggtgggaggattatttgagcccagaaggttgaggctgcagtaagctttgattgccccactgccctccagcctggggtgacagagcaagaccctgtcaccgtctttatacattttcataacatttgaatttttttttacaaggactatttattagttttttttttttttttttttttttgagacggagtctcgctctgtcgcccaggccggactgtggactgcagtggcgcaatctcggctcactgcaagctccgcttcccgggttcacgccattctcctgcctcagcctcccgagtagctgggactacaggcgcccgccaccgcgcccggctaattttttttgtatttttagtagagacggggtttcaccttgttagccaggatggtctcgatcttagttttgaaagtagaaaaaattagtaaagcaatccccttgccacatacacacataactaggaaaatatttggataatcttttttttttttttttttgagggacagagtttcgctcttgtcacccaggctggagtccaatggtgtaatctcagctcactgcagcctccacttcctgggttcaagtggttctcctgactctgcctcctgagtagctgggattacaggcacccgccaccatgcccggctaatttttctattttttagtagagacagggtttctccatgttggccaggctggtcttgaactcctgacctcatgatccgcccacctcggcctcccaaagtgctgagattacaggcatgagctactgcggccggcttggataatcttaagaggctactttgttttgattttggagtttatatcttttctccacatctttgtgagagttttttttttttttttaaattgatctgtttctataactttcttttttctacttattgtgtaacaaggcatggctagtaagtttgggagcaaaggaagattgggaaaaaaaaccaaactgtacagttattaaaagtttactatgtgataggttttcttaaaaatattagctcaacattatttagtgtgatgtttgtgcaatttttcttctattcaaattatagaaaattcattattttttcatttatttattcagacatttactgagtgcctatgatacattcgaaactatgctaggctttataaatttgtgatactggcttatgtgtgaacttgtgaggagatatgggggaaataaacatgtctctgaatcattaaacttttgcctgtgtggcgtgttaataaattagatcctcttgtccaactttttaacttgtccaacttttacacaatttttcataagctacaaacatgtctaacactctttaaaagctcccataaaacatggaacataaaatacaatttcaatatgaaactgagattcctaaaaaggaggaacaggaatctaggcttataacaccaattatagataaaatgaggactctggagacagatttggacttgagacctctgtgagtttttttttttttccgagacggagtcttgctctgttgcccaggctggagtgcagtggcatgatcttggctcactgcaacctccgcctccggggttcaagcgattctcttgcctcagcctccccagtagctaagattacaggcgtccaccaccatacccggctagttttttgtatttttattagagatggggtttcaccatattggccaggctggtctcaaactcctgacctcaagtgatccacccgcctcggtctcccaaagtgctgggattatgggtatgagccactgcacccggccgactcctctgtgctcttgatgcttagtctctcatctgtaaaatggagctaactccttcctaatggactctatttggattaagaatatgcatgtacagcctgtatcttaccagatacgtggcaaatgttaatccttttttccccaaatgctgtaactgactggccaggacctcttgagcagtcacttaaattttctgagacttggtttttgcatctctaaagtagagatattaactgtcctgtctcatggggttgttgtgaggattttttcttcatattattcataaatcagttttgagtacttttcggtatccttcttaatggtgatttttaagatggaagagttgacatcaagtgtttaaacatatgccagttttgtgtatgttcttctgaagtatcaagtggacactcatttactttgtcactttattaccttcttaaaatcaggctgtgatggtaaaaccttcctgtgaagggcccattctggggagctgtttattgagaccaaacctcatgtattcagcctgaaaagagacttgccactttctggctttacagtgccatctgtaggtaaagaggagaaagcttggctgaaggtttgtatctggagagcaagggtgctctggtgtttaaaggtgttttgtcattgtcaggtggtctcggctgctcgtatcttacttaggaaccctggaaatcaagctgcttatgaacattttgagaccatgaagaaccagtggatcgataatgttgaaaaaatgacaggtagagttttctatacaaatcttgttgtctaatccatgaagaatgagttctgagaaattggagcgggactggttctgttactcagctgtaattggataaagggccggtcacgtgctgagcagtgtacttggctctgcttaaggctgctgagcagtggcggcttctcattcaagccttgcaactttgtcagaagagagactctttgagtctcttttattttaatgctgccctcctggcgtgatgtttattgtcaccactcctatcttctctttgaatagtgtctttgcccagtccgagcccgagtttggtttcagaggctgggaggcggtgtttgtggatacagtaagtgtccctgtcattttcagtgggttcacatttcaaggaaccacaatagctaccatttaatacaacttgtctcaaagtttcctccaacttatcaactacgtagtttttttaaaaaggagaaaccaaccaccagcaaacctgtgtctgtgcaattgaagtggcacctctgaatcgtcttcattctctgtaaagggagagataggaaagaaggaatgaggaatgtaggctttttgctgtccctgcagaacctgctgtgactggggtccatggcagcccgagatgaaagtggaactcctgaggtgtctgaagagaggtaacaggaataagaaataggctgttacggttattggaatcctccgcatggctcatcttgagcactacaagctgccaacaagcaacagatggctggggagtgagagggacagggagaaaatattattcacagataacgtggtggtgatgcagtgatggtttcagacatattccttgtttcctcccgatgttgcatttctggttgtctggggtggatacaagaaggctggcaaccacggttggtataaatgctgcaaatccagatgggcttttgggctatgtcctcactgttttttttaactgtggtgtttacctggaagcttttgattatgtaggaagagtttgagctgaagaagagaattctggatgttatactttctcatgagaagtttgagtggataacagtgttttggagtttctgttcttctaaattgaaactaaattccatttctgttttcctaacagggctggtggacgaagccattgataccaaatctctgttggatgcttcagaagaagcaattaaaaaagacctggacaagtgcaaggtagctatggccaacattcagcctcagatgctggttgctggggcaaccagtattgctcgtcgggccaaccggatcctgctggtggctaagagggaggtggagaattccgaggatcccaagttccgtgaggctgtgaaagctgcctctgatgaattgagcaaaaccatctccccgatggtgatggatgcaaaagctgtggctggaaacatttccgaccctggtaagcaatgcatggcactatgtctcacctccactgagaggttaactcaggaaaggtcgtgagggaatatgtaccccacaaccaccacatacaaagtctgggggcaaaaactatagacacttagtttgagaatgctagattaatctttttccatccaagtctctgcagttatcagcaggcttgttgtatgttagtttttctggaccaacttctctgtgctttcttttttttttgagactctcacccaggccagagggcagtggcatgatctcagctcactgaaacctccaccttctgggttctagcgattctcctacctcagcctcccgagtagctgggattacaggtgtgtgccaccatgcctggctaatttttatgtttttagtagacagggttttgccatgttggccaggctggtcttgaattcctgacctcaggtgatccacccgccttggcctgtcaaagtgctgggattacaggtgtgagccaccgtgcccaacctctgcgcttttttagtgctgggattacaggtgtgagccaccgtgcccaacctctgcgcttttttttttttttttttttgagacggagttttgctcttgttgcccaggctggagtacaatggcacaatcttggctcactgcaacctccgcccccgcctggattcaagtgattctcctgccccagcctcctgagtagctgggattacaggctcccaccaccacacccagctaattttttgtagttttagtagaggcagagtttcaccatgttggccaggctggtctcaaactccagacctcagttgatccacccgccttggcctcccaaagtgctgggattacaggcatccagcctgtgctttcttaatatggtctggctaaatagctcctcgccttgttcagtcattattttggaaaattttcaaaagatgcatgataaccaatttaccatccatttagtttatgtaactggtgttaacttctcttgggcttttcttaaaatgcttttttttctttgtaaagcattctcagtttctatcaaatctggagggcttaagttgatctgtgggtctcctaggccctacacctaaagaaaatctgggttttctttaggtgaattttgatcatatttttggtactaccatggcagatcataattggagccgctcctttggttgaaatcatctgaattccttcctgttttgaacatctgatgttttcagtcttgtctatgagtagaatgcagtcaatgcaagagagtaggaaggaggggctcccctattcatctctggttcaggcagaatctttctaatatccaaaacccattatcactaaggacatgcttggtttcctaattggagtttctaatagtagagtagattcctgaattccaggcaactgaacagagtagcgcagctcagcataagggttaacatactgaatgccaaggacagcaaaggagtagagagaaaggtgagaagtacttcagggaatgtatgtccaatctgaaactgacatctcccatgttctgagttgggcaggcttatctcttgactgcctcatcataagagaggtgatggatgccacctgagcccaaagtgttcatgcccagggatctcctgggtactttttagttgtacagccaagaaggcaccctgaacactaaaagaacagctggtttgtgatgcttccaatgctctgcaggcctcagggcatctgccttgtcctgcctccccccttcttcaatcactgcccgtgatatttactggcagcttcacatccagcttttgttcatggaaccagttctgctgctgcaaagacagtgctttggggcactgacccacccagctgaaagtgaggatgtcttgtgtttaggactgcaaaagagcttcctggactcaggatatcggatcctgggagctgtggccaaggtcagagaagccttccaacctcaggagcctgacttcccgccgcctccaccagaccttgaacaactccgagtaagtaaattcagatatgcagagaattgagcaggaaggtgttgagacttcagcaagagagaggtagattgtgttttagagcctccatcactaggtggcttcgtttagctttcatttgaagcttagtgggaggcagatctcgattttcattcctaaatccagtggagttataacctagtgcttatatgcatgggttgtgtgtgtgtgtgtagtactggtgtgtgtggtagtggcttgctgtgatggggagcggctggagcagaggagctggctttggtaagtgtggatgtgatgagtgatgaggtagtgcattgtggtaaaataatctgcacagcttggagtaaggagatttggtgtgttcttagttgataatggtagaaccgaggtggttgaaatcttgtgttggttctttcctttatttgacttttttttaagtaacaagatacatgcttttaaaaaatttttccctaactataatttaagatctttagataccttccccactaccccccgcaagtactgtgaatatatttttacatggtgtaggaagaagctagctaggcagtatgttgcagacacaaattccagaaacagaaatagtgattatttctagacacttattccaactaacagtattagaaataccttgactttgtaaataacttatcaaggcaataatctgatttactttcccatatttaatgtcagtaaaagatgttaagtttttaagttggttgagtacaaaattgtgtcatcgcacacacagctaaggaacagtgtttcccagccttcaacgcatcttagattcttcccagctgggtgcttggtgggtgtttagagctgggagagagggctattcctgggaatggcttcttatgtgagcaacagagttatgtcatttagaatctggatcttagaggtcatttggtctagctacccctcagtgacagatgaggaacctcaggccaaggggagaagttacttgcctatgtagctgctttttggtagaaccaggaccacaacttacatcttctgtagggactttttgagaatccttcatctggtagcactgtgtatacttccctgggatgcaaccaaaacagtagctgcaagccttttttttttttctttttttcttgttttgagatggagtcttgctctgtcgcccaggctggagcgcagtggcatgatctcagctcacggcaacctctgcctcccgggttcaagcaattctcctgcctcagcttcttgagtagttgggattataggcacatgccaccatgcccggctaatttttgtgtttttagtagagatggggtttcaccattttgggcaggctggtctcgaactcctgacctcaggtgacccacctgccttggcctcccaaagtgctgggattataggcgtgagccactgcgcccggccactgctagctttttgtagagaaacctgcttctgttgagattgaagcaggtggtccttgtggctcagtgtgggtggtcttatgtggagtcaatatgggtgggttttctagggatgctttttagaagaaaggaaagaattccaggggggagtagttttaggactttacttacaacttgttttctcttttttagctaacagatgagcttgctcctcccaaaccacctctgcctgaaggtgaggtccctccacctaggcctccaccaccagaggaaaaggatgaagagttccctgagcagaaggccggggaggtgattaaccagccaatgatgatggctgccagacagctccatgatgaagctcgcaaatggtccagcaaggtaagtagtgaagcttttcttgttgagaaaggatgtcttctcggaaaggatgaaggaccatgaaagacccagaaagaagagtctatttggagtcaccctctctctctcctttggttcctgtgttgccaatagcatattcctcttcttacctgtgctttagtgagatgtttctgacacctgatggtttctccttcaagcttgcaaaagccagagtcagggtgcctgtgatttgagaagaggattcctgtcctttgtccattagagtgccaggtgccttgaccttagcatttggggtcttttagaaattgcttatctttcttggaactgcaaatgtttttagatgctacattgctaatgatcagagctccaaatatgaattgtgtgggctgtgctaaagctagatgaaatgtttgcattttctttttttttccacagaagcaagtagattggtatcttagaagccatgtgcttttgtcctttctcagaatcatttcacctgtcaactcaagacagctccaggctgtctcttactcagcaaatctgaaggtgtaaatattaatgtggttggtaaaaatatggatgctacagcagtcttgccctatgaataacttttgcctattttcccctaaatgatgaaaagtgagcagtagcttttctagataagaggaatattattgctaaccctgcagtgaaaggtagctcttagttctaaactgtttctaatatgaccctagatcttttttttaatgtttttatgaccctagatctttattcccaccacctatttgcctttattctttacacatcctcaaagctttcaagctcttgtgtcgattgtatttcctcagggacctcctgcacctgcagctgatcttggatttttttcaggctgggaaattcacattggtttttaactctgtattttgctgaactgttagctgtgagcccaggttctaagaaggaagggagactttgctggtgttggacctgacctgtagaattatttataatggtatctctccaactgcatgtggcagagccccactgtgcatggggagtgggggagggtgacagtgaagattttaaaggaaatttaaatttcattacaatgaaccaaaatacactatgcagaacaaaaaatatacatgaattatttaaaaaaacaaacaaacttaaaagcagacagcattggcccacattacttgccccactctgccatttgtggccagaagtcctgaggtctatctcctgaagtgtgcaagatcaggagtttgctgactttgagttgtgtgaagtcagaagctacttgaaccatgtgtgtactgggctggggaggaatatctgttcgtgtgtctgtcaacctatctgtctttgtacactgtgggactctgagccttagcagcagtgagctggcttttcttctgagcagcagagatgggtcttggttgagtttaggcaaaagagtttagatggtatctgaaccccttgttggccctgaatcctccaacatcgtcaccctttggagtcaggtttcatgtgcaggttaagacttttaggagtggtaacaacctcaaagaaaattccatataaactacttcctcttgagtacagatgtttgatgtaaagaacctgtattcatcattctttgtataaatggtttggcttcattgtggcagtttttaattttctttccatgttagtctattttcagcatctggcttttataatctccatccctggttctaaattcatgttctctccatcatgattctcattcttaaatgagcaccattcttctgagcttctgtgagctcagctgcagtcacttgccaagttcacatattattctatctgtgaactagataagcagagtttggggtgagtgagaacctattttgcaagcaatttaggttgtacccaaggagaagctttctgaggtggtactagcaatggatgcaaaaagagatggtagaagctttgcctcagaagaccttgaggggatagagagctggtctgatgtgtgggtgttccctgagatgggcggctgacgaggtggcttcttgaggctccttacagctgggtgacagtggggtacttaagttctcttcagtcaccattgtgtttgtttttcctgcctctttcctagtttggtattcgttacctctgatgtatcatttttaattctgggacttttaactcatgaaggaaataatctatgtctggcagctgcagagctgacccaaattgcctcctgtgtcccaggaaaatgtagaacagtgaccatatgatccagcagtgttcactttgttctgtacaaagtaacttgtgtggctgcatttactttttctctccggattccttttaaaggtaatttgctactatcgtttggttgtttggctcctcagaaatattctcatgtgagaatcactcttgtcaagtttgactttagtatcaagtatattaaagaaatggatgccacttgctttcttggtgtaaagatttctctagaagccctttgccattggagtgagtcccttttcttctctcaccacacagtggcttgggctgagtggcgctggaggctgagaattcccccttctgtgaagcttggtacacaaggctcctagagaacatgtttctttctcatcctaggcaggctttggttactaaaccagctgaagcccagtttcccaagtcgtattgctcttactaacactatccctatttctcatccttcccgccatcgacaaagccgggcatcccagccgctgaggtgggtataggtgttgtagctgaggcagatgcggccgatgctgctggcttccctgtcccccctgacatggaagacgattacgaacctgagctgctgttaatgccatccaatcagccggtcaaccagcccattctggccgcggctcagtccttgcatcgggaagctaccaagtggtctagtaaggtactgataagcacccccagttgggggctgctccatatgcatccggccatgtgcagccttgacacattgcatcactcatgatctgtgctggtcctgtgagtctgagcagggcgggcatctgtctgtctgcaccatgttgttaggactggcttcacaagtttgataggtctgctaacgccagattaattggactgcatttatgtttaggggatgaagagagatggggggggtcacttttggaaaggattccttttcttactgattttgtggccatcgctggaaaccccttgggaagccgtgaatgcatctctcaatgacttccaggtcaggaaccatggtagaccattacgaggtcacctggcctgaccattgagctttgcctgctcccaactgacccctcactgatggctcagggagagttgatgagggggagaggcagctttatagggcagggtctctgggggaggactgcttgctgccctgcacttggctatgtggcagatgctggccttgatgggagtccacagaaaatggggcctcactgactgcttgtccaggtatctcagtgggagggaatgggagtgggaaatggagtactcaaggccacaagacaggccgccatagaactttggccttggggaatgaaccaaagctagtttggagagtagggtgattggggtgatcacttttccctttaaaggtggcatgctgcaagaagaaaggctttgaagagtgatgggtagtcactaaccatggcactatgctatcttctaaccaacgtgatggggtcctggaatgatcctaggtctgcactagaagaggtagacccagaggaccttgtctaacataccccttgcttcttgacttcttcccatacctgcgttctctccggcctcaattactgcctgagatgttacacccttccagcataaatgatgaaccgcttcatggtgcctgtagaggcctcttgcagagcaccctgcagtggtatggtttgtgtatgcctcactgcactgtagagaaatgaagagcatgaggggaaaaatgagtagggcctggacttttagctagttttgaacactgcagttgctatgacttggggttgttagcagccaaaagaggagctttcatgagagggcacagaatacataacttgtctgtttctttactatgacccatgagggttttagtaaaccaaaatgccaagtctaagataaactgccattccttggagtgagggttccatttacagcctgaatcacgacttttattttcctaatgccttctcttgcatcctcttagctgaaggttcctttaactggagtcttcacttagctgaggggactgaagaattgattctttacccttttacgtgggaaaaattaaagcaacatgttcgttcaggctgacaggacaaataagaggcagtagagggatagccagagcaggctagatcagaaaatatcttttttttttttttccctcacccagctgagaatagttacttgggtttgaaattctagttaagtagcaagaacgcttggctgctatttgcaacaagggtaagcatgaagagggtgatttcagcatctggaaaggctcctctgtatttttcccctcaggccagctctactgctttctccctatagaaatgaaagtgcctgtttaaccagctccttggccctgtccccagtttattgatatgattaacctggagatgccaaagtgcttgttcagtgctgtgcctggggtgcacatcttgccctttcagactaatatctgggtcttccttttttttagtcaggaaatgtctctctccctctcctttccccctcctctctcctctctctttgtttctcacactgagtgcttgggcgagtgccctgtctcattctttttttttcttccagtgctatccgtatcactcaagaacggcccttttctcctcttctcacccttccggagggatgctaaggtggcaagctccctcctcttctctgtgcttctccttccttccttaacatggccagagcgtgggcagagctcacactgtatctttgcttccctctagggcaatgacatcattgcagcagccaagcgcatggctctgctgatggctgagatgtctcggctggtaagagggggcagtggtaccaagcgggcactcattcagtgtgccaaggacatcgccaaggcctcagatgaggtgactcggttggccaaggaggttgccaagcagtgcacagataaacggattagaaccaacctcttacaggtactcggggaaagaggctgcgtgtgtgtgtgtgtgtgtgtgtgtgtgtgcgtgtgtgtgtgtgttggaggggagggtatgagagggagaaaagcaggagagaaaaactaggtaagggagaaagaggcacttcaccggggacagaaatagcagaaagggaaaaaaacaaatgtactgggaaagacagattcaggaaaggttacttcctaatcaaatgaatgcttccatttctggagaaatggattgtactgaccctaggggaaaaaacaagtggaattctgctgcttatttatcgagtgccttttctgtgccagccactgggaatacagaggtaggtaagtcttgccttcaaggagcttgtgggcaaggcaaacagagaaacataccaaattaaactttctctttaggtatgtgagcgaatcccaaccataagcacccagctcaaaatcctgtccacagtgaaggccaccatgctgggccggaccaacatcagtgatgaggagtctgagcaggtatgtggcagctgtttttggtttctggctggcagcttctgtgccgttttgcagtaatttaactctgctttggggaaattttaccccttaattgagtatcgagtattcagtatgtgggatgcactcagactgtctcaggaggggaaagtctgtgttggatagatacatcagaaatttggaattggggccaggtgcagtggcacatgcaggtaatcccagcactttgggaggctgaggcgggagaattgcttaagcccagaaggtcaaggcagtaagctgtgattgcaccactgcactgcagcctgggtgacagagtgagactcttgtcttgaaaaaacaaaacaaaacaccaggaattgggagccaggtgtggtggtgtgcacctgtagtcccagctactcaggaggctgaggcagtaggatcatttgaaaccaggagttgaagactagcttgggcaaaatagcaagaccccatctcaaaataaatagataaataaataaataaataaataaataaataagtaaataaaaggaatctggaattgctcttgggcaacttttgtcattttacagataggaaactgaggtctagagaggttaagtgtctgaaataacactatggatcagtggcagttaggactctactcagttccttacccttggaataagtttggctcttttgaggcctccagtgcctgttcatttcaactcactgtatgtttctggctggagagaaggtccgctttccagctctctgtgtgttagtgcctcagggaggatgaatagtgcaggcttttccggggcatgaggtagttaggcctgtgctgaaactgaaatgacagctcaaaggaggtgcttctcttatattctctttaggtttctctgatagagatagaaataaggatgctgagaaggttctcttaaccactgcttcctgcatataccttggcagtcacccaagtttgtcctccttcccaaaatcttggcccaggtctttcaggaaaccctcatttgagcaccccttactctccttatttcccctccgggaggccctgctctaagcaagattcccacatggactgcccacacagggctcctcacacatggggtacatagttttgttggactagccacacgaggctcatcacacatgggctaaggtgaagcactgtattaggtgttaagggagtttaaaaaattaagagacacaattccccccacccaacgtggggaactcaaaaatagtctgaaagaacaactgtttctgatctctaggccaggagatagggcactggggcactttagaggaaataaggcggccattcttcttggtgccattattgttgcttctgctaccatattctaatccaacaactctcaccctaatcctctcttctcccaaaccatgggaactgtatcttcacacctaacttccacatattctatgaagggtttgcacacttcgctgtttctatgtcatgtgatctcttctgtccaaagaaaggtggaaaaaaatggggaaggaagggtaagactgagattcaggcctaatcagagacttaatcaattaaccactaaaaatatgccttgagaatatctattatgttccattaaatattccagttttaaaaagggtagaaattgacagtatggtagaatggaaaaaacacaggactgtttgggaggctgaggcaggagaatcgcttgaacctgggaggcggaaattgcagtgagccgagatcgtgccattgcactccagcctagttaacaagagtgaaactccgtctcaaaaaaaaaaaataataataaaataaaataaaataaacaacaacaaaaaacaaaacccataggactataagtcagaaatcctgagtcctaattctcactctatgaatgtctctgggcctgagtccctttgctgaccaagtgaaaagaacaactgatgaggaattccagcccacagttacacttatcagagcctgtgaaactgagtgtacaaattttatgcaggtgtgcattttttctgggggagaattcaccgccttcattaaatcctcaaatgatgtatgacttaaaaatagccaagaattactgagctgatgaattgccaagatccttccttgactttctatggtagagtaccaatgtgatttcagtcttataagtttgtgcgtttgtttgaaagattaacgtatttagattttcatgggtttaaagtggttggttgcttggtttgttcatttggttgtttttaaaattcattaattaaatatttatgaaatacctcctgtgtgccaggcaccatcctaaatactgggggtatgacagtgcacaaaattgacaaaaatctactctgtataacttaaatgttagtatgaagacagaaaaaaccctcaaaactcccaaacaacctaggtaaaatacgtagtgtatcagttcgtgatgataggttcaatggaaaaaataaggccaagcgcggtggctcacgcctactgtatgtagtcttagcactttgggaggctgaggtgggcagatcacttgagcccaggagtacgagtccaacctgggcaacatggcggaacgccatctgtacaaaaaattaaaaaattacccagatgtggcagcatgtacctattgtcccagctgctcaaaggctgaggcaggaggatccttgagcccagggggcagaggctgcagtggccgagatcacaccactgcactccagcctggatgaaagagaaagaccccatctcaaaaaaagaatgagcagggaaatcctcaccaaggtgacaagtgagcaaagatctgaaggtgaggggatccctgggatccctggggaaagagcagtccaggtacaggaaacagcaagtcctgagggagaagcatgtttgaagaccaagaaagaggacatgctgtaagctatctgaagccacagtatacaatcagcgatggccagttttgggttctttttggtgatctgggaaaacccctagtgatgcaagcaaatatgggggatgccaggtaccagtggggttagctgcatcccactcctggctgaaacctattttagagacaggcctgcatcagggaccctgggtaacggaaagtacctttttccttgcaggccacagagatgctggttcacaatgcccagaacctcatgcagtctgtgaaggagactgtgcgggaagctgaagctgcttcaatcaaaattcgaacagatgctggatttacactgcgctgggttagaaagactccctggtaccagtaggcacctggctgagcctggctggcacagaaacctctactaaaaagaaggaaaatgatctgagtcccaggagctgcccagagttgctgggagctgaaaaatcacatcctggcctggcacatcagaaaggaatgggggcctcttcaaattagaagacatttatactcttttttcatggacactttgaaatgtgtttctgtataaagcctgtattctcaaacacagttacacttgtgcaccctctatcccaataggcagactgggtttctagcccatggacttcacataagctcagaatccaagtgaacactagccagacactctgctctgcccttgttccctaggggacacttccctctgtttctctttccttggctcccattcactcttccagaatcccaagacccagggcccaggcaaatcagttactaagaagaaaattgctgtgcctcccaaaattgttttgagctttccatgttgctgccaaccataccttccttccctgggctgtgctacctgggtccttttcagaagtgagctttgctgctacaggggaaggtggcctctgtggagccccagcatatgggggcctggattcatttcctgcccttcctcagtttaatccttctagtttcccacaatataaaactgtacttcactgtcaggaagaaatcacagaatcatatgattctgcttttaccatgcccctgagcaatgtctgtgctagggaaacttcccgtcccatatcctgcctcagcccgccaaggtagccatcccatgaacacactgtgtcctggtgctctctgccactggaagggcagagtagccagggtgtggccctgccatcttcccagcagggccactcccggcactccatgcttagtcactgcctgcagaggtctgtgctgaggccttatcattcattcttagctcttaattgttcattttgagctgaaatgctgcattttaattttaaccaaaacatgtctcctatatcctggtttttgtagccttcctccacatcctttctaaacaagattttaaagacatgtaggtgtttgttcatctgtaactctaaaagatcctttttaaattcagtcctaagaaagaggagtgcttgtcccctaagagtgtttaatggcaaggcagccctgtctgaaggacacttcctgcctaagggagagtggtatttgcagactagaattctagtgctgctgaagatgaatcaatgggaaatactactcctgtaattcctacctccctgcaaccaactacaaccaagctctctgcatctactcccaagtatggggttcaagagagtaatgggtttcatatttcttatcaccacagtaagttcctactaggcaaaatgagagggcagtgtttcctttttggtacttattactgctaagtatttcccagcacatgaaaccttattttttcccaaagccagaaccagatgagtaaaggagtaagaaccttgcctgaacatccttccttcccacccatcgctgtgtgttagttcccaacatcgaatgtgtacaacttaagttggtcctttacactcaggctttcactatttcctttataatgaggatgattattttcaaggccctcagcatatttgtatagttgcttgcctgatataaatgcaatattaatgcctttaaagtatgaatctatgccaaagatcacttgttgttttactaaagaaagattacttagaggaaataagaaaaatcatgtttgctctcccggttcttccagtggtttgagacactggtttacactttatgccggatgtgcttttctccaatatcagtgctcgagacacagtgaagcaaattaaaaaaaaaaaaaaaaaaaatccctgaatgatgattagagacatcaccgctaaaaaactacatttataagctaggatttgttatatgcaaatattttctgcctcttcttttgttctgtttaaaacaataaaatgcatttgtataaaaaatgctttaaatgatggatatgttactttagcaagaacttttaggtcaggtttctcctttgttttgatgaatagtcaatgaaactaatcctcaagatctggaaactaaagatttttatttaatccaaatgttgcactggaagaagaaatcaacagtggtatatttacttaacaaggatgtgtgtaatacaagacaaccctggggattacacacttgaaggaatggaagtggcaaaggttaacaggcagaaagcagctggatgaaacagtttattttcatcttagaagattctagctatctgtggagaccaccactgttccccgaaaagctaaagttgttaagtttgtaggagtaccacaggtccttccccctgctgcaagacagagacttgctctgttgcccaggctgcagtgcagtggtgcaatctcagctcactgcaacctctgcctcccgggttcaagcaattctcctgcctcagcctcccatgtagctgggattacaggtgtgcgccaccatgcctggctaatttttgtatttttagtagagatggagtttcaccatgttggccaggctggtctcgaactcctgacctcaagtgatccgcccaccttgacctcccaaagtgctgggattacaggtgtgatccaccacgcccggccacacaggtccatttttcatattccaaagcccagtatagaataaatagggttttcagggatccaccagggctataaaacagagttagcttttggggacatagtcctcttcttccttaaagaaacactgactaaaatagtaggagcaggtttttagagtagagttgggacatcactttttccctgattttctagatctgaaaggggtaacatgtcattaaagggtgatgatattgatatttagtgttgccaactgctattatcactgctttatcttggaaagttgccgactataaagacagattccagcctgcttgagttaagggaaaggccaaggctgctactgaattagcagtttctaaaactgtcttgtttttgccatttaccatatgttcactggtgctgccttcctgctgtagtataatcattttctcaaatcagttgcctctcaggacaagatcagcattttcctagggtccttctgtagcaccacttaaggaatgaacctatcacaggaactccctttgaataaaatgatggtgactcccacacgcaggaaagaatcatttacttcatttgctcttgatatactcccttatgaatttagaacaagtgatccaggattagctgtaactctgtgcttgaaaaatattttactactactaagtattcagaaatctttgttatcagtaggtggtggtagtgatagggaagggagctttgatcactaatctctcagactgtggccagaatggtgatgcttaagccaagtattaatggctattaacatactgaggttagggaaggagtactgagaagtgctttgcagcaacactcgcagcttgtgtgatgatgcagaagaaaatctgatcatgttcaccctgctttgacaatgagccttgcccattggagaatgttcaatcaatagtagacctaaaaaaaatcaacttgttgctttcatctttttattgatagcacagccagagctaccaaaatgatttactggattctagcaaattaataaatacagtaatttgattgtaaaaggaaacattctacttggacattttagtagaaattgctagagggaaggagctcctggcatacattctacttggatagaagagaagatagcacaggaggagaactggacagtccaggtatagattgttgagattagggattcagcagaaagca

SEQ ID NO: 12222 - DNA, 12293 bp, Human
attccaccttggcaagcaccatttgcaagaacgaactgggataaggtaaacaaaatattgcctaaaagaggcttgtccaaagaagtcagaatacgctcttcatttacctctaaattatgtttcttaaataccaagtaacctgcagtaccccctgccgccaccaaaaaaaaagagagaaatacttttttttctcctatccactgcagaatcaattttacagtggttctgcagttaatcctttcagtacaccataaatctaaatactcaaaaaaacctgtgccttttcaattgctactaaatcacgagaagactgatttacatagtctccttttatctcccttggcgggtaagtactcagctctgctcgttactaatattgaaacaacagcccttgaattgagtgatttccctagaaaggttaaggtgaccgaatctgaacactccctccatgtcttggacacgaagttttttgctgcgtagacagttttatccccctcaccccaaggtcaattgcacgaattcttttggaaaacaggacctatggcatttcccagacaaatcaccgtgaaccctgtactgtgcattgctgtcctaaaattaacacataaatctattgccgccaaagattctgtcatttgtgttacataattgcctttcatttgaactcattaatcaaattggggtttttaagcaacacctaattaattctttaactggctcatattatacctttaatgacttccaccagggtaaaaaccactgatcactgagttctattttgaaactacggacgtcgagtttcctctttcacccagaattttcagatcttgtttaaaaagttgggtgtggtttcatggggggagggggaagagcgagaggagaccagagggacgggggcggggactctgcaagaaaaaccttcccggtgcaatcgtgatctgggaggcccacgtatggcgcctctccaaaggctgcagaagtttcttgctaacaaaaagtccgcacattcgagcaaagacaggctttagcgagttattaaaaacttaggggcgctcttgtcccccacagggcccgaccgcacacagcaaggcgatggcccagctgtaagttggtagcactgagaactagcagcgcgcgcggagcccgctgagacttgaatcaatctggtctaacggtttcccctaaaccgctaggagccctcaatcggcgggacagcagggcgcggtgagtcaccgccggtgactaagcgaccccacccctctccctcgggctttcctctgccaccgccgtctcgcaactcccgccgtccgaagctggactgagcccgttaggtccctcgacagaacctcccctccccccaacatctctccgccaaggcaagtcgatggacagaggcgcgggccggagcagcccccctttccaagcgggcggcgcgcgaggctgcggcgaggcctgagccctgcgttcctgcgctgtgcgcgcccccaccccgcgttccaatctcaggcgctctttgtttctttctccgcgacttcagatctgagggattccttactctttcctcttcccgctcctttgcccgcgggtctccccgcctgaccgcagccccgagaccgccgcgcacctcctcccacgcccctttggcgtggtgccaccggacccctctggttcagtcccaggcggacccccccctcaccgcgcgaccccgcctttttcagcaccccagggtgagcccagctcagactatcatccggaaagcccccaaaagtcccagcccagcgctgaagtaacgggaccatgcccagtcccaggccccggagcaggaaggctcgagggcgcccccaccccacccgcccaccctccccgcttctcgctaggtccctattggctggcgcgctccgcggctgggatggcagtgggaggggaccctctttcctaacggggttataaaaacagcgccctcggcggggtccagtcctctgccactctcgctccgaggtccccgcgccagagacgcagccgcgctcccaccacccacacccaccgcgccctcgttcgcctcttctccgggagccagtccgcgccaccgccgccgcccaggccatcgccaccctccgcagccatgtccaccaggtccgtgtcctcgtcctcctaccgcaggatgttcggcggcccgggcaccgcgagccggccgagctccagccggagctacgtgactacgtccacccgcacctacagcctgggcagcgcgctgcgccccagcaccagccgcagcctctacgcctcgtccccgggcggcgtgtatgccacgcgctcctctgccgtgcgcctgcggagcagcgtgcccggggtgcggctcctgcaggactcggtggacttctcgctggccgacgccatcaacaccgagttcaagaacacccgcaccaacgagaaggtggagctgcaggagctgaatgaccgcttcgccaactacatcgacaaggtgcgcttcctggagcagcagaataagatcctgctggccgagctcgagcagctcaagggccaaggcaagtcgcgcctgggggacctctacgaggaggagatgcgggagctgcgccggcaggtggaccagctaaccaacgacaaagcccgcgtcgaggtggagcgcgacaacctggccgaggacatcatgcgcctccgggagaagtaaggctgcgcccatgcaagtagctgggcctcgggagggggctggagggagaggggaacgcccccccggcccccgcgagagctgccacgcccttggggatgtggccggggggaggcctgccagggagacagcggagagcggggctgtggctgtggtggcgcagccccgcccagaacccagaccttgcagttcgcatttcctcctctgtccccacacattgcccaaggacgctccgtttcaagttacagatttcttaaaactaccactttgtgtgcagttgaaggcccttgggcacaatgagagccagtcctccaaactttcagaaagtttcctgccccttctggcaggctgccaatcaccgggcgggagaaggaaggaggggaaggcggtggagggagcgagacaaagggatggtccctcgggggcggggatggcggggctgtcctgtaggtctgtgcggccaccgtgattgcccctctgcgcggtgcccgaagtcccgctgaaacctgccgagggcagcaggtctgaaagctgcaggcgctagttgcgcggaggtggcgcagctgctctggaggcgcagagcgaatacgtggtgtttgggtgtggccgccccgcccctggcggtttcctcgttcccctttggttaatgcgcaactgtttcagattgcaggaggagatgcttcagagagaggaagccgaaaacaccctgcaatctttcagacaggtttgtagactctcttcccactcgcagccgcctgaccccacccaacacaacccacgagcaattctaaaagttgcttaactcacgtctaaaaagtgcaaaacttcagggctgcgcgtaaagccctctagtggcgggaagaccacaggttggagcttctcatgattagaaaaatattaataaaaccccttgagcgattttttttttttttttgagacggagtcttactctgtcgcccaggctggagtgcagtggcgagatcttggctcactgcatcctccgcctcccgggttcaagcgatccttgaatgatttctaagcagttccttgggacataaagaaaaatcttttaactttttactttgtttcccaaatgttgcacagttttgcaacacattgaccttctggtttcgaacggttacaattttagattgtggtttgccaaagtcaagttgcttaatttttacaaggccacaaaaagcgcaattatgccctgcagtttaaaatggaaaacgtgttggaagataagaaaacttagtttccaactggaatggagccagcaagtttcttttcttctttgcaaattctattgtgtcattaaagttcgatggaagtatcactatgcacaactattttgtgatctaataagggtgaaaaggagccatctgtccccttggctaaggggtattaatggtttctatgggcttcactatggaatgtagatacagacattctggcaaatgtggtggctctggacagaaataataggagtctttgtattcccagggaagctttgcaacaggctacattcttactgaatatgtaatgatgtaagcacggttctaattggacacaagtatttgctaacatccgttatctaatatctggcccagacttgagaagtaggtaatgtaaaaagtttttaaagctacaagcatacctcacattttaaaagtcctttcttgattgggttcttgtgttctttagcactcttgccataaaaaataataacagtaataaacccaaggctgaaaaactgaattttaactaaagggtttttgtgcgtgttttttttttttttcaccaaaattagatggacttacagaatttttaacttaaaattggaatccaaaagccagaagatccccattatagtttatagttgtattccctggaatatttactgggattaactgcaaagcactctcagatgaatagtgtagtataacattttgaaactgaaatacatttaccaaattaatttaaccacagcaatgtgtgtggttcattttagtccttgagcatttttgattatcatacctgtcatgttttctgcagtgtagtgagttaacataaaacaacatcaatacaaaagatcctctgtttcgagattaagcaaaattcctcattctcttcaatgtgatagaataccacattgatctttctttggaggttagtaaaatatcttttatgtatttttcagggcttaacaagtaaaaatcaatgttttcatcaagtctgatctttttgtcacccactcttcattcatttttccactaaggtgatagaaaagtctcaacagtttaagaccgtaaggctatgaactccaaatataattgctgacaagataagcaatcctcacgcatccttttgagaggaaataaaatcttagttgcaagattacatattctgatttggaatgctgagctttttaaatggaaatatagaaggacggctgaatcagcaaaaatcctttatgtagtttcattctttgcaagcttgaccagtcattctgaaacaggctaactgaactgatacagtggcaagtgaaaaagacatgcctttacaggatgagtcaaaggagttttagaagaaaaatccaccagagaaagccaagcaaatacagttcagagttacatttcttttccattttttcctgaactgaatctttggcatgcatatcctgaattgggttattgaatataaatctagccttgtacaatggatgccagatgactacatatttgctttggagcctaaggataagtttcaaaagatttgagtggagaagaaaagctaaaactcttgaagcacaagtttctgttctccatgtactcaagtgtacatgaagttgtgaaaatttgtccacctctatcatcatgttattccatgaaattacaaaacaaatcttaaaaatgttgtggcatagattttctagatttaaaaagtaattaaattaaatgaattactttattttttgagacagagtgtcactctgttgcccaggctggagtgcagtggcactatgttggctcactgcaacctctgcctcctgggttgaagaaattctcctgcctcaacctcccaagtagctgggactacaggcatgtgccaccacacccagctaatttttgtatttttggtagagacggggtttcgccatgttggctaggctggtctcgaactcctgacctcaagtgatccacccgtctcagcctcccaaagtgctgggattacaggcataagccaccatgaccagccttaaaaagtaattttaaaatatcactggtaaaatgtggattcagtcatgattgagtgcagtttaccatgtgtgtggacatttatttattttaaaattgtctgatcaccaccttgagtaaaacacaagcagtcacaattaaaatatattagtgagcaggagaaagcacagcatattatagcactgaatgatttataaacctattccagggtcataaaatgtgtcaacggcttttctatagtaaggagactaggttcagatggttaatctaagacaaataaatgagataagccatacacttttacatcctccatgtcctgtcttttctctgttcaaaataggatgttgacaatgcgtctctggcacgtcttgaccttgaacgcaaagtggaatctttgcaagaagagattgcctttttgaagaaactccacgaagaggttagtggagtgactttcggggaatgaatgagggtaaggcagcccccacggttggcagagctgaccgtctgtctgttctttttgcaggaaatccaggagctgcaggctcagattcaggaacagcatgtccaaatcgatgtggatgtttccaagcctgacctcacggctgccctgcgtgacgtacgtcagcaatatgaaagtgtggctgccaagaacctgcaggaggcagaagaatggtacaaatccaaggtaggaaacaaatcagtgcggcttcaaccaaagaaaagcattgtgttctcaaaaccccatacctgtgtgtgattcctaaatatcctctagctccaatgcaaagctggctttgacttcttgctcatattgtgtttgccaccacagcctccccaccactcacatcacctcctttatttatttatttattttcttatttatttatgagacagagtcttgctctactgcccaggctggagtgcagtggcaacatcttggcacactgcaacctccgcctcccaggttcaagtgattctcctgcctcagccccctaagagctggaaccacaggcaagcaccaccatgcccggctaatttttgtatttttagtagagatggggtttcaccatgttgaccaggcttctctcaaactcctgacctcaggtgatccaccctcctcagcctcccaaaatgttgggattacaggcatgcgccaccacgcctggccacatcacctccttcagaatagcagactctcttccccctaaccttgcctccaagtaaaccccaatgccatacctttgacctccactgtgttgaaatgagcactgtagagtgaactctgaaaatactaatgtcagtactccactgctctttccctggctttcaaaacagaaatttaaacctatactggaagacattcagtgagaaatatgattttttttttctaagagagtcaaaagacttgaatgtgagcaatctacatttctgttttcttcccaacagtttgctgacctctctgaggctgccaaccggaacaatgacgccctgcgccaggcaaagcaggagtccactgagtaccggagacaggtgcagtccctcacctgtgaagtggatgcccttaaaggaaccgtgagtaccaaccctgcagtaaaagagggaaaataatgacccattctgctgactaggctcatgatgatacctgaacaaaatgttgagtgagtaaaaatgtatatcataatgcaaagaaaatgagttatcaagacagactcaaaagggacttcatggaactcttgaaggttttagcttgcctatatcattgcttctaatatgaaggacttggtactcgcattctccacctaaaattagagtggtcgccatttgccgctaatggaaattattgcagaaggtctgtaaatggttctgggaacagctgggtttttctgagaaataacaccagacatctttctcaccccctgcagaatgagtccctggaacgccagatgcgtgaaatggaagagaactttgccgttgaagctgctaactaccaagacactattggccgcctgcaggatgagattcagaatatgaaggaggaaatggctcgtcaccttcgtgaataccaagacctgctcaatgttaagatggcccttgacattgagattgccacctacaggaagctgctggaaggcgaggagagcaggtagggaactcagacttggatgcgtgaactaatggtgaccatttgttaggccctgtgccactgggctctaagcagtgtcacatttaatctttagaaagtttctttgaggtaactgctttccactttttgtagaggaggaatttgaattgagagagagtaagtgacttgctgaaaaagggttaatcaacagcagagctgggatttgaacccataactctgtcaaagcctccactcctaactcctgttcatgctcctgtggagaaaatgcttgtagtaacatattttaaatgtactaacaagaccagtcatgggaaaatgtttctgagacaaatctctagtttatgatttaaaacagtacgttttcttacgtgacgaaaacaaaaagtgtgttaatttgttcccagtggttgaagttatttgccaacaattttactgtttctcttcatctgtttataggatttctctgcctcttccaaacttttcctccctgaacctgaggggtaagcattttatttccctttaggaaaaacgtcagctgcttgtaaccactgtgtttatgtcaaagcattcattttttttaggatatctgaaaaaatgccatataagagaaaactctataaaacatctataattttcgaacccaagtacactcttgcattctatgctttaagttaaatgcaaactcctttttccttcttcctgctgcaagtactatctcatcctgatgctcaagagtgtcagggcctgggtttccaaacagagactaccctaaaattatttggcgagtagtactttacacaattgcctctcccccacaaatcataattgtttcagtaaaatggttacttggtttttccaagaaaaaactcgtttttactcatttttggcctgtttgtttatttagaaactaatctggattcactccctctggttgatacccactcaaaaaggacacttctgattaagacggttgaaactagagatggacaggttggtatcttttaaggaaaaaatagggtaatctcagacaggagttgatatattttaaaatcagtgaatctgaatctcagatacagctggctaatttgagaggttcaggtttcattcatgcctactaaaaaaagaataggcttcttcttccagcagtacacacagccaactaattatttggctcctggatgtgaagttgagatagcagtcttcctgtgctccagaattagtgatttgctttggtgcttaatttgaagtgggagtaagcttccttaaaccacttcctaaagcagctacatgaaacagcttcactagactacctcaatatgaggaatgttttgatcctggacatatggtgtcttcctacctccatactttatagattcctaaacccatctatataatacaagcatgtgccatacgatcatttagtttcttattacctccctatgccaggaaagaaatagttgcaatttattgtagtcatcatgaaatcttcccttgcacataaatttaaaatgtacctgctgcacattttaatatgtcttaattgcttttaaacttggctgtattgtgtacaactattataccatcttttataaacacagttttttaagaaatttctttttgtaagttacaacattccactggatccttatattgcctgtagtggaagagggtcttgtgtgtctgccccttctagttttcactcatgcagaagcaacataaccttctgatttgcacaataaattacatatatttagcaggatttttatttgccgtgatatataggataatttagtctttggcatgtggcattatatttattttggtttttttttttaaacaggttatcaacgaaacttctcagcatcacgatgaccttgaataaaaattgcacacactcagtgcagcaatatattaccagcaagaataaaaaagaaatccatatcttaaagaaacagctttcaagtgcctttctgcagtttttcaggagcgcaagatagatttggaataggaataagctctagttcttaacaaccgacactcctacaagatttagaaaaaagtttacaacataatctagtttacagaaaaatcttgtgctagaatactttttaaaaggtattttgaataccattaaaactgcttttttttttccagcaagtatccaaccaacttggttctgcttcaataaatctttggaaaaactcttttgttgtgttatttattggataatatctaaacaattctctacttggtcctattagttaatttgtcattacaatcatgtaagttgataaattcaggttatttatgcttgagatgtagttcttaattttgtcatttttgatagacctcacttctttttattattacttaaaaacatttacaaataggtggtgtcgaataaaataacttgtaccaaaatgaagataggtctctctaaaatgagctcaggtctgtgattttaatcataacaaacagacttcctaaaattaaaaaataaaaactttttttagtacatatagcatatgagtaacacaaattccactttgggagttaaagcataggaagttgccaagatataggggcttatcttccgctagcaagatgcagagaaatggaaaaagttcaccaagtttttcttttatttaagacaggatctcactttgtcactcaagctggagtaaagtgactcaatcatagttcactgcagccaacaactcctaggctcaggcaatcctcccacctcagcctcctcagtagctaggagtactcaaaacaaataaacgaatgtctaactttagcctaaaatgtgagttgtcttcccaaaactagccacacacctggctaatttttttaattttttgtagagatggggtctggaagtgttgtccagcctagtctggaactcttgtgctcaagtgatcctccctcggcctcctaaaaagctgggattacaggcatgagccaccacactcagcctagttcaccaagatttaatatatgaaaccgttctgctttattgtgtgtgtgtgtgatagctatatctatatccatctatctatagatacagatatttgtaaagacctttgtgtttggagaatggcattaggcacaaaataaaacctcctaccttttcttccagggagatgagattattacatgtgaatcgcatggtgctaactgtaggtgtaataaggtttcaaagtctggagcaataaaaatgaagtggggcagtcatggaaagctccctagaaagcactcagtgtgagcatagaacttacataaatagacgagagaaggtattgccaagaggcaatagtgtagtaatggtcaataatgtgtgttctggagtgaaaacttcgagtacattctcggacatctctaagtttcaaattatggaaatattattatcttctctcctccgagaatgatgtggtagacattgtcataatttttctgtgtttgcatctgcctctctctggagttaactagtgagatggttctcacaaagccctgcccatttgcaggaatgttcactgtgattttcatcattttggttaccgtgggtactgcatgaataaagaaaggattggggctggatgcagtggctcatgcctgtaatatcagcactttgggaggctgaggcgggtggatcacttgaagtcaggagttccggactagcctggccaacacggcgaaatcctgtctccacaaaaaatacaaaaattagccagccgtggtggtggatgcctataaccccagctactctggaggcagaggcagtagaattgcttcagcttggaaggtagaggtttcagtgagccaagactgtaccactaaactccagcctgagtgacagagcgagatcctgtcttagaaataaagaaaaaaaggattggctgctgaagtaactcctagccattctaaaggtaaattctaaatgtaaaagtaaactttacattctagtttacttgggacattcttggtttatgactgttgtgtaagcataattattaataataacagtttggacaatagattgtatgtggtcaggtcatgctacccttagaataatcttacagaaaatgtgtctgtcccctcagcccccatattcaaacaactgacatggacaatggcataattaattttattagtgtaaacatccaggtctttgggcccttatgaaaccttttctatttgattt

SEQ ID NO: 12223 - DNA, 12860 bp, Human
tttttctggaagcatccaaaagttaagctggctacaggacctctggtttacaattcatttccttgaaagaaaagaagaaataaacacaattctataaagtctgtgaattaaaactttgaacctgcagatggtgctatgattccattttcaaattgttttgctttctagtttaaattcataagagaaaatgcagttgtttggttgagtttacttttattcagaggtaataaaattgaattatttctttttattttatcttattattattataatagaagcaattgtcttttgtattgggaaaagctactatagttactctttgtaaatgctaagtgcttgcctaggccaaataatgatcagctttacatcttttatgtttaaaatttttcttcttatcattcagcagtcatttgtctgtgaccctcaattaagttgctttgctgtttctgctcttaaataaaattggttcactaagaattgggtgatgaagagctaaggataaaaaaattccatatgagaactgtttcaacctctagtttgtaataatcaggtaaaaaagatttcctggaattaagccacaggaactctggcttaagtcagagctgtcaactgggaaacaaatttccagacattttgaaacttaattcatttaatttttctggtaactggattagaaaatatgattaagcatagcaggatattcttttactggatcagtctgactttgaacgaaggaaatagatactacaatcttaaagtagaagaaagaggactgtaaagccattctgtcttatgaaacttagaaacaaaatgtaaaaataatacacatggcagaaagcctttaaaataaaaggaaaaatggcattttcctctgttgtttaggaaatttttcatgtggctgcatttttaccttaaactctgattgaatgtgtgctagactacctttagttacaaatccacaaatagaagtgaagtatttatcaaagtactatataaatgcttttcaactatttgaagccacctgtcaagtgattgaatcagaaatgttcaaaactggtttgagtatgtgtgtgtgttggggatgagggtagaaaactaattctacattatgcaaagacttataaaagtgatgaggaaaatctttaaaaagaaaagacaattaaattccttgaggtatatagcctgacaacaatttattttttggatcatttgacacagtgtatgtaaaagtgcattgggaattgtgccattttatacaaatatgaaatagcactacttgtactgctttgtacaacagcgtgcatatcttactatcttagagactttctgaaacacttatcttggaattagtttcaacaaagacgaaatgtaataataggaaggtgaaaattatctctagagcttttaaagttaggatagatttcaagaaagattaaatctggaactatatgaatagcataaaaattaaaaatattaagagaattgatactttgtaataaagtataattatacttttataagcgtaatgaacataagtgtttgttgctttatgcatttgtttctacacatgaagtctttattttctgaaggaatcccaatggccctggctataacactacaatcattttcttattttacaattaattaaaggttaaaacatttcacattgagcttgctactttgtttgtttaaagaaaagtaaatttcctcttatcttacattttgaagttgctcactataaacttatataaattaggcataatgacaattaagtaagaacttcaagccctattcatcccatggccgtcatactgtgacgtctttcagagcactttgtgattgctcagtcctaagtataagccctataaaatgatgggctttgaaatgctggtcagggtagagtgagaagcaccagcaggcagtaacagccaacccttagccattgctaagggcagagaactggtggagcctttctcttactcccaggacttcagcacctaagacagctccaaaacaaaccagaacagtcagctccgggggagcacgactgggcgaggtaagtgaaaactttacctttcctcttctttttccctcctgcctctggaacttttctcacaaaataatgaatttttctctcttgaaaagaatttgatagtgctttgcttttgcaacagcaaaaaacaagtttctcaagtcacctggtaaggatagaaatacttcaatttctctcatatggatagattttctgaattcttttgtttgtaagatgctttaccctgcttgctcttttactgaatactgatttttacaaataattcattcaagtaaagtttacttgtatgtagatttttgactgaaaatttcagtgggaacatttgcttttgaaattttcaacttatttttaaagtgctttttttttcctatttcgtatgttggttaagtgaatctaagatgcatttattttttccttaagtttaaattccataatttttataggcagcaagagaaacagaccttactcctaggcttttaatctagaaactagaaatgaaatgtgtaagttgattaaatgcaagaaatgcaagctttgcttttaatatatattttcctcttatggaaaaatttatttcaatgacaacatatgattcagtaatattttgagtattaatattcactactgagttaagaagttcaaatccaggtgtaaggaaataagtttccgtaatatctacaattgaaagaggaaaaagtaatgtatatacaaaatcttttttaaaattatatgtatatatacacattatatttatacatttgcacacacacgagcagaataattattaaatagatgatactctagtcttatattagtcagatactgaaattttaaagcagaagaaaatcaatgtcttgaagctgtttccttcgtcaaaaaatacactaagcttgagtggtacatccctgttatgaaaagattgtccccagggttatttccagcactatagaagtatggcattcaatagatactggggccaaccatgtgcccagacagcaggtgaaaaggattctaatttttattcaagcacctgtcactgagagaaatactgatttttgaatgtatcatcttgcaatttaactctttctacaagatgaaaattactctttacaaactctgcaagagccattgaaaattactgctagacaatcagaattaccttgctggtgacatctttggctggaagaactgaggtgattctctctctttagaggcacagaaatggacaccagaaataaggcccagctccttgtgctcctgactcttctcagtgtgctcttctcacagacttcggcatggcctctttacagggcaccttctgctctcaggtaagttccctttcaattcaaacatctgaacattccttcctcatctaaatgggaatttcctatacattttgttggacaactaaatagtataaattatgtattatgtatttaaatttttccttgatgtgttgagtgagaggtgtttgtcaacatcaggtcattctgagtcctggaattcactttcagggcatgagagacactgtcagttattagttttatgggctgagtggatcacattcccaaacatggtgaaaggaggctttcactttctttttattcaaaaccatctttagataaataataagcttttatccattgttatctcaagtcagttcaatttctggtggaaaaaagctgtttagttgccaaccacatttgagtttattttcaagattaatcagtaaataatcataagactagtagttgattagtgaaacatgtataaaatcatgttgcacagaaatctatctaggcagagtcaatttgccaatattaaatatggggtaattgatctattgagatacactcccccaataggaaaattttgatatactttgtttggaccataaatccttagttttattgttctatatgttatattatatattccaaatccataaagtataacacaactcttatttaaaactttattaatgtatgctaaagaagtaaacaataaatgaaaactatattagcttgaattttcctttcagtttacgggcaccactgtatctccaaaggaaaaataataattgggttggtttccttctttgcttattaggtcattcttgattttttgcttaaggtagacttatgctcaacagagagaataacctcttagctattagtgttctctgtgaaatctgtttaaatacagctcctgcgttgctttgataactaaacaaaatggttctatctgaatagttctaccacagcagatgaacaatcacaagaatgtggacatttgtgttgattgctaagcttcagacccacagaggactagttgctagtgactcccaactcccaaatcactgaaagatacacaagtgtccaggagctgacacgctccttggatgtttgccctaacagtgaaaatctgcacacacaaaattataagagttgccggtgattgaaatatgcatgcatccataaatatagtcatattccatatatgcatttgactattcttagtctttcagtgtaacattgtacatcccttattaaagttgtgttaatacataagattagaaaaaagaaggccccataaaacttattgaattcaaattcatcttcatagatgagctatccatctatggagacattctttgaactctgtcaatacagagaaatatataatgccaaagtaaatatttgaagcaaagcttgggggtcgagagagagagaagcagttaatactctgttcttcagagatgtttggaacaggtaatactgaacatcaccaaatccataaattgttatcagttctcattcaatattagttttttgcaagtttctattttgcataaaatatttctacatacgaaatttgactttgcaaagtgaagatattcttggcatagtaaattacaccaaagaagtatagtttgcttaatgctctgataagattgaattaagtagctcttgtgttttgtatattcagcttataaaagtcatatggcatctactttataggataataggaatttcctatttatactctcattaactatatgagccattaagtcaaattatgctattctcatattatgactgggtaatacttcccaagagtctaagtatcttattttaaatggttgcggaaccatacacactgtcttctgaaaaaagaatgtattattctcgtgtaactttccccatcaggttgggtgacagaataccctttgagggagcaaatgaacctgatcaagtttcattaaaagaagacattgacatgttgcaaaatgcattagctgaaaatgacacaccctattatgatgtatccaggtgagtttatttttataaaactatccaatgagttttattttagaaaatgtgtttaagaactataaacgtgcttattttatctcaccatgaagctattccgatagcaaaacactagaggtttctatgtgtcatggcttcattcatcctgatttactgcagatcttacagctgtacataattttcatactgaaaggttgtaacaagccaggatgaacacaccattcacttccattctgttgcacataattccaacatcacagattgtaccaattctgataaaagtacagcatttagcattccaatgatggaagagttgccaaggagttttgtctctatataaagaaaagatacctgatagagctgttcattcatagagctgtttgtctagagcatcatttcaagtacagaccaagtagctctatagtacttggtacagacaaagtataaaaggtgcttcatttgaaagagaaaaggtgggatgataggccttaatgccttctctatcttaagagattttgtttccaaatattttggaaaaagaaaaaaaaaggtgtactggggtttatgaactttccaaaatcagaatattttcccattgtgaatgtctttattcagtggggcagacacaaagcaccatgtacaaatagcagctaatttaaatagatcatatttttacaccaatatttcttagaaagaaatagttataaagattcaaccatggaggaatattgaaatgtgctcctagaaatgcctgtttctttaatttttcagtgtcttgggctagaaatatagggtatatcttgatataagtgactagaagatctcttttgttagggtgttaagaaatctccttttgaactttagttttaatgagaagctttcataataagcccataatttttttgttatttaataagccataataatattctagaaagccatttacaaaataatagctatttttttcttccttgttttagaaatgccaggcatgctgatggagttttcaccagtgacttcagtaaactcttgggtcaactttctgccaaaaagtaccttgagtctcttatgggaaaacgtgttaggtaaagagaatttattatttttataaaatatgttatcattattcaatctgaatattgtattttcactcttaacaagttatttactttgtttgaaattgaaaactcgttgataatgtttaatttagttaaatgaaataacttgtattcttcaataacatctatcaagcccatggactaagactttttcataatatcatattcattgactccagacacacatttttctcaagtagcaatcatttagcaatctgcaatcaaattgaacaagactcagtaaaacaatcaaaaagagatagtacagactgaggtaaattttaaggtcaaacagaatattctttttacttcctgctcaaattaaatggagaattccaaatggccaacagtcaaatatttagatgacgttgctcagggtagcatagcttctaaagaagtaattatgttttttttaaaaaaaaaaaaaatttctcccaatggcagagcacaacttcagctattcccaaatttttatttttggatgaattatttgctcagctgtacagaatgtgtcataaaacagtcccaggccatgccaaaatatggcagatgattccttgctttccttcatccttaggtttagttgtatttttcttttagtctttttatgatagaaaattagttgggtgggaattgctttttatgtggctccaagaaacctggaacatgtgtgtatttatcatttcttgtgaaaactctttgatttccttttcctcatgttccttagcagtaacatctcagaagaccctgtaccagtcaaacgtcactcagatgcagtcttcactgacaactatacccgccttagaaaacaaatggctgtaaagaaatatttgaactcaattctgaatggaaagaggaggtaaagaaaaagagaacttgctaaaatgaggaatcatgactgactttcaaaatagaagctgcacatggagacctctctatctcacttatctagctatactacgtgaagcagtgattttcaaccttggctgacattagactaccccgcagaactttaaaaatacagatgtctgggccttctcccaaaccaattgccaggaaatcggtgtcttcggtggtgtggccctagacatacatttcttttaagagttccccagttgactttactatgctgccagtgttaaaaatgatgactatacagacatctagtctgaatctaagagcaagtttcatcaaaagtgatgatttttaaaacatgtaaagcatagtcaattgcaatttggtaacacatggaactcacttcgtgtgcatattcactactgttatttaatcaaattaaaccattaggtattttgtatatttagattctgtaaaatctatatctctctatggtgtgtaaatattggacacaatacataaacagtgtagtgttctgtctttttattccaattgtttttgtttaagtgatgagtattaaggataattctgtttgggtgtgatcagacaagatgacctctttgcccactagatgataattctgtgagaataattttagaaactctaagattgatgaataattcataggtactaacaaacctcaaagataattgtttagcctccccatacactttcagagcacagagaacagcacattcattatgtcataatagtttctttagaccctttctcatctgagagccttaatatgtacaatgtttttctggtctgcagcagtgagggagaatctcccgactttccagaagagttagaaaaatgatgaaaaagacctttggagcaaagctgatgacaacttcccagtggtgggtatattcgtgcattccttctgtattcttatggctgtctctgattatataagtagctaagagtcacttagtaagaaacatcttagggttaaatagtttctcatcatgagacctcatccaagacagacacttctacaacagtggaccccaacccagtaaacagcttagaatgattcatgaaatttttttgatcttgtaaaagagagcactcacaataagcaaacgttttgagatctgaatagtgttcctggcttacttggggttatttctacctttgtatcaagataaaaaaacagaggaggctgactcacactgacaagaaaaatgggctttccttttgaggatcgacccatgctgcttttattaattgaaggtttagtctcacaattgactgttagctcctcaattaagtatagggaaatagcaccaaattagagcatggcccattactatgaaaatatcaaggcattctgggtctaactatattccttgaaacatggcaaacttcatagagcaaaagttaaatttagcttgttttacctgtaagtttgttttacctatatgactctaatagcattctctgccaacattttttttgagcagaaaaaacatggatagactttttttctttgtgaagtaataagcttgctatcaaaattgattttatataaatgtgggttcaagacatatttctttcctgagttacattacattaatattcacattcgctcataaaaaatctataatactgggcaagtgcttaaagaaatttcatgctgtcaccatatcaaaggttagcagattttaaagggctatggagtaaaatatgtttggctttgtgagccatctattttctgttagagtgacttaactctgctatggtagcacaaaagcagccacagttagatgtaaaacgaataggagtgactgtgttccaataaaactttattcataaaacctgaaggtgagccagattccaatccctaactaggttaaggagattaaattcacccatgctcaaactaaaggcaattcatggccttacctcagttcctgatggggttatctaaggttttcaacagtcatcaagagtggacatggtgtctgggaagatacctgcttaattgactgcttttgtccactaattacccttagacctctaagagaaagcagaggcaggagtgtggcccacatcaactctttatcttttatagacatctcagagaaacaagtccctttgctcaaagaagaaagttaattacatatagcttttctaagagtgtttataagaaggcttctccatcaaattaagaaacacggtaggcactaaaatataaaggagaattgattaatcacactgtgctttgtaaatggtaagatcacttatgagattccatcctccattcttttcttttttaaatgggtggctttggacaaattctttgaagaggaaatcatgtgggtcatccattagtgaaaattacaagtgaatcattaataatggttagttagacgtcttttcacattccagttcctctctgataatcagtcctctagaagctgctctcttggtatgtcccaggacatgatcccctgccacaggctgttaacaagggacaaagagaaataagtgtttatcagataagtaaatcagtgaatgaaactaagatgctagaaataaaatatattttatgcctaaagcaacaattttttctttttcagaattcttgaaggaaaatgatacgcaacataattaaattttgagttctacataagtaattcaagaaaacaacttcaatatccaaaccaaataaaaatattgtgttgtgaatgttgtgatgtattctagctaatgtaataactgtgaagtttacattgtaaatagtatttgagagttctaaattttgtctttaactcataaaaagcctgcaatttcatatgctgtatatcctttctaacaaaaaaatatatttaatgataagtaaatgctaggttaattccaattatatgagacgtttttggaagagtagtaatagagcaaaattgatgtgtttatttatagagtgtacttaactattcaggagagtagaacagataatcagtgtgtctaaatttgaatgttaagcagatggaatgctgtgttaaataaacctcaaaatgtctaagatagtaacaatgaagataaaaagacattcttccaaaaagattttcagaaaatattatgtgtttccatattttataggcaacctttatttttaatggtgttttaaaaaatctcaaatttggattgctaatcaccaaaggctctctcctgatagtctttcagttaaggagaacgacccctgcttctgacactgaaacttccctttctgcttgtgttaagtatgtgtaaaatgtgaagtgaatgaaacactcagttgttcaataataaatatttttgccataatgactcagaatattgctttggtcatatgagcttccttctgtgaaagtacatttggagacacaactatttttccaaaataattttaagaaatcaaagagagaaaataaagaccttgcttatgattgcagataatttttttgtttgattattttatatgattcagcagtaactcattttagctctaaagttctaggcactagatagcttttgtggtatttgattgtgtgcaagttctaaaataatgatggcttaaaataaaagagaaatttctttctcacgtaagtcaagaagtaagatgtcagggttattataatggttctgctcagcaaaaccctcaataacttacaccccttccagctcatccctcatctccaatggtgtggcacttttcctcatgatccaaaattagagctagcattccagccatcacatatgcattccaggcagcaggctataggaagaaaaaagggagcaaatattatatgccagttctctttgaactgatatcttatactaacatcccctttactagtacatagtcttatggccacagtcatttgcaagagaggctgggaaatgtagtatgttttcttttctttttctgggtgatcatgtacccaacttaaaactaagactctattaatataaaacaaggaaagaataaatgtatgcagcgattaaaaataattccaggcttggatcttaaattctcacccaaaaagcttaaagaaataataaagagagcgagagtcagaccctaaccattaatgaagaagcattatccccataaggcaaagttttgcttggtttcattttctacaattaggacaaatggccacatcaggaggaactagtctagaagtaccagtaattgcaaagtagttttcacaagttgaagtaaattgagcttcttgtatctctttttcttatctgattcttcaaattattaaatatttattaagtgacatttttatgagaagcactgcagtgaaaacagacaatttctaagtgttaagtgtacataaaaagcttgtaaagatgaaatggagccataatttgagtgtgtaactaaagagttttaattttattttattaatatgaatcttttcaatttattccctattgcttcaagaaattcattgaagaaatattcactgaatgactatgatgtgctatgtagctatctgagagattgttctgggctgagggaacagcaagtgcaaatgagggaacagtcctgacatatctggagagcaaggaagcccatgtggctggagcagagtatgctggacagggactcagtaggagaggaggtcaaagaagttactaaggactggaccttgtagggcctcacaggccactgtaattgtttgtgaagtgagatgaggtatggcagagttttggacagaggtgtgatattatctgaactgcactttaacaggatctttctggatactctaatgagagaagagtgaaggagtgctaagggtggaagcaggggtacaaactagggggcaagtgctataaatcaagtggcagatgatggtgccaccaaggcagaagcactggaggtattgagaagtataactgaatagatcttaaaagaagagtcaggttttctgagaatgggttgaagacaagaaataggagaggctgggcatggtgggtcatgcctgtaatcctagtactttgggaggctgaggcaggaggattgcttgaggccaggagttcaagaaggaggaaagtcaagaatgacatccaaggtaaatcacctgaggcaacttgaaggatgggattgctatagacagagaagactgggaggaacgagggttcagggaaaggtgagcttagtttggatgcactaaggcagatgttgagtagggagttggagatgtcatgaagaggagatgctgagctgcagatgggcaagtgggagatttcgcatatagacgggatttagaaacacaagactggacgagatcagcaagagaccaagtgttgctaaacaacaaaacacaacaaaaacagaaacctcaacacataatccttgagtgtttttatttcctagtgccaccataagaaggcaccgcagaccaggtgtctcaaacaaagaaatcaattgtctcacag

SEQ ID NO: 12224 - DNA, 52711 bp, Human
ttcccattgtgcagccatctgtattagtccactctcacactgctataatgacatacctgagactgggtaatttataaaggaaagaggtttaattgactcacagttccacatggctggggagcctcaggaaacttacaatcatgacggaaggtgaaggggaagctggcaccttcttcacagggctgcaggagggagataactcgcaggggaaactgccacttttcaaccatcagatctcatgagaactcccttagtaataccagaacagcctgggggaaaccgcctccatgatccaatcacctctcaccaggcccctccctccacacttggggattacaattcaagatgagatttgggtggggacacagagccaaaccatatcaccatcactgccaagatttttacattttgatttcacagtagcctactctattatttaatgtttttgtttacatgtgtcaatgaagagcttatgttcagactgaaatatatttgacaaaacaggaatatacatgtaggagactaacacctggctgagcacttgccaagcactgctctgaggcactttatatgaatgaacatctcctctataaggtaggtgctatcatggaccccagcttacagcttaggaaactgaggcacagagaggtttaggaaagctactcaaatgcttgccttggcccactggttgctaccgtttattgagaactttaccatgggccagggctacacgctctttggttttttttttttgttttttgttttggcggtggggggtgggcgggggaacagagcttcactctcgttgcccaggctggagtgcaatggcgcaatctcggctcacagcaacctccacctcccaggttcaagcaattctccctcccgagtagctgggattacaggcatgcgccaccacgcccggctaattttgtatttttagtaaagacggggtttctccatgttggtcaggctagtctcgaactcccgatctcaggtgatctgcccgcctcagcctcccaaagtgctgagattacaggcgtgagccaccacacccagaccaaaggctacacgctcttaagctccttgctcatctcacagcaacctgacgatgtggtatcaagacttagagaagggaagtgagtctggatttggatccaggtttctctgactctgaagcccgtatcttaagcacgtgtactgggctgcgaagctgttatgggacagcagacgcaataggtggattttgttccggctgtggagcaccatgagaaggaggacgaggaggattgggacgcccagttccggagtgctggcctcagagcatgcaatttatatgttgagaagagacttaagaaagcaagccaaggagcagagccgcagtggccaccgagttggggggtggttgagtgctcatggagcccgtggattttggacaggagttcctgctgcttattaatcgtgtaacctcagaaaactgacgccgctgctctgcagagtgccccggccacactcacgaagtggagataatcctccgcgcccccagatggttgtgaggggtaaactgagcgatagttgtgaatcatagagctgggctgtagagcagcgattctcaaagagtggcccctgggccagcggcttcctagtcaccgggaacttggtggaagtgcagactctcagctctcacccacgctgccgaatcagaaactctagggtggggcccaacaatcggagtttgtttgtttgtttgttttttgtagagacagaatcactgtgttgcccaggctagtctggaactcctggccctaagcgatcctcccacctcggcctcctaaagtgctgggttacaagcgtgagccaccacctgggtttgtttttttccagccctccaggtgactctgagcaccctcagatgctctgctgtgacacagcgggcaaacacatgtaaatgtgatgctgtcacctgtcctcacagccagtcttgcgggcagaagtgcctttcccacaggggcactgacatctttgctggactcttttaatcctcataaacccaggctgctggcacttgaaatttgagaagggcaatcagtctggcctcctgcctttctggcctgcaggcccagcctggacaaacaatttaggtggagctcctggaggctggaagcagagaggaggtacctcaccatcctctcctgccagctgttgcagactctgcctggggaactgattaagggtgagcagaggcatttatctccatgttaacaagcaggtgagagagtagcggaaaagaacttcccatccacttcccgctgtggggtcgagctcagaagtggggtgtggggctgagcttggaagtgaggcatggggtcgatctcagaagtggggtgtggggctgagcttggaagtggggtgtggggtctcagaagtggggtgtggggctgagcttggaagtggggtgtggggctgagctcggaagtggggcgtggggtcgagctcagaagtggggtgtggggctgagcttggaagtggggtgtggggtctcagaagtggggtgtggggctgagcttggaagtggggtgtggggctgagctcggaagtggggcgtggggtcgagctcagaagtggggtgtgggactgagctcggaagtagggcgtggggctgagctcagaagtggggtgggggtgccgagctcagaagtggggtgtggggcttccagcatctgcaggagcaggcaggccttcagtcatatctggggactcttgtcccagggcagtcacacccttttcctcctgagtccaagcacggaaggcctcagaattctctccctcctcctcatggggttccgcaacccctccagcccactggagctggacatgaaatgaaacccacttatttcttccttcgataccagcccaaagttgaggaaagaaatcgtttcccaggctcaatgtcctgacttcctaattgcaggggttaagtctatttcggctctgaccatgtcacacccccagttacacactttgatgcctccccactgtctcaggtgccccctcctcagcactgcgcccccagcacctctcccagcggcagccccattgctggcctgcatttgctcagacccagcctccccacccccgcgctgcaagctcctggctccatctccgcacaccacagacaggcatgacctagcacagcgccttccaccccatgcctccccttccctcctctgctgggcttgctctacttggccttgaaagctcagctcagtcgtatcctcccgggggccctccctgacttcccagatttccatctccctgctgcaacttgcagcgctggctttagccctgatgaccctgaattgagcttgctggttacatgggggcctcccccatcctctgagctcccccataagtgacgctgtctgggtctgcccatgcatctcccctacagtgcccagcatggcatcaggctcagagtgggcaccaatgatgttggctgaactgactctgggccccaggtccctgaggcaggcagagtgagggctgatttgtgggtccacgctgagaacagaatgcaggacccctggttggatgcccaccccaggaccagagttacagagcttcagccctgcctcgggctgactgtgggacgctaagcaaggcgcgcttcctctctgagcctcagtgtccctctctgtccaaagacaggtctgaaagctctgtgccagaaagcggacagtgagcagggagtggagctgccagattttcagcctcctggaggtgtcttggaaaatccccagtgatccttgtcgctcgaaactcccagataaggagattgtggggcaataaacctgtgtggagttttggtcagggcttgatttgggggattaaacagaaagaagctctgctctgtctccagaaggtccaggcaggacaagaccttctcaggacagctgatggctggacagctctgtcgcccttgtggtcctgtgtgtgtctggtgtgtgcaagctgcagcaccctccacagaccgtcctaacaggtgggcagggcagggctgttactattatatggatagaaactcagaaagcgggagaggggacgagatttgcccaaggtgacggagcgaattggtgtcagaattaggattctcggccaggctcagtggctcacacctgtaatctcagcactttgggaggccaaggtgggcagatacctgaggtcaggagttcaagatcagcttggctaacatggtgaagcccctttgctctactaaaaatacaaaaattagccaggcgtggtggtgcacacctgtaatcccagctacttgggaggctgaggcaggagaatcacttgaaccccagaggcagaggttgcagtgagccaagatcacgccattgcactccagcctgggtgacagagcgagactctgtttcaaaaaaacaacaacaataaaagaattaggattctccagcctgaccagcacaactgctatgacagtgatgggcccagccccttggctcctaccacctcaaggaggggttcagaagaagctgctggtgtgagtgaaagctcaagctgggagtcaggttggcctccccctgggtacccacagggctgtaggtgggcacagcagaaggggagaaccatctaaggttgacagtcctatgggtgtgttggtgggggaggaaggaagagaaggaaaaaacacagtgggcaggaaaggagacgaggggcgcttccatgggctgagctcctactttgtgccagacacatgcaaggtcttttacatacattatttcatttaatcttctagattctatgagaaaaatatgaggatactctaatgctacggcacagagacaaataggggtccagggcttgaacttggtgccttctttttccctgcctttggctacctccccaaatgtcaggatgggacctcatgggatggagagactgctcagtctgagagctggggaggctccttggaggtggttctgttggagctgggccaggaaggtggggtgacaggaaggggcattctaagagccctgctaagagccacccagcgacttacctgagctggcttagttctaggcagagggaaggggcatgagcaaagacagattatctgggaaaatgatgcttttttattttctttttgcttctccccttctcttttgaaaagcacgatgctttgaggggagagcagacagaccagtttgtctcagagaacaggtctgtggagatgagaaggaggtcaaagactcagggggaacgtagggacctcaaaacccaagtccagcagaggactttatcctgaggacagaggggacccggggtgcattttaagggaaagtgcagggccagagttgggggtggaatatgcgaggcctgagtccccaagagagaaggctgctgaggccttggcatggcctgggagaggggtagagagcaggtgggggccgtgggggcagggctggggaggaggcagggcaggaggaggtggcccgcccagggacggtggctctgggcagtgtcagatgtggggaggaggcactccctcaggcctaatctcatcaggaagaaagaggccttgtcttggtttgctctctgactcaatctgtacttcctgtgggcctgcagagatgcatctgtgctggaccagaaggatgggcggcgcgggggcggggaaggcggaaacctgaggacgggactctttgcatttgctgtttgcatttgccggctgcagacggcttctgcctcgctggtgatggtcaagccccaaaggagggtccctggatggctgcgctctgcttccctgcctgggctgtgctgatggagaaaaagcaaagggcttcttcccccacccctccaccccgtcccaggtccctcagcactagggcagggtggggccttctggcctccacctaggagaacccagcccggagagatgcacaaatgcactctcttggattctttttgatcagtaggaattgtcagctagccttctgcatgtgtgtgtctgtttccccatcatcatggtttgcaccaggggttggaactctcacgagccacttggcccctgggaggctgcttcatgctttctggtttgggatttttacttagatacccaaaatgctggcctcccagcatatacctgttgtgtgttaaatcacatctcagtgtcttgtacacattgggaccacaacaatcttactagccaacgtcttttgaacactaagtatgcaccaagcatcactctgcatgctgtgtgtatcaccttatgtaagtgtccaggaacccctgcgagagagtgtggacctgtgactgaacagcctggcttcagattccagcccagccactaactagctatgtgatcttaggcaagttatataacctctctgtgccctgtttccttatcttaaaaatggggctatgacagtacttgcatgagggttgagttggtatgtggaacatacttaacacctagtcagtaatataggcgttagctagtatgtgtatttgtagtgcctgattttcctggtgaggaaatagacacattaagtaacttgcccagagtggcagataggaaatgatagggtggtgctgtccatcagaactttgttcagagatgggcatgttgtttaattacactgttcattgggtgttgcttgtatggtttcatctgtgattatgaagcacatgtggcttttgagctcttgaaatgttgctagtgtgactaaggagctggattttacactttatttaattttaactttaatttagaagccttgtgggactagaggttctgtgttggacagggccgtttagagccaagattagacccctgacagtcaagctccggggcctgggccacctctgtgctctcctgcttctttcttgcttaaatcttttacaatggaaatttaaagacacatacaaaattaaaggaaagattcaaatgaatcctcttgtaccctcacccactttcagtagccatcagcagcctgtttcatctctacgcactcattccctcctcctctgtccaacaaccgcaagttattttaagataaatcccagatgttatatcatttcatctgtgaatattaggcatccgtctctaaaagataaagactcttgtctaatataagcacagtattattaccacacctaatgacaacaattctttaatactgtcaggtgcccactcagctttccctgattgcttcctgatgcctttttgcaattggtttgtgtgaatccggatccacacaggatccacacattgcacttcttgctgtgcctctgatctcttaagtctcttctgaactgtaatgacccttgtccctttttccttgtcatcttaaagaaaccggatcttttaaaaaatatatgtatatttcattgtactaaaatacacataacatagtatttgccatctaaatcattcttaagtgtacagttcagtggtattaagtacgctcatactgccgtgcagccatcaccaccatccatctctagaactctttatcttgcaaaactgaaactctatatccattaaacaataacttttcattcctccctaccctcagcccctggcagccaccattctactttctgtccctgtgattttgcctactcaaagtaactcatataagtggaatcatgcgctgtctttttgtaactggcttgtttcacttagcataatgccctcaaagttcatccatgttacagcatgtctcaagactttcttcctttttcttttctttcttttttttttttttttgagacaggatcttgctttatcacccagactggagtacagtggtataatcatagcttactgcagcctctaactcctgagctcaagtgatcctcccaccttgacctcccgagtagctgggactacaggtgtgtgccaccatgcccagctaattttttttttatttctagcagagatgaggtcttgctgtgtcacccaggctggtcttgaactccagaacccaagcgatccacctcatcctcccaaagtagagttttcttccttttgaaggttgaatattattccatggtttgaatataccacattttactgatccgttcatctgtgaacggacacttgggttgattccacatttaagctattgggaataatgctgctatgaacatgagtgtgcaaatatctcttctagaccctgctttcatttctttaagggtgtatattccagaagtggagttgctgaatcgtatgatcgttctatttttaaatttttgatgaactgccgtactatctttcatagcaactaaacccttttgcattcctaccaacagtgcactaaatcagattgtttcaaatcaaattgtttgcttgcttgttgttgagttgtcagagttctttatatattctcaacattaacaccttatcatatggatttgcaaatatttcctctcattccatatgttgccttttcactctgttgctagtatccttaaatacacacaagtttttaatttccatgaatacaatttgtctattttttttcttttgttgcctgttcctggtatcataaccaaggaatcattgccaagcccaatgttgtgaagattttgctcttcgttttcttctaaggttttttatagatttagctcttctatttaggtctttgttgcattttgagttaatgttagaaaccagaaaacttagcatgtaggatgtcctgtgtttttttcctgattgtatctgtgtggctgttaacatgtttctccatactctgtgtgcacagttacatacaaagactcggtcaacagtgggtttcattttttggcaaggccactttataagtagtgtttcctgttgcttcatgttagcagcacataatgtctggttatctcttttagtgatgctaagattgggcagtgggttcaggtattgccaacccatccattacaccactgagtctcaaacttgaacctggggggctggttaaagcagagtggtgagccccacccccagaatacctgattcagtaggtctggggaaggaggcttgagaatttgcaaataaaaagttccctagtgatatggttaatgggggactgcactttgagaactactgcatcacatccattatgtgtttctgttatccttgctcctaacatgcgctggaatcacatgcactggaagcttaagcagtgctggcatctgggtcccccacccagtaatctgatttaagtgattctaatgtgcaaagttgcaagccactgccctgcatgttagcagtccctcgaggtcacaccatctcatctctttctgctcttggtcatttccctgagaggtatgaacatgtggagagcagtgactgaattattcatctctgacccctccgagccctgctcctgacacggcttggcgcagaataagcaccaagtcaatatcagatgaagattggagattgaatgaaatcctcttcacctctctctataaagcttcctggattattctgctttgaaatttctattctatggttcggtatgttgggctctttaagaaatggattctagagcctcctctctcgcagacaacttgacaaagtcagggctaccaggaatttacaatagaattgttacgtgtaagccaggcacggtggctcacgcctgtcatcccagcactttgagaggctgaggtgtgaggatcgcctgaggccaggtgttcaagaccagcctggcaacagagtgaaaccctgtctttacaaaaaaattagccaagcacggtggtacatgcttgttcttagctatgcaggaggctgaagccagaggattgcgcaagcccaggaggttgaggctgcagagagcactgatcacgcctctgcactccagcctgggtagcaaagtgaggccctatctcaaaaaaaaaagaattgttacacctagaccctggtggtggtggtagtggtgggagagtgaccaacttatccctgtttgcctaagtaagacttcccccagtttagcgctgtaagtcctgcctccctggaacccctccacaatccgaggcaaaccaagacagttagttgccctacttctgtggagagcggcaaggaccctttttgctttgaaggagggaggaaaaattaccctgtggggtgagactgttaggtcctagcacactggatcccactgtatcacttcagaccttgttgctggccggtgcaaggcaaaagttaagacacctcgtgccaagaggtggtggtttaaaccagggtctggccttagattcacagagcccagttgtgataaaacccttacagaggagaagtagctgagccttgtatttttttcttcctgcctggtgagaaaggaagatgctgtgggaaatggttacccagaggcctaggttggcagcagggtggccttatcctccatgggctttgatttcagagccagatatcccactcgcaatgggtggatcagagaccccataaggattctggatgactgaaaagagctttcccagcaagtttagggccaaggccaggatcaagataaactgtgatggataatagtgggtcagggattggagtccaggtgagggacccacccatgatgagacgtgtattgtgtgaattctcagcctttgtagagcaccttcacatagagcgttctttatcctgattaacagtaacctcttttcggtttttgaaataactgggtaacttgtggttctaatcttccctaactgtggctgtgacataagtgtggtggttcagaccctctcaccaggcacttacaggtggcagctcactgtgcccacaagtcaaattttaagagagagaacagataaaacttcaaatattatatgtgaaaccacaaatttacgaaggggcactggtagccagcaatgcctacccatcctgttcaaagaccaaatcaggtcatttcattctttccttaaagccacaaacagtacaattaatgaataatctattataatggtttgcaccacgcccagtttgggttcagtttcagccaccctgcagctaacccttgtcctgcaatgagtttagggctgggtaaagaagaggggcctttggaacaggcaggaaactctctctgtctctttctctctctctctctctctctctctctctctctcacacacacacatacacacacacacacacaccccgcatgtatgtcaagaaaggagcatattgcatagcaggaagaggggtctctcaactagtcctcagactacttcccacctgcactgctcatcataacatgacttcagtctagtcacttcccttgcaccccagttttcccatcatcaaatgggggaaaataatccccacctaccttgcaggagagttgtgagccactgtcaggtgttaagaaataaactcaaggccgggcacaatggcttacgcctgtaatctcagcacttagggaggccaaggtaggcggatcacctgaggtcaggagtttgtgaccagcctgggcaacttggcaaaaccctgtctctactaaaaatacaaaaattagtggggcacagtggcatgcgcctgttatcccagctactctggaggctgaggcaggagaatcgcttgaacccaggaggcagaggttgcagtgagctgagatagcaccactgcacactccagcctgggcaacagagcgagactccgtctcaaagaaaaaaaaagaaataaactcagtgcgatgcaaaacccagagatgactacatcctttctgggagttgggaattcacaggccccggagcctaatcccatggcatcaggcccaccaagcctgcatgggatcacagcagcagaatggatgccacctcccgccttgtgcccagcaggctgtcccagagtgccacacctgagaatgcctgttgtggctttgatgtgggcccagccagatggaatggggcaggataagatgagtggcctgggatagacctggctcgaatcggctgttctggcccagcctgtaggcgaagggcccgctacagtactcacttgtgggcaagtgcctgcttgtagggaaaatgaactcctgttctctgaattactgagtcattaaagtcatgcatgcacggatacacgcatgcgctcatgcatgtgtatatacacagcctcagttaaacatccaaagggatgcacacgtgcatgcacacccacaaaacgacacaggcgctcatgaacttcctgatgaatgcagttcttgtgcacacacagtacgcacacaggccagcacgcatgcacaagcttcacccatgcatatacacatacacttccatgccacatacaaagggagaggtagctggccttgctagcggctgccccaccccctacttgtgaagtttcccttcatgacagcaggtctggaagaatcttagcagtgcaaataagagttagggtggggagaggattgggggacggacagaagggcactgatgttcacgctcttttgctgtcagctggcttcatccgtggggaagtggggagcctttccagagggttctagctagcttcctgggcctcattttccttctctgtagagtggaagtgatcatgatcatgacagttcctcttagggacagaggtgagatccagggctgtgatgggtctgaaagagctattgtcatcatgggtattgtctgtgaggacctggagctgcaggctcaaaagctgcaggcttgagacagctgagtgcagcccccaggcctgctgttcactagctgtgtgacccggttactggcctgaacacctacatctgaacgggggagcaaggtagcacccacttgctctattcatgcatggaaagcatttggaatggcgcctggcagcttgtaagcactcaaaaaccatgacttcttattgccacagaggtgactgtgagctccaggggaggtgttgcccaggcctctcacggcctcctcactcctcctggatggagagtggctctcaggagttgggccagaccccaggtaccccctacaggtgcacagacaggctgtggagggagacagctcagagggtccggaaggggccagggctgttgttaatgtaagctcatgtcgatttcagcgactaccccaggcccgccacatgcactcaggcaccacatttggttgatcccacctccttggtatttcagtaacatcctctccccaccatcccgtccacttcactgccctactccagcccgggtgaccattgcctcttacctgctctatcctttcctctgctcaggaatcagaggaaaacctgaaaattaaatctggtcctctatctcccctgctttatttattagaattattattaattatttttgagacagattatcactctgttccctaggatggagtgcagtggtgcgatcttggctcgctgcaacctccgcattcccggttcaagtgattctcctgcctcagcctccagagtggctgggactacaggcgcgcgccaccacacccggctaatttttgtattttcagtagagacggggtttcaccatgttggccaggctggtctcgaactcctgacctcaagtgatccccccacctcagcctcccaaagtgctgggattacaggtgtgagccaccgtgcccagcttctcccctcctttaatttctccagtagctccccactgccctcagagtccgggtatctgagatgatctgggtcctgcctcctcctctgtggccacaccaagcacaggcagccacttgccatctccatgggccggacttgcataggctgtatgaatcaggatgggtcgctgtcctccatgacaaataaccccttatctcatggttcactctacaagtgtatttctctgttgcactgtatgtcagtagaagaaagtgctctgctacacatggttcctgagggaccaactaccttatagatgcaccatctgaaacatgcacccttctcatccctttggccaaggacgagagtcctagagggtcacaggcaggtctcatgtgctttggcctggaagtgacacacatcactgcctcccatgatccactggctaacgggtcataggaggcagtgatgtgtgctatggctgcctgactggaaggggcctggacatgaggggagcaatgggacgtctggtgagcatcaccagctgccacagacaggtgcactcccgccacccccagcagttgctcaaggtgagggaggagtgggggggcctggagcggagcctgctgatttgctccttgctttcccacccgagcccaggcccaaggtggctcctccactgccaccaagttgccaagaccctagggaggtcatttgtccttgttgtttctttccaaggggacccccagtacccatttctctcaaaactcactatagagaaaagatgtgctgctccttagcaacttgtggcttttatcttatagacaccaaataaatccctttctgattctcttttccttgttgaattggccactaggaagctcagacccaaatctgaggtctacctcctctgtgtggtggacctggccgcacacctagcttaactcctcctgcgtttcaggtgatctctttttacctgcattttccttgtgtccctattttttctcttgtagctttttcatttccttctatcttgtgttctatttttgtgagtcttcttaaatcctttctggaatcacatgggcattaattagtcagtccatccctacattctgtgcagcttcctgtagctctggcaaatgcagccagggtttagggcaaagctcccgaaaggagagttggaatttctgagctttatgggatacacaagcccctgcaagactgacgtgctacctggtgctgtctaaagggcttgcctcaggggtcaggcccttatcgctatgacttgcctgaggtcacacagtgtaatctcgttctgaggaattgagcacagagaagagcctcatgggtcagccgtgtgggctgggtgagcatcttctttatcttgaccagcgtaggcccagccaaacctgccttcccctaagtggggaaggtgggggcccaagggggatagacactgtgctggacactcctggagcagagccttctctgaggaagctccaagccagcagagaaaatgagaactgaccctgaaccccaaatcagggtagacagtgtcaagggctaaaggcaaggggagaggtggctgtcagggaacagaggagagcgagatctctgctacttgggatatcaaggaggactctctggaggaagtggcttgggagctagggaaggggcggatttggatttgtggagatgggaacaggaggtgggggcatgggaatggcaagccaagcagaaggagagggacgggcaaagagccagagggctggagatgcaagagcaggtgctggggaagctggaaggtgccgtttagatgagctagaagaaaagaatcttggaatatggaatgagacccagccagaggccttgaatgccaagccaaaggatttggccttgatcctgtagggcagcaatgaatgggcagcatcagagggtgatgtgaggccaggggcagtggctcacgcctttaatcccaacctttgagaggcagctacaggagaattgcttgagatcaggaggttgagaccagcctgggcaacatggcaagaaaaaaaatttttttaattagccaggtatggtggcatgtacctgtagtcctagctacttggaaggctgaggcaggaggatccttgaggtcaggagtttgaggctgcagcgagctatgatcacaccactgcactccagcctgggtgacagagcgagatccttcctcaaaaataataataaataaagggtgatatgaggtgggggtggggtggtgagggcttggtattcagaagggtccgtctggccaagaggaggccccctggtattatgggtatgggtttggccatgaaagaggcctagaccctctcacaggccacttgtgatctggctctcctcgcccctctggcttgtattctcttcattcacgttacccaatatacatggtgtgtgtgtgtgtgtgtgtgtgttttcttctttttaatttctctttgataatcttactaaaccacatgtggttcccccaaactgttctatctgcctaagacaccttcccccagctctccctcatcctgcctacatgaccaactcctactcatcctccaagtcactgtttagttgtcacttcctttgagaagccctccctgactgtcatgtgcgaatctctgttattacccatagtacagtcggtcccagtggcccagactctcctagtagcctcacccagaggactcttcactcctgtaaaggctgggctcaggcctactgtttccaaactccctggtacctggcacagggcctagacacacagtgatgctcggtaaatattgagtgaacaaatataaggctggacgaggagcaaagcaagctgaagatgcccagatgatactagtggctgtgattgccactgttgatcaagtatctgccatgcaccaaggggtctaaatacatcatctaacttaatccttatgacaaggctatgaggcagatacttttttcaatctctctctcttttattttttttttagagacagggtctcactgtgttgcccaggctacatttgaactcctgggctcaatcagtcctcctgccttggcctcccaaaatgctgggattacaggcatgagctgccatgcctagctgagatggatacttgtgttacctcattttacagatggagaaactgagactccagaggttaagtcacttgccatccagctgataagagacagagctgggattgaaacccaggcaggctggctccagacagcacattggtacctacttagtcgggctgagggtactgggctgtctggtgaaacagcagatgggggtcaatgtggtggattctctctatggttcttctgccttgttatattcacactcaaagggatgaaaagccttaacacatcagcaagcaggtcagtaatagctatgcttcatcccatcttatcttaccaggtctacagaagtaactgtaattagagtcttttcacttgtttgcccttcacagtgcatcaccgtccacgttgaactgaccactgtcctgctcgtaccctcttatgtactcttaagatgagagctctgtgtgtcccatgatcagggcagtgagcctcataccctttgtcccatttgtctcctgcagatgtcatggcacccccagtaccggagctccaagttccgtcatgtctttggcaaaccagccagcaaggagaactgctacgactccgtgcctatcacccgcagcgttcacgacaaccacttctgtgccgtgaacccccacttcattgcagttgtgactgagtgtgctggtggaggggccttcctcgtcatccccctgcaccaggtaaggacacccccaggcccaaacagctctctggaggcagggcaggacagagggaaagtggaaagagcctgggtttctagaaagtcctagccctgcccattactagctgtgtgaccttgagtaagtcatttcatctctttgagccttggtttcctcactgggaaaaatacacctgtcctgaattttagcctctagcagttggcttagctactcgtagcacctctcctcttctctgcaatataattctgcgaatttatttcctcctgaataaaatataattttttaatgctttactgggattacaggaaattgggaaagtctccaaagccaccttccccaccaaaaaaagggaaacaaacattgagtcaaaactagctaggagaggcaaacagtaagcaagcaggaagaacaggcttttgtccttagtgcaagtgttgctagcgtaggttggaccatataaaattgtggatattcaactggtttgaccccaaaaaagcaacattttcacatagatcaacctaatagtagttccattcaggatgccaaccctgagtctctaccttaaggcagaacacctgaaggggctagagggatcccaggttagtagtgccactggctcacagcagaaactgacatgaagcctctccagaggaaagcatccacaatgtggacaggatccccacagattaaacatagagaaatatgaatccacaaagatcacaaagcatgtacaccaccatgagtgagagtcagctgaaacacaaatagcagacttagacccccagaggacttcagaagttaaaagatcacgcagattagaatctcatagaccaggtttcctgaacacaatgcaattgagttagaaatcaataacaaaagataaatcttaaattcccattcatttggaaacttaaaaactatttctaaataatttataggccataaacaaaatcaaaatggaaatttaaaaatccttggaattgataaaatgaaatatatcacaaaacttacgagatgtagggaaagtggggcttcaagggaaatctatagcactaatgcttatattagaaaagaaggaagcctaaaaattaatgattaaacattccatctaagaagttagagccgggtacagtggctcacacctgtaatcccagcactttggaaggccaaggccagaggattacttaagcccaagagtttgagaccagcctgggcaacatggtgaaaccccatctgtacaaaaaatacaaaaattaactgggcatgagggcatttgcctgtggtcctagctacttaggaggctgaggtcagattacctgagcccagggaagttgtgagccatgctttcaacactgtactccagcctgggcaacagagtgagaccctgtctcaaaaaaaaaaaaaaaaaaattcaaacaaagagcagcagaataaacccaaagaaagtttgaggaaggagataataaaaagcaaaaatcaatgaaagagaatataaggatacattagagaagataaaagggccaaaagtttgtttttagaaaagggtgatagacaagcccctgcagagactggccaacaataaaagagaaagggtacaaaaagcatcaggaatgagaaaaacaatatcacagcagagctttgaaatctaataagaactaatacaagcaactgtatgccaataaatttgagaacattaacaatatgggcaaactccttaaaaaatataacttgtcaatactgatttatgtagaaatagaaagcctgaatagttctttaaaggaatagtcctttatgtactttaaaaattgaacaataggccaggcgtggtggctcatgcctttaatcccagcacattgggaggctgaggtgggtggatcatgaggtcaggagttcgagaccagcctaaccaacatggtgaaaccccgtctctactaaaaatacaaaaattagccaggcacagtggcgggcacctgtaatcccagctactcgggaggctgaggcaggagaattgcttgaacgcaggaggcagaggttgcagtgagctgagatcatgccactgcactctagcctgggtgacagagccagactccatctcaaaaaaaaaaaaaaaaaaaaaattgagcaataaaaatttcccttaaagaaaatagcaaaaggaaaggcgagctatagagtggaaaaggatataataaacatgacaaaagactcatttcttgaatgtataaaatgtaccgaaaaatccacaaaacactgaaccagcacttcatagcaaagaaaatccaaatggctaataagcatttgaaaaactactcaacctcattagtaaaccagtgcaataccactacacatcagattgtcaaaaatgtctaacactagtaaatgacagcaagtatacagagttgtgtaaacgatcagacacttctgatgggagtgtaaactggcacacctgttttggaaagaagaagaaaatgcatatacctgtgacccagaaataccaaccataggtttataccacgcagtgttcaccactggtgctctgtccaccagaacagaagcataagaatgtgcatagtagcattgtttgtattattgcaaaactgggaaaacctgtatgtccaagaacttcataaataaattatggcatatccatacaagtgaatgtacaaaaccacaaaaaggaataaagtgtagttatatacaacaacatggttgagtcagaaagataaagttgagtgaaataagccaaacaaattttaaactatatcatttaattaaccttaaattaaaaacagcctacactaaaccatactttaacagttgcataattacatagtgaaattttaaagaaaaacaaagaagagactaccatgaaaaacagaatagcagttacccctgggggatggagagggttacgactggaaagcatctcgtgggagacctcctatgtgctagtaatggttcatgtcttggcttgggagggtagcaattatgggtaatttattttccagtaatttgttaagctgataattttcattctttacactttttgcatgtttcttatattttacatacatatatttaaaatatatatatatatatgtatttgtgtgtatatatatatatatatatatatatatatatatatatatacacaaacacataagaaagactctaggcctagatggttttacaggtaattcctacaaaactttcaaggaacagattctaatcttttacaaacatttccacaaataaaaaagatgaacaacttctttcctcattctgtgaggccactgtaaccttgataccaaaaccagacaaggaggacagaataagaaagaaaaaaatattgatcaatctcactcatgaagatggatgccaaattactagcaaattacagtaaataaaagatacattctgaccaagttggatttattccagaaactaaaggtgatttaatattagtaaatctataaaggtaaatcatcatattagcaagtgaaagaggaaaaaccatatgatcatgtccatagatggagaaaaagtgtttgataaagcccaatacccagccatgagaaaaactcagcagcaacaaaaagaaaattagcaaatgaaggataagggagaatttcactgacctatagtaaacagcattttaaaacctttttatcttgaagcaatttcaagcctacagaagatttgcaaataaaactgaactaattcctgattaaccttcacctggtttaccggttttaacattttgcctctcggggtgtgtgtgtgagtgtgtgtgtgtgtgtgtgtgtgtgtgtgtgtgtgtgtgtgtgtttggaaacagagaagttacagacatatagcctgggcagtatagcaagaccccatctcttaaaaaattgctttttagttagctgggcacagtggtacacacctgtagtcccagctacacgagaggctgaagcaggagaattgcttgaggccacgaatttgaggttgcagtagctatgaaagcaccactgcactccagcctgggtgacagaataagaccccatctcttaaaaaaaaaaaaaaaaagttatcagccggatgcgctggcttacgcctgtaatcccagcaccttggcaggcccagacgggcagatcacttgaagtcaggagttcgacatcagcctggccaacatggtgaaactccgtctctactaaaaacacaaaaaattagccaggtgtggtagcgggtgcctgtaatcccagctactcaggagtctgaggcaggagaatcacttgaacccgggaggcaggggttgcaatgagctgagatcgtgccactgcactccagcctgggtgacagagcaaaactccgtctcaaaataacaaaaaaagagaaaaagttatagagatgaccctttacccccaaatactgtacttcggtctgtatcttctaagaacgagaatattctcttatataaccacatcctagaaatttaacattgattcaatgctaattataatatacaacccaaattcaaattacatcagttgtcccaatgatgacctttataatagcttttttttctgatctagaatccaattcaggaccacacattagttgtcatctcttagtcttcatcacttcatgatattaacatttttcaggagtaaaggtcagttgttcagtagaatgtttctaaatttggacttaccaaattgtttcctcattattagaatcatttatgtatttttggcaagaatattgcatgagtggtggtatatcatttttaggtcattacatcatgggacacatgatgtcagtttgtcacattattcatgctattaacttgacttatttgttaaatagtgcaaatatcattcataaaggggaaatgttagaagcatctacaggccaggcagggtggctcacacctatgggcccagcactttgagaggccaagatgggtggatctcttgagcccaggagttcgagaccagcaacatagagaaaccccatctctacaaaaaatgcaaaaattaaccaggcatagtggagcatgcctgtagtcccagctactcagaaggctgaggcaggaggctgccttgagcccaggagttcaaggctgctatgagccatgaacgtgccactgcactccagcctaggtgacaaagcgacaccctgtctcaaaataaataaaataaaataaaatcaggaataagataaaaggtcatggcctgcacagtaagactagaaaaatgtaacttgtcaataccaattcaagtagaaacagaaagcctgaatagtcctctaactactaaacattgagcaataaaaatgtcccttaaagaaaaaacaaaaaaaaaaaacagcaaaagaggccgggtgcagtggctcatgcctgtaatctcagcactttgggaggccaaggcaggtggatcatctgaggtcaggagtttgagagcagcctggccaacatggtgaaaccccatctctactaaaaatacaaaaattagccgggcatggtggcgcgcgcctgtggtcccagctacatgggaggctgaggcaggagaatggcgtgaacccgggaggcagagcttgcagtgagtcgagatcgcgccactgtactccagcctgggcgacagagcgaaactccgtctcaaaaaaaaaaaaaaaaaaaattagccgggcatggtggtgcatgcctgtaaccccagaggcaggagaattgcttggacccaggaggcggaggttgcagtgagccgagatggcgccattgcactccagcctgggtgacagagcaaaattccgtctcaaaaaaagaaaaatagcgaaagaaaagttgaaagtgttaggatggaaaaggaagaaataaaactgctattatttacatatataattgtctacatagaacccaaaagaacatgtagtcaaattattagaaaaataagagtatttggaaggtagtggatacaagaatcagaacacaaaaatgaattgcatttgtacatactgggaatatttagatgatataattaaacatttgcaatagaataaaagaagattggatacctaggaataaacaagcaacgcttagaaggaaaatgatagaacattgttaaaagactaataaagatgacctcaatagatggaaatatttactatattcatggatagacacttttacttcctccctcaaattcccacagcattctctttttttaggacatattccaagcctattttttccttagaaccatgccctgactactttgaattagagtcctttgtgcttttctgctagtacctcctaatgtagttgggtgcataattgttgctcataaattttcattaactccacaaattatctcatggttgttcatccaaataaatagggagggcataaatggcaaagggaagggcacaagcaaaggcatggaggtgcaactgtatatagaatgttcaggaagcaatgcagagagcagctgtctggccagaacaaataatctgtgaaggagaagaagggaagtaccctaaggaagtggactggggctagctgagcagagccttgaatgctggggtgaggcatgtgacctgtatcctaaagagagagagaatgtttcgagctagggagggacaagtgcaaaatggaatttgtagaaagacataaaaaggtcaaaatgggaaggaccccctatagatggccgattttgctacttgtttcttccaagctttgcatgcttgtaaaagattacgtccaccaaacaaactgcattcttaattaattcaataattagttggttttccttttattactcaaactctcagaactgtcactgtttctaacttgcatgaactgctcggtgtaaatgggtactaacaactgatataaagaaaataaattggtgtgatgtgatagagtgtgacgtggtttgggagaggggacctagtttaggcaggatggtctgggaaggcattcctgggaaggtgatctttgagccgagagccacttgaggctctaaagggagagtatgctggcagaacaaatagaacatgcaaacattcccctgagtgggaatgggtttggtgtgtctgtgcattgtcagcacgtggacacatgtgctgtgaccacagagtggtgggaggaggtgaggtcagattggggagtagggcctggactgtgaaggcgtcgtaagcccaggcaggagtctgggctctatcctgagtccagtgggaagccactggagggttgaaactcacttgtcagccaggcgctgtggctaacacctgcaatctcagcactttgggaagccgaggcaggcagatcacgaggtcaggagtttgagaccagcctggccaacatggtgaaaccctgtctctactaaaaatatgaaaaattagttgggcgtggtggcagccacctgtaaccccaactattcgggaggctgaggcaggagaactgcttgaacccaggaggtggaggttgcagtgagtcaagatcgcgccactgcactccatccagcccaggcaacagtgcgagactctctcaaaaaaaaaaaagaaagagaaaaagaaactcacttgtcctacacagcctgatcctagataaaatgtgtgattctctttgggctttttgaaatataataaatagctcaaagatacatgttaattgctatcatcacagactcctaggaatccagatccaacaggagctgtgatacagtttggatgcttgtcccctccaattttcatgtggaaatgtgatccccagtgttggaggtggggcctcatgggaggtgtttgggtcatgggggcagctcatgaatggcttgatgccctccctgtgataatgagttcacctgagatctgattgttgaaaacagtctgggacacctccccgtggcctgcggcacacctgatcccccctacactgtctgcatgattggaagctcccctgcagtccttaccagaagcagatgctggtgccaggcttcttttgcctcctgcagaactgtgagccaaacaaacgtcttttctttgtaaatacccagcctcacatattcctatatagcaatgcaaaatggactaacacacccaggagccactgatcagagcttctcatactttagtgttacaacacagattctgatgtagtgggtctgaagtggggccagggaatctgcatctccaacaagctcccagagatgcctgataaaatacaggatgcccagtttaatttgactttcagataaacaacaaatcgttatttttgcttttttctttttaattaaaagttttattttgacatcatagtagattcacaagcagttataagaaatagtacagtgcaattctgtgtatcctttaccctgtttcttccagtggtaacatcttataagactacagtacgcagtacagcatactgttgtgatactggcatcactacagtcaagatacagaacattccatcatcacaaagatctgttcccctccacccccattccctccttaaccccagatgacaattaacctgctctccatttctatacttttcccgttttaggaatgttacataaatggaatcatacaatatgtaaccttttcagcttggctttttttactcactgtatttctctcgcagttcagctgggttgttgcatatattgagtattgatcatttttttttgtgttttgtgtgtgtgtgttttgttttttttgtttgtttgttttgttttgttttgtttgagacaagctctggctctttcacccaggctggaatgcagtggcatgatcatatctcactgcagccctgaagcctccacttcctgggctcaagcaatcctcttacgtcagcctcctgaatagctgggactacaggtgcatgccatcacacccagctaatttttgtatattttttatgtagaggtgaggttttgctatgttgctcaggttggtcttgaacccctgggcttaagtgatccacccaccccaaacttctggaattacaggtatgagccactgcacctggcctcaattatgtgttccttctttctttttttaaatttttatttatttatttatcttattttttttttttttttgagatggagtctcgctctgtcgcccaggctggagtgcaatggcatgatattggctcactgaagcctccgcctcctgggttcaagcaactctcctgcctcagcctcccaagtaactgggactacaggcacatgccaccacacctggctagtttttatattttcagtagagatggggttttgctatgttggccaggctggtctcaaactcctgacctcagttaatctgcctgcctcagcctcccaaagagctgggattacaggcatgaaccaccttgcctggcctctttttttttttctttttttttttaatagaggcgaggtctcatgatgttgcccaggctggtctcaaactcctgagctcaagtgatcctcttgcctcagcctcccaaagtgccaggattacaggcatgagccaccactcctgcctctgtgtcctttcttactgctgaatagtattctatggtatggatgcactacagtttatataaccattcactcactgaaagccagtgggttgtttcgagtttggggctattacagattaagctgttacaaacatttgtgttcatatttttgggtgaatataagtaagtctccatttctctggcataaagggccaggagtgcggttgctgagtcataaggtagttgcatgtttagccttataagaaactgtcactttatttttacaaatttttagtgtaagtaaaatattgcatggaacctccttatgctaaaatattcgttgtttatctgcaatttgaattttactgggcatcctgtattttacttgctaaatctgacttccctcctcccaggtgataccgatctacttgtttgccaattgcattttcaatagcaaggctctaatctagctcaggttcataattatggaaaaatctcaagcacaaaagtagataaaaataatatgatgaactttcctcagcccagattctagaattatcaagtttgccctcttgcttcactcatcccttttacctgaagtattttaaagcaaatcctagacattttgtcatttcaacctctgccccccgccccctaccacatgtcagtatgcaattctaaaaccagggacattttctgacataaccataatgccaggatcacattaataataactcttgtgtcacctgattcctaattcatgttaatggtccctggttgcctcatacatgccactttgcttgtggtttgtttgcctcaaagtccagatggggtccacatcttgcatttgattgatgtttctttttaattttttcttattgtaagtagagatggggtctcactatgttgcccaggctggtctcaaactcttgggctcaagggatcctcctgcctcagccccccaaagtgctgggataacaggcatgagccaccacacctggccaatatgtttcttattaagtaaccacatccattactactgtgcaggcaccatgccatagcacttacctgcacagacaggccttagaggctctttattatgttgtaaccagggttggagtgattatgctgataccttatgaacattagccccatttataggggatcttgccccattgcacagatgaggtcgctgaggctcaggaagatgacttcccagaggaccctgtgcagtgtgtccaggacccgaatgggagcccagacctgggtgtggcctcgggccttgctctcacttcactgacatgaggcccctgaggtttggcactgatttgcatcagctcctacttgttaccaggattacgttctgtgccaggcacagagatgtatcagtaggtgagtgatgtgagaacaaggaagggacaagctagctaatgatttaattaagtacataaattgcattgagattgggagatgtctggccttgccacagcgtgcaggaagtccttctcagaggggccgggctgccccaggcagtttcagatgtcccaaagggagtgacactgcaggcagggtccctccctcttgcctgttgtgacccagggtgagctggttagagggaggctggaggtgagtttcgcaacctgcagccttggcaaccagggactgtactcagggaacaaaggcagcaggggaaggctggggagaggccaggactgtgctcctgagcctggggcccagcctgccacagagtcactccagggagggggtgaagaaggtggactttgctgtgaggtgtggagggtggggaggaatgaaagcaagggcaggcagagcccctgggggtcagccctggaaccctgctgggagtagacaggccagaggggacatgggcctgagggcctaatggacaccgtggctttcaggtgcctgggagagtggagaggagcatttcactgccatgatcttaaaggccagccttagccagcatggtggctcacacctgtaatcctggcactttgggaggccaaggcaggagatcacttgaggtcaggcattcgagactagcctggccaacataccaaaaccctgtctctaccaaaaataaaaaatcagctgggcgtggtggcacatgcctgtagtcccagctacttgggaggctgaggcaggagaatcacttgaacccgggagacagaggttgcagtaaaccaagatcgcaccattgcactccagcctgggcgacagagcaatactctgtctcaaaaaacaaacaaacaaaaaaccaaggccaacctgacccttctcaagccgatgtgtgtccacatcactccgctgctcagatgcctcccaggactccttgctgcctgcagataatgttctgcctctctcatcaaagccctctatgccctgtcctagccaactgtttggaacctcagagccttccatagcacatatctgttccctccatacaaattgcccttctagaaaggcagggtatgggctagtctggcattttggaagtctcttccagttctaggggtttgttcatcctggacaagaacatactcaaggaatgggtcctctgtcttcaaatatccaaggagttggcctgccacagagggcccagatgtgtctataggtccccaaaggacaacgccaggaccagaagtgggaagtgaggggaagcaggggccacctggaggccacactgggctcgaagtaggaaacattttctccaaattcacaaggtctgaaagtaggatgaattacctcaggaggaagtgagctccctgtccccacaggtgaccaagtggggacaccagctgtggttcaccgctttcatccctggatgttggattctacagtaaaccctccaaaggctcatctgggtgctcataaggagaggggtgatgaaggatgctctgccctaaatcatgggaatgtgctgtgcattttagaagtgctgccattcctagggtcaagaaatgctcctctcatctctccctctgctcaatcccagcctcctctgggcggtccctggtcccacatctcaccctctccagtcaggacatggctcacctatccatttgtccacctctctattgggtccagccttgcaccctgggcagggtgagtagactccatgccctcagcctcacccctcttgctcagcctcctctcttgccctgtcctccagcctaccgtgcccgctggctgcttcagcctcctcccacttaaaacctacctgtggccctgcctttctgacttgagattcctcccctccacctgacctggtcaaagtctccctctctttaaggcccaatttaaagtcctcctcctccagggagccttctctggttcatcccccaggtctcttgtgtgcctctcctctgagctcaaagtatattccttcctgcctcctccataaggtagatggctcctatagcccaggattgtgagtaccgcatctctgccatcacctgcatgcagtctggcacatagtatgtcctcagtgaaaggcctgtatgatgatgatgataaccatggtgtgaggacagcaagagcagaccaggccataagaggaaacattcccaatcctggctctgctgtccttagtacatgattgtcaacctctctgagccccagcctctgcacttgtaaatggggaattcttgtactatgtcctggggtggttgggaggtaaatcaaatattatgagcaacgcagctggcactgggcctggcacatatatgactccctagattatggtttctaaagaaaagctttttttttttttttcttcgaaacaggatctcactctgttgcccaggctggagtgtagtggcacgatcatggctcactgtaggctggacctcccaggctcaagtgatcctcctgcctcagcctcccgagtagctgggaccacaggtgtgcatccctacaccggactaatttttgtagagatggggcctgttgcccaggctgctcttgaactcctggccttaagtaatctgccttggacttccaaagtgctggaattacagacatgagccactgtgcccagccaagaagcatttaaaaacctatttcttatagacatgggaacatgtctgatccagctgcctgcattcaccagtaggaaaacaatcaagccactagttcattcatggagggcatgcctggagccactgctatgtaggaaaggatgggagtccccctgcagaacagtttgtcccctgcccagtgagtatatcccctggcccctgaaacatactgagcaacaatgaaactgggtaatggtaatgagctgtgatgagcttctcctggctaatgtactgagtacttagcaagtactgggcaccgtcttcagtgctttactgtgaatgaggtgctactactgttgtcatttcgtagataaggaaactgaggcatagagaactgaggtcacttgcccaaggctgcaccatggtaagggatgtggcagggattccacccctggaagccagagtctgcctgcccacttcacctctgctacactgtgtgtcctccctctgcccgtcctgccacccctgcctcccagtctccaccctgagctgttgggatgctcatttgaggccatgactatgatgctgttgtaggaacagctgctcccttgactgctgagggtcgtgacagtggcctcacaacctctccctttctggcaatggaggtcagccgtagagagtccccagtctggtcccccacccgcctgactcctcctgggtccttctgtcctgtcttccccctctgccccagggcagccccttggagacttggaggtgatgcctctccaggcagggcggcccaagccagggttctgtggggtctgcgaggggagcaggcgtgtctcccctgatttagagcttgtacaccacatccatcagaagcctgtttctggctgagtgctggcctaatgggcagaaggtggaaatggcctcctgatgataaatgtccctgacaggcttttagcagctcagtcaatagcccaccaggctggctaatgtccgctcctgcctgtggtcctcagcgtaaaaccttttagaagcagagcaatctgccagcccagggcagggcagcgcagggcagcgcagggcagggcagggcaggggaggtggggcggaggggagggctggggtgggctggggtgtgagtgggcagccttccctcatcagctgagaaggaagagaaggctgagaaggaagagaagctgtctagggctaggcccttctgagccacgcccaaccctaaggcgccttccctgagtctgtgggaggtgggaggtgtgtgtctgaatggggctcctgggcactttgcctcccgtcagcccgagggcagcctgactattggctcatctggcttttcttgggaaaccgcactgcggaaattggggcatggccctgggccagagtctaaaggcccggagagcaatcagtgccccacagccaaagacacagtactgctcatggcctttgacccaggaaatgatcccagagaaaggaaaggctgtgtgcaggaaggaggccagggcagggactcacagagcactcactggtgctccctcagagcacaggaagtacagcaccaggctcacacttggggaaccagaggcctgggctcaagcccagctctgcccctcacctttgcagtgaccctgggcaagtccctactccatgctggatttccccaagtctgaggtccgagagagggtgctgggatccattcgcaatgcctgccacaggtgcaggataagacagtgcagctgtgggctccattcctggtctctagagcccttcaagagctacagttttataacagaagtttttggctaatcctggatggacccattttttcagaaaatctgtatttttgtttttaaacaccttttttaattgcaaaacttacatagctaaaaataagacaaagatattaaagccagccatttattccaccatctagatataaccatgattaacattttggctcattccttttagtttttttttctcagttttgacatacaaatatacatacatatacatataataatagcttctgttactgagcacttacagtaacacctgactgttgggctcttcatgcatagtatctcatttaactctcaacaatcctgcaaggaagaaatgattattcattcacattttacagatgaggaaaaagaggcttgcaaaatgtgagcaggtgcacaacatgctcaggttttaattttcgaaaactcaccttgaggacagtgtacaggatgtcctggaggctaagcaagaggtcattggcagctgggcgcagtggctcaagcctataatcccagcactttggaaggccaaggcgggcagatcacctgaggtcaggagttcaagaccagcctggccaacatggcaaaaccccgtccctactaaaaaatacaaaaactagctgggtgtggtggcacgcacctgtaatcccagctactcaggaggccgaggcagggagaattgcttgaacctgggaggtggaggttgcagtgatccgggatcgcaccgctgcaccccagcctgagcaacaagacgagactccatgtccaaaaaaaaaaaaaaaaaaagggtcagtggtcccatggagacctgggccagggcctgtgggtgcagtgtccttctaagaccctagctccaggtaccgccctgccaggacagggcaggaagcatgcacctctctcccctgtcctgctgtagaagaggcagagaccacttgaaagagagaaaattttcacctccctccatgcacatcactaacaaaggacacaagtccacattctttcctttttttttggttctctttctccctctgaatgtgtaggtgtgtgtataattttttgttttcagaactctttgagggtaagttacatccatcttagcccttcatccctaaatactgtttcctaaaaatacaaatattctcttacattactgcagtacattatcaacttatataagtttaatgttgtgataatactgtaatctaccgttcttgtttagatttgttaaataatgtcctttatagcgttgtcccctccagtaggggatccagtctaggcggaggtgtctgatcactttttcctgaggggagagacctggattagccagagtatttccagagggaggcacaggaccacctcctctgtttgcagagctactaaaatgcatgcataggccaggcacggtggcccatgcctgtaatccctcactttaggagggcaagttgggaagattgtttgagcccaggagttcaagaccagcctgggcaacatagcaagaccccatctctacaaataattttaaaaattagctgagcttggtgacacatgcctgtagttcttagcctggaacttgggagggtgaggtgggaagattgtcttaccccgagttcgaggctacagtgaatcatgattgcaccactgcactccagcctggacaacagagtgagaccctgtctcttaaaaaaaaaaaaaacaagtacagtggtctctacacagatggggaggtgatggaagaagagaaggttgggtgttccctgagtccaccctgttcttgaaagtccctctagaaaaaatcccaagactattgattctgcaaagtcaaggactatgttgagtgttcaccttgcaatcagcccctccaacagcacctgtcccctgggcacctcgggaatatttgtgggatggatggatgttggccagttttcttctcagctgtctctttcacttagatataaaaatggctgggggagcattctggtgggtggctcaagaacctggaactagatggtggatgtgggaggtcgagggcctgggtcctggtccctgttctgccagggccatgcaatgtgatgtgcaaaatgagcagattggtcactgccagtccaaggttctgtgactgaactggtgtggtttctctatgaccccaagaaatccaagtctcttggtggagttggaaatagcttcagggctgtgtggcatgggctgggggacctgtatgtccctcccagcacctatacaggaattctcattaggaaaggggaaaatgagggaaatgccctttctatgtaattgaggtagaattcacataccagaaaattcaccgtgttttgttttttgtttgagacagggtcccattctgttgcccaggctggagtgcagtggcacaatcatagctgactgcagcctcgacctcccaggctcaagcaatcctcccacctcagcctcccaagtagctggaactacaggtgtgcgacaccatgcctggctatttatttatttatttatttttgagacggagtctcactctattgcccaggctggaacgcagtggcacaatctcagctcaccgcaacctccacctcctgggttcgagtgattctcctgcctcagtctcccaagtagcttggattacaggcatgtgccaccacgcccggctaattttgtatttttagtagaggtggggtttcaccatattgaccaggctggtctcaaactcctgacatcaggtgatccacccatcttggcctcccaaagtgctgggattacagccgtgagccaccatgccaggcctaattttttgattttttgtagagacggggttttgtcctgttgccatgttggaaaattcaccgttttaaggtgtatagttcagtggatcttagtatattcacaaggttgtgaatatactgtgaataaactgtcaccaccacctaatttcaaaatcattttgtcactccaaaaagacacccctcactcattagcagtcaccccctattgccccttctcccaagcctgaggcaaccagaatcttgccttctgtctccatgaatgtatcgttctgcatttttctttctttttttttttttttttgagacagaatcttgctctgtcgccaggctgtagtgcagtggcatgatcttggctcactgcaacctctgcctcctgggttcaagcgattctactgcctcagcctcccgagtagctgggactacaggcgtgcaccaccacgccgggctaattttttgtattttagtagagacagggtttcaccatgttggccaggatggtctcgatctcctgacctcgtgatccacccgcctcggccccccaaagtgctgggattacagtcgtgagccaccgcgcccagcccgttctgcatttttcatatgcattacttagggttccagataccaggtaccagggggatgcattaatgtgctcaggcaatgaaaccacatctggaacatcatctaagtggaatcacacaacgtgtggccttttgtgcctggcctcttcttctagtgttttctaggttaatccatgctgtagcagggaccagtacttcattcctctttttagggacagtagtattctgctgcatgaatatactgcattttgtatgtccattcttcacttgatgggcatttgggttgtttccactttctgatattatgaagaatattgttgtgaacattggtgaaccagtttctttttttttttttttgagacatagtttcactcttgtcacccaggctggagtgcaatggcgcaatcagagctcactgcaacctccacctcccaggttcaagtgttctacctcagcctcctgagtagctgggattacaggtgcatgctaccacgcccggctaatttttgtatttttagtagagacagggtttcaccatgttggccaggctggtctcgaactcctgacctcaggtgatccacccaccttggcctcccaaagtgctgggattaggtgaaacagtttcttgcggacttatcttttcattttccatggagatagacctaggagtggaattgctgggtcatgtgggaaccggttaaccttttgaggaactgccagactattttccaaaagagctgcaccattttacatgcctaccagcagtgtgtgaggggaaatgcccttttattgaacatctgccatgtgctaggcactgtgccatacctcctctcccatgatcctcacaccaacctgtgaaatacctgtgattgctcccttttactgaggaggacaccagagctcagagaagtgaagtaactcccccaggatcccacagggaataagaagtaaggcctagattcacacccagctctgtcccttatgttttcctgttgactggttgctaactgactatgtgactgtccagatgctaatgtggaatccacctcctccccaaccctcctgggcactgtcttgcagacagggaagttggacccccactacccaaaagtctgcgggcacagaggcaacgttttggatgtcaagtggaacccttttgatgattttgagatcgcctcctgttctgaagatgccacagtgagtgtcagcccctgaggggcttccccttcctgaagagtgggattggggtggttggggtggaatggtacctgttcttggctctggtgcccctgactccatcgcggaggtgaggtcactgtgtggggaggtgttaagttaaggtagaggaggagacattcttggtgctgtaggactagcggcaccacccctcctctctatgggccttagttcccccccatataaaatgggcataatagttccacccagctaataaagcccagtgaaaatgtatattccgatgggaaaacccatccttcggggagctataaaaggctatgaggggcatttttatggtgatcagaaaagatgttccacttaatcccatagtgaggaagcgagctataaaaggctgtgagggccttggatgaatgtggacactaaaaccattccagcagcttcagtctcactcacttttttgagcccgtgttctgtaccagggttatcatccctgccccaacaatgttcagtgttacttatttacaattcattttgtacccacttctaaaatatggtggtatggcttaagacaagaaccacagatatgccaggttcagtggctcacacctgtaatctcagcactttgggagactgaggtgggagaatcacttgaggccaggagttggagaccaacctaggcaacatagtgagaccctgtctctattaaaaaattaaaaaacacagatatgatcagatgattaaaataaagataaaagtcattgtcaccatttattgtgagcccactgtattcctaactgtcatcacacttatcatttcacagtctccccagcaaccccacaaggtaggatatttttctgatggagaagctgaggatcagagaggtacagcaatttgcctaatgttacacagcctgtgggaggcagagcaagacttcagactgaggcctgtctgattccacagcccattctctttccaatgtgctgtgacacatctttaaagagaagcagccacagatggagaaactgaggaaatactagaaatgatggctaagaagggttgcagcagctaagctgctagtttagctaagagctacctggcagccaaggcaaaatgggcaacagaatgtattgcaaaaccttcagttagatcaaaagaagcagaccagttcatcaggaaaggaaggcagaaaattcaaagaggatttgtgtcggtttccatatagcagatgctgaggaacgtaaaggacagtgtctgccgaggtgatttcaccaaagggacaatcaggtcctgtgagaattggccctgtccccagggagtatagggcctctggcaggatatcaaatatctgaaactgtccccacttttgtgatacctgccttttcaggactgctttgaaggctcccatcaagatctttataaatctcttgctagcctcattgcctgccactgccccttccccgatgccccagggcaggacgtgactgttgggggactgaagaaggaaggggctttcctccccgaagctatgcccacagtgaatttatggggtgttcctccctgccttcagggcctggagggcacggttgctcctctagcagtggggagtcttctctgcttcagtgttgcgggtggtaccttcatcttccaaacatacctcttcagagtgtgtcttcctcccggggttctatgcagtgacagccctcatcagaccgaagtatctggagcctgtcactactctcgtggggttggcttcctggttttaaatccaagatgaccaggaaataaatatttgctgaattgaaagcaaagtcgtctacctgaaaaacctgtatacctctaagggaaacagtgcatacaatcaactaggggccagagaaccttgcaggaccaataaggaagatcaagtcagcagcatcccaggatcaccttgtactccatttgtatacctctgtgacagggagcttactctctgccatggcagccccctccatcttcagacaacactactctggaaggaagtcccagcacctcttctcaggccctcaccatgaaatacaggcccatgaccccatccagcccagcctcctgaccttcagagtttcctcttgcaggccatccagggtgcacctccaaagcaagaagtttgtccctgccctgctgcagagacctcgccggctccctagtgcctgaggatgcagcctaaacccttcatcctggcatttgaggctctaccctgggtctttgggacaagaagaacactgtactttggggatatcctagcttaggagacaggcctgaaacccagccacctgcccaccacctcaggccagcaggatgacaaagatctctcaagggcagatttggaggcctagactcatccctggtcagcgctggcccctgctcaggctggaggagcttggggaagcccctgtctgtctgaggaccctcagctgcccctccactgcccctcaatgcccatagccactgagtgggaggtggctatggagagagctcccttggtccttctgctggtcactgccagatctgtggcttaggctggtgacggtgccaaggtgccctggctaatgctgccttgggccctgtctcccctgccagattaagatctggagcatccccaagcagctgctgaccaggaacctcacggcctacaggaaggaactcgtgggccacgcgcgcagagtaggcctggtggagtggcaccccacggccgccaacatcctcttcagtgctggctatgactacaaggtgagtctgggtattctttctctggggcagccccaacaagttcccacaaactggaatacaatggaaatgtattctgtcacagttctggagaccagaaatcgaaaatcaaggtgttgggagagccagctccctccagatgccctagggaagaatccttccatgcctctcccagcttctggtggctccaggcatccttggctatagctgcgtcactccaggctctgtttctgtcttcacacggccttctctctgtgtacctgtcttccttataggaagaggagagcaactatcattggatttagggcccacctaatccattatgatctcatcttaactaatttcagcagcgaagaccccatttccaaataaggtcacattctgaggttccaggtggacatgagttttggggggaaccctgttcaactcattatagcctgcccggagtggatgggatggcactgcccagaaaatcgttcccccgaccctgctccactgacaatcaagcatgcaggcagtaggccctgtagattgggacccacagtacaggagacctcaattctattccgactcagtctctgacctgcactatagcctgggaaagtgccttgacttctctaggcctcagtttcccaatctgtacacaaatggaattggtggcaccatagctatggcctttcagttctttccttttgacactataggggtttacagagacacctcgggaccctctgtgttggataaaagggaggtggggggccggacatggtggctcacacctgtaatcccaacagtttgagaggctgaggtgggaggatcacttgagcccaaggatttgagaccagccaacatagtgagaccccatctctacaaaaaaatagaaaaaattagccaggtgtgggaaaatgcgtcaagtagtcccagctactcaggaggctgaggtgggaggatcacttgagcccaggaggttgatgctacagtgagccatgatcatgccactgtactgcagcctgggcaatcctgtctcaaaaataaataactaaaattgttgtggggagcactgagggaacctgggccctcgctcttccgatccacagcgctttctcatctgtttgtatggggtgtctgcagagctgctgcgtgtatttgtgctggttgttctatacccaacttcagggggcactagtcacgtcctagtctataggaatggattgccctggacctctgcatgcacagcctgtgcagctaaacatacagccctgttgatctgtgggaggtgcaaactgctgctaataactgaaaccgcctggattagctggttccctggggtcctcccagcatggatgttttgttgctcagaggcaggtggcgttttcctttcaccactagacagcctggccctgggattccccctcctgccacaagcagcttcagcctgcacatcatcctcccactgaggcttcttggccaggctgccagctgcgccaccctcccagggatactgtgtttcactgcatcctggccagcatgtaactatgaggcccaggggcaaggtggcccctgtgctcagagctggctctctgccatgcaggtgatgatctggaacctggatacaaaggagtctgtcatcacaagccccatgagtacgattagctgtcaccaagatgtgatcctctccatgtccttcaacaccaacggcagcctgttggccaccacctgcaaagaccgcaagattcgggttattgacccccgagcagggaccgtcctccaggtcagttctgggccaggggctggctcaggctcagaggagcaaggagcagagtggggacagagagaggcttcagagaacaggacagtgatgctgtcagcgtctgggctgcgccttcacaggcagcatccctgtctgtcctctcgggattgctggaaggtgggatatgtcctttccattttgcagatgagaaaactgaggcccgtgagagatgaaatgactcacccccatggagagctgggatctgaacctggtctgactccaaagcttgttggcgtgcctcagctctggccagggggtcaggagagccgacgataccactgtttagccactgtgcagccttgggcaagcgcttcctgctctgagcctctgttttctcatttgcaacaatgggctgttagtccttcctctccaaggattagataagacaggccaggtgacagtgcccgcccctgtagggatgcccaatactctttcagcaagaacagggcgctgggcagaagtttgtttctgttcttgctcagaaaaataactcttaacaaagatagtggggagagactccatgtggatgagagggatccaggtggtgcccctgggaagaatctccaggcagagctggggtgagaaagggaggcctcccaggtggagcggtggcataagcaaagcagggaggccagaaaccccagctgcccccgatcctctactgtctctccaataccgaccgcacgtgtccctccaggaggccagctacaaagggcaccgggccagcaaagtgctgtttctggggaacctgaagaagctgatgtccacaggcacatcccgatggaacaaccggcaggtggccttgtgggaccaggtgagggctgcaccccacccctcaccatcacccctcagctgagagccagtgtcattcattcatgcatgcattcatttagacacccatttatgacacacacatttagcgtagactgccaggtgctggggatccggggatgaatagcagggagatgctgacagccccgggcgagcccagaccctgtgtatcttgccacccaaggagggagatgggtcaggacccaggggagtccgttggctagaggaggggaggtagctgagtctgggaccaggactaggaggaagggagaaggagagggccatctgggctgagggtgcacctggagcaaatgaggtactaacgggtatggggagaaggagctttcattgggacagctgagggtggagcagggtagggtgagggccaagctggcggtagtattttgagggagcatttgacagagtttcaaagactggacaaatcacattttctctctgagtctccttcttcatctattaaaataaattttaaaaaacaggtaggggaagattggaatgagatcgggtgtgtcaaaagtgatttgttatggccaggtatggtggtacacgcgtgtaatcccagcacttcagaaggccatggcgggaggatcacttgaggccacgaattcgagaccagcctgagctacacagcaggacccccatctctgcaaaaaatcagcggggtgcagtggtgcatatctataatcccagctatttgggagactgaggcgagaggatcgcttgagcccaagagtttgagactgcagtgagctatgatcgcaccactgcactccagcctgggtgacagttagaccttgtctcaaaaaaaaaaaaaaaagtgatttgttaagggcagaaagctgacaaaataggtggcagcagcattttagtgcctttaagatgtcatctccactagagagtagcccacacattggaactcaagaaccagggacatcttccccccgcacacacatataaaaaaatcacactttttctctgacacacacactctcgcccagagcaccatggcagcaattcttatctccgggagcaccactgagggcccccaggagtgacccaggccttccctgcctccccttcccctgcaggataacctctctgtgcctctgatggaggaggacctggacggctcctcgggcgtgctgtttcccttctatgacgcggacaccagcatgctctacgtggtggggaaggtcggcttggcacgggagggaggtgacctcctggacccctgagacagcggcagacagcagcctggggccattgggaacacagggcagggatgggcaggcctcgctggccactctttccctgtgagaaggaacccctcccaccctcctggctccctaggaacacctggagccagggctctggctggacaccttgaccttgtctcttcccaactccaggcccagatgtggggggaccattggtgtttctcagcaggggcacctgctaaactgggggcagaacaggtctccactgggtaggactatcccatgtctggcagccctggcccctgcccaccagtgccaagaacagcatctctccccctccatccaagtcattatgacaaccagaaatgttccccatggtaagaccttctggatgacctctgaggccaccccagttctgacttttgctgctgctctcagataggagcgggatttggacttgtcttcccagagcttctgtcttagaggaaaaagggtgggctttgggtcatggtgggggaggattgaatattaaaataagggcccaggcccagcacagtggctcatgcctataattccagcactttgggaggccaaggtgggagaatcacttgagcccaggagttcaaggccagcctgggcagcatagtgagaccccatgtctacgaaaatgaaaaaataaaaaattagccaggcgtggtggcacacacctgtggtcccacctactcgggaggctgaggcgggaagatggcttgagaccaggaggttgcaatgagctgtgattgcactactgctctccagcctgggcaataaagtgagaccctgtctcaaaaaaataagataaaatctaaaataaaatgaatatcccctcatcaccctcctgccttgatgacagggcccccagtttcctggtgttcccttgagtgagatgggtttgccgatcatcaaaaaaagccaggtctttgctgcatggctgggttgctgatgagctgatgagctccagctctgaatctcaccctcctcttccttctcctcctcctcagggagatggcaacatccgctactacgaggtgagcgccgacaagcctcacctgagctacctgactgagtaccgctcctataacccacagaaggggatcggtaagtgagggacactgaagttcatgcctgtaatcccagcacttcgggaggccgaggtgggagaatcagggtcagggcttcagtgcggggtctggggagacagggatgagtcagatgggaggagagacagcatagcaacactctgacttggtgggggctgtacttgacgtgtgcaacagcacaaaggaggaagtcagggaaggcttctcagaggaggcaacattggaggaactgaaagaggaagcagagcccagcaggggagagagggatgtgttctaggtcaaggttaagcagttaccacaagagcagagatggaaagggctgacctagaagagcctctaggaagcagtcctcagttcctttctaagtgtgcttgaggattaaaaacacagctatatttctgtaatctacaagaaacccactttaaacataaagacatggctagattaaaagtaagggactggagaaagatgcaccctgctaaccctactcaaaaggaatctggagcggtttgattaagagcatttgggtcacaggagctgtggggatggagatggggaaccttaagcagagcaaactgcctataaaagttcagctaatccagcactttgggaggccaaagctggaggatcacttgagcctaggaattcgagcctagcctgggcaacaaagtgagactcctgtctctacaaataaataaaaaaattgaggtgcatacctgtggtcccagctacttgggacgctaaggcaggaggatcgcttgagcccaggagtgtgagactgcggtgagctatgattgtgccactgcactccagcctgggcaacagagtgagaccttgtgtcaaaaagaaaaaaattcagctaaaataatttaaatctttgaaggtgaagagtctgattaattcaactccatttcccaacatagggcccagcccagtgtcggtatttgtccctgagctgttttctgggaggagactggtctctgttcaggtccaggtgtgcagcctggctttggccctaacactgtggccccagcctagccagaacctcttggccctccctgtctgccttcaggtgtcatgccaaagagaggactcgacgtgtcctcctgcgagatcttccgcttctacaagctgatcacaaccaaaagcctcatcgagcccatctccatgattgtgccccggcgggtaagggcagtcgggaccgcatgggaggcaggtggggaacctgtcctggagaagacagacccagggctgtcgggcaccagagcctggagcccacgttcatggggcagccacagagcggcctttctcacagccagtgtgacatcagtgggcgtcaggagtcctgggtctcggtccacctctgttcttgagctgctgcgtgacctcgggcaagtccctttgttctctgggcctcagtttcctcaattcagcaggggttggtgagagcctggactcccaggtctaagggcctttcccatctgagcagcctaccctaccaccctcctcactgtctggatttctcctgcagtcagaatcctaccaagaggacatataccctccaacagcaggggcccagccctccctgacggcccaggagtggctcagcgggatgaatcgaggtgaggaaggcagagaagaggcccaggcaaatgtgacaggaacatggcgtgcccagtggccccaagcaattgagaggggttgggcctggatttttcttctctcatgacctcagaagccatgcccttgaccttcagtccccagtgggtagcatggtcacatacaggtccagaaagtcagggggcttgacccaagagctcagaaaactccaactcaagggactttgccccacggaaagcttctttacactctggggctatgtggggtgcctggaccacctcagccagactccctgtccctgttccccacccctacctctgcaattcttttttttttttttttttttttttttttgagacagagtctcgctttgttgcccaggctggagtgcagtggtacaatctcagctcactgcaacctccaccccacccccaggttcaagtgattctcatgcctcagcctcctgagtagctgggactacaggcacgtgccaccatgcccagctaatttttcgtatttttagtagagatgggggttttgccatgttggccaggctggtctcaaactcttgacctcaagtgatccacctgcctcggcctcccgaagtgctgggattacaggtgcgagccactgggcctggccttttgcaattcttcttgacccaagaagccctccaggcagcaacccccacccaggtccctctgcccactctgcctgtcctgagccactctcccgctcctgccaacacgggggccagcccagcagaagcagtcaccccagctgctccctctcccttccacccccacaaacttccttcacccccaccccagtggctgagcgggcctcctggtgtactggaagagcctctgccttggggggcagcggaccagggccgagtcctagttttggataaccttaagtaggttttgctccctgggcctcagtttcctcatctgtagccatgatgccagcctcccctgctttctggaggtggtgagagaactaatgaacttggtagatggtggggtgcagtgtgggtgggactgtccttacaaagcaagggcaaggtctcatgtgagtttgaagtgtttgggggctgcttcagtgcacgcaccgtgctgttcctacaaaccaagcttcactctgagggtggcacacgtgggtatttgtatctgttagccctgctctgtgggtttgggcctgtccacaggtagctgtatttcccacacatgttgcatgggtctgcatggctctgagtgtctctgcatgcctgcctgtgtcattggtgccccatatgcccatcttcccgtgggcaccccgtcctcacatggctctgcttcccttccagacccaatcctggtgtcccttaggcctggctctgagctgctgagaccccacccactgcctgcagagagacctatcttcaattccatggccccagcctcaccccggctcttgaatcagacagaaaagctggctgcagaagatggctggaggtcttcctccctgttggaggagaagatgccaaggtgggcagcagaacacaggctggaggagaagaaaacctggctgacaaatggctttgacgttttcgaatgccccccaccaaagacagagaatgaggtgtgaaggaggacggggtgggcctttcacatggggcagctggggtggaggggaacagatccaggctgagaagaagggagaaaatgaggcatgagaagaataaccagctgtgtggcctggcctagtcacttgactcattttgttaattcattcaacaaacaggcagtgagctccatcttatgccaaaatgatgggcatacataaagatggtgggaggctgggcacagtggctcactcttgtaatcccagcactttgggaggccaaggcgggcagatcatgaggtcaggagttcaagaccagcatggccaacatagtgaaaccccatctctactaaaaatacaaaaattagccgggtgtggtggcgtacacctgtagtcccagctacttgagaggttgaggcaggagaatggcttgaaattgggaggtggaggttgcagtgagccaagatcacaccactgcactccagcctgggcaacagagcaagactccatcttaaaaaaaaaaaaaaaaaaagatggtggggaccaggtgaccaggtgcagtggctcacacctgtaatcccagcactttggtaggccaaggcgggtggatctcttgaggccagaagtttgagaccagcctggccaacatggcgaaaccccgtctctactaaaaatacaaaaattagctgggtatggtggtgcgtgcctgtagtcccagctactctggaggctgaggcaggagaattgcttgaacccaggaggcagaggctgcagtgagccaggatcacaccactgcgctccagcctgggcaacagagtgagactctgtctcaaaaaaaaaaaaaaaaaaaaaaaaaatggtgggaaaccatctgtaaaatggagagggtttgacctagtgggtatcaaagtctttccagttctgacattataggactttctgtgctttcaaagtccacatttgtttagtgcctactgtgtggcagatcctggggtaggcactttgatacagcacgtgattgaattctctcaacagccctggaagtcagtctgtagtggctaagaacacagaggctggcatctcacagatggattctgatcctggctctgctgagtactaatttagggtcttagacccagagactgaatgtctctaagcttccgtttccacggtggtacggtggggacactagcactgccacccttataggggtgtcacaacgttccagtgggataacgaggcccttagggcatcactcaatatctaacacccattctgcacagagggcagttttctgaccccattttccagaggaaggaatggaagctcagagtgggtaagtaacttgcccaaggtcacacagttcagtggtggcgaaaacaccaatccccagacttcagagccaggcatcctttcctctatttcatggaggatctatggaagcaaaatacatctgaaacattccagtcttcttgaatttcatttattgggtgaagtaaacaaggtgtttgtaaaagatctatgcagtgacagccccatcaggcctcagccatgttaatgtgaccgcctccacctttctgagtcaaagagggatagtggtttagctttcagctggtgtcctgacaccatggtgatcctgccttccgatctttcttccccagttgctgcagatgttctaccggcaacaggaggagatccgaaggctccgggagctgttgacccagcgagaggtccaggccaaacagttggaactggagatcaaaaacttgcggatgggctcagagcagctctgagcagagacctctgccctcctcaccctcagggacaccactcggctccatggggaggtttagaaccaaaccacaagtcccctcaaggacaaccactatttctatattttttaccagaaaacaaaactctccatcgctgaaagagattccagtgggacatggtgccgtttttctgtttgccttcttgcaacaacagtttctgaattgactttgttttcagatgatgccttctgttgaattctgttattaagggcccatgatgagctgtaacttctcaagaggaaagaacacagtagaaaactagagctggaaggatctaggttgacctgtctgtgattttcaaactgtggtccagagaataggggaagactgggccagacgcagtggctcatgcctgtaatcccagcactctgggaggctgaggtgggcggattgcttgaggtcgggagtttgaaaccagtctcaccaggcgcagtggctcacgcctgtaattccagcatgttgggaggccgaggctggtggatcacgaggtcagcagttcgagaccagcctgaccaacatggtgaaaccccatctctactaaaaatacaaaaaaattagctgggcgtggtggcaggcgcctgtaattccagcgacttgggaggctgaggcaggagaattgcttgaaaccggaaggcgggggttgcagtgagctgagattgtgccactgcactctaacctgggcaataagagcaaaagtctgtctcaaaaaaaaaaaaaaaagaaagaaaccagcctggccaacatggtgaaaccccgtctctactaaaaatacaaaaattaggcagggcgtggtggttcacgcctataatcccagaactttgggaggccaagctgggcggatcttctgaggtcaggagttcaagaccagcctggccaacatggtgaaaccccgtctccactaaaaataaaaaattaaccaggcatggtggtgcatgcctgtaatcccagctatttgggaggctgaggcaggagaatcgcttgagcctgggaggcggaggttgcagtgaaccaagatcatgccacttcactccagcctgggtgacagagtgagactccgtctcaaaaaaaaaaagttggccagccgtggtggtgagcgtctgtagtccctgctattcgggaggctgagataggagaattgcttgaacctgggaggtggaggttgctatgagccacgattgcggactgcactgcagcctgggtgacagagcgagactccatctccaaaaaaaaaaaaaaaaagagagagagaataggggaagactaagcaggaaggctgtgtctcccttccccacactgtattccaaccagacagctcccttctattttatatgttgggctagtatgaaaaacaattctgctaggaaaaaaaaatttttttagaagtttgaaagctagtgatttgacccaagttcctcattttacagctggggaaactaaggcctagagagaggcaagtgatatttgtttcatggcagggctgggctgagatcctgcttttctgggtctgtctttttgctcttttgggtctgatgcagttctcagcccaaagagtagaaatctgttgcttctggcctcagctgtgccccagcttactcagtgacctcttgcaagtcctgccctctctggtctcagtttcttcatctgaaccaggggtaccctggaacaagctgctctctgcaggatctgccacctgaaaccttgacctaagagaaaactacctgtggggtgatctgggtttgctacagaaactaacggacactggcaaggggtcagaggcattcaacccaattctacaacacaggcaggtggtcaaaaccaacctttccaaccagaatcagcctgatatggatagatgctgtcccttatggagggacgcagacttcagaactgtgcccatgactgctgactgccaccaccaaggccctcaggtacacagcctgcctcctgcaggatgatgtgggcagatttcagccctagttaacagaagagtcccccaggaggtagggggcccccatcactggagacatgccagcagagcctctggccacctaaccaggaggtcttctgaaatgactatacgaggtaaagaagtagtaccagatggtcccaaagttcccttttagcctgaaagcttttctttgtccctccttagtgaatctgtgttccgagccctactctaaagttcagtggtcaatacaatagtccaccaagagactgggaatgattagaagtgaaattggtccctccttaccaaggaggggcagatgatctccattgcacagggcgattagattctggagctgaggtggggactgcaggaggccacctagtctggtaggtttcaacccaagctgtgtacattagaattcccttgggagcgtgcaggaaatacagatgcccatgccacattccagaccaactgaagctgaatctccagagtagggcctgtatgttcatataagctccacaggtgatctgcagtacagtgaagatggaagactgcatgtgtacctatttgcaataaagatgaagaggacagcaagctcc

SEQ ID NO: 12225 - DNA, 24709 bp, Human
agacagacagacagatagataaacaaacaataaaagtcttaactttctcctttgtggaagaaattctaaggggataggacagtgcctcaatgaactcattttaaattagctctccctttttacacaaaaactgcccaaatctgctctacctcccaatgaatttttgcatcccttaggagttctctagtcaagtaaatggcaaaaactgtggtcagggaagaagtcaaggctgaaatccaggagtcattgctccttatcttcctagaacctgactcttggcctgaaatagactctactgctccctttctgaatgaagagagaggaggacctaaagttgtttgtgtaggagccacaactgaccaagctcatctcacaataaggtttggagccccaaataaagacttggtctagaagattccatgtggacaacaaaattacacagttaagatactgaggtgaagaccccctaaatcgtctggcctaggtaatggagaaagtgaatttgtgtattaattctttattttctggttcagtctagccagagagggttttggagcaagaggaacaaggttaaaagaaaagaacaaagaccattgtctcagggagaccttaagaaaggtgatgcagatgctaaagtagaaggtgtgaaaatagttagaaagaatgaagaagacctagtattcaacagcacaacagggtgactatcgtcaataataatttcattgtacatggtaactaagagtataattagactgtttgtaacacaaaggattaatgcttgaggtgatggatactcatttaccctgatgtgattatcatgcattcattgtatgcctgtatcaaaatatctcatgtacatgtactccataaatatatatacctactatgtatccacaaaagttaactgaaattttttttaaaagatggggctatatggccacatagacatcagtctggagccctttgaggatccccagtgctgtggctgaggccaccctcctccctagggaacagaaggagcagagtcccagagaagtgtgagcgagggcctgggtgccctcctggctccgccacctgagtttaagaaagtagggattttgagatcacctttgtgtgcctattgaaatctctttccttcttcgaaactcaaattctaccttcttcagaaaacctcccctaaataagcctacactattataggcagtttgtagctttctaatactttattaaactgcgttattttattgtcaccttactaggctgtaaatgttgttagggcagaaatcatgttttggtttttaaaaatttccacaatgcctagggtggtgttgagaataaaataggcatttggtaagtaattgtgtgatgaaaaagttgaaaggaagaaaaaaccatcgggcttcctgaagtttctagcctttctaacttagacagagaatacactagatggtaggactgcatccccacattctcaaatcagagggtggaggttcacctgcacctggtgtatttttttctgaaaaaacaaaacaaacaaaaaaatgctatcctgaatgcaaattcagtctcaaagtgctacagaggacaaccaggaaagcacagtcctttctggatcccttttggggaccaggctgtgtgtgtgtgtgtgttgtgtgtgtgtgtgtgtgtgtgtaagtgtgcataggtgggaaaaggttgtggtgtgatgggaggggataggcaagagggaggaaagagactccatgcagtgattatgtggaggggatttgctatgtctcttccccccgcttctttctttgtcctctttctcctggtccccttcttctgcatttgtctgggaggatcctggagtgttcttttgatcgactcaatctttctctggcacttgagttctgattggctgaaggacttagaggggaaaaaaaactttaattaagtagataatctcttctttggacgtttggcagctccatttcacctccccttaactctgtttgggatcgcttacacaccaaggaagttgggctttgagaattccatcccactggcactgaggagaatatttctccgtcttgcttacccatctcccagttttttggaattttctctagctgttactccagaggattatgtttctttcaaagccttctgtgtacatctgtcttttcacctgtgtcctccaactcagccacagctggtaagtaacctggactcttacctggagctgggaataggtaagtgtatgtaatgtgttgggtaaagctcatttcatttccagaaatgtaggaagccttgatagctctcctaggaaaaactgttctatggggtagggctcttcctaaatttatggctgattttagtgaatctttaggacccctaccaataaaggactaaatgatgggagcgggggttcctatttttataaattgctattccacaaatattcccccaaagtgatttgggggtaaatggacagcagcccttttcacgaaatcctgatgtcagcattgtagagaggaggaaggtagttcaaagcaagttctaccgtgtgttgaatctgatcttgaggtaaagtctggagacaaaattcaatgggatcttactttgtactttctgactttattttttttttcaggatattctaagtaattgctcaaattatcatttcctagacataaaaaattttatttgaaccactaagcaggcattgggttaacaaacatgtttgaaaccagatattttagaaatctaaacgtctcgagaaatttatttaatttgttcaatttacaaatatttctaaattgttcagaaaatcagataacgtatatgaaagtgctttgtaaattataaacacaaatgctaaagaatatcatcaccattctcatttagctcttggaaaccacataaactatctatacatgcaactgttcattagcaaatacaccagtacacaataacatacagaatgcaggttgctagggtgttcggagtttctctccagttcagatatgagctcagtctctctcttcatcagctctcattttgaccatctatttaacaaagatataaatccaattgctacataaactgttgaggaagcaggaaaagaaatttctttgctgagataagcttcctttgagaattgaaaatacatttttatcataaatgagtgtagccgtctttataggagtgttgataggaagtatgccaacttcataaaactatttgcaagttaatacaataatttgcaacatttctgattataagcagaaccaccaattagtccatttttaattggcattttaattaaatatttcaatgttaaaaaaaaggtctctcttctctccccctcatgagaacaaaaagacaaaagggagaggagactatttcagagcatttctactgatgttcatggtattcttcagctgattcagtatcagcaaaagagaaacacgagattcccttccctagtcaccagggcggtgtgaagaattgttctataaaaaatacctttactgtgtgttcccttccctgctggagggggtcatgttcatttcattccgatactgacacagccacactgaaaggtggctgggttgcttgtctgtccaaattcaagtgtctggattcaaaaagaaaaaaggaaaaagagatgtgaaagaaagttctaatttaagaaaacagggtttaagagcccttctcgccttgcctgactttgaggagaaaatgtacaaatctcctttataatacaattagattttaattgctttttcctataagccccaatttaaattaaacatttgtacttcaccaagaatctgtttgtggtggcatttgaaaagtgatttttaaatttaacattaaacgttgattatgcttctaatgaaactatcagggttttgcataaggtcatcttcccctttatgccatgcagagaaatttgaccaaccacagcctttgaaatgtttctcttaatacttcattatcaaccttttatgtaaggacctcaaaagcatttaacaaatagagaaccacaatttctgcttggctgttcaattgtaggcctgcctgaaattactatctaaaagagtccatcagcagaaattcctgggcttgaaaaggagagaataatgatgacattcacctataatatgcagttttactaggtaaatcagtacaagatgatttctttgaaaagtatttgccacagttttttatagttgggacacttccaaggagaactgtcttttagtaacttgagaaaattattttctttgaatttgtttgtcttaatccttatggctccaaagatagagaatgagaatgcatgataagccaagcagatgatgatgattataatggtggccagagatgaaccaatttgattttccttccaatgcacttactcatctggaatgagcaggcctagaaagtgttttaccttaactggttggccccattttactccaaatgatatgtcataatgacagtgggtcttacccagttctgttcatttctcactctctccccacctaactcagtcaccaaatcagaaggatgccctgggatacagaagtaaactatagctctgctctcattcttcaacagaagtcaccgcctctacttctttccaaaggtctgcagcaggaatttaaacagggtccatttctcttctgcagtagggcaagaatttacctaaaatcattggattttatggcagcttttgaaaaacatcatcttttggtcctctacatgcatctcatagagtaacctttctatggctcttgaaatctcatctgatgatgacatgtgggactcctgattggcaaaggaatcagttattggaggaaggtctttgaatccatattctcaccaagcattgcataaagctgaaattattgatctccacactatgttctactacttttaggtgtattttatgaacaataaaatacaaactcacttaaaaattactgaattcatactggggttctgtcataagtttttgccatgttgaatttttcccactaacagattaaaaaaaaccatatatgatcaagtgaagatccactaaaactgtcacgataggggaggattcttatcctcaaagacgctgggaatccctgaagttaaagaaataaaaagtaaggtgtgaggaactgctttggaatctggaaaaaaaaataccagtataaaagagtgacttaatagcatccttggttcataaaaaaaagtgcctgatccattaaaaaaaaagctgggatttgtggagtagctctgaggtgggctagatcagcagctgcactgtaggaaggcctgagggctctgagacataaccagagaagtttaattcccaggtttatcaatgaaggcctccacaacttgagccccatgtgtttctttccagaatctctatttctcttgtcatgaaagacaataactattattattataattattaataacaacaaaggctgtgagtatcctgggaaaagacacttcattacagctcttgttatgaaaccagtttgtgtgagtgacaagaaggatgctctaagatgcatctttgttttagttttagtttttggtggatgacaacatgacacaaagaaggatctcctttgtgtgctattacatagtgacaaatgaggcattaaaaaaggaccagaagaaaaggagttttaatctaaaccctctccttccatggaaagatattccttttttttttctttttcccagctgggaaaattggtttaatgctgctctatattgggtgatactattatctcttgggactattaataaaattcctttttttctgggctccaacgatgcttgtctatttccatcagaaaagtgggggagaattcatatggcttagagaatgaggtcaatataatttttcttaggataaatctttatttttcagaaagtggattttttttttcttactcagtaaaagatcaggctaggttaacagctgagggaaacactgagcttgggtcacataaataacattccccattgcctcccacttgaaatacacctgcactcccaggacctctcaacggaaactaccatccactttggacagatgcttcagtctcattatgagccaaacttttatggtttgtttttctcaatctttattgtaagcccctgttattgatcatttcatttctctgtatgcttcttaggttagagttttctccaagccaagagaaaatcagatcataaggggatcatttaaattcaccatcatctgaccagtccaaactcgctttttaaaaataggttgttttcgcaacttcagcatcctatggtaccagcacattatggggctatattccagtagtcccaataagaccctataagagggctaataggtcagtctttctatgcagctccatagatgaaattcttatactctccaggccaaatttacaccaccctacattaggaggaatttccccttcattcaaaactgcaattaccatttgctgctctaaatctcagtcctttttctgtagtcaggttctttaggtttatcgtatcacactttgaaggttccattatccaggacgctaagtagtgaatcaatagattgtccacgttatcctgtctggtatttcctcaccttaatccaaggcatctggtggagcccagattccatagattattgcttttcagaataattggttttgttttaaaattttcatactatgggaaaaacatgtttttacaaatgttgagaacagcatatataacaaaccccaataactcagcttcaaccgttatcaatctctgaccaatcatgtttcacctatactttctgtagcatttttaactgcatattctcttagtctgaatcttccaagtactaccatggttcaaaacaggaagaagagggatagcaaaaggattatctgtcctgtgtctgagagattcaggccagtaattagaatgaagtttggggaacattgtacatttctcccattgcccttaggagaagatcaagaatacagattagcaaaagggaataagtcattcaaatacatgtttgtgtttatttctattggagctgtggttaattagcaaaggcagtagaaattgatggttggatcagattgaggagagaacattttaccatctatttggattaattccattaagcagtaaaaatggcactaaagtgccaaagcctgtcaattttccaaccttaagctgttcacctagttattttacaggataattcttggagttaccatgtacacccaccttcttgatactgatataaactggtattgtttccatcgatgcaactgagaacataaatgttttctaaagtctatactgcagggaccaaggcaacaagatcagaaaacaaaatggaattatctgcctccataacgactgtggaaaaagttcccgtgatcccaggctttctgggaatggtggcttgagctgttccttagcagctctcacttagagaccaaggaaaggagcatgagtatagcttatccctgccacagtcctcatttagatgctaagtgctgaagtgcttttctgtagcttagcgtttctcagcagcacttgctacaatacataaagaaggaaagaaatgaggacagggaagatagcctatcactctataaaatatcctggaatacaaatgacgtatcagttgcagggaaaaagatgatcccccgaacatttgtgctttgcttgtgaaggaatctgcctgagcttctttagcaaagatccatggtacagagttgtcctgtgggctattacatggcctttgctaacaattgtttggcaagggccggatttgcgataatgtgggattttaatatacattttaatataaggactactgctaagattgtcacatctgtttaactttaaaaaattttttttgtcaattggcttacaagacttgttttctcttttcatattttagggcactgcatcattatataaaaaattcacatttataaaaaacatttttagaatgatttacagggctgaactccctttgaagaaagaaatggactttaatttggtgaaatagttatgggaatatgaccaaaagctacacattcctgaatttttctttctatactcatcttgaaaaataccttcctctggccccaatctctactgcaatcatttctcctttctcttttttctttcaatgccatcctcccccaaccagttagcactagctactttcatgtcataactcctcactctctgcaatctggcttgtgttctattgccatacttaaatagatccctccactgataccagctttgttccctcttgacatatttttaagtaggaggaaatctgattttgaaagtctgaatacttctcttccctttaagacttcagataccttgtaacttctacctcctaatcccttcccctagttaaataggaaagcctgatttcaatactttggaataggtaagaattagtcatgcttttcacccttgaaaaatatttgcattttaaacttaactctctcaaattgtacagtgaatagttccaagttcaatcccctcaggtattatcagataaggtagtgaagaaaatttggggaccaacgggatattatttcacagttattagtaagacctactttctgtgtaactgtgtgtgtgggcacacgtgtgaacatacctttgtgtctgctcgtgcacatgtgttctacaggtcagatgtgtggatgctgtggaacagagacagtcacaaggaaactcactcagaagagctatctttgggctctccccagcccaaggcatcttgggagttctatggactgaaaagctgctgtcagaactcattctatgagaaagctgcatcactggagaaccttccagctatagcccctggcagtttccctactccataccctccccttagcctttagccctttgtcctatatgccttctgtgctaaatcttcagatggagatctatagttcacattcattcactaccacttctcctttcccctgggccagcactccaatttcggtaatcagatgtctctctcctaaagtagaccaaactgagcctcatgactcagagacaatttttttaaggcaggatctcactctgtcagccaggctggagtgtacaatcttggctcactgcagcctcgacctccctagctcaaatgatcttcccacttcagcctcctgagtagctgggactatagtgtatgccaccatacctggctaagttttgtattttttgtagagacagggtctcattgcctttttaaaatatcatcattatatcctcttttctgagctccatcccatttatccatctttattatgatttttatttttatttttcgtagagacagagtctcactctgttgcccaggctggtttcaaactcctgggctcaagcaatcggcccactttggcctcctaaaatgctgagataacaggcatgagccaccatgcccagctgatgactcagagacattttatggacattaagagatgggattaaaggttggggagaagccagaaatactacgtaaagatttgtggggaaagtgatgagaggcagaacaaaacaaaatcacagggcactaagatgaaagtcctgggtggtaagaggaaaatatcaaattctgcagattcatattcagaatgtttcttattttctattttattttgttttattttattttttgagacagagtctcactctgtcgcctaggctggagcgcagtggcgcaatctcggctgactgcaacctccgcctcccaggttcaagcggattctcctgcctcagcctcccaagtagctgggactacaagtccacaccaccacgcccagctaatttttgtatttttagtagagatggggtttcaccgtgttagccaggatggtctcaaactcccaacctcaggtgatctgcctgcctcagcctcccaaagtgctgggattacaggcgtgagccaccatgccaggcctatgttttgtttagatacacaaatgcttaccatcatgttataattgcccacagtagtcagtacaataacatgctgtataggctggtagcctaggagcaataggctctaccatatagcatgggtgtataggaggctatccatctaggtttgtataagtacattctatgatgtttgcacagtgacaaaatcacctaacgacacatttctcaaaacatatccctgtcatgaagccacacactgtatcccctccccacctctgcctacagtgtcctttagcatttgtttctccctactcttttatacatagaacccagtgtgagcagcaacagtgcctagaaaatgtgcccaggggatgtcgtgctacccagataaagcagggcctgtgccctggcagatgtggttgttttgtggacatagaagcagtaggctggtgtaatgaaaggataaaaaagtagcagagacaatgtgataattaactgagtgtattcatgagtgtgtgcaaaacatggcttaggccgctcagaaatatttaccaagaatttttcaggaattaggagtcctggattagccagtgggaataagagcaagggaaaaacgggctgcagaaaagcacagcaggtagagtgcatgctctagagtaggactgcctaggctccagccctggcttcaccacttacctagctgtgtgaggctgggtggccactctatgtttcagtctctgtttctgtaaaatgaaagatataatagtttctacctcatataattgtgatcattatatgaacttaaaatatgtaaaacacttcaaagtacatggtcagtcctggcaacacaacgagaccctgtctctacaaaaaatacaaaataaaaatatgccgggcgcggtggctcatccctgtcgtcccagcactttgggaggctgacatgggcagatcacttgaggtcaggagttcaagaccagcctggccaacattatgaaaccccatctctactaaaaatacaaaaattagccagcatggtggcatgtgcctgtagtcccagctactcgggaggctgaggtgggaagatttctttttcttttttttttttgagatggagtcttgctctgtcgcccaggctggagggcagtggcgcgatcttggctcactgcaagctccgcctcctgggttcacgccattctcctgcctcagcctcccaagtagctgggactacaggcacccgccaccacacccagctaattttttgtatttttagtagcgacggggtttcaccgtggtctcgatctcctgacctcatgatccgcccgcctcagcctcccaaagtgctgggattacaggcatgagccaccacacctggccggaagatttcttgagtctggacaacagagcaagtccctctctctaaataaataaataaaagtacttcgtgtgcacagaataaacactcagtgaaaagtatagtacccaccccatggagttgctacggaaatttaaaaagatgatacaggtaaagcacttagaagagttcctcacatacttgaataaatgctagttattattacatgatatgattaaactttatatcagtgtatacacacacacacgtatactggacagctaacacaagaagaagaaacaattgtaaaattttgacttggcagtgtaaaagcacaactaaccacagttatttatgtaaatcgcttaccacttatgcctaattactatgaagcacaataacaattatgcacagcactaagtgtgtcagattaactttgctaaaggtttgattatagcactaacctctgtgtacatatgctcagtgttcactctgttactcttgtagttgatcatctcctaatgtggcacagtcatctgctcactacactaaaaaattagtgggagcactggcttgccacaggcttcctatatttctcaaaatctttttgcagttctttttctccttacattttctgctgcatctgatggtctatcttttttatttcaaaatccttgtattcaattcacttttataggcacttactatgttcaaagtactagattaggaactggagggtatacagagataattaaggcagcccatacttaagtataaaagaggaaagggaaaccttcatatgaaacagagaaaagttgctgtgaggcttcaaggtgtgctggttgtggcttctgcactggtacttattcaagaataagtgagatttttaaataatagctttattgaaatataatctacatactataaaaggcaccctttaacaaatcaatgattttttttagccaattcatggatttgtgcaaccttcaccacaatccattttagaacattttaatcacttcaaaaagaaaccctttatttattagcattcactccccgttcctcctcccctcagtccctggaaactgtgaatctagtcagtttccatgagattgcctatgctggacatttgatatagatagaatcatatcatttatggccttttgtgtctggcttctttcactcaggatgatattttcaagggtcatccatgttgtagcttgtatccagtacttcattcctttatatggtcaaaaaatattctattatgggttggacatggtggctcatgcctgtaatcttgcactttgggaggctgaggcaggcggattgcttgaggtcaggagtttgagaccagcctggccaacgtggccaaaccccatctctactaaaaatacaaacattagctggacatggtagtgcatgcctgtaatcgcagcttcttgggaggctgaggcacaagaattgcttgaacccaggaggtggaggttgtaatgagccaagatggcgccactgcactctagcctgtgcaacagagcaagattctgtcttaaaaaacaaaaaaaaaggtgactcttcatgatttttgtctgagcaactaggaggaacagtcctttacttagatggagaagactacagaaggggtaggcttgggtgatggcagcgaggatcaggagttcagttttggacacgttaagtttgagatgcgtattaaacactgaaggagagatgccaagaatacagttggatatgcaagtctagagttcaagcaaatgtctgagaagagctgggagggttcaggaagtcatgaaccctttgaatggtcctgaatctgggtaatattgtcagcaactgtacaacctcatgggaaatgggaagcttgtacctccatctgggagtatactgttttaccatgttctgtctatatagcagcctccatttgttaaacaaaatttatatcttaaatttacatcttcagtgtttgttagcatctttccttcaatcacataactgccacatagaggtggcacccatacaaacacttaaattccttcctttttggttctctttgcatcttctcacaatactcactatgttttctgcaatctatattttacccccaaaaggaaatcatgtcattgtttcattgaccaagaacaagatcctcctcctttggtactcactacaggacagtcttcttttttttttgagacagagtctcgctctgtcgcccaggctggagtgcagtggcacgatcttggctcactgtaaactccacctccagggttcaagtgattctcctgcctcagcctcctgagtagctgggattacaggggtgcatcaccacgcccagctaatttttgtatttttagtagagacggggtttcaccattttggtcaggctggtctcaaactcctgacctcaagatctgcctgccttggcctcccaaagtgctgggattacaggcgtgagccactgcacccagctgagtcttttcttaatataggatattttggatatgaacaagctagccataaggttcaaatatgtctgcaaataactcggaggttaacaacacaagttggctgggcgtggtggctcacgcctgtaatcccagcactttgggatgtcaaggtgggcggatcacctgagattgggagttcgagaccagcctggccaacatggtgaaaccccatctctacaaaaattacaaaattagctgggtgtggtggcacacgcctgtaatcccagctactcaggaggctgagacaggagaattgcttgaactcgggaggcggaggctgcagtgagccgagatcatgccactgcactccaatctgggcaagacagagcaagactccgtctcaaaaaacaaacaaacagaaaaacacaagtcccgggaggtggagtctgcagtgagccgacatcacaccactgtactcaagcctgagcaagatacagtgagactctgtctccaaaaacaaaacaaaacaaacaacaaaaaaaacaaaaacacaagtcactttataggaatgttgtccaaataaggcctatagtgttgttccatgacaggtgctcaattaagtctcattcattgatcagttgggcttgacctggatatcatacaaatctttgcatattgtaggatcttccaggaaagaattctctagaatctctgtctattactccctgtagttccggcttagactcctttcacaggaagactcttcaccccagctatggcaaagcattttctttgtcactcaatttgctttgttgttttgttttctttcctgataatttctgtcttatggaaaatgggaactagctctgtcaggcttggtaatgtccaaaatctttgaatgttattcctaacataaaaagtgcctttctgagtgggaacaagctcaggcccctttccccaaagcaaaggggcctggctgactcctctgacatgtctttaaggatcagaaattcatgtccaaacctataatggctttggaaattgtgaattcatttaagtcattctgaattgtatttttgtgttttgctggtgctactacacctgatcaagcagtgcttcttttcagttgaattaaggttgcctaccaagctttaaaaagtaggccttggtggctgggcgcggtggctcacgcctgtaatcccagcactttgggaggccgaggagggcagatcacgaggtcaggagatcgagaccatcctggcaaacacagtgaaaccccatctctactaaaaatacaaaaaaaaaaaaatcaaaaaaaaattagctgggcatggtggcaggtgcctgtagtcccagctactcgggaggctgaggcaggagaatggtgtgaacctgggaggcagaggttgcagtaagccgagatggcaccactctagcttgggtgacagagtgagactccgtctaaaaaaaaaaataggccttagttttgatagacttcatagtatttttgattttctaaaattctattacaactcgtttagaatctttttcatctcatatggcagcctcttagtttgttaatactggttttcaaaaactactcacatttttggtgttgtatgtgttttttatgaagaaagtcagccaagctcttttggcctgacaagaaactttcttggtctatttcatttccaatcccctttctggtgatgttcagcatcttattggccttcagaattgcaggggtacaccagatttcatggaacaatacataatgattcccgtattactttctcacattataatggaaaaacaaagataatagataatagattctgattttcaaatgcctatactgaagtcattctccaagtctttagccctgcagatcatgtgtatatgtacatatatatttaactttttatttttagataattatggagttgcaagacatgtacagggaagaaacgtacagggaagtcccatgtacacttgccccaacctcccccagtgtgaacatcttacaacgttagtacgatatccatgaagcttattcagacttcaccatttttacatgcacttgtgtgtacatgtactcatgtatgtggctttatgcaattttgtcatgtgtagccttgtataaccacagtaaagacatttggccattcccccaagactttctcatgttactctttacagccacatccatcccccatcccaaatccttggcaaccactgatctgtcctccagctctataattatataatttttattatttcactattgttatgtaaatagaatcatgcagtatgtatccttctgagactgactttaatcactccgtaacttccttgaggttcatccaagttgttgcatgtatcaacgtatcattcctttttattgctgagtaatattccatggtatgaatgtaccacagttttttattttttattcatttatttatttattttattttatttttgagttggagtctcggtctgttacccaggctggagtgcagtggcgcgatcttggctcactgcaagctccattcccaggttcacgccattctcctgccttagcctcctgagtagctggaactacaagtgcccaccaccacgcctggctaattttttgtatttttagtagagacagggtttcaccatgttagccaggatggtctcgatctcctgacctcatgatctgcctgccttggcctcccaaagtgctaggattacaggcgtgagccaccgcacccggccacagttttttaaactaccctttgaaggacattgggtagtttccaatttttgactattattaataaagtggctatgagcatccaggtacaaatttctgagtgaaagtaagtctttatttctctgggataaatgcccaagagtgcaattgctaagtcatatgacaagttcatttttagtttttttttgttttttttttgggacagaatatcactctgttgctcaggctggagtgcagtggtgcaatctcagctcattgcagcctctgcctcccaggttcaagcgattcttgtgcctcagccacctgagtagctggcattacaggcgcataccaccatgcctagctattttttttttttttttttagtagagacggggttttgccatgatgatgcctaggctggtcttgaactcctggattcaggtgatccacctgcctcagcctcccaaagtgctgggattatgggcgtgagccactgtgcccagcccatttttagttttaaaaggggcagccaaaccatttttccaaatcgcattacttatttttagagttttattatgactcaatccctagagagatattccactgtttgtttacctcttcctaattagagaagtatccttctaacgtcccacggagtcagatgaatgtggattcaaatcctgcttcactcacttattagctgggtgagcctgaacacacgtttaacttttctggagtctcagatttcctgtctgcaaaatagagataataatgcctgagacagtaaggatttaacaagatcaacatgtaaaataccgagagtagagcataaggaacatagtcaggagttaatgctagttctctcccccacttcatggcagaataatcagcaaccatcactatcaggtatatggtactggaaattttacctggctttaacaatgcaaggaaatgatactacttttattcatgttttttctactaagttttatgtgtgtgtgtgtttttttttttttgttttgaaacagaattttgctctgccgcccaggctggagtgcagtggcgcaatctcggctcactgcaacctccacctcccaggttcaagtgattctcatgcctcagcctcctgagtagctgggactacaggcgcctgccaccatgccccgctaatttttgtatttttagcagagacggggtttcactatgtttggccatgctggtctcaaactcccgacctcaagtgatccacctgcttcagcctcccaaagtgctgggaatacaggcatgagccaccccacctggctgtaaatcatctttagtaggtttgttatgcacagtgtttcctgggtaaaactagtttccctttcttcctattaatgacatgtgctgaagtaattcttaccactcttggaagcagaaacaagttggtgtctctgcattatattctgtttttgttttttttttcccttataggtcggtgaacaatttcctgatgactggtccaaaggtaagaacaaattccattaattgatatggatttcactaatcttagcctgttgactaaagatgataaatgcagatttttcattatatccacatattttattatgctgtatacattacagatagaaagattgagacccagagggtgttagggacacatctaaaaccacatagcaaaccactgtcagcgccaagataagaacgcaggagcactgaatttatggctagaatttccagagccataaaagtcaacagccttttataggtgtcaggctgcaaagtcacacatccttctcagtgccccgtggtgggatgcagtttcccatgtttaaaatgctggaattgtactacatgatctttacattcatgggcattttcagttccaaaatgttgttttctaagatggtcatgtgatgagaactccttaaatttcatgaattaggtgatttgggctcattttggagagacaggatagtatagtgaagaaaggtgaataaaggataatagggactagagtctgataaaactgagtttcatttctagttctgccatttgctagctctgggactttggggaaattactttagctcactccctgggcctcagtttcctaatctataatatagtgcctatttcacaagttatttgtgatgtcaaatgagacagcatatttaaaggcttactccattattttggagggatgggagagtgagcaggaagagggctgtttggtcagtttagggtaaatgcctcctaagttcagtctgaatttttacccctatgtccctacaggcttacctgatttactccagcagtgtggcagctggtgcccagagtggtattgaagaatgcaagtatcagtttgcctgggaccgctggaactgccctgagagagccctgcagctgtccagccatggtgggcttcgcagtggtaagaaaaacctcagccacagctccctggaccctctggtcacaggttagagccccagggatagccccttgcctcctcgacacccttattcctcacctgctctcttctcttaggtcatctccctctccaggatcttctcttttccttttctacttcctttttcccacctgtagagttttttctttctttctcaacactctcattgctcaacaaatggatcttgccttactcccaatcccataccatccttggcctcccagctggctaaaggtctcctcacaatgtaagtaatatcaggaggtaggcaggggtcataattcctcagacctcttagccccttcctcagcagagagatactgggcaagtggagagtgacttggagaccagattcccatggagaagataaagagtggccatgccagtaaatgaaagagctaccaatcagaggttcttttcaagactaactgcacatgactcttagaccctaagtgttccaggaggaagtggggatgggttctttacaacctagccttcagattcatctccctccccatttcttcctcaggctctttccagtcatgtgtgtcaacagtaccctagccacttggtcataaaatgtgtgacctgaaaagacaggaggtgagaagagcagggctaaggccagggatggggcagaccatgcaagagggtaagatacactataaagatgggaaggccaggcacagtggctcaagcctgtaatcccaagctctttgggaggacgaggtaggaagactgagcccagagtttgagacaagcctaggcaacatagtgagaccgactctctgcaaaaaaataaaagttaaaaaataataataaagatggggaaataggatggagctagggaaagaggatataatgatggttattaaagaaaggtagcatgtctggtatttctttaagctgaaacccctccctctaactctggatttttggttcctgctagccaatcgggagacagcatttgtgcatgccatcagttctgctggagtcatgtacaccctgactagaaactgcagccttggagattttgataactgtggctgtgatgactcccgcaacgggcaactgggtgagtagtaatgtagggatgggtaccataggccagccaacgcacataaagaatgaaaagcctggtgggggtgaagaagagctgtattcttctaaatatgaagaaaatcatgcggaagatgggtgaacgagtttgatcccaagccctacaatgacaagccaggctaaatgtagcttagaaccttcttttcccattgagtagtttccttaatttaaatataaaaataaagaaacaacactctggggattcctctgttgcttctctcaaacacaaggggaacttccttccgtgttgcctatccccgtctactttccactctttacctccagtgctgtctccaatctcctgagccctcctgaccaatttccaacatcgttgttccatatttcaattgtacccctctttccccctcaatgctcgagctttcctcatctttttggcaccattttgtcccttctggacctcaatcaccagcagggcacgtgcaccctctgcccatgcgaagaggcactgttggcagaggagtgtactggcaccttgcaaagaatccactcggcaactacttacgtcgttgagccctgagcaggggattggctgaacctggaagtgggcgtgtaaaagtggcaaaaacaaatctagacggcaactgatctggatacagggcactcgcccaaccttaatcctctcctatcctggacccccccacccccaacccaattagaaacagcagcccaggaggctctgcgcccgcttgctcaatgacctgtcctccctctgcacttttccagggggacaaggctggctgtggggaggctgcagtgacaatgtgggcttcggagaggcgatttccaagcagtttgtcgatgccctggaaacaggacaggatgcacgggcagccatgaacctgcacaacaacgaggctggccgcaaggtgagtcccgcagcccttggaaataggcagctgctggctatatccactaccagctccaggtgcggacaactcttcagttcatttaaaagattggcaaaatgaggtaccaagtgggctggcccagtagactaactagacttctcgcaactcccacaggggcagttaaactcgccacgcgcttaatccggggcctctcactcctagctctctccccaggcggtgaagggcaccatgaaacgcacgtgcaagtgccacggcgtgtctggcagctgcaccacgcagacctgttggctgcagctgcccgagttccgcgaggtgggcgcgcacctgaaggagaagtaccacgcagcactcaaggtggacctgctgcagggtgctggcaacagcgcggccggccgcggcgccatcgccgacacctttcgctccatctctacccgggagctggtgcacctggaggactccccggactactgcctggagaacaaaacgctagggctgctgggcaccgaaggccgagagtgcctaaggcgcgggcgggccctgggtcgctgggaacgccgcagctgccgccggctctgcggggactgcgggctggcggtggaggagcgccgggccgagaccgtgtccagctgcaactgcaagttccactggtgctgcgcagtccgctgcgagcagtgccgccggagggtcaccaagtacttctgtagccgcgcagagcggccgcgggggggcgctgcgcacaaacccgggagaaaaccctaagggtttcctctgccccctccttttcccactggttcttggcttcctttagagaccccggtaattgtggaacctagggaatggggaacccgctctcccagacctagggatcctgagagggagagactgcaatttctccaaagcttgccactttccagcctgtttccccaattcctctgtgctctcctagagctctgtctgaatcctcgcagccacacctaggtctgagaactcaggctttgagttactgatcttccttggattaggagaacaggtgttcctcctcccctctcctagcagccctaatgtctgacctagcctatcaagccttaggcgctggaagaacccttctcagacacgcaggacccaggtaaagtcaaagctttgcccttttgcccactgtctgctaccagggctcacccactgctgcacctctcttctgcacagctcctcccctgctacctgctgagccagattccccaggaatcttgaatgctttctctcctcttctccctttcctttcccagaaaaactgaggaaactggccccggaaaagcatgtctttggggttggttcctagaggcagaggttgaagatggaagagggagctctggagtgctaacttgaacaccaagggtgctactcatccctatggtatcatatcatgaatggactttactagtggggcaatgactttcctagacaataacccgagggactccagatacataccccgaaggtctaggaaatacgttaagggcagattacagtcatttcctaccctttaaaggtaacttctcccttctcctgacctacttcctcctagcaaccaactttacctcttcttctccaaaggatctttgttcctctgagccaagactgaggtaaataaagccactttcctcttcagatcctggtctgcacctctagaggcaggtcctaagaaggagaaactgagacccttccttctcactaacctggttctcaaacaggcaggattcagagcactggatatcttccttcaatgagtaaacttcctgcaatgaaactgttgcttagtaggaagttcagcaccttgaaccttaatttattgcagtcattgtgatatgtgctctttttctaggtactgcacttattcttgaggatattcgggtgggctgtggtaacagatacaacctgtaggctctctcctccctcccatcttggcaggataccatcctccctaaagcctcacttccctggtggcccaagcagttatctggattgaggctaagctgccaaggattagtaaatcatctatttaaatcttctaatacattcactcaagagccatgagcttgctgcttgtggtacttgagtcttctggttttattctcagagagtacagcagggacttgtttatgaaacagagcaagaccttggggagggaagaaccaatccctgacagaccctctgtagcccaaggggcttcccagccagcttccttgccctaggacagtcccaggtctggggctgggcagctcttctagagcagaactggtcagatgctagacgacctcaaccttcctctcccagagtaggaaaagcagtgtggctggctccaggcaacaaaagccaagactctaggggttcacctgtaagagtcaagggttcccgtattccaaactaaggcaatggccaggtcagatcccaaacccttggcctcacccacacaccttctggtcttaccaacacttactgaggagagagtttccccttcctgaccggggatacacttcctttcaggtgttcttagtgcttcatttccagctttctcagcaaaaggcccttcacgccttccctctgcttttatctgaacctcctgaatctcccaactcaccttttctccttaatcaagaagcagcatatactaacctacctgtcccactttgcagaattactttataatgtacacgaagaaagtttggcaaggcagctagaaaatttaaaagcacaatgttgtaaagtaaagctacattctccaggtctcttagcataaaagcagaactattgtgcttcatatttggtaactccaggtcagcactctaaatacgtcatgccgccagaacattatttcataggttattgttttatacccccaaatggataccagattcattccagttctaccaagaaaacatgactgagatgccttggatctgtattgcttttcccttccttttgcaatatccacttgttcatttgttcattcaacaaacaccagagtagagatagtggtgaacaaccaccattgctgcatcacggagtttaagttctcatcttacactcaattgccagggccgtggtccctttacaaagtagacaactccagaactggtgcttgggaagacatctttgaggtcagccagtcaaaccttttgtgttacagatttaaactgatgctgagaaagatgactggcttcttcccccaactagtaagttactgtggggagagtgcagagcacaggccccttccacctcttgtgtgctcttcaggagcccatctgtctcagccagaagacagaaacagagggaggccctgagaagtgacaaggacattggttggggtgggcaaaacactgtctccttcctgtccctggcctgtgagcctaaacacaggcagagctttttctttttgaaaagaatcgcagcctcaactggccttagcagcaggttagggcaaagacagagacggggtcgtcttcggcgctggtggtgctggcggtggtgggaggggagggcaggccagggcactcgcctattgtaggtctggattggatgcttccactcattcatttccttttaattaacccgcattcctggaggagaaatatttatgttggctcccatagaggcaatcctcagactggaaagaagggggaagaaagcctg

SEQ ID NO: 12226 - DNA, 34539 bp, Human
gttctgagagcatcaccaacattagcccattgaatcctcataacaaccctaagaagctagtactattattatgccaactcacaggtgaggacactggggactcagggagataaagtcacttgcccaagatcacacagctagtgggtgccagagctgggattgaaactcaggctgattggctcccaagtcagtgtttcaaggctcagttcactgacagaaagacaggaccatgtttgtcctcaaaggctatcttcaggggtcttcccctgcaaaatcccatcagctctacctgcttgcttgcccttcaggatggctactgcagcaaacagaggaggcaggagtctttgagggggcattttccagtgctctggtctctgggaataatttcattaccagtcctggaaggggtgggagagaggagcctggggaaaaggctgcgggagcttcagcagttattgaatgacagcattctcatgttctccttgtccctggtctgtcctctgaggctgtgggctcctgccctctgcttttattcctgagaatgaagttcactgggccacctcactcattttgactctgccccttcagagactcccatgaaggtccgttttccctcttcaaaatggcctattttgtcattcttgaatggatggttgaaagttgctttacacttgatgtggacataagcagactgtaaatccattaaaaatagaaacaaaaggaatggtggccaggcatggtgacacgcacctgtggtctcagctactcagaaggctgaggctggagaatcacttgagcccgggaggctgaggttgcagtgaaccgagaacatgccactgcactccaccctgggcaacagaataagaccctgtttcaaaaataaaaatagaaacaaaaggaatgggcagtttgcctctggggccctccaggctaggtgagcatccatccccattgggtctgtttgtctctctaaagcattcctctctgggaaatcgccttcctcgaacccaaagagcaagggttctgtagagcatttactaggagctgccttgaagctgccctctgattcagctgggcgtgaagacaaggcaggcctcagcttctccatttccctcattgggagttgtgttgtttacgagtgactcacacttcagggtaaccaaatccctgttctagaagctacagcagaaacagcatttccagttcaccaaattagtcttctcagagcgcccaaactcccctttctgtgtcttcttccctattcagtggcatcccccaaaccctccagataggggcatctttgggctttcatttcctcccaggtgtgagtggctctaacagcctcggttccccagagtgcaggttcagaaaatgcaggggaatgggactccccagatcccaagggaagagctggcatcacttcttcagagtgggcactcctggggggactcatcccagctcaagaaagtaactctccagtcacaaccaactttcccaaggggtacagtgggacttgccaagcactacaagaagagaggacactggcttttccagtcagcttggaggaagagagggaggaaaaaaggagggggaggaagagcaaaaaggaggaggaggaggaaatggacaaggaggaaaaaaaaaaaaaggaggaggatgaggagggaaaaggaggaagaagaagaggaagtggaggagcccagaaaaggaggggaaggaggaaaaaggaggaggagaaggaaaacgaggaggaagaagaggtggggaggaaaaggagcagcagcaggaggcaaatctccatccccacagcaaaagcagtgctggagccagagcccagagtgtgggagctaatgggaatcagcttgctggagggaaggggaccgaattaaggaatggctggggctctgccgctgagagggggctgggaaaagcaggctgattgagaccagctgttgtgcctctgtctctgagatctttggactctgcccaggatagcctcacaccctatcctacacgactaggaacttgcacagtccgcctcgggcagcccaaagctcctctgcccaccctggctcccagagccctccaaaacaaaagaccagagaagcactctccacccagcagccagacgcctccttcttgacgccagcccccaccctctgtctgctcgagcccaggaaaggcctgaaggaagaggccggggaaagagccctccctctctcccttgtccctccatccacccagcgccggcatctggagaccctatggcccgggctcactggggctgctgcccctggctggtcctcctctgtggtatgtgcatcctagcttccactggaaggcagctctgacctctcccctctgagctcagaaagggttggagtgagggttggggcccgagtctctttttctgttgcttcctctctctgacttgaggaagagacacctcagggccagtgttgggggccctcataacttggatcgagtctggtttggcacctttccattccccccgttatagaaaaaaaatattctgacactcgttaaaacggtaaggaaaacttaatttaagactaccgcattgcaatagaggagagaaatggggctcaactctgattacagaaaagacttccagggatctgtagccaaggagcagagtgagggggtcagtggatggaaaagtattaagaggagatagcaagggtagggggattcttgctaaaccgactgaacagcattcttgctgacggcaggccagagtgatcagatatcaagggtgtctaaactgacttagcaagattcttgctaagactgggtgatgcaagcctggcaagggcaggacagacacagaaggccaaggtcaaggccaagtggagaagaggctttgggggagcctaactaaactttggtcaggaagagagtctttcctctttgtcattcctgcggcaccctctctgtcctcaactaggtgcccagcccagcgctcccaccctagccttcctttctttgttgtctgtcagcagggcctgatcagtcactcaatgtccagttcctgagcacctacccagtgccaggccttgtgccagggaccacagagtcattcagctgcagagcctgctcttgggagccacagccctggcctcagagaacagcatattctggtgtccagagagacataagttggctgtgtcctcattcttatgttagcatatcagtgccaacattttgccagggatctgtttctacagaaatgggtgtttgttttcttaaatgaacagtatgggtcgcatctgatccttgagtttatgagaccaagataaaatcacacaggacgttcatggtgttgaaccccagccaccctccttgcatctgtagctcagcccactcgaaagtgtggctgggcgtggtggctcatgcctgtaatcccagctctttgggaggccatggcaggcggatcacttgaggtcaggagttcgagaccagcctggccaacatggtgaaacactgtctctattaaaattacaaaaattagccaggcatggtggcgcacgcttgtaatcccagttcctcagggggggctgaggcaggagaatcgcttgaactcaggaggcagagattgcagtgagccaagattgtgccactgcactccagcctgggcaaaagaaggagactccatctcaaaaaaaaaaaaaatgcgggcgcggggggcgttgggcgcagtggctcacgcctgtgatcccaacactttgggaggccggggcgggtggatcacctgaggtcaggagttcgagaccagcctggccaatatagtgaaacccccatctctactaaaaatacaaaaattagctgggtgtggtgggtgcatgcctgtagtcccagctacttgggaggctgaggcaggagaatcgcttgaacccgggaggcggaggttgcagtgagctgagatcgccccactgcactccagcctgggtgacagagagactctgtctcaaaaaaaaaaaaaaggagggggggcgggggagtgtaatgtctccccacactcagggccccattaccatctagggaaatccctccctaaaagacaggggggttagaggcaaggactatcagagaccgctttgtctaattcaagcccctcctttccagaggtccagagcctggagaacttagtccagtgcctggcacacagtaggcgcttaggagatggttgctcaatgaatattgggggggggtcactctcgagtcactctaaattgggggcagagcccaaactagaaactagatctccatatattctgtcccttctgtggcatcacctttttcaggcccacctctcatacttggcagagtgggaggactgaaagtgcgctcacctcttttgtattaagatggcctgggttcaaatccctgttctaccactgactcctggtggcacaagttagacaagttaccaaatctatctgggccttgacttcctcctctgcagaaagtgaacaataatttccacctcatagtgatgtcacaaatatcaaatgagatactgtagatgaattgctgcgttcagtatctggcacataatagggtgtctttaaatactaattaatccatctttccccaccatggcagactaggatttctgtctaatatattgaaaatgagcctggaatgataggcaaagatttggactgtaagaaacagtgcaagcaggccttgaattgaagtcaacccaatgtatcatacaattagatttataaaaggctaaaatgaaggtggggtgattatttagcgtgatcttctagagcatttcaaagaaaatttgataacaaaaatttaatttacacacaacttttctacttcactaaaccctgaaaagacccaattagattagaagaaaaattgatttaatgagcactaaaacccatccaaaagtggcaatcacttgtctatgaaacagatttctttgattgtgacccagggtgctatccagttcagcctgatttcctatgaaatgtgattatttttatcctcaagtagagctggccagcttcgtgcgtttcaaaggatggaggccccgtggggcgggctgagaggatactccttccctctctaggaactagctggtccccaaatgaccctggatttttctcccggcttctagcttgtgcctggggccacacaaagccagtggaccttggagggcaggatgtgagaaactgttccaccaacccccctgtgagtgccccttgccccccgcgcacggcccccctggccccacggcacccccccacccctgccccacgcacccctgcaccgcagcacccccgccctgctctatcatcttctctatccctcattgggtcagttggtagcccctcctcctaccaggctttctcctgatttccggactcttgggcccctcccccctccactccctcccctccacatcagtgccctcccctccctcccattcattcccccagcaggttatctgcttccgtcctgatctgggcctgggaaacccctctaggaggagggaggagggcaggaggcccctaactggcctttggctgaggccaggcagaggaaagaaaagacaaattctagagtgacagcaaaaagagaagcacagaagggaagagggaggaagacagaggttagaagagccaacggaggccgagcacggtggctgacgcctgtaatcccagcactttgggagaccgagccaggtggatcacctgaggtcaggagttcgagaccagcctgggcaacatggtgaaaccccgtctctactaaaaataaaaaaattagccaggcatggtggcgggtgcctgtaatccccgctactcaggaggctaaggcagaagaattgcttgaacccaggaagcagaggttgcagtgagccaagattgtgccactgcactccagtctgggcgacagagcaagactctgtctcaaaaacaaaacaaaacaaaaccaaaaccaaagaagagccaacggaagggcaagagagggaggcctagggtgtgcagacgaggaaaaggcccagcagaaggggcttgggtagtcagcttcctagctggagaccagagtgattctttctacaatcagagtagggctaaggggtaggcatgccagcagcactgtaagccatgggaaaaacgcagtacatctgctagcaatatcaactttatgggacccctggggcaggcaggtgggtgggcaaaccacattacttttatattaaaacaaacatggatatatcgtggagtagaaagcaaaacagcacaaacggaaacatgcttttcgttttaaagctaaaatgacctgtaaagaaatagagaactggtctggaaagggtctttctgggcaatatctcaaactgctgggggcattcattcactctcctctgccatttgggaccagtgggtggcaacctgaaaaagccctgccaagggaaggttgccagataaaatacaggacacccagttacatttgaattttagataacaaataagaatttagtgcaagtatgccccaaattgtgcatgttttaatataatacttacattaaaacattacacattgtttatttgaaatgcaaacataactaggtgagtgtcctgtatttttatttgctaatctggcaaccctacccccaggtagccaaagaaggactgtctgcatggcctggcccaatgccagagctcagacccctgcagttctcacccacacccatatcccagactcaggtcccattactgtcacaaggggtccctttccaaactctccaacacctccatctccacccagcccaggcatcttaatctagactaagcagtaacatcagttgccaccccatcccttcccaagccaggccagcctaacttcccccaaccgctgcttcaggagaggctgggggctcttctggaggccaggggcccagatgtcattttctctaagcaacgtgtgtatctgtttgtttgtgtctcaatgtcttcttgtcatctgtcagtaccttccagttactgtggtcaataccacaatgtcactcacagccctccgccagcagatgcagacccagaatctctcagcctacatcatcccaggcacagatgctcacatggtaagagacagcttctctcccccttgccctctctgctaccctgggtcagagaccacaaacaggagctgttaaaactcagaagatgaagacagagaaaggatctgatgggcaaagggagggaagtagagagcatggacacggtagttttagggcaagtgaaagaatgtatccctctacataggcgggcagacattgccaaacctccttaacctcaagaaattaaactataaacaacttcagaatcaattttcatcaattcccagaaggcagatccagaatgaatgtttagggtatccctgccctaggaggttagaaggtgggctggaaattgggctggaagaactccaagctcccttctggcccaggccttcccatactctgtggaatggagtagcaaaataatccaaaatcctgggttaagggagcgcggggttggttgtggaggggggcacccatcccaccgtttcccctcactagctccaccctccacaccatccacctttccaacaccagcccatttggaagagagggcatttttagtgtcaatgagcttgtttaaattaattttcccacatgctgggaagggctaagaacgttgggtaagtatctgaacttccctgagcctcagtttcctcttctgcaaagagaaatgggtctgtaatgagatctatctccaaggattatgaggatcaaaatatgataatgtgtaaagccctttgcagaagttatgatgttcccagtctactgtgcttgactcaggagggagaaggattagctggaggggaaaacccaaacgagccaaaagacaggaccctagactgcatagaatttgcagggcagggcaacaagtctcctttgcagaacagtccagtgttacactgagtccagtgtgaacagtgtgggggcgggggagttgaactgcaaaagatacggttgctcaaaggaagggaagatattgaaggctgggagagttacagagggcttcctggaagaggcacttggtgtgcttgggcttgtagctgacaaggggttggagccgacagacagaaataactgggatgtggttgggggcctttcatgtgggatctgataccacgaaaaaggctaatgatggtgttgttgatttcctagaacgagtacatcggccaacatgacgagaggcgtgcgtggattacaggctttacagggtctgcaggtgacaatcattacccagccccattgcttttgttggtagatccagaggtggtcacagaggacctaatgtggctagtgtctcagcatctgggaccccagaacctactgtagagaaaacccttctactctctctgtctccctccaccaccccaaaaccatcagattccccagggcacatatctcatagcccaccagccactttctgtgtagaaatgaggcagaggctgccttcctgtgctcattacctctgctgcaaccaggcccagtccagcactcccaggctccgtttctaaatagttgctacttctacctctaaccgctaagaacccgctgattcctttcacatgagggctcatttggagacaaagttttcctttgccggttgttttacggacaacatcacttcacatggccaaatgagacacaaacatataagcccttgatgagatcacagtgtctgaaggggcctcgcaccgtgatcctggcccattgaatgaaatccaagcttcctttcctgatcctcaaacattcctccttgggcttcaaactaccctgcctcgtgcctcgtaggctctttttccctttgccaaagtctctggattattcttgcccagcagtcctcagctgagcctctggtttagcctccctatcagccaccgagtctttacgctgagccccatctttcctgagagcgcctacatgcagccaaaagttgacctcacttctgctgaaagtccacaagcagccctcaacacaaagcagaggtgcctgattcaggacacctttctgccagctccccccacagctctttttaagatctccttcctcacttctttccaatggaggagagaatctctttccagaggccccttgtggcattctcagagccagcactgcattgcacatccatcagctaatgccacgttcctccccttcaccctcacctgcaagtttctctgttctgccccaggaactgcagtggtgactatgaagaaagcagctgtctggaccgacagtcgctactggactcaggctgagcggcagatggactgcaactgggagctccataaggaaggtagaagggccgcatggatttgttccccaagtcttgggacctggactaggttcaggaaggtataggtgagagcgtgcatgtaagaccatgctgggcctctatggggagcttaggaaatttgaggccatcactgactttcaaggctgatctcaaggaagacacacatggtaggaccatcagacagaacccctggctggagagcctggggctggccctgaaggtgacctctgcattgcttcctatctttctttcagttggcaccactcctattgtcacctggctcctcaccgagattcctgctggagggcgtgtgggttttgaccccttcctcttgtccattggtatgctcttccttcagtccctgaatttgtccatgctaacgagggtgactcagcttccctaggatataaagaaatggaccttggtagaaggaggggcggtgggactataaagatagagcatttgaaattgtagttgcagaatgttttgcaatgaggatgtattcatggattgtgtaattaaaatacatttaaaagaatcagtacaaatattttaaaattcatgagtgcagagacccaacctagaagactcagtgaatcattaaagagctagtggatgaataggccaggatgtgcttgaacccagaaccatcctctgtgccctggaaccctgccaatgatgatgctggaatcacatggtaaccctcttctggaaggtagcttagaagggtcaaaagagttgggagggcttctgagtttaaaaaaaaaagggcccctgagaatacaactcccggagttctggggcctcagacagctggcaagcccattcccccaaaggggagtcctcatgaatatgtactgaaaggcttgtgctttagaactggcttctctgccagcctgtccaatggcctgaacatcaccattccttttgactgtgacactgaagccctgataaaataattagtgcccaagagaaggaccacccacagccactggcaatgaaaaagacaagcttagccaatttgtggcagtcagtgttagagtaggctcagggcattaggcttggaaagcagaaagaggatgagaaacataccccagcgtgggcatacatgccgggggtggggggtgggcaggctgctggggcaggctccgggcagctgggctgcaaagggaggcaaagggaaccaggactaactttgcctgaatcacaattttttcctggggtgtaaatgggcaagggacaagtgactccttcttgtctctgcagacacctgggagagttatgatctggccctccaaggctctaacagacagctggtgtccatcacaaccaatcttgtggacctggtatggggatcagagaggccaccggttccaaatcaacccatttatgccctgcaggaggcattcacaggtgattcagtaagcccagtttccttcccaacttgtagcaacgcaggtcccggctgctattccgtaggtggcaaacttcatcatcagaggtaccaaagcagtggtttgcaaaccttagcatgcacctgagtcacctgggatgcttgtttaaaatgcagatttcagggccccctccccttgaggagtctgaatcaaaatgtcctccggccatatttagaaaatgttgggttaaagaatgttaggatttgaaacaagatggagcaggaagggaggaaagaagggaaacagagaaagatgagagaaaatatccaacccctttcaagagagaaaaaatcatgatatgatttgcttgcctggtggcagagactgatccataatgaatcattcagacctttacttctgaccctcttgtgatgaagaatttagatttgtgagatggctggggtcaggtgggccaggagtggacagaggaagtaaataactaagttcagagtcattctgtagcacagattacagttcaggttttgctggaccaatcaggaaggttagaaaaatataacatcaataaccttgaccccgttgacactatctaaatccatcacaaaagaacagtatgttgtaagattcctgtaagtcgtaactaaagtcctgaccaggaccagcctactgattatgaatcagtgtcttggccaccaaccagtcctatctccctgggaattctgaatgagccaatgaacttggattcctagtaacattgatcaagccaagagatccctttccgcatgcaagtccacataatttctcacttagaaaggagccaatacagcaggagggagatttcaaaatagcagccatgacgaaacaagtgaaaattgtgtccatttttctttatctgttctgatgtaacttccagaatcattctttctgcatcttgacaccatttttaaagaaatttgttatccaagactgttaaatcataaataaaactcatcttattcagataaagaaagtcaaagttatgtcgggaaggggaagggaaaaaagaaaaaccttcctggggctggaagggttttgtcacttcccaaaagtgaggggatgccgagtcatcacccgctgccagtcttcaagaaaaaggcacctggagcttgagtttggaagccgaagaacagagttcagcttcaataagcttataaagacgagagagactttccagccacttgcagattttaaaggagaaaggagagtgcaaagggcagaacatgaaaagttcgctactcaaacatacctgtacgcaccagaccattgaaatttgggttcatttggtttctcagaaaggtatcatattcctgaaccttgaaaacataattgcaagtgaaagaagccagtcagagaaggccacatattgtacaattccatttgtatgaaatatccagcactggcaaatccatagagacagaaaatagattagggatttcctggggctcaggggaggggggatagggagtgactccttagtgagtacagggtttcctttggggatgaagaaaatgttctagaattagatcgtggcgatggttgcacaacattgtgagtatgctgaaagccactgaattgtgcactttaaaaagattaaaatgatatgttttatgttatgtgtaaaatacacataacataaattatgtgtaaaatatgtagtaaaataaacctacaaaaatgtattgtacccaaagctttggtcattgttgaatagttttacctgttcacatgaaatatttttcacgacattaagttatttatgctcatatctgaacccaactaggacccttaatgtttatggccttcggccagcaaactcctagtcctgcctaggggtagactctttgaatatcttgcagggggcagggatagaagatgaaaactaaagtcatagaacccagatataagcatctgagaaaggacggtgctgtgacacagagtttaaggacagatttggagactgagaatgttatcaagacagtacggtgtctgtacagattaagagcgtgggccatgcagtcagacagaccagagttcaaatcccagctctacctcttgcatccatgaaaccctagacaagtcactttacctctctgaagcctcagtttccttatctgtaaaatgggatgggtaagaattagaacaatgcacatggagtgcttagcccagtacccgtggcttagtaaatactggggttactgcagagaaagttgaacacggccccagccctacccctttgtccttcaactaggactgctctcttgatctcagtctgcatgattatttattaatcagaaagatacaagagttactacatctcaagataccattctgtgtgctttacaaatattaattcattccatcctcatagcagccctattgaggcagatgcttattatactccatccccattttacaaatgtgcaaaatggaacacagaggggttaggtaatttgcccaaggtcacccatccagtaatggcaaagccaggatttgagccccatctgggtccagggcccatgtcattaatgagtacacaagtaagagtttgtttgaggaaagggtttcgctgctttttaagaggatgcaaaactgttaccctaaggctgaccttccaggaaccgagtgccaaaggcaaggtctgtcacttacacttttttggggctcctttgcttctagggagcacttggcaggagaaagtatctggcgtccgaagccagatgcagaagcatcaaaaggtcccgactgccgtccttctgtcggcgcttgaggagacggcctgtgagtgtggatttgcagacatgggtgggcgcctgggtctccccaatgccccaagcctcccgggccctgcagcacagagctagctcttccccaaataaccatgtgcccaccaattcttgagaactccatggccacagcccgtgggaaccaagaagggtaagggggcaggagctcatggcttcagaaaaaggacaaaaggtagccctgagcaagctgggaccagcccacaggccaccagaggaacgaactgactatggcagcaaagtgcttctgtcccactaaggggaggaggaccaggaaatgcctcccaacaacttagccactaccccagggcactcacactcccagctttagcacccagtgggactctactctttccgacatggctcaggacttcttgtctgatccctatggctgggcttcagatattccagggacccactggaactgtgtgctgactgctaagtatctgcatttttctggggggaaaagatccataactctcaacagcatctcaaagacgcccactcccccaccccccccccccggcaaaaagattgagtaacatgcagaggtagatgatacaagcatgctgttggtaatctttggaggccaaaggaaacagtggggcaaaagtgtcagaaatgcttgcctctggccgggtgcggtgactcacgcctgtaatcccagcactttgggaggccaaggtgggcggatcacctgaagtcaggagttcaagaccagcctgaccaacatgttgaaacgccgtctctactaaaaatacaaaaattagctgggcatggtggcaggcatctgcaaacccagctacctgggaggctgaggcaggagacttgcttgaacctgcgaggtggagattgcagtgagatcttgccactgcactccagcctgggtgacagagcaagatactgtcaaaaaagaaagaaaagaaagaaaaagaaagaaaggaagaaagaaagaaagaaagaaagaaagaaagaaagaaagaaagaaagaaagaaagaaagaaaggaaggaaggaaggaaggaaggaaggaaggaaggaaggaaggaagggaggaaggaaagaaggaaggaaggaaaggaaaaaaagaggaaaagaaaagcttgcctcaggcagatcagcattaaatattccttgtcaattctcttcccagggctcttcaaccttcgagccagtgacatcccctataaccccttcttctattcctacacgctgctcacagactcttctattaggtatggcttttccttagcttgctgttgtggactttctccaacttccaccctcttgatgccccaccactgatcccgccttaatatacagccctctggctgcccatcagctcggcgcctgctgcagcacgaccctttagaaaaccccctgttgtcttttcctgactctttaaacctctgtccctattgaatcccaaatctggcctgcttggctccctggggctggcttcctttgacctccaggaacagagggactgtgactgcctctggtcctttgcatccttagcagatgctcaggaccctccttgtcttcccaccccacccaggttgtttgcaaacaagagtcgctttagctccgaaaccttgagctatctgaactccagttgcacaggccccatgtgtgtgcaaatcgaggattacagccaagttcgtgacagcatccaggcctactcattgggagatgtgaggatctggattgggaccagctataccatgtatgggatctatgaaatgatacccaaggtgggtttgccaggccccagcccaagccaggcaccaatccccactctaggcctgagaagtcttaacctaaagtgaggtgaagcccctcagccattcagtcatctggtcagccaacaactgtgcagtgagttcccttcttggcctaactgggaagagccagaagaggaaacagggatggccatccagagagctcataaaattgtcaggaggctggagagtatacggcctgatctagcagagactttggagtcagccaaacttgaaaatgaattccagctctgtccctaactagctgtgcagtgactttggacaagcaacttagccaatctgggtctttttcttcacctataaaatggcaataagagtcctgacctcgcaggagtcgctcagtggagatctaaaggagatagtgtatatgactgacacatggtagtgtccaataaatggtagctgtcatgatatgtacaggaaacttacactgtcaggacagcctgtcgagtgactcaggccagactctgatccatcccagagtgctggtgggatccgaagacagggagttcattgccaagcaaggcagtgtcaatcaaggaagccttcctggaaggagagagggttcagctggacgtggaaaactaggaaagacagaaagcacacacagagtagagagcattgccacgaaatggtggcaaatctcacgtctgctgggtcctcctgccagtcctctgaaaacacccctgtgccatggagacctcctttactgtgcccccagacctgtgcccccagacctccttttctcctccctgcccccaacaggagaaactcgtgacagacacctactccccagtgatgatgaccaaggcagtgaagaacagcaaggagcaggccctcctcaaggccagccacgtaagtccacgttcaggcagacatggccttttgggagtatccagcctaatgagttagaaaggaaaggcctccagaagagcctgaagaagaccctcaatgaaacaaagaagcaagctgggcgcggtggctcacgcctgtaatcctagcactttgggaggccaaggtgagaggattgcttgagctcaggagtccgagagcagcctggccaacatggtgaagccctgtctctactaaaaatacaaaaattagccaggcgtggtggcgatcacctgtagtcccagctactcaggaggctgaggcacgagaatcgcttgaacctgggaagtagaggttgcaatgagctgagatcatgccactgcactccagcctgggcgagactaggtcaaaaaaaaagaaagaaagaaagaaaaagaaataaagaagcagacaccaaattattcctgggcgcccacatgcacctcatatccttgcccccaatatagtacagtggtttagagcacaggccctggagctagggtgccttgagttcaaaccacagctccacccaattcctaactgggtgaccttgaccaagtcattttacctctctgggcctcagttaccccatctgtaaaatgaggatcataacagtaatcttacagcatatggttgttgtgagaattcaatgaatatgtatattgctctgagcaccacctagcacattctaagtgttaaataagtgttagctataatgatttcctcacactggcaagaggatggctcaatttttaaaaaagaattcttgttaaaattaagataaaccacctcatttaaaaaaaactttgtctcataggaaattttaaacacacacaaagataaagaaaatagcatcataatctccagtgtcccttcatccagcttcaataatccttgactcatggccattcttgtcttgtctataaccccatgttcattaccaccacaaccaccccctctgctgctggattcttttaaaagtaaatcctagatagtgtgtcatttctgccgtcaacacagaactctttcaaaaacaggaacacactatgatcatatataaacactaacaagaattctttgacatcaaatagccagtgttttcaaagctccacatcctggagccgctatctgatctccatcatcttggagcctgtggctgcaaccagacctcacccggctcctctgtttccctgcttccccaactccaggtgcgggacgctgtggctgtgatccggtacttggtctggctggagaagaacgtgcccaaaggcacagtggatgagttctcgggggcagagatcgtggacaagttccgagggtgaagagccacggccgtcctttttggctgactgtcttttagtgtggcagtgggggcagggagggggaatttgtccccttacttagcagaaaggaagatcctcctcatatgcgtgctgggtgggggagggctctggagaacaaggagtgacaggttcttgggtggtcggggagttgagcagggggcgttggatgatatttcccgccccgctgaaagcaggacaactcgaagggccacaacccaatagcgtcccctagtgtctgcttcaggtacggtctgaatctccctggggggtgctgtggctcagaccaggtcagcccctggaccacttgagaataccaggtagggaggaggattcccgaaggcatgcttggcccaggtcagggccggattgtaggtttgaggtacaggatgctctcccaggactgggggagttttcagatacagagagctgggtttcttcactcctatccgtaaaatggaggtggagaggaaataatgtgtgtctacagtgtgtcctctgatcttcctctataaatgacaggtcagggcttgaggagatggaaccaggaggtgagggctgggagagccaaatggtgtccagttgagaggtagaggcagccatgaccttcattggatttgattagatatcccgggcccagcctagtccaggggcccattcattgaccatgccttgccttgtactttccagagaagaacagttctcctccggacccagttttgaaaccatctctgctagtggtctgaatgctgccctggcccactacaggtacttgaggaaaaagaattttctagggccctgttggggcatcctgttgtgtgtgtagaggaacagggtgaggggagggggatgttctgggacctgagtccacgttgaaggtccgaggcccctagccctgtgggggctgggagaggagctcagtgtggagtagggagttgccttgtaatgaaaaggcctgagagctggaggctgggggacctggaaggaagacaccgatgccattggatgcttttccctggcttcccatgtgttgcttatgttagctaatgcttaaagctcacgagttcacatggagagaggtctgttcactcagcctgaaccagccaaggtgggcccaagatacaggctagccaggtgtttggccctatagaaaacaaacccctgcaggcctgcctgatgaaaagctgaccagctgcctccgcctggcatgggcacagcagggagaggtcaatgccctccaagggagtgcctgacatgtcccagaattccctcccctggtgtcccctggtgtctcccacgccttcggctgccttgccccagcccctcctacccactcgggctagagtggcagggtgggtgctcctcggctttaccacctcttgctcagcagccccaccctggaggtatcctcccttcctgtgctctgcttcttctcagggccctctgctctcggaggcagcaggaagttagagacaaagggccggagggagcatctgggtagaggcccagctctttgccgctttaccgcgcatcctcgtgcaagccccttggcctccataggcctgcttctccttatggaaaaggagacagctgagctggggggtctctagggctctcccagctctcatattctgggctttaccctctctctcctccctggggaccagggcctggctcagccaggtgcaggattaacagacgtgtgctgaggacagcagcaacggaagctgagttctcttccagggccctttgggatagaatgacttcctccagagggactggcctggaagcccaggccccagaggtcctcccaccaaggcctcccacgtgacccagtgcagggttaggctgcccttctcaacattctctccccttctcagcccgaccaaggagctgaaccgcaagctgtcctcagatgagatgtacctgctggactctggggggcagtactggtatgtaccccgacctcaccctagcctggatgtctctgctcagacctcctgagcctgccaagagtcagccaaagctttcccttcctgggccacggattcttcgtctgaaaaaggagagatctggaatgagccccgaacatcctacccattttcacacatgggggtccctgcacagtgggaaatacacagaggctggaatagtggcaggacccaggcagcacctctgtgggaattaggaaaagactccctttgcttaagttgctgttttttgtgggttgtttgtttgtttgtttcttgacagagtctcactctgtcgcccaggtttggagtgcagtggcgcgatcttggctcactgcaacctctgcatcccgggttcaagtgattctcctgcctcagcctcccaagtagcttggattacaggtgtccaccaccatgcccagctatatatatatatatatatatatatatacacacacacacacatatatatatacacacacatatatatacacacacatacacacacacacacacacatatatatatatgtatgtattagtagagatggagtttcaccatgttggccaggctgttctcaaactcctgacctcaggtgatccacctgccccagcctcccaaagtgctgggattacagacatgagccaccatgcccagcctcaagtaaaatgttttctaagtccacgtattattacacagtctgagcaactatactcaatgtccctgcctggccacacaaacacatataccctactctcatccactagtgcacaccctggacacccccgcaccaccaacgtcatgcagactcctcagccccctcttccccatggcactgttcagggtggaggtgggggcagatgagagaagcaacccttttgatgggctacctttgtacagtgtacaacctgaatgctcagacatgacagccgtgcagaatagactaacctggccaggcgtggtggctcacacctgtaatcccagcactttgggaggccgaggcgggcagatcacctgaggtcaggagcttgagaccagcctgggcaacatggtgaaaccccatctctactaaaaatacaaaaattttccgggtgtggtggagcatgcttcccaagggaaactgaggcaggagaatcgcttgaacccgggaggcggaggttgcagtgagccgagatcgtgacactgcactccagtctgagcaataagagcaagactataaaaggaagaaagaaagaaagaaagaaagaaagaaagaaagaaagaaagaaagaaagaaagaaagaaagagggagagagagaaagagagagagagagagagagagaaagaaagaaagaaagaaagaaagaaagaaagaaagaaagaaagaaagaaagaaagaaagaaagaaaaagaataggctaaccccattccttccaaacgtgtgactgatcattcacaccagagttgagctgagctgagctgacctgaaagattttcccttctcattgaggaaggaagtgtgggaagcgtggggtgggacaaaagaagggccgtactgaactgatggaggagcaaggagtcctgtggaaatggcgaatgtgctaacgacagaggctctttgcttgttcttagcacagctctaggggatccagagtagcaggcgctcagcttagcagcctttgctggtcaggagttcgatgctgtgtgtacttgagatggccaatgagcaaaggggaagtgaatttgtgggggcgttgctggaatggggtgtgctcagagtagggtgaggccggggaaatagtcacctcacttcctcttctttccttctgaagaagaaggtcaccacaccccatgacccaaggagaagccccagggccctgggaccatttctcccctctccctcaccaaggcatgatcacaggggccatctgtggcaactgctgcagctgggagttgggagtcagaccttgggactgaggcttcacctaactggaactcagcaagtcactgggtcagatccgtgtttgccatggagaggactgtgtggagaggcagtgcttgctctaggcctggcttcactgaggttcagagagggaaacagccgcatggcctcaatggcctcatctgtgaactggggataatgaggcctcttctaccattcttcccagggagcagcaaaagtgtcctataaatggtcgacaactatctgaatatgagagtgttatgataatataatctctctggacctcagtttccccagctgtaaaaaggggacattcccctttctgcctcccaggaagcctggaagaagccttgctttcataaccagctggacccaaggaaacccagacctacagaacagccaaaatgagtgggatgggggaggagtgtgtagggtggggagtcacacttgtcagacaacttagtaacttttaacttgataggtttgcagaggcctttcacacataggtgctgaagaggggattttgattatggtagctgtcttcttcctttcgccgtccacccatcccatcccagccctgccacttgtggaaagcacacagaaagcacatggccccagtccctagccccaggcatttggcatgttggttttccttctccatagggacgggaccacagacatcaccagaacagtccactggggcaccccctctgccttccagaaggtaagcatgggcccagatttcccctcaccaccttcccccaagggggcacccaagcagtcaagatcccttccatttcagaggctaaaactgaagctcagagaggttaagtagtttgcccaaggtgacaccactggtgccggaaaacccagtgctccctgctgcttccccggggatatttcaggccactgacaaggcctcagcccaagctgagcctcatcctattctggtaaatcagtgcacaaatatttttttgttgttgcctgtgtgcctggccctgtactcagcagaaaggagaaagaaaggcatcccaagtggaggaaaacggcacaagtgaagcctccgcggtggaaaggagccagaggtgttcaggaaacagcgagggctggccagctggggcagaggcgagggcattgtctctgtgcaccagagggccctgggggtggagcagcgagctgccgtcatgctgcatgcagcaggccgactatggggcagacattgtgctggaaacacagagaggggaacaaaatgctgtccaggtctccaggagctcacagtttagcggcggagtctgctgcctctggctgtcctgcccaaagtgacaagcctgtgaacctgtgtggtgatggagattgaccacatcgcctctggaagtgaccagaagaggccactgtcaggccacctccctccgctgacagaggaaggctaagctgccaagtcagcaaacctcaaccctcatgaaaggccttaagaaaactcagcagccgtcacaaccacaggaatgagtgtgctaaacttccgtgaagcatgcacgctgttggcagcaccttctgtacattagtctgcctgcctctcccaacaaccttaggagctaggtcctgttatcttcccatcgcagataaggaaactgaggcacacagcagttaaagtcgcctgcccaaggtctcagagtgagtggctaagtcaggattcagcccagggagtcacagcctcggttcaccgccaccaagtgtctcctgcagatattgtaatgatcctcatagaccagccagagggaagcacgtgatggagccccagctttgggaaggccctcctcagcctctgctggccatcttccagaacccgggcagccacacataacgatgagactccccccaccctgcctacacacacccaggcctgggccctgcaccgtgtatccataggccaagcagctggatactcctctggctcctcctcccgtcctccatatcacctcttcctctccccatcaggaggcatacacccgtgtgctgataggaaatattgacctgtccaggctcatctttcccgctgctacatcaggtgggtttcagaaaccagtctggacacagcctcaggccctgatttcacaggactcagaccatcaccctgggaggctggtggggcaaggattttgtcatcatcccatcccttatgtagatgagaaaatccagcctagagagagaaagtgacttgcccaaggtcacacagaaggttagcgggagatccaggccttgaacctgagtttcctgcctcttaatctaacactgttgctcagaggtgggagagatcagtgggccacagcaattatgggaggattcttagaggaattaggtgtcaaagtgcaaagccctgacagatggggagaaattacagtagaggcatcaattcaggtaatggatacaatgtatggtaagctggagatagtgatgggctggtctggcgagggaaccactaactccatccatcagccctcctccatcccaacccaacatcattgcatcagtgcatgcttagcggcctctcaggggcccctcttcttaggcaccactctgatagtgaagcaagaaggggcaaggtggacagtcttcggtaaagccatctgactggggtcaatctctcttcccttccagggcgaatggtggaggcctttgcccgcagagccttgtgggatgctggtctcaattatggtcatgggacaggccacggcattggcaacttcctgtgtgtgcatgagtgtaggtgtctcctcagcactccccaggccaccccccttttattataccctctatgaaggtagagaatttcacaggtatggaaatgacaaagacccacaaagatgccatgatctacccaaggttacccagctccacagggtaagtgaggaatgccagcagcaggccagtcctgctggctgcttggcattcaagagggcaccagaaagagggtcaagccctagtgactaacttatatagaccccagagaaataaaagccagagccagctgcatgtggtgactcacacccatagtcccactgctttgggaggccaaggtgggaggatcacttgaggccaggagtttgagatcagcctgggaaacacagcaagaccccgtctctacaaaagaaatgttttaagtatccaggtatggtggcatgtgcctgtagtcctggctactcgggaggctgaggtgggaggatcccaggaggtcaaggctgcagtgagccatgatggcgccactgcactccagcctgggcaacacagcaagacccctctcaatacctaaataaataataaaagccagagccaatctggtgtgtgccaggcccaggcagacaatgatgtgatggacctgtgctcatagagatgctctgggatcctcacttatctgctcttcctcggaagctgctcacttccaagctggtgagtataggagaactgataccatgtttatgtcttcctttctagggccagtgggattccagtccaacaacatcgctatggccaagggcatgttcacttccattggtatggccctcaggcccctctacctcaccaccccatcccagagcaggactagcccaggactgcagtctagagtgtaccagacttcagaggagcacagcaggcactagtacagctcgggactcacctccccattcccaccgctacgcccagccccaaatggcttgtcccaccctaattccagctcccctcagcccagaccctctttttgctcttgggagttgtttcccagctgtatattcagacgagatcaggtgcgttcagggtggtatggccgtagacccagctgtatattcagactctggagttgccaaatgctggagtaacaggacagtggcatccagggagatgggagtaccttcaggacccaagtgggtttttagggcttccctgctgggctacagggaagagagagtgagtcagagatgcccctgtgggggatctgaggcctgacagggatgagttgcctctgcttagccaacaaacatctaaccagttgtggggctgccagagtcaacagccaggggacagccagacagccagtccctccagccactcatcagtaggtacaggaagcctgggcttgggccctctcccagcttaatgccaccagcatctctgtgtctcccagaacctggttactataaggatggagaatttgggatccgtctcgaagatgtggctctcgtggtagaagcaaagaccaaggtaaactgccaccaggatgggctggaggtgtgggcagcatgtcagtgactttgggctgcatgggaggaaagtggggaggaagatcaaaggagaagggcatttagtgtgcaggcatgaatttatctggagtcttccttaggaattccataagtcagacttttcaaactcgcttgcacatttgaatcacccagagagctttctggtgctttaaatgcccatgcccaggccccattccagaccaagtgaatcagtatccctgccctatatcattggttctcaatgcacataataatcgccaggggagcttgttagaaataaagattctgtataatagcagccaacaagataaaatacctagatgtaaacttaaaaaggcttacatggagaaactctctactaagggacataaaaaagatttaagtaaatggtgctctctggagagaagcctcaatattatgaagatatcattactctctaaattaatctataaattcaagataacctcaattccagtgctaactggatacttttgtaacttcacaaaatgatagtaaagtttatttgtaaaaataaacatgcgaagatagctaggaaaattctgaaaaagaagagcagggccaggtgcagtgcctcatgcctgtaatcccagcactctgggaggccaaggcaggaggatcgcttgagctcaggagtttgagagcagcctgggcaacatggcaagaccccatctcaacaaaaaatacaaaaaaaaattagctgcacatggtgtcatgcacctgcagtcccagctactcgggaggctgaagtgggaggatggtctaagcctagggaggttgaggctgcagtgagctgtgaccacgccactgcactctagcctcggtaacagagcaaaacccaatctaaaaaaaaagcaataagaaaagccagtcctctcaaatttgaacacaaactaccataactaaaacagtatgacactggagatgaaatagatagctgtaacaatgaaacagaacaatcagtccagaagtaaaccctcttattcccataaacaacatgggaatttagtttacaagaaagctgattttgcaaaaaagtaagaaaaaaatgattattcagcaaatggacagggggaacaaatggctaatcatttggggggattaaactgaataacctccaaaataaaattccagatggaccaaagttttaaggtgagcaatgagaccacaaaagatgtagaggaaaacctatatcaattcatttataatctcagggtggaaaagagtctttctgtgcaagaccagaagccatgaaggaaaagattaataactctgactaaatagaaaatggaagctatgtttatggcattgtgagagggtgagttttcttattttaccatgagctttttacaaatccgtaagacaaaaatagacaaaacaggaaaaaatagggcaaaggacatgaaaaggcaattcactaaaattaacaccaaatggtccacatgcatgtggaaagatgctcaagttcatccttaaagaaatacaagaccgggcgtggtggcttatgcctgtaatcccagcactttggaaggccgaggctggtggatcacctgaggtcaggagttcgagaccagcctgaccaacacggagaaaccccatatctactaaaaatacaaaattagccgggtgtggtggtgcatgcctgtaatcccagctactcatggggctgaggcaggagaatcacttgaacctgggaggcggaggttgcggtgagccaagatcatgccattgtactccaacctgggcaacaagagcaaaactctgtctcaaaaaaaaaaaaaaatacaaatcagggccaggcatggtggctcacacctgtaatcccaacactttgggaggcagaagtcagcggatcacttgaggtcaggagttcaagaccagcctggccaacatggtgaagccccatttctactaaaaatacaaaaattagccaggcgtggtagtgtgtgcctgtaatctcagctactcaggaggctgaggcaagagaatcgcttgaacccgggaggtggaggttgcggtgagccaagatcacaccactgcactccagcctgggcgacagagcgagaatctgtctctaaaaaaagaagaaggaaaagaaagaaaagagaagggaaaaaaaagtctctttcttgctcagtttccttcctgagaacatttcaggcacacacagcgtatgtatctatctatgtatatattttgaaaatacaaacaaaatggattctactgtacatacttttctgcaccttccttccctgccccgctgccccttacttaatagtaaacctaggagagtggtctgcaatagcgcagggagatctacctcattcttttgaagggttgtcgaagagcctatagtatgtggatgtcccatgatttatttaaccaaccgtggatattgaggctgtttccaaatttttactatatttgccatcaatgctacaaatcactgtataaacatcttggtgagcttttgggactatatccagaaggtacatatctggcgtagggatttccaagacaaaaagtacaagcatttttaataggtaatttgatagatattgtcaaactgccctccagaaaggttgcaccaattgtactttctccaacagtgtgtgagagtgcccatttcctcacatactcactagcactgagaatcatcgaagtcactaatttttccaatctgataggtgaaacatggtattctattgttgttttgacttgtatttctttttttctttctttctttcttttttttttttttttttttttgatggagtctccctctttctcccaggctggagtgcagtggcgagatcttggctcactgcaacctccgcctcccaggttcaagtgattctcttgccttagtctcttgagtagctggaattacaggcacacaccaccacgactggctaatttttgtatttttagtagaaacagggtttcaccgtgttggccaggctggtcttgaactcctgacctcaggtgatgcacctgccttggcctcccaaagttctggattacaggcgtgagccaccacacccagccttgaatttctttaaggatgaacttgagcatctttccacatgtatgtgaaccatttggtgttaaattttagtgaattgctttttcatgtcctttgccttattttttcctgttttgcctatttttgtcttatggatttgtaaaagctcatggtaaatatgaaaattcaccctctctctgtgatatgtgctatatttgtcacacaactcttggctttgtttatggcattgtttccataaacattgtttccattttctgtttagtttagtcagagttattaatcttttccttcatagcttctggtcttgcacagaaagactcttttccaccctgagattataaatgaattgatataggttttcctctacatcttttgtggtttcagcctcccgagtagctgggactacaggcgcccaccaccatgcccaactaatttttgtgtttttagtagagagtagagacggggtttcaccatgttggtaatgctggtcttgaactcctgacctcaaatgatccacccacctcagcctcccaaagtgctgggattacaggcgtaagccatccattgcacctggcctctttttttttttttagagacagggtctcactctgttgctgaggctggagtgcagtggcacgatcacagcccgctgcagcttcaacctcctgggctcaggtgatgctcccacccttccacctcagactcccaaataactaggactatagatggacaccaccatgctcagctaatttttgtgtttttttgtagagactggtgtattagtctgttctcacattgctataaagatactacccaagactgggtaatttttaaaggaaagaggtttaattggctcacagttcccacatgcctggggaggccttgggaaacttataatcatggcagaaggcgaaggggaagcaaggatctcgacatggtggcaggaaagagagagctaacaagagcagggaaaactgtcttataaaaccatcagatcagccaggcgtggtgggtcatgcctgtaatcccagcactttgggaagctgaggtgggtggttcacctgagcttaggagttcgagaccagcctagccaacatggtgaaacctcatctctacaaaaaatacaaaaagtatctgggtgtggtggtgcccatcaataatcccagctacttggaaggctgaggtagaaggatcacctgagcccaggaggtagaggctgcagagggccgtcatcgtgtcactgctctccagcttgggtaacagagggagatcctatctcaaaaaaaataaaataaaataattgaaatttagatttctgggccctgccctaaggattctgcctccagtaggtttgggaggtgggccctggaatctgcatatttatcatgctccctaagtgctgttgatgtgcgtactttgaaaaacacaaacctaagtctaaatttccagaatcaggagggaagcaccaaaggtggagcactaagtggcagacaagggggctggccaagagaagggactctagaaggctcaggcctagccagggtgtccagggttgatgaggcccagctccttgtgtcctccgggtggagtgctccttccttcccttcagcccagttcctcctcctccctcactgtcctgcttacccggcttctattctgggctcccagtacccagggagctacctgacctttgaagtggtatcatttgtgccctatgaccggaacctcatcgatgtcagcctgctgtctcccgagcatgtgagtgcccctcagcattgccttctccctgaccctgggcctttcctgcctctgctacctgccaccacatcctctgtccctgcccctcctccaggagggtccacactggtggcacctgcagacacacactggggcattcctccccagctcatcagagaccccagagcttctagaactttccagtcagaccagcctgcccaaccccaggtagtgaataactggaggaatctgagattgggcctctgagctcggccactacaaggcctggaactataagtgatcccttctattcttttgcctcagtctcctcttttgtaagctgaggataagaatgcctgcccagcttactcccattcccgggcctgaaatctacccaccccaccgcccatgaacatcaccatgacatgaaacagccagccaggggaactgcctctgaaaagccccagagaattcctgaagcctgatgatggtgggggacctgtggccatctggactatggtgacagctggagtaccacaacaggggactgggcgtcaccaagacttcacctcttggcagcttggcttagagaggctgtcaccccttctatccttcgcagctccagtacctgaatcgctactaccagaccatccgggagaaggtgggtccagagctgcagaggcgccagctactagaggagttcgagtggcttcaacagcacacagagcccctggccgccagggccccagacaccgcctcctgggcctctgtgttagtggtctccacccttgccatccttggctggagtgtctagaggctccagactctcctgttaaccctccatctagatggggggctcccttgcttagctcccctcaccctgcactgaacataccccaagagcccctgctggcccattgcctagaaacctttgcattcatcctccttctccaagacctatggagaaggtcccaggccccaggaacacagggcttcttggccccagatggcacctccctgcaccccggggttgtataccacaccctgggcccctaatcccaggccccgagataggaaagccagctagtctcttctcttctgtgatctcagtaggcctaacctataacctagcacagactgctacagctgctcccctcccgccaaacaaaaccccaagagagcaatgcccctaccacccaagggtgccatggtcccgggagagcccaaacctatcaccacctgttgggcatagccagagctgttcccacccagccagggcatgaaacatcaaccccccacatgtgaacccatcattcctaaaccctgggtaggctccatgccaagtaacagcagagggagttaagccataggaatttggctgtggagtaagagggaatgcggtgaggcactctggaatatgaccctaccagaggttggagaacaaacttgggcagccggaacccgtcactattctagacttccctggcattcgaggagccctttgaactttccaaagtgcagccacagctacaatgctgttaaatcctcccacattcttggatgccccttcaccttgtgtggacagtgtctggtttctccattttacagacaggaaaactgagcttcagacagggggtgggctttgcctaaggacacacaaatttggttgggagttgatggggccagatgagccagcattccagctctttcacccttcagcaacatgcagagtccctgagcccacctcccagccctctcctcattctctgaacccactgtggtgagaagaatttgctccggccaaattggccgttagccacctgggtccacatcctgctaagacgtttaaaacagcctaacaaagacacttgcctctgggttttgcattgtgtctgctgtgttgccggagactgctgtcacctgtggcttttgtggtgggggaggaagaagagagggtgaggtgggggtggggacatgaggctcctagaagctcagtgggggagcacgtgggcttgagagtatgtgtgtgagcatgcatatgaatatgtgtgcgcatgtgcacagatgcacgtgcacaccacgcccaaccagccaacctccagcctgtctaaaaaggtattgtaaccttgtggaagggacagaaaggagccctacactggggaacttgtcaaatgtaatccagaaaagttggggctggcacctttgccaagcagcgcacagttggtggaaggaaagaaccaaggtgcagggtgccaggcaaaggcaccaggcagagaagtctcctggcctgaaaccatcaggcctagtctgctgagtgtgagggtgacctgtgatggttaccatcaccagtgcttgcatccagaggctccagccctgaccaagccttactgagtatccaaagatgggcctctgtttgctaaataatttgctccctcacctgctcaccccacaaagacaggtactactaataaaattaaagtcatcatcaccctcatcatcatcaccatcatcatcatcatggctgccatttactgagtgtttatgtgccaccgtgcaagaagctttacatgcattttctcatttaatcctcacaacctctgagaaggcccttttcttattcccattttacaagtgcaggaactcagtgaggcccatagagatttatcaagtgactcaaagtcacttttttcattgggtaaatgaaaaaaagccagatttaaaccagtcagaggactctagaatccactctcaagaaagggcaagtcctggccgggtgtggtggctcacccctgtaatcacagcactttgggaggccgaggtgggaggatcacatgaggccaggatttcaagagcagcctgggcaacatggtgaaaccccatctctactgaaaatacaaaaattagctgggtgtggtggcgcacacctatagtcccagctactcgggaggctgatgcaggagaatcgtttgaacccaggaggcggaggttgcagtgagctgagatcgtgccactgcactccagcctgggcaacagagcgagactccatctcaaaaaataataataataataaaataaagaaaaataaagggcaagtggtatggctttcatcattttactgacaagaaaactgaggctcaagcaggagaagcagatccacaccatagtgcctccccagaccctgccagacctttgcctttgcaccctgacacttgctcctggggttctggcaggtcatgggtggcaagaccaggcacctgaccaacaccctcacacaggcctttcggaccgaggcagctcgtgcttttttcctcagtgcgagacccaggactccacctcatctctgaatccccttaactgccccttccagcctaccattctgggaggaagaacccagccctggaacgtggctggaacgagggctcacagtcaccccagctcttccctcccctgggacccagatggccagacttgaccattcctgctttaagggattaactctgggtcaggcagggaaacagggcacatacaccagggctgatacacagggactcttgtgacatcgttaggaatgaaagattgttaggaactgtccccttgggctctagtactttgttttaatgttggaggatggggcttagcaaacctctcctcgcctgctgattgcctggggagccggccatgtggaaaagccccttttcctaggagttaagattctggggtttgagtcccatttgtgccagctgtgtggccttgggcaagtcacttctccctggtcttcagttatcctttctggaatctcccatgctgccttcttggtgaggttacagcgagaggctcatgagacccggatgtggcagcactctaaaccaggaagccac

SEQ ID NO: 12227 - DNA, 156942 bp, Human
  misc_feature (1)...(156942): n = A,T,C or G
agggaaatctgcagctcagctcttttgaaataatgcatgcaaggcctttctcagctacataccttctaatagacacagatactttcaagctacagaattatgtgacaagcacaaaacacactctgaatatgaaaatcaaagactccctttcccaactaaggaagataatctttttataacccagccaggaaatttggtcctatgaaaaacttggaaagaaggatccccagcaggtcaactttccccaaaatggaagggaccttaccaagttctctttagtaccccaactgcagttaaaaattctgggaataaacagctgggtccacttatctcaaattaaacctgtctcttatgaagtcctataggctggcggaacacaagagactgatcctgtttattcccatgagccagtgacctttgactcctgttcagaagaaatgaaagggataggtaacataaagatatagactggcattctacttttgggtataagttggaatcatgcagagagtaacttatttactgagtgagcacagacttcatcctctctacataatcaaacaaactgttgggcatgcagacattttaacagagacccaaaaggaaacctgtgctttgatcaaaaccaaatgttgtgtgtatgcttcagactattcacataatattacccaggctataaaagttttaagcactcatatctctgccatttttatgcactatcagtcaaccacgtatcagcttggttccaacaactgcccacttcttgcagagccttcctgtttagtttacctgggataattttactaattttgctttgctgttgtgaaatatattgtggttttactctttgtgtagaaatgcaagacaagctcactaaatgctttcttgaattggacatttattagtcttccagtaatcacctttttttggaacttgaagttatgaacgaccttcactatacaaacactgtctgactgagtttctctctactctgaatgcaagaggccccaacagttagtcaggaatatcatcgcccctactcagcctgaaaaatttacagaaggtgaatctttgtctctctgcaactcttaggattaaggatcctcttgtaaaacaagggggaaaatatgtcagaagcatttataccagagctactccattttgagagagggctaggaaaatgatgctgagacttgctgggctgcattctcagcaagttagacattcctagcctctagatgtttacgattaagggaacgaattaatgtttactaagcagaaccagacttaggactgtctagatatcccaatatctggagaacagaggcattcctaattttgctttaaagataatatcgagttggcggatgtggtgaatcacgcctgtaatcccagcactttgggaggctgaggcgggtgcatctcctgagatcagaaggccgaaaccagcctggctaacatggagaaatcccgtctctactaaaaatacaaaaattagcgggtgtggtgttgtgcacctgtagtcccagctactctggaggctgaggcagcagaatcgcttaatcccagcaggcgaaagttgcagtgagccgagatcgtgccattgcactccagcctgagaaacaagagcgaaactccgtttcaaaaaaaaaaagtttacattttgaatacattgaaaaaaagagagagcaaagaagagagagaattttcccgtgctctgggattggcctggctcagctcagggaagaaaccttgcctgaaaaggctacaacttaggctgtcaatctttcttctttcagtccaacctctgaccacatcttccatcactcagggcctgagaaggcgggggtcttaaacgttatccaatcagggacgctgtcctgggaactgtccaatcagacacacagctggagggaacagggcggcttccggtatttggtggggcctttgcctctggcttcagtcgttcctcctggtgttgtcctcattcctctgtgtcttctgcttttagaggcccagcctctgtggccctgtgacctgcaggtattggacattcacagctgagacacgaggaccccctggaagcctagaaatggtgaaagtgctgagtccgacatcccgagagaagggacgagcctggttggaaccggtgggaagcggttgatgggactcaggcctctccgcagtcatctccacaatctgcgcccagagttctccttgcccagctcggcctcagtccccttcagccataagatggcggctgcactgacagccgggccccccagacggcctgtctcttccctgcgcagtgaccatgtcctggcctggagccctctctgggcagctctggacccgcagccccgcatctctcccagattgtgcaagtaccatgggaggaaggtcagggcagaatcctgattcggggtgcaggttcacgaatgggaagagctttttgtccgtgggattcccaggccctttttttctattaaaaatttatgggcatcaccacgaaaatattaaataacttaatcaaagggtgattcaaaaattgttgagcagcaccctgctgtagtttgtaatttgcaattcatggaaggcgcttgaaggaaaggtttttataagaaaaccaaattcaataattggcttggtacggttatgtagttttttgtttttgttgttttgttttgattttctattttttgagacaaagtctctctgttactcaggctggagtgcagtggctcaccccaatccccgcctcccaggttcaagcgtttcttctgcctcagcctcgctagtagttgggactacaggcgctcgccaccacatttggccattttttttttttttattttttgtagagacagggtttcaccatgttggtcaggctggtctggaactcctgacctcagatgatccacccacctcggccttccaaagtgctgggattacaggcgtgagccactgcgcccagcatagtttcttaatttttataatcaaggtaaagctggttatgtaatcagcttaattggcagtttatagttggttaagcctgaattttgtttcctccaatgtagttatttaccaataaatgctcttcagtttagattttttttttttttttgaagtagaaatccagggactagagccacctcaatctaatttcctgcctcttactgattttcacactccacaggggactgattttttttctgaatttttcacacgtgtcacaagcagggcctcaagttcactcctcatcacctattcctccagtctgactctggcttgcagtaaaatactaaattttcagtttcgtctgacattcccaaataccaatttcccctccctaattcactttatcaacaatttgtcatttagtatacattttaatacctattttaattaatctttttttttttttaacttttgagatagagccttgctctgttgcccaggctggagtgcagtggcttcatctaggctcactgcagcctccacttcctgggctcaaacgattctgttttttgtttgtttgtttgttttgttttttttttttttttgacacggagtctcgctctgtcgcccaggctggagtgcagtggcgcaatcttggctcactgcaagcttcgcctcccgggttcacgccattctcctgcctcagcctcgcgagtagctgggaccccagctaattttttgtatttttagtagagacggggtttcactgtgttagccaggatggtctcgatctcctgacctcgtgatccgcccacctctgcctcccaaagtgctgggattacaggcatgagccaccgcgcccggcacaattctcttgtctcaatctctcaagtagctggaattacaggcactcgccagcatgcctggctaatttttgtatttttggtagagacgggatttcactatactggccagactggtcttgaacttctggcttcaagaagtccacctgcctctgcctcccaaagagctgggattacagacctgagccactgcccctggctaattaattattttttgacaaagcatttgatggcacatttaaaaagattttttttgtacatatttcctatgagagttaagcaaagaataatctgacactattgtaaaatatctctgtgggttttttttccttctattttccgttgacacagatatcttatcagaatgtttttgggtcaagttttttttttagaaacattatagggtgatgtgttttcagtcacccttccggttttcttggacctggatttcagtattgtatgggaaaaaccacaatacctaccataactatgtctgctagagtctctagtgaatatcagccctggggcttatttgctcatagggcaacctgaggtattgagtgtagcttctcaagtgcacacatggatgccctcaggctaagaggcatttcctggtgtactttttttttttttcaaagttaaccccttgagacattaatattgtcttcatccaacccaactttcatttcttggagactcattgctggtcagccaatcagataccagtattgaggagaaaaataatttctgtgtcctggattcctttaggggacagaaaaatagtacaagaaaaacagtaaaaaaattctagaaaaaaaatcagcactccaaagacaagaaaaccaccaaaccccaaaaagctgactccattgagatggtgtaagaacttgcagagtaaaatgtgcctgaggcactctctgggtcatagttcagagtctcctgagacagggttattgagcacttaagtgtgcagggtggggtggggcaatctctcaagtaacggaatggcctgatgtgacacatgaataagacatatctgtaccttgaaaagatttattcacttaatttacctaaggtttatttatttattttttaagacagagttttcctctgtcacccaggctggagtgaagtggtgccatctctgctcactgaaacctctaaatcccaagttcgggtgatgcttcagcctcccaagtagctgggagtacaggtgttgaccaccactccctgctgggttttgtatatttagtagagtcagagtttcaccatgttagccaggctgatctcaaacttctggcctcaagtgacttacctgcctgggccttccaaagtgctgagattacaggtgttagccactgtgcccagctgtttttttttaattgtatattgcattttagtagtagagcttgaaaggtaagaaaatatttacaaaggacataaaaaaggtgagtcttttttttttttttaattgagacagtttcactcttgttgcccaggcaggagtgcaatggtgccatcttggctcactgcaacctccacctcctgggttcaagtgattctcttgcttcagcctcctgagtagctgggattacaggcatatgctgccaagcccggctaattttttatatttttagtaaagacagggtttctccatgttggtcaggctggtctcgaactcctgacctcagatgattcgccctcctcagcctcccaaagtgctgggattacaggcgtgagccaccgcgcctggcaggtgagtcttaaaaacattaatatctaataatacattttgtttgttgaaaattttcacttacttttttctttctcagagtgagtttagaaattttctcaggtgtgtgtttttatggcagagtgatttcatacagtccatctagcttttagaatggtagctaccaaggaagaaaacaaagaaaaatttctcttcaatttcagctatagacaatgaatacatttccacacacacacacacaaaatgtggttggtaactggttagttacatagattcctgaaaacttcagttccttttgttagcagggtaaatttttgaccgtgaatatctttgttctatatcctgtttttgtgtgtgtgtgtgtttttttttaagatagagtctcacaacgatgcccaggctggagtgcaatctcagctcactgccactttcgcttcccaggttcaagcgattctcctgcctcagcctcctgagtagctggcactacaaacatgtgccaccacacccggctacgttttgtgtttttagcagagatgggttttcaccatgttaggccggtcttgaactcctggcctcaagtgatacatccacctcgacttccgaaagtgctgggattacaggcgtgagccaccatgcctggccctgtatcctgttattttgatttttgagtttattgctaaattttatgtaatgaaaattggtgcctcctataagtgtttccaagtgactaatttttttttttttttgaaacggagttttgctcttgttgcccaaggtggagtgcaatagtgcaatctcagctcactgcagcctctgcctccctggtccaagcgattctcctgcctcagcttcccgagtagattgaattacaggcttccaccaccatgcccggctaatttttgtatttttagtagagatggggatttcaccacattggcccggctggtctcgaactcctgacttcaggtcatccacccacctcagcctcccaaagtgctgaaattacagacgtaagccaccgcacctggctgactaattgtttcctacatgagttttaatacaaataataaaataatacatttattgcctgaaaggaataaatacttttgctattctttgaggtataaagtgtaagcgccttaaaatgttcttccgttacatgaacactgtgtttgagtaattttgctgaatgtttctaacacttagttttagtttcaaaaaccaagttaataactctgatatggaaattaaagcttacgctgcaggagggtgcacatgaacaaaggaaagtaggggttttttattacctctgatgcagctttttcttgttactgtgtcctgcctccgctggctggagttggactgcataatctaaactaaacccatttggctaacttgaaaaatgcaggaatgcagttatacggttgggaaggcaggaagatcagtttcggcggaagtagccattgcgatgggaggggaaattcacagagtcgataatagatttggaatgtgggctccatagataaaaactgggagaaggttgtttaccagggcagggggaacatacagaataagaaagtctggccttgaaaacagggaacagaagggcaaagaaacttaagctagctaaacatttgaagaagaatttcttatactgtgttcaaactctatgcattacacggttaagaaaatgctcatttaaataggttggcatttattacctggaaagttctgaaaaaataccaggagataactgcttattagggtgctaaagaaagaactacttaaaatgactgttaaaaatgttagaacataggccgggcacagtggctcacgcctgtaatcccagcactttgggaggccgaggtgggcggatcacgaggcgaggagatcgagaccatcctggctaacacggtgaaaccccgtctctactaaaaatacaaaaagttagcttggtggccggcgtctgtagtcccagctactcgggaggctgaggcaggagaatgacgtgaacccgggaggcagagctcgcagtgagcccagatcatgccactgcactccagcctgggcgacagaacgagactctgtctcaaaaaaaaaaaaaaaaaaaaaaattgtagaacatggaagatacctgtatcttgtactttccataaaaatgatgttttcttatggttaaattcagacagtaatttagtaggggccatatctcagtagtgatgctgtgtccttctgggtggatcagcacactataaaaagttttcctagtgcagttgatgttaataactcacttaataaactctcttacagagtttttcactatagagttatttttctcttcattaagtatttttatgcagttgatgtgcataaaccatcacatttaatctggcagctgctttttttttttttaaaggttttctttgcatttatctttctttggtaaatgaaattctcatctttgtttacaggccagaaaaactgaaaaaaaacacaggctcttccacttactggatgtttgacaaaatagtattttggtgccaaaccattggcataactggtgagcttggtagagcctagtacctcagactttatttcagatctcctgaaaaaataatctgccttaataagatgtccagtttattgtacacattaaaatttgagtggtaccgtctaactcaacatgtctattttgtctgaaatatataaactatgtctttttcttctgaaaaatatacacaactaattctctattatgtaaatatagcactcaaaaatgtacatgttcgtgatatgccctcaattttacacttttgtcattcagacaagtatcacatatacactgaggttgtggatattatgccactctcttatctcatagttagagaataccttagaaaacgtttgtgtgttgacaattattttattggatagtttcaatcattcttttaagtcagaaccagttctattcactttctgattttaccttgtgtcaaataaaaaattctattcatagccactttgtaaatatgtgtgtttgtgtgtgttttccagggactgttgacatttagggatgtggccatagaattctctctggaggagtggcagtacctggacactgcacagaagaatttatataggaagatgatgttagagaactacataaacctggccttcctgggtgaggataactttaatacaaaattcctcaatataaaataaaaatttcatttctctttgtagaatgttttctggtacttatgctttcatatttctgttatcaagaaaatcctggggagttgtctgtttagaaaaaatttattgaagatgtttcatcttgacctgaactttccacattcctgagctgatctgtgtccttcattttagattagtggtaatttcagaagcttagtggcataaaatattattcacaccttaaaatctatctgcttcaccaattttttattcagcagtggcaggcactgaaattaagaacctacaaaattaaaatattttctaaatatttaaaaatttctgttataaattagtatattgggataaacttattagaataatctattatatcctttttactgagcacattactaagtcggtaattggagaatatgaacaaaattcatgttagctatttttaataaaacaggtattgctttctctaagccagacctgatcacctgtctggagcaaggaaaagagccctggaatatgaagcgacatgagatggtggatgaaaccccaggtaggtgagagtgaatacaacagacgacatggatgagaggtccaaagtcaagaagaaagtaagtctttaaagcgatttgggaagctgtgttcctaaggaaatagtttctgggaagcctgaaattgtttaaaaattacactctcacatagggccatcttctgcttatgcttataaaatctctaagaattctactttcccttcagtgatcttcgttgaagtttacagtgacagccaaagtactgttcatggcatataaaagagtgcacaatctgacttcttgtttttgtggacagatacatatctgcataattttgagatactctgttaaaccattttattttgttttatgttattttattttatttgagaggcacctttgcttttgttgccaaagttggagtgcagtggcgcaatctcagctcactgcaacctctgcctcacaggttcaagtgattctcctgcctcagcttcctgagcagctggggttacaggcacacgccaccacacccggctaatactttgtatttttagtaaagatgaagtttcatcatgttggccaggctggtttcaaactcctgacctcaggcgatctgcccaccttgccttcccaaagtgctgggaacacaggcgtgtgccaccatgcctggcctaaactatttttaagttctctttttgcatcacatctggaattttgatagggagtttattgaatctagagatcactttggataatatggcattttcacaattcttattctttcaatagaaataaaatatttttaaatttatttgtttcctaatttttttattgatatatctttcatttaaaagatttatgagctcttggcctggcttggtggctcactcctgtaattccagcactttgggaggccgaggcgggtggatcatgagatcaggagttcaagaccagtgagatggtgaaaccccgtctctactaaaaatacaaaaattagctgggcatggtggcgggcacctgtaatcccagctactcaggaggctgacgaaggagaattgcttgatcccgggaggtggaggttgcagtgagccgagattatgccactgcactccagcttgggtgacagagcaagactcttgtctcaaaaaaaaaaaaagatttatgagctgcttaattaaatttgttctaaaatggattattttatgctatcataaataagattgttttttcctctgtcagagagtttgttttaagtgtatggaatgattactcagaattgtatgttaattttatattttgctaattaactgagtgtattcattagtttaaacaggtttttatgtactttttattttttatatattaatattacatgatctacaaacaaacgttttacttactgcacttcaacttcaatgactttaaatttttcttttgactatttcttctttcacatgccttcagtgcaatgttaaaatagaagcattgacaataagaaacaatagttttgcattggtgtgtgtaaatttgaaggagcaaacacctcttcaggattttataaactggtttcagaaaggaaaaatctatttttattgggccaccagagtgatagaatgcctctgggtttgtagtgaagaggggttttaggttggttttaagccttctggatttgcacaagaatccatttaagtggtcttgttaaaaggggcttggatagttgtaattctcatttaatttttggacagagtgaatatccttcaggacttaggtgctctgcagggcaaacccaagggcaggtttctgcagtcaggcctgcatatggtgggctttatatcaggatgtggatgagcatggctttcaccaagtacaagagagaattttcccaggtcactttgggtttctacatgggcagaaccggccatgaactgtggctcagggagctggaactgcatcatggaactgcttcagggaccacagtaaaggcaaaggtctgtaggcctactgcatggctataaatgcaggtcttcctccaggcctctggaagggcaagacctcccccagactatggctgggaagagtttgggattgttacagagtaagtttaaaattctcagtggaaccaagttaggtggaacgttttcttgtctgtagccaaaaacagtagtcctgtagtttgccacctgaatgagggcctgtcttctaaacagaattaccttcagtcttgggcttcagcagagtttcacagctcccttcctggatctcagagctcttttaaaggcacttatttttgaaatgggggtcttcctacataacccagaaaggtcttaatattttgactgcaggcaattctcctactttattttgccacgtagttgtcattacaggtgtgaaccatgatgcctggttctctcataaaggcgtttttatcaggaatggctgacaaattttcttgctttcaggggataagcaagtagggcacctttttaaaaaaatcttattaatgtcactctccatatacatttttactttctattttctacttcaaatttgtctgtaattttagattcagaaatttagggtactatactagaatttacatgttgtgcctgaattaaattagataattagtgtgcaggcagacaaaaaggaattatagaattttcaacaaatttatcagcctatatctaaataataacataatttattccccaaatattcattttatataggaggctctgaccatatgtgtatatatatacatatatatgtgtatatatatataaaagcagtgtaaggattttctttgcttctaaacttggattacagtagttatattttgtttaaaaatagcgtatatttaaaacgtaaaaattggcactagtttttttaaatgcttaaatctattaaaagtttctcattagcatctcccatttatgattgttctgcattttctctgaaattttattgccataaaatggatgccagtaatttcaaatgcctgccttccatgaatgcacagttacagtcaaacattgcagttatctagacaaattatttgttaatgtacattaatgttgccaactagattttatgactaagcatttctgttattattgtcttgcagttgtacttgcagttagtgtgctttttagtgtaagtttgttaacatcagtttattgtgtctattgctattatttaagtattataattttagacaattagcagttgtttgtatactttaagttaatgtaagttttaattaaaagataaatgagccatgtgtatcacaatcaaattatatatatgtgtgtgtttttatctgcaaatatgaccccaattttggctataccttatcttgtatacattcatacattcttagctcattttctttcttttttttttttggaaatggagttttgctcttgttgctgagcctggagtgcaatgcaggatctcgtctcactgcaacctccgcctccctggttcaagtgattctcctgcctcaggctccttagtagctgggattacaggtatatgccaccacacccagatacttttgtatttttttttttttttagtaaagatgggctttctccatgtttgtcatgctggtctggaatttctgatctcagatgatctgcccacgttggccaccaaaaatgctgggattacaggcatgagccaccttgccctgcctcttagctcattttcaatgttggttttatcttttctaagtgagtggccttggaaatagtcttattttcaccatgtgtttaatgatgaatatgtatttcctttgtgtgagagaaacacttttgtgatccgaaggtaatttttaaaaagatttataattctgtattttttccagttttaaaaaaaaaaatgttgtaaaaacacataacataatttaccttcttaaatctatttaaatgtacatgtcagggccaggcatggtggtggctcacatctgtaaaaccaggattttgagaggcaaggacagggggatttcttgaacccaaaagtttgagaccagcctcggcaaaatatggagacaccctctctaataatattttttttctaagaaatagctaggcacggtggtgtgcacctgtggtcccagctacttgagagattgaggggcaggattacttgaccctgggaatctgaggctgcagtgagccataattgcgccattgcacacaatcttgggtgacagattgagacccagtctgaaaacaaaaacaaaaacaaaatgtatattttaggcatgtcatgtatattcacattgttatgcaaaagacttcttgaaattttacatcttgtaaaactaaaactcagtatcattaaataacgtttatccattttacactctctccatcccttgagaaccgcccttccacactctgtttttatgaatgagactattttatatgtcttaaataagtgaaatcataacatccatcatttcattatggcttatttcagttgacataatattctcagagtgtatctttaaatgtgagaagatttttttttaaggctgaataatatttcattgtatcgaacatgtcttcaaggtcctatgttgcatattttagatatagattcataaatggaattgctgtatttgataatttatttttaattatttgaagtacatttataacgttataaaataatgggtgcatccttattttccaccgacaatcaacccaactaactttgtatttttagcagtgatggggtttcaccatgttggtgaggctggtcttgaactcctgactcatgatttgcccgcctcggcctcccaaagtgctgggattacaggcttgagccaccacgcgcggccaagggtttcatttttattgcatcatcgacaggtttggtgtttttaaaaaattgatagtggccatttaaatgagtgtgaggggattttgtttttcattcattgtgatttttatgcatttctctacaaattagttttgtgtgtcctttcaaatgttttgatgaaaatttatttcaattattggcctatttctaaataaagttattcaactttattgttttgtttgtttgttttgagatggagtattgctctgtcgcctaggctgtaacctccacctcccggtttcaagtgattctcccacctcagtcacctgagtagctgggataacaggcgcatgccaccacacctggctaacttttgtatttttagtagagatggagttttgccatgttgatcaggctggtcttgaacacctgacctcgtgatctgcctgcctcggcctttcaaagcgctgggattacagatgtgagccaccgcacctggctattgttcggttttaaaagttgtttatattttttgaatattgactcctatcacatatgatttgtaaatattttcacccattttctaggaggcattatccccctattaaatatttatctgtatttatatgtgcagaaatggtgaagtcattatttctttataaattatccactctcaagtattcctctatatgcaaaataatacagtctataatgttgtctaggttttctgttttttaattgatttttctatgtgagttttctatgatggaaaatggggtcttgatgtctacaattattatgttgctatgtattttttgctttacttttgttaatatttgctttatatattttggagcctgatgttatatatacacatacataaagaaaggaaagaaagaaacaaagaaagaaagaaagaaagaaaaagaaagaaaaagaaggaaagaaggaaagaagaaaagaaagaaagaatagttatagatttgtggtaaatcaattcattttactaatatatactatcaatgtttgtctcacgttagcacttgacttaaaggatattatgtctaatacccaattgtagttactattttcataaaataaatttttttttcaccatgtggttttcagcctatttaactcagtgctaaaatgagtcccttgtaggtggctttttcttaagccactaaggcattttattttttctttttataatttcatttaattacttgtttattcatttatttttgagataggtctcactctcaaccaggctggtttgcagtgttgtgatcatggctcacagaagcctcaacctcccaaactcagaagattctgtcatttcagcctctcaggtagttgtgtgtagcctctcaggtagtgtgtagcatcacacccagctaggttttttgtatgtatggttgagacaaagttttgccacattgccgaggctggtctcaaacttctgagatccagtaattagcccaccttaacctccgaaagtcctgagattacatttctttctattaagtagtttaattaatttatatttaaaattatttattaaaatgaagttattagttttattgttattgttttatgtattcctcagtgggttttttaatatattgttttattgccttaaattttattttaattgtgtagtgacgtgcttcaattattttttacattttgttttgcatagtttctataaatattgtcttcataaccatcttgtgtattagtctgttttcatgctggtgataaagatataacccgagactgggcaatttacaacagaaagaggtttattggacttacagtttcatatgactggggagaccttacaatcatgctggaaggtgaaaggcatgtctcacctggttggcagacaagaaagagagcttgtggaggaaaactctgccttataaagccatcagatttcatgagacttatttactgtcgtgagatcagcacagaaaagacctgcccccatgattcaattaccttccaccactttcctcccacaacatgtgggaattaaagatgagacttgagttgggacatggccaaaccatatcatcttaaaaaatggagtttacatgaaacatcttaaaattaaaacaatatatttaaatctcatgacaacttaaattgaatataaaaattttacctctatatttttcagtttgttattaatattaaaaattattttatattgtatattaacatttatgccggtttttctgttttaaatactctacagaatagctttaagacttgtatacatcatcattatgatagtaaagagttctatatttgtatatttgcatttaatagagcgctctgttttatgtatggttttatgatgctgtccagtattttatttttaaacaaaattgactcattttagcatttttttggttatatgcagagtctccctggattactcagcgtgatctgaaactcctggtctctagtgttctgacagccttggcctcctaaaactataagattacagtcatgagcccacagtgcctgcccccatgtagcattttttcataaaactgtgctagtggtgatgaacaccctcatcctttatcttggatttttttattttcatcttctttttaaagtaaaataaatttaaatcaaatattattggttagaattttttcttttattacgtcaaaatgtggaaagttctcacccttttttatcttcaagtaacctctattatttttttctcatattcttcttccttaatgaatatattgatctagttgatggtatctaataagttttacattccatgttttaattttattttgcaattttatatttttgtatataaaatatatatatgtatttgagggtatgtcacaacacatctgttaattgtgttttgattttttagtatatattctaattgtgcatgccaatatttaactttgtacaatttaagacattgtggagcaaaatcatatatgaattagccatatgtcttttccaatagaattatctctatttgcctggaaaaatgttatccttgtttttttttataacttgtatatttgttgtgaaggtttgttgtgaatagttttttaatcctgtgtagatgagaagtcatgaaattcttgtaatttcaacatcctattaatttgtgaatatatgtgatttttgcatgggagaaacacatttggttttgaatataatttaaaactatcataactatgtatcttttaggtattattgtttatttttacttgtcaataaaacataacaaaatttaccacaaaatatttttaaatattcagtttatcgtgacattgtcatggaacatattgctaaaacatttttatcttgtaaagctaaatcttaatacatattaaacaactactaatttttccattgtctaccaaattttccagagtcttgctctgtcacccatactggagagcagtggcacgatctcagctcactgcaacgtccaccttccaggttcaagcaattttagtgcctcagcttcctgagtagctgggattacaggtgccaactgccatgcctggctaatttttgcatttttagtagacgtagttttgctatgttggccaggctggtttcaaactcctgagcttaggtgatccacctgccttggcctcccaaagtgctgaaattacaggtgtgagccaccatgcctggccccagttttttctgttttatggcacttttcaaatatcactctgttctttgtttctaaaagtgtaactccttcatatatctcatacagtctctttttgtggctgactcatttcattttgcataatgcaatcaagatttatatttatagttggcagaatatttccttctttttgaatactgagtgatattccagaattttttttcgtttttctatttcattttttagatggagtttcccccttgttgcccaggctgtagtgtaatggcatgatcttggctcaccgcaacctctgcctcccaggttcaagcgattctactgcctcatccccccaagtacctgggattacaagcatgtgtctcgacgcctcgctaattttgtattattagtagagactaggtttctccatgttggtcaggctggtcttgaactctcagtctcaggtaatcagcccgcctcaccctctcaaagtgctgggattacaggcttgagccaccacacctggcctcacaatttttatatttcaaattacatctgctgaatgatttggtgaaagaaatttgggttgctttcacctgttggcttacagtaacaatgctgcaataattatgagtatgtaaatgactccttatatgaccatatatgtgaaagtttatatgtgtgctgcattctattttatgtctacttttttacctttatactaatagcaaatcattttaattctgtagctttgtaatgtattttgaattaagaacttaaatgcctccagcatttttttcttttttttgaagattgttgggcactttatagtctcttgggattctatatacttttggggttgttgtttctatttcttcaaaaatgcaatgagaaatttggaaaacattgcattaaatatgtaaattgcattgagcacaatggacctcttcacaatttaactatttcaacttttgtgtaagagcacacttaagagtgttttgtttaatttctgtgtatttgtaaatttttcatttttgttctcatcatagtatactctcatatcattttggtcatagaaagtagttcatggaattttacctttaaaaatgttggtaagacttcctttgtggcctaagatgtggtctatcaaggaaaatgttatatgagctattgagaagggtatgtattctgatgttgttgaggaatgttctccatcactctgttcggaataattgttttatactgcctttaagtagtctattcccttattaacattcttgttttatttttgttacagaaagtgtggtattaaaatatctttctataataatactgctttctttgtgtttcttccattctgtcaatattggctttatatatttggaacactaatgtgagacacatacacacacacacactcacacacacacagagaaatttgtaataggttcccagttaatgaatcgattattttttgatgttcttctttgtttctttggagttttaatttcaagtacattttataaaatattatactttttgacttaagatggagcttgtgtatgattattttgactgtttatgctgtcctctgattaatgtttgcatggaatgtctacttccagtcttttttaaccattaaatttcttttctgagatggagttttgttctttcacccaggtgggagtgcagtggcatgatctcggctcactgcaacctttgcctcctgggttcaagtgattctcctgccttagccttctgagtagctgggactacaagcatctgccaccacgcctggctaatttttgcatttttagtagagacggggtttcaccatgttggccagggtggtctcaatctcttgaccttgtgatccacctgcctcggcctcccgaagtgctgggattactggcatgaaccacagcacccaacctcttttgtgtatttatacgaatatgtttgtggtactttggggattacatataacctctgaaaaatacaacaatatattttaatctggtaaaaaaataagttgcatacaaaaattctttttcatcttccctcaagtttcattgacattgctagttatgtctttttgtgttgtatattcattaacagatatttataattatttctatacttttttctttcaaatttcagagaataattagaaatgttttttgcaccactaggataatgctcagaaattctaattttgtttatttgtgtatgttttccagaaaattatttttgtatgattatgtggtgtttttttgaatcatgttattttcagtaaaatattttcagcaccctttatatgtaggacataagcagtaccaatatacttttttaaaacttgtttattttggaaagtttctatatttttatttggcagaacagattcactgatggtattattctcacttaatagctgctttttctcacaacttttttatgactacatcacacagttcccttatggcctgcaaaatttttgttaactcttcacagattatctcgtaagactgtgtttgtaaatggcacatcactgtttccttttaatttttattttttggagacagagcctcactctatcctcccgacatgctggagtgtactggtgcaacctcagctaactgcaacctccacctcccaggttcaagcgattctccagcctcagcctcctgagtagctaggattacaggcacacacttccacacccagctaaattttgtagttttagtagagatggggattcgccatgctggccaggctgccctttctaaaggcattatgttacagtgagaagcaggaaaagctgtgttgggtaaatttatcagacttctctttttcttctatgtggtttttcacattgtgctcatctgggacactgcacacaactcatttataaattttccacagatgtattttggtctctatatttttgttacatttgtatgtctgtgaaagaattagggcctgtggtattttgcaaagccattttatttatgtagatggtataaatttataggtaagatttttaaactatattcatgtgagtctagtaagtggagtaatttataaaaattttttttcaggtatacattctcatgttgctcaagacctttggccagaacagggtatggaagattcttttcaaaaagtaataccaagaagatatgaaaaatgtggacatcagaatttacagttaagaaaaggctcaaagtgtggatgagcttaaggtgcacaaagaaggttataatggacttaacctgtgttacacaactacccagagcaaagtatttcaatgcggtaaatgtttgaaagtcttttataaatttgtaaattcaaacagacataagacacactggaaggaaacctttcaaatgtaaaaaaatgtgtcaaatcattttgcatgctttcacacaaaacccagcataaaagcatttatactacagagaagtcctacaaatgtaaagaacgtggaaaaatctttaattggtcttcaacccttactaatcataagaaaattcatactgaagaaaaaccctacaaatgtgaagaatatagaaaagcttttagtctatcctcaaatcttactacacataagataattcatattggagagaaaccttataagtgtgaagaatgtggcaaaacgtttaacaaatccttaaccctaaccatatataagaggatgcacactgaagagaaactctacaaatgtaaagaatgtggcaaagcatatgtatggtcctcaaacctaactaaacataagaggatgcacgctggagagaaaccctacaaatgtgaagaatgtggcaaagcttttagccaatcctcaacccttactacacataagataattcgtactggagagaaacgctacaaatgtgaagaatgtggcaaagcatatgtatggtcctcaaccctaactaaacataagagaatgcacactgcagagaaaccctataaatgcgaagtatgtggcaaaacttttcatcgattctcaaatcttagtgcacataagataatccatactggagagaaaccttacaagtgtgaagaatgtggcaaagcatttatatggtcctcaacccttactgaatataagaaaattcatactagagagaaaccctacaaatgtgaagaatgtggcaaagcatttagccgatcttcaaccctaactatacataagaggatgcatactagagagaaactctacaaatgtgaagagtatggcaaagcttttagacaatcctcaacccttactgcacataagatgattcatactggagagaaaccctacaaatgtgaagaatgtggcaaagcctttaactcgtcctcaactcttactaaacataagataatccatactgaagagaaaccctacaaatgtgaaaaatgtggcaaaagctttaaccagtcttcaatccttactaaccataagataattcatactggagagaaaccttacaagtgtgaagaatgtggcaaagcttttaatcgttactcaaatcttacgaaacatacaattgttcatactggagagaaaccctaccaatgtgaagaatgtggcaaagcctttaaatggtcctcaaatctaactaaacataagataattcatactgaagagaaaccctacaaatgtgaagaatgtggcaaaacctttaaccagtcttcaattcttactaaccataagaaaattcatactgtagagaaaccctgataatatgaataatgtggcaaatcttttaacttatcttcaacttttaataaacattgaggtagtttatactggagtaaaaccctacaaatgtgaagaatgtgggaaagcctttttctcatcctcatccctaactacacataagaaaattcatactggacagcaaccctacaaatggaaaaaatttggcaaagcctttaaccagtcctcacttattactacagataagtcatattggagaaaaatcttacaagtgttaataatatggaaagcctaaaaaagtcctcaattcttaacagacataagattattcatattggagagaaactctacaaacctgaaagaaaagacaatgcttttgacaacacctcaaacttttctaaacataaaaacatgttgccaacaaattctagaaatgtgaagaatgtgacaaagcctttaaatgattgtcacacttgattatagataagataattcatgctgagaaaattgacggtgtgaacaatgtggccaagcttctaaccaatgctcacatcttattgcactgtaaagcatttatacttgagaaccaatgtacaaatattgacaaaaaagccattaatacctgctcaaatcttactcaaaatcagaattcatactaaataaaagcattaaaagtttaattactatcaaaagatctatcagaaaatatgtctataaagtgcagaagagtatttattttgaaaaagcattaccaatatgaagagggttgtaatatctttgcttgtatcacagatcgtattgtacacattttgtactagaggaaaatcttgaggcagttgttaaaattttgttcaacatcaaggagtttatactgaagaaaaccctgccaatgtaataaatttggaaaaacatttttttcaaaaactgcaaattataaaacaccaaagagtttatactaaaatgtatttttgcagatgcattaaatatgaaagatgttcagtccaaagttagttagttctatgtaactatcagggaatcattcacagtagaaatatctaggacactcaaactttagacattatactaaatcagaatgctgagtataaaaaatacagactaaagttcatataaacattatttgtatataactttaaaaaaaaattttggagagatgtaattacactcaaagtatactttttgtgaaaatatggaatttttaaaaagtgaataataatggaattaatgtcttaaattacttcatgctgtttcatcattcctggtgtattcacatgtgaaaatatgtgactaaacattgctgaataaaagatacgaaagattcttttttttaggtaggtgttatttatgaccttttctatggaagggtaaggacattataatgtaggattcatgatgaaaatttaagtagagaggctctttgtggttaacttataacattgagtgatgtatgaggtaggtgttcagagtaatctgcattattaggaaagaaaaacttttaaattttgtttaagttagtatgttatcttattaattgtacttttatggaataatattaattatacttttaaattataaattttatgtcaactttccatttaaacatttttaacagtttaaatactatcatgaattcattgaagtgttatgccactaactttagcctattacaccttactcaagggtgtaggtaaaagatggtaacaatatattatttggtaagataatggactgaaatctctagtaatcttttttgccagtggctttaaattgtcaataagttacagaatattgttcctataggtgaaacttttattcttattttcacgtttaaatttatttttcttaatttttgtggatacataatatgtgtatatgcatatgccatatatggcatattttgatacaggcatgcaatatgtaatcatattagaggaaaatagttatccattacctgtagcatttattctttgtattacaagcaattcatttcttcaaataactaactagttttagttatttttaaatgtacaattaaattgttattgactgcaggatcacttttatggtcataatgaaaattatgtagaaacataagtaaaatgtggcctctgcttgcatgcacatatggactgttagtattgatttacagagttaaatatacatctattagtctaaagataaatcttaggtgtaaataaattttggagtaaatgtatttgtgttattgtaagtttgaaactatttttagcagaaaaaagcaattttggagcaaaataaatcattttaagaaggtgtctaatttactagaaagaaattctcaaaaatgctgaaagcaaatctattctgtctgctttgtattgaatttattactgtataatccttggcttatgcttcagaatctccccatgaaaattctctgttttaagttgactattactcatgttagacccataatttttgtttgtttgtttgtttaatagtttttttttgttttttttttgagacggagtcttgctgtatagcccaggcgggagtgcaatggtgctatcttggctcactgcaaccttggcatgacattttcaagcaattcttctacctcagcctcccaagtacctgggattacaggtgcctgccaccatgcccaactaagtttcatatttttagtagagacagggttggtcaagctggtctcaaactactgacctcaggtgattcacccaccttggcctcccaaagtgctgggattacaggcatgagccactgtgcccagcctgtgtaatagtttatgaagtattcattatgtgagctagtctgtaattataagaataattttttttaaaatctcattgttccataatttaatggggtacaggtgatacttggttggatgagtaagttctttagtgatttgtgagatcctgatagacccatcagctgaccagtatacactgcaccatatatgttgtcttctatccctcctttttcccactcttccccccaagtccccaaagtctattgtatcattcttatgcctttgtgtcctcatagcttacctcccacatatcagcgaggacacacagcgttcggttttccattcctcagttacttcacttagaataatagtctctaatctcatccaggtcattgcaaatgctgttaattcattcctttttgtggttgagtagtatcccaacatatatatatatacacacatatatacacacacatatacacaccacaccttctttatctactcgttgattgatgggcattttgtttggttccacgattttgaaattgtgaattgtgctcctagaaacatgaatgtttaagtatgtttttctataatcagtatttgggtttatttttgggttctctgtttcattgttctatgtttcaaataatgacttcttttcctgtgggtagatacccagtggtgggattaaatggtagttctacttttagttctttaaggaatctctacactcttttctatagtggctgtactagtttacattcccaccagcagtgtagaagtgtttcctgattgcttcatccatgccaacatctacagtttattgatcttttgattatggccattcttgcaggaataagatggtattacattgtggttttgatttgcatttccctgatcattagtgatgttgagcttttttaaatctatgtttgttggccatttgtatatcttcttttgagagttgtctaatcaagagcccacttttttatgggaattttttttttactgagttgtttgagttcattgtagattctggatattagtcctttgtcagatgtatagattgttaagattttctcccacactgtgagttgtctgtttgctctgctgactgttccttttgccgtgaaaagctctttaatttaattaggtcttagctatttatctttgtttttactgcatttgcttttggatttttgtcatgaaatttttgcctagccaatgcctagaagggtttttccaatgttatcttccaaaatttatacagtttcaggtcttaggtttaagttcttaagtcatcttgagttgatttttgtataaggtgagagatgaggatccagttttattctcctacatgtggctagccaattattccagcaccatttgttgaaaagggtgttctttccccactttatgtttttgtttgctttgttgaagatcagttggctgcaactatttgggtttatttctgggttctctgttccattggtctatgtgcctgtttttataccagtactatgctgttttggtgactatggccttacagtatagtttgaaatcaggtagtgtggtgccttcatttttttttttttttttttttttttgcttagccttcctttgtctatgtgggctccatatgaatgttagaattgttttttccaactctgtttttctaactcaccatcttcagaatgatggtggtattttgatggggattgtgttgaatttgtagattgcttttggcagtatggtcattttcacaatattgattctactcatccatgagcatgggatgtgtttccatttgtgtcatctattatttctttcaacagtgctttgtagttttccttgtagaggtcttttgagtccttcattaggtgtgttcctaagtattttatttttgttgagttattgtaaaaggggttgagttcttgatttaattctccgtttggttgctgttggtgaacaaaagggctacttatttgtgtaggttaatcttgtatccagaaactttgctgaattattttatcagttctaggagctttctgcaggagtccttagggttttcaaggtaaatgattatatcatcagcaaacagaggcagtttgaccttttgtttactgatttggatgccctttattttctgtcttattgctttggctaggacttccaggattgtgttgaagaggagtagtgagagtgggcatccttgtcttgttcccgttctcagagggaatgctttcaacttttccccattcagtattatgttggctgtgggtttgtcatagatagcttttattatatcaagctgtgtcccttgtgtgccaactttgctgagagttttaatcataaaagatgctggattttgtcaaatgctttttctgaatctattgagatgatcttgtgattttagttttaaattctatttatgtggtgtatcacattgttttacctgtgtgtgttaaaccatccctgcatcctggtatgcaatccacttgatcacagtgaattatctttttgacatgttgttggatttaattagctaattttttgttaaggattttagcatcaatgtttatcaatgatattggtctgtagttttctttttaggttgtgtcttttcctggtttgggtattagggtgatgctggcttcataggatgaattagagagatttccttctttctctgtattagtactgattctttgaatatctggtacaattctgttgcgaacctctctggtcctggacttttttttgttggtgatttttaaattaccattttaatctccctgcttgttattggtctgttcagggtatgtaattcctcctgatttaagctaggagagttgtatttttccaggaatttaagtatctcttctaggttttctagttcttttgtaaaggtgtttatactagccttcaatgatttttttgtgtttcagtggtgtcagttataatatctcctgtttcatttctcagtgaggttatttggattttctctttttttctttcttagtcttgctaatggtctatcaattttatgtatttttcctaaggagaagctttttgtctcattcatttaccttttgtatttttttttgtttcaatttcatttagttcttttctgatcttggttatttcctttttttctgctgggtttgggtttggtttgttcttgtttctcttttctctagtttcttgaggtatgaccttagattgtctgtttctgctctttcagactttctgatgtaggcacttagggctatgaactttcctcttagcaccacctttcctgtatcccagaggttttgaaaggctgtgtcattattgtcactcagttagaaaagtttttaatttccatattgattttgtttttgccccagtgctcattcaggagcaggttactgaatttccatgtttttgcatggttttgaaagtttctttgtgtgttgatttccagttttattccactgtagtctgagagagtgcttgaaataatttcaattttcttaaatttattgaggcttgtcttatggcctatcatatgatctatcttggagaaagttccatgcgctattgagcagaatgtgtgttccatggttgttggatgaaatgttttgtgtatatctgttagtccattttttccaaggtgtagttaaattcattgtttctttgttgactttctgtcttgatgacctgtgtagtgctgtcagtggagtattgaagtcccccactattatgatgttggtgtctatctcatttcttctgtctattagtaattgttctataaattttggagctccagtgtgatgtttgtatatttaggattgcatatatgtttaggattgtgatgttttcctgttgggtcaggccatttaccgttatataatgtccttctttgtctcttttaaccacagttgctttaaagtttgttttgtctgatataagcatagctacccctgcttacatttggtgtccatctgcatgaaatgcctttttacacccctttactttatttgagtctttatgttaggtgagtctcctgaagatggcagatagttggtgagttcttatccattctgccgttctgtgtcttttaagtggagcatttaggtcatttacattcaatgttagtattgaaatatgaggtaccattgcattcatcatgatctttgttggctgcatactttggtgttttgttgttgctgttgttgttgttgttgttttggaatggagtctgctctgtcacccatggtggagtgcagtggctcgatcttggctcactgcaacatccgtcttccaggttcaagtgattctcctgcctcagcctcctgagtagctggtactacaggtgctcaccactacaccgggctaatttttgtatatttagtacagacagggtgtcaccatatcagatagggtggtctcgaactcctgaccttgtgatccacccacctcagtctctcaaagtgcttactggaattacaggtgtgagccactgcatcgggtatttttttttaacttgtatttttattttataagtcttgtttgatttatgctttaaagagtttctgggctgggcacagtgactcactcctataatgccagcactttgggaggctaaggcgggtggatcacctggggtcaggagtttgagaccaacctgatcaacatggagatacccccttctctactaaaaatacaactgtttctttccttcatatatgatgcttagtttcattggatgcaaaattcttggcacataattgttttgtttgaggaggctgaagatggggccccaatcccttctagtttgtatggtttctcctaagtagtctgctgttaatctggtaggttttcctttataggttacctggtgcttctgtctcacaactcttaagattctttcctttgtctttactttggataagctgatgacagtgtgcttaggcgaagatctctttgcaatgaattttccaggtgttctttgtgcttcttgtatttgcatgtctaggtccctagcaaggccagagaagttttccttgattattccctcaaatatatttttcaagcttttagaattgtcttcttcctcaggaacacaaattattcttaggtttggtcatttaacataattccagacttcttggaggctttgttcatattttcttattattttttatttgtctttgttgaatttggttaattcaaatatcttgtctttgaactctgaatttctttcttctacttgttactgctgagactttccagagcatttcgtatttctaaaagtctgtgcaaagttgcctgaatttttgatttttttttctttaagctatatattttgttgaatatttcttccttcacttctcatatgattttttttttattttgttgcattgggcttcacctttctcttgtctctccatcattagcttaagaactaacctcctgaattctttttttagataaatcagggatttcttcttggtttggatccattgccagtgagctagtgtgattttttttttttgtggggtgttgacaaacctccttttgtcatacaacctggtttgcttttctggttccttctcatttgggtagtccctttcagagggaaggtctagagctgaaaactgttgttcagattttttttttttatccctcagggtgttcccttgatgtagtactctcccccttttcctgtggatgtggtttcctgtgagctgaactacagtgattggttgtctctcttctggatctagccacccaatgagtcttcccagctccagactgatacttggggttgtctgcacagagtcctgtgatgtgaagtgtttatgagtctctcagccatggataccagtgcctgttctggtggaggtggctaagggtgcaatggactccatgggtgtccttagctttggtggtttaatgctttatttttgtgctggtagacctcctgccaggagatagtgctttccagaaagcatcagctgtagtactgttgaaagggactagcagtgggtgggaacccaggactcccaagattatatgtcctttttcttctgctaccatggtgtttagggaaagaccaatgggtgcggggggtgctaggcatgcctgagttcagagtctccttgggtggttgttgctgaagctgctgtggcagatgggggtgagattcccaggtcactggagttgtgtacctaggaggattatggctgtctttgctgagtcatgcagggtgtcagggaagtgggggaaagctggcagtcacaggccttactcagctcccatgcaaacgaaagggctggtctcactctcactgtgcccttcataacagacctgagtctgtttccaggtggagggcgagttgggcttgaaaatttccccaggctttctgtctcccagctgcgggaaaaaaaagggctttagttcttccatgcctgtgaagtcttcaagccggattcatgccttcccccaagttctggccataagtcttcttgccccattcaaattgttacaaagttcagctagggaagtccttctccccttggaagttttaccccctgctcctctgtcctccccttgatggatccctgtggtgctaggcaggaatgggctccttggggattcagcgagctcccagggcctctttgttgcctcctacacccctgtatttcactcagcttggctctctaacttgacgcagctccaggtagttagaaacttctcccacaaacagactttcagcttctccagtggggttgtgtgtttaggagaggaggatctccctttcccacttctgcagttgtggcactcacagtatttggggtgtctccagggtcctgcaggagcagtctgcttccttcagagagtctgtcctgatgcctttaaagacacagtctcaagatgaaatggtgatttgttcagataatctctcctgagaaggaatcagagaagagaggaagaaatggttgattgtcaggtaagtgtgtcccaggtcaaaattctgtccacattttcttctagaatgtcatgtatttagaattgcaataatttacatttctacttctgatgcttttgcctaacaagattatttgaactacatttctcttgtcttctcgtgacagtgaaaggacctcattaaaataattcacttctatatatcagaaccttatctttattctctccatccaggcttcttacatatcacaactaataccttgaatttataccctgaaatattgagagtattccctttgttgacagatcagcctgggcaggtggggatataaaacattcttattggggatggtgctgggtcctcagatatcagtgagggagaaaaccgcaccttttgggttccatcggagggctccatcagctctatgaagaacataatttttaaatgcacactttaaaaggatgaaattaatagcctggaataatttagaaagatatttaaaggaatgaattcaaagaaatttgccttctagaatgctaaaagagtttttagatacactactagaaattacaaaacatgggcaacatatgtggcttgaactttacataaaacacatttttcatgattagattcagattataatttatgttttttggccagtagtctcacagagtcatgttgcatcctcctatatgtatcagcacctgataccaatctgtcccattaattttattaacttggttaacgtgttttctgaagaatttcttcactataatgtttctttttaaaaactgtattattaataggtattttggagaggtgactaatgtgcataaacaatcacatttactctgaaagctcccctatcatgccaagtgtcaggttccagcctaatctgaggtctaacaggagtgggtgggtgagtggtgggttgctggaaaaacaatcaaggaactatgggaatttttgagatggcttttttttctctctaggcacaagcctgagcacgagccctgtgtacagggtgagcagctttactctccctctccctcctgtccacctgtctgtgtactcttttcactcaatagtggatcagagccaagtatgagcttatacaaccaggttacataataagtagaatggtgcacctgcactctaaactaactgagtcatgctgaaccagacgtttaccatggcctatttttgaccacagaacatccatttttcttacactctttttcttaatagtttctctttgtttatacattgctttggaaaatgaaggctgtcatctttgtttactggtcatatacatggggaaaaaacccaggttctatcacttactagatgttttacagagtatttttcttaagctagaatcattgacatcattggtgagtttgttagcaatacagtaactcaggtctcatcccagatctcttgaattagaatacgtattttaacaaaatctccagtttattaatgtatgcattaaaattcgagaggtaacttctaacttactgtgacttctccatatgagaactgtacacaccttactctgtataatgtatatatggcactcaaaactgtaaatgcttgtgtttttgccataaatattatgctgtgtcattcagaaaactataatacatacactggttttgtggatcttgtttcatcctctttcctcagaatgaaggaatacattagagaatctttctctattgaacaatattttattggataatgccagtctcttatgtgaaacagagccagttctcttaactctcaaacacttagagtaaaattaataattctgcctatgaccacttgctaagtatgtgtgggtctttgggtttattttaggaaatgttaactttcaaggctgtggccatagaattctctcaggaggtgtggaatgtctgaatactgctcagtgaaatttgttcagagatgcagtgttagagaactgccgaaaactggtctctcggtgtcaatacattttccccaggttttctaatacaccctaaggcttctattttctccctttgtagaatgattttggcagtttttcctctgcacaaattatttttagatcaacacttttaaggaaaacttgaaggtttactggaacagaaaagaaaatcttcaagatgttttaacaggaaacttcccctttcttgagctaatctgtattcttcactctagattaatggtcattctagaaattcagtggcattaaatattcttgcccaaatattaaaattcaatatccagcaccaattttaaattcaataatattgaatagtagagctaaggacccagaaatgtaaaatatgttctaaatattcaaaagtttctgtcagaaaacagtattttggaattaaatttctagaatctttcatattttctcctctctactgaacatggtacaaggttggtaactgtagaatctcagcaagttatgttacttttttctaacaaaacaggccttgctgtctctaaacctgatcgcatctcctgccttgagcaaataaaagacccctggaatgtgaagagacatgagacagtggtcaaatactcaggcaggtaagcatgaatgaagcagataacacagacgagaggtacaaaggtcaaaaagaattgcagaccttaaaatgtggtatgggatgctctgcttcagtggaaatgtttcctaaaaagccattttttattctgtagcttttgtataggagcatcatttgtcccataccattaaattctctatggacgttacttgctatttagtgattttcctttgaaggtaccgtgagagctaaagtcctctttatggcttataaggtgctgcatgatatgcctcctcttccattgcttcaaggggggatataagaatatctctgagtattttgaggaagtgcatgttagatcatttctgaagttttctttttccatcatatctgaagtgtgtgagagcagtggtgacattaagatttgtttcagaaatctcaggaacatcaatgacagatgttacttgctatttctgtattttttcttttctttctttcctttttgtttttgtttgtttgtttgtttgtttgtttgaggcagagttttgctcttgttgcccaggctggagtacaatggcatgatctcagctcaccaccatcttcccctcctgggttcaagtgattctcctctgggttcaagagattctcccacttcaacctctggagtagctgggattacaggcatgtgccaccatgaccagctaattttgtatttttagtaaagatggtgtttcccaatgttggtcaggctggtcttgaatttccgaacgtaagtgatcctcccgccttggcatcccaaagtgctgggatgacaggcgtgagccaccgtgcccagcctctattttttctttttgatattagtaattttaacagatttgaagtcatacctcatcactgttttcatttgcagttgcctatttgtaggtgatattaggtatcattttcatgtaataaactaattttctttgagtagatacccaatgatgaggtttctgaatcaaatcgtagttttatttttagttgagattgagcatgttttttatatgcgtgttggttatttgtatgtctttattgaaaaatgcttagtagtatttgctcatttttcaatgggatttcttattattatgatatttttgaattgtttgagttatttgtaaattctgaatattggtttcatgttggcccatagtttgcaaatatattcttttattctgtaggttgcctatttatcctgttgatttttttttttttttttactgtgcaaaaactcttttgtgtcccatttgtctattttttataataataatataataatagttttctttgttgtgtccttggctagttttggtatcagggtgatactgacctcagagtgacttagggagaatttaattatcttcaatttttgggaagagtttaaggaggattattattctttgtatatttggtagaatttggctgtgcgtttatccagtcctgagcttttctttgtcgagatactttttattactgactcaatcatgctactcattactggtttgttcaggtactctatttcttcctggctctatcttgggaggttgtatgttttcatgaatttattcattctttttaggttttcaggtttattagtgtctagatgtttataatcatttctagtgaacttttgtattactgttgtatccattgtaatgtcttctttcataactgattttgtttatttagattttcattctgtttgtggttaatctacctagcaatttacccattttgtctttttggaaaaccaactctattctgttgatcatttttattgtttttcatctctatttcatttggttctgttctgatttttgttatttttttcttctaacttggaattttgtttattattaattttctagttccttgaagagtgtgtgatgtcaggtgctcaatatgtaagctttctacttttttgatgcagtcatttaggctgtaaactgccctcttagtattatatttgctttatctcacaggttttattatattgtgtttgtctttccatcttttttcccacacatttttaatttttatcttaattttctttttgaaatgggttttaatctgtcacccaggctggagggcagtggaacaatcttggctcactgcaacctccaccttccaggatcaaaccatctttttatctcagcctcccgagtagctaggaccataggtgcgcaccattacatctagctattttttaaaattttttatagagatacagttgtggcatgttgcccaggctagtctcaaagtcctgacctcaggtgattcacctgcctcagcctcccaaagtgctgggattacagagatgagccgccactcctggctggccattttaattacttcatttacagtttttgggaacaagccccccaaaatctgtccataaactggccctgaaattggccataaacaaaatctctgcagcactgtgacatgttcatgatggccataacacccacactggaaggttgtgtgtttagcagaatgagggcaaggagcacctggcccgcccagggcagaaaaccacttaaaggcattcttaagccacaaacaatagcatgagtgatctatgccttaaggacatgctcctgctgcagttaattagcccaacctattcctttaatttggcccatcccttcatttcccagcctgaccaatgtggtgaaacctgtctctactaaaaatataaaaattagctggacgtggtggtgggtgcctgtaatctgagctactggggaggctgaggcaggagaattgcttgaaacagggagacagagactgtagtgagcctacattgcaccactgcactccagcctgggcaacagagcaagactccatctctcaaacaagtaaaataaaataagtaaatcaacatgcagtagtcagtgagcatcagccatgcaattgtgctaggtacagaagatggaaaaaatatccttgaggtaggagaaacatgttaacagataaattacagcagacagacttgatagacgagggtaaaagttattaggaacagaaggcctaattctccctagaaaaggtactatttgagatgggtctcaacgaagagtaaagagtaaatattctttgctgggggaaggggatggagacacaacaaaaagaacaacccatgcaacagcaggggcagtaaagaattattcagtgtgtcagtgatgtggaagacagagacaagagccaagactagcaatttggtttggaagcagatatgggtcttcgtaaaacaagtgaaggagtttggatttttctttttgcagacagcagggaggcaagagatgttattaggcaggcaaacaatgacagcagcttttgtttttgaggatgatgactctggcagcaagctggaagattaacagcagtagagagaaactggtggcagaaaattaagaggtgcttatgactcaatgagggccttaggtcagaagtgattaaacagccaaagtcagtgactgaagcatggttttgaggagagcctggtgactgattggacatgggggtgagagagacatgcatcaggacagccatcagtaatgttcctggcctagtaggttgtgtgcatggcaatcaccttccagaaggaatggacattactttcatttttacaagtacttgcagggtgagggacttgtagtgtgatcaggatcacaaaagattactgcttcagaaaaattgtaagtgaaaatgtagagttagagttgtcagtttataggttaaaggagagggcacaaaagcaccagaatgcacagggcactctgcaggaacagaactcactcccaagtatgggaggtgaaaggttgctgcagagaacaggtacctggcaactgactgcaatgggatgcttacagtctgtccactgatttcagaattttaaaacaactattctcaagtgttgcacatgtctctaaggtaagtgggagcccagaccactgtggaggcaactgtctgcttactgcaggcagccctttcttttctggaattcagtctcctcatcttcctgccttatctcgtgcatatttcctgcttgtgtagtagggtggaaagtggaagggcaggacaaaggtcaaatcagtggcacttatttgctaaacatatactagacagttctggtgtgaggcctggggtcccagatcatataaattatcactgtctcctttattgcatccctgtattgtccccatccatctcagccagggcagctggctaacatccactctctcaagacgacatgtgtagacagaagacctggctcagaaacaccggtctatgaaaagggcagatagttatgtaagaattttgcaaaaacttgagaaattaaaataagggagactatgaatgcaaaaacattaactatcaagctagtaagagctagttcaaagaatttttttaaaagatatactccacgtaactgaaaacatgagggagactggcagatgacagcatcagagcgaatttcctaaataactcaggtaggagccacctaccaaaacagctttacagagccaatgcatctcatttgttgaagaagctgatgagttctagagctcttatttactatggagttttcaaatacactgaataccacttaatgttttcctcaatcccaagcttcttgtaaaactttgaccttgccaaccatggcatcttagaggcaaataaaagcttacttactttatggaatttcagatttctaaatatagcacatgcaatacagggaatgcacccactgtgcttgtggatgcaataaaggccactactacacctctcaagcaggcttgcttgacttcagctctgctgacatttgtggctatcctgtgcattgtaatatgctgagcagcatttctagtgtctgtatacttaaggccagtagcacccttccccaaagcaaatcactcaaaaattcaaaattctggaaaggaaatccacagtggatacccacaaaacttcctgatctcaaaataaaccactttattccatatgtaggttttgagtttctggaacatttatttatctttacaacaatcccatgaggtagaaaggctactgaaaagatgtctatcatcatattcatcaatggcaacgtcaccagaggctaaagtttcatttgaaattcccttataccttcaaattcaatcaaatttattttgaaaaaaaaaggtctttattaaaaataacaacacacatacacagaggtaaataagcagtatacatttaaatctatgattttttttttttttgagatcaagctgactctataaagcaggtgttccatggagctagatggtagttaggaattgtggatgctgagcttaatttattgccagccactgggtacctcataaagcagctataaaatgggtcaacatacccacccaaccctaatagtgttgttctgagtataaacatggaatctttcctgaatgatttcaaagaagcagggtgaaaataacttagtccaagaaggtacatcaaaatgaataaagaacattttaaagtaattaaactaccagaaatatcacacatttatatagtcctaccccattgtctctgagaacacggaaaaaagagaaaatacaaagcaagctagggaaagacaaatacagtttttaaaagctctaattaaccccactaagaatttttttggctacctggtgtatgtcaggcactgtacaatgtagggcagtgctcctcaaccctgttggcaccagggtctggttttgtgacagacaattttttcacggatgtggcaagatggttttctattggtatgatttaagcgcattacacttactgtgcactttgtttctattattacattataatatataatgaaataattatacagctcaccataacgtagaatcagtgagagccatgggattgttttcctgcaactaaaggttcccatctaggggtgatgacagacagtgagagatccttaggcgttagattctcgtaaatagtgtacaacctacatccctcacgtgcgcagttcacaatagggtctgcactcctacgataatctaatgctgctgctgatttgtaatgcgagtgatggggagtggctgtgaatcctgatgaagcctcgctcatccactgctcacctcctgctgtgcggtttggtttataacagaccacagactggtatcagtctgtgccctgggtgttgaggactcctgatgtagggcaacaatgtttattcatttatttattgagtgtagtgctgtaatctcagctcactgcaatctctgcctcccgggttcaagtgattctcctgcctcagcctcccgagtagctgggattacaggcatgagccaagaagcacggctaattttgtatttttagtagaaatggggtttcaccatgttggtcaggctggtcttgatctcctgacctcaagtgatccactcgcctaggcctcccaaagtgctgagattacaggtgcaagccaccatgaccggctggcaactacatttattaccatccatttattactaggtcacccatgttgtacagtgcctggcacagaccaggtggccaataaacagctattgatctaatgcaggaataataaggtaaggtttattttttctccttcaacatgctgtacctttgccagatgcaaataagacctcaaaagtctgcctgaataaacttaaaataaaagaccctttcatcaaacggtcacttagatggtgtaacaagttaggtatgaatgtatcacctgtaccagctcagtgaaatgcgtgttaaccatcacataacaaactcgtgtctggcacgctaagggctttgagtctgaatttctgatgagaaataaagtggtatatagaaaaccccagagaatgatattccatatatccataagcatcagtagcacttcttaaaagtctcgcacatccagcaaaccctttaaaaatgagatatcctaatatgcaaccagtttagcagtatttttaagaatgataagggctgggcacggtggcccatgcctgcaataccagcactttgggtggccgaggtgggcggatcacctgaggtcgggagttcaagaccagcctgaccaacatggagaaaccctgtctctactaaaaatacaaaaatcagcagggcttggtggtgcatgcctgtaatcccagctactgggaaatctgagacaggagaatcactcgaacctgggaggcggaggttgcagtcagccaagatcgtgccattgcactccagcctgggcaacaagagcaaaactccgtcgcaaaaataaataaaataaaataaaataaaataaaataaaataaaataaaataaaataaaatataaaataaaataaaataaaataaaataaaataaaataagatagggcaacttcatttacctaaaatggagcacaagatcctttagaaggaactcatactcattcctgcaaaaattctgccaactcttgaaggtagcacagaattaagcatttgtgtgtgtgtgtgtttccaaagaggttttagccaagattgtggtctctaacagactccctgattaaaatagggtttagaaactatactgcctacttgaaaaagcatcaaatctagagaatgcttttcacaggtatgaaaaaaatgaaaacaaaatcacattcttctatttgcaattccctttccctcactttccacttctattaaatatacttcagtaacattgtgcataggtgcagagaccacacatatctaaaaaaggaaaaaaccctcaaatatatggggatggactggcgactctgcctttgcagaaatcattttgtttcctccagacagaagtgtctcattattttcagcattcctatctaaaaggcaaactttgtttccattgactttgaaagggctaagcttaaatctgaactcttaaacaaggacaagagttcaattttctattaatgaaaatcccagacaggtttttcagcctaccaaatcgttatacttttcttattcactcttctatctctctccacaaccaccaacattaccacccacaaaagaagaagaaaatccctccaatgttccctgaatgtgtgctgctgctagctcggaagctgtgtagagttttgtaatggagtgtgaactgctgccccggatctgggctgtatctgtgttctatctcctatccagtcaggagagaaaaaggacaaatccgctgagcagggaaaaattctttccgcctcatttataacctctcatggatgcagcgctgaagagggtcgctaggcacacggggaccctgtcaagctgcccactggccagcgcgttctgcgccgggcggggtctccacgccctgcaggtctccgccttgcctggaaaggaagctgccccgccaggcagtgagatcggttgccgttccccacccacacccttggccagggaatgggtcacatcctcgatgcgccctcggcccagaaaacgcgccgctttccgggcggggggcgtcggcgacgggaaggacctcccctgctccttagcaaacactagggtcgcagtttcctaagagacgcgagtgggaaggggaggagggagcccaagaagaggctggtgctgggggcagagaaagcaacactaggatgcgggccggtgtgggaggaggaagggaagccccggaactagctgcaaattgttcgagcgggagaagctccccgccttcttcctggactaacgacggcacccggcaccgagcccccgactgcaaggaaggtgcactccacatcgacggatccctgtaaaacaaggaaggtgcaatccacaccgacggatctctgtaaaacacgcacttagccaacggaagggcaaggaccgataggcgcccccatggccaggccctggcccccttctttcctgggcgcctaaggtggtaggtagtcagccacaccaaaaccgccagccaggaaagggccagggcgcagggctgcctgctgccccctcgaagccagtgtcctctgcccaggaagatcaaatccacagagcagggtgcgtcaggggcttccaccaaacaccctggtgagagcaccccaggaggccacctcctggccagcacccagatgctttgcgactgcaggggaaagcaggggccctagtttccaggcttccctgccagggaggggctggaaagaccttagaaggaaagtttctctttccacaggggaaggatgctgggaaagagagggcagaaggtggggagcagcgtcaggaagatgtttctggcctgcgaggcttgcaccatctgaatcagggcggttctgtaagaaataaattcaccccagtattccgggaggccaagacagagggagcgcttgcgcccagaagtttcagaccagtctaggcaacatgttgagacccggtcactgaaaaaaaaattagtcaggtgtgatgggccacacctgtagtcccagctactcgggaggctgaggtgagaggatctcttgaggacacagtgaatcataatcttgtgccactgcactccagcctaggtgacagagcaagattctttctcatagaatagatgatagatagatagatagatagatagatagatagatagattacatatatatacttggccgcctgagttaggctggattaatactatcctccaaaagctaatataaatgtacatcaggtctttctagtgcagcgctgaagaggctgccactacgtgtgctggatgctgcttggcatggctaatggctcagtaagaggaggagtaggagtggaggagtgaagaaagaggaggaggagaagagaagaaaaggaggaggaaagagcaagaactacaagagaaaaggagaagaagataggaagaagagaggaagtggagaaaaaaaaagcagaggaggacaaccggaccaggagaggagaggaaaaaagggaagctaggaggaagtagattaaaaagagagagaaggagaaggaggagaacaataagagaatgaggaaaaagaatgaggagaaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccaaagcaggagagccacatcacctaggtgagagccccagagatacagcacaatgccttctgtgggtagggctcaggaagaagaggaaagttacataacctaggggctacagccagctatatgtcacaatcacccgaaggggcagggacaatgcatgagaggagagtcatatcaagtaagtggtgagcaaagcaatattaacaatcagagcagagtgtcatctcctacattctgggccatgagatatgttacaacctcccctatgggcaaagccccaggtaatagaagagatttacatcaaatagttgatgggctaagagatacttcacaatgccccctgcagaaagagagtaggagaaataaatcagattgcctgtgtgctgggccccagggataagccagtttttcatctgtggacatggcccaggcaggagagggagtcacatcactgagatgctgggcacagagatatgcaacaagcttttctataagcaaaaccctggtaagaacagaaagatacatcaaatattttatggacccagagatacgtcacgatgtttcctcttgacagagtcaaggcaagaaagtgacatcaccttggtcctgggtcccacaataggtcacaatgccttctgaaggcagggacaaggctaatgagtaacatcttaaagctgggcccagcatatatgtaacaatctcccttgtgggcagaacctaggaagaagagaagtgtcacattagctaggtgctgagctcagagatatgtcaccttccctcctgtgaacagaaaccaggcaagagatgagagtacattacctgggtgatgagtgcagagagatgtcacaatcccccctttaggctggacccaggcagaagagtcacatcacctgggtgttaaaatgagcaatatgacacaatgccccttattggcagcaccaaggtaggagagaaaatttacattacctgactgcaaatcccagcgatatgtcacagtgcctcctgtaagaggcaccaaggcttgagaatagagtcatctcacctgggtgctgggtccagcaatatatcacaattctacctgtgaaccaagccaggcaggagagtcaaatcaggtgtttggcagaggtgtatgtcacaatcagaccttcaaaaaatacagggatgaaattaccaatccctcacatgttctggttctaggtatgagagtccacatgtcttgtatgatgggtaaagtagacaagtcacaacctcaactgtgaactggatctgtgcagcagcttctcaatgttttctgggcattgtgtccccttagaaaagtcacagcctgacacgtgtgctaaattatggtttaagggtcacaaaatccatgcataacgaattcatgaatgagagtcaacattgcaacttttgactgcctctagatataagattcaaatcctcaacagtgggccatgctcatgtgagaggacaacaatctttactcttgactgtgtctgcttactactgtcacaatcttacctttcagctaggctattagtacactctctgtaccacccaaagaatttatgagatacatggtttggctctatgtcctcacccaaatctcatctacaattgtaatctccacgtgtcaaagcaggaaggtaactggatcatggggcagtttcctccatgctgttttcgtgatagtgagtgagttctcaggagatctgatggttttataaatgttggaagttccttcttcattcactttctccctgctgccacctgttgaagaaggtccctgcttcctcttctgccataaatgtaagttttctgaggcctccccagccatgtggaactgtgagttaattaaacctcttttctacataaattacctggtcttgggcagttctttatagcagtgtgaaaatgaactaatacaatatgatatgcatgtgagttgcaatctgcattaagaccttcatgctgatatgggcccatgattgtacctgtcattctaagctcaggtatgagagtcaacacctccccaattggctgtgtctaaatagaagagtactcatctgcctatgagctggatttagagatgggtcactatcccatatgtgtccagatgttcacatatgactgacacattccatctgtagactgtgtctacatatgagattcaggatctcaccagtgggttgtgtccatgtgtgaggatgactatcttaaggattggcagggtgtgtataccagaaatacaatatctcctgtgtccttggacctgtggtgacactctctgtaccactataggactttagagagtggtaaacctctgtgacttttgtacaaaaaggacacccaggatcttatctttttccttaagcttagctataagagacagtatctctctcattggcaagttgaaggtatgacagtcatcatcacaccagtgagctgggccaagatatatgtgacaatcactcctccagatcaggagtaagcaggagagtaacattacctgggtttggggccagatgtatgtcacagtcttctctaagggctcagcaatatgtcacagtgatctatgtattcaagacccagtcaaaagagactcaccactttcttgcagggtccagtgatacgtcataatcttttctgttaggagggtccaggcagaaaagaagagtcacatttcctacgtagtgtatgtggatatatgtcacaaggccccctgtgggcagggcccaggcaggagcctcttattttctaggtgtgggacccagcgttatttcacaatacaccaaatatgtggggcctagaagaaaggagtcacatcacataggtgctgagccaaatgatatgttgtaatccccctttttagcagggcccaggcagaaaaataaaatgtgtcacatcatccaagtgataaacaaaaagagtaacattacctatgtgctgggctcagcgatacatcacaatacctccttggtcagagcccaagaagtagaagagagttacctcacctaggtgctgagtccatcaatatatcacaatacctactgagtgaagggcccaagaatgaggattacatcatttcggtgaggggcccagagctatgtaccaaagctccctgtaggtagggcttaggaaaaaagaagagagtcacataacctgtcacataacctagacagatgagcccagccttatgtcaaaattacaagtggtcagagtccagacatgagaggagaatcacataacataaatgttgggtgaaggaatatgtcacaatccctactggggacagaagcagaaaaataaggagaattacaccatctaggtaatgggcccagagatatgttgcagtgacccctgtgggcaatgaccaggcagtagaatcacattgcctgtgtgtcgtgcctagtgatcatttactttacatccagtgagcatagcacaggcaaacgaggagagtcacaacacctaggtgctggaatcagagacatgtcacaatctcttctaattgtaaagcccacataagcaagaagagtcacatcaaatagttcatgaacttagagatatgccacaatgccccctgtgggcagggtccaagcaagagactcatatcatgttgttgctgagcccagtaatatgtcacaaagctttctgaggtcaggaccaaggcaaaagtgtagcatcaccttactattgagtccagagacacatcacaatctctcctgcaggcagaacctaaaaagaatagaagagtcacatcaactcaatgctgggcccagtgatgagtcacaatattccctgtgagcagcgatcaggcagaagtgagtcatatcacctggctaatgggtgcagagatgtcataatgcctcctgtaggaagggccaaggcaagagagttacatcacctgggttctggaccaagcaacatatcacaatgggccgtgtgggcagggtacaggtaggagaaccacataacttgggtgtggggcccaacgtcacaatgccttctgtgcacagtgacaaaacagaagaggagactgacattaactgaatataaggcctagtgacagtgatatgtcacaatgctgtctatgggcagtgccaaggcagtggaatagagtcccatgatgaaggtgctgggtttagcaatatgtcaaaattccatctgtgggttgggccaaggcagaagtgttaaatcactcagttgctggacagaggcatatgtcacacagtctcacatgcagaaagatacagggataaagttaaagttcttgcacatgacccaattctaagtatgggagtcaacatctcctctatgttgggtctaaatacatgagtcacaatcttaatggtggactaggtctgtgcgtgggaacctcgctttcttctgtgcactatgcctccttagtagagtcacagcctcacaggtgtgctgaatcttggacggagagtcaccagcccacctgtggactggatccacatataagagtcactttttcaagtttcgactgcctccaaatgtgacattcagaacctcaaaagttggctgtgttcatgtggcagtatgatgtgcataccagtgtcaaaatctcacctgtgctgtgccttgtcaggaaacactttgtagcacctgagggctttatgcatgagagcctcaatatgctttgagacctcccttctggtatggacccatggttataatttttaccctaaccgcttgtctcagagtcaacttctcttcaattggctcagtccaaacagaagtgaactaggtttggaaatgagtcaccatcccaactgtagcaaatgagagaaacaattccagctgtggactgtgtcaacctgtgtgattcaggacctcacctgtgggctctgtccacgtgtaagggtgaaaatcctaatggatggtagggtgagaatatgagaaacacaatctcatttgaatgctgggttccgtggtgacattttgttccacactagggctttatacaatgtgtgagaaagtggtaattttctataaccttcatacaaagaggagacatgggattttacccgtgtctctaacctcagctaaaacagatagtatattttctgttggctggtgtgtggtattagagtcatcattgcaactgttagctggaccaagatatatgtccctacctgtgggtagggagcaaacaggagagtcacatcgcctatgttctggtccaggaatatgtcacaatcttccctgacagaagggaccaggcagaggaataatatcacctgggtacttagccaggaatatgttacaatcacaatcccctcctgaaagctggatgcaggatgtagactgcagaaccacatcaccttggtaatgggcccagcgatgtgtcaaaatgctttctgtgggcaagactcaattaggagagacttatcatctgtttgctgaggccagcaacatgtcacaatcttccctgtaggcagggtgcaggcagaagaagagagccacattgcttaggtgataaatgcagaaatatgtcaccaggtccactgtggacaggccccagccaggagcgttccatttctaggtattgggcccagcgatatgtcacaatacccaaaacatgtggggaccaggcaaaaaaaaaaaaagagagagagagagagagactcatatcacctagatgatggatcaagtgatatgtcacaatcttcttatttggcaggtcccaggcaacaaaaatgtgtcatatctcctaggtgatgaacaaacagtatcatataatacccctgtcttcagggaccgtagagtagagttgcatcacgtacttgttgggtgcagccatatattacaacacacaatgtatgccgggcccaggcaggagaggagagtaacatcccttaggccctgtgtccagggatacatcacaatgcctccttcagcagagcccaagaagtagagaagggtcacattacttaggtgccaggtacaacaatttgccacaatacttcctgagagaaaggcttaggcagaggtgtcacatcaccttggtgagggaacaagaaatatgtaacaatgtccctggtaaatacagctagaaaaaaagataagaatcacataacataaggtcagtgcccacttatctgtcacaatcacaccagtaggcagggctcaggcaagagtagagagtaatataatgtaggtgctacagcaagaaatatgtcacaattttcactgtggacaagtcccagaaagaaaatgagaatcacatcacctaggtcatgggcccagagatatgtcacagtggcccttgtggacaataatcaggcagaagaatgacattgcatttgtgctgggcctagtgataattcattattccttctgggagcctggcacaggcaaaagaggagagtcaccaacacctagctatttggcccagagatatgtcacaatctcttctatgggcaatgtccaggtaaaacagcagagtcacatcaaataattgatgcagccagagatatgtcataatgccttctgttggcagggcccatgcaagagagtcacagtgtcacaaaacacaatgtattcagggctcaggcaagagatgatagtcacatcatttaggtcttggatccattgaaacattacaattttgtattgagcaaaggctaagcagtctagaagagtcacatcacctaggctttacgtccagcaataccttgcaataacccctgagaggagagcccaggtaaaaggataactttatttaggtgagagtcctagaaatacgtcacaattatctgtgtgggtaaagatcaaaatgggaggcagttccaagatggccgaatgggaacagctgcagtctacagctcccagtgtgagtgacgcagaagatgggtgatttctccatttccaactgaggtaccaggttcatctcactggggcttgtcagacagtggaggcaggacagtgggtgcagcccaccgagtgtgagctgaagcagggcaaggcatcacctcacctgggaagcacaaggggtcagggaattccctttcctagcaaagggaaggggtgacagacggcacctggaaaatcgggtcactcccaccctaatactgcacttttccaacagtcttagcaaatggcacaccaggagaatatatcccgtgcctggttcagagggtcccacgcccacagagcctcactcattgctagcacagcagtctgagatcaaacaacaaggccacagtgaggctaggggaggggcgcccgccattgctgaggcttgagtatgtaaacaagtggccaggaagctcaaactgggtggagcccactgctgctcaaagaggcctgcctgcctccgtagactccacctctgggggcagggcatagccaaacaaaaggcagcagaaacctctgcagacttaaatgcccctgtctgacagctttgaagagagtactggttctcccagcacagagtttgagatctgagaacggacagacttcctcctcaagtgggtccctgacccctgagtagcctaactgggaagcacccccccatagtggcaaactgatacctcacatggtcgggtacccctctgagatgaagcttccagaggaaggatcaggcaggaacttttgctgttcaacaatattcgcagttctgcagcctctgctgctgatacccaggaaaacagggtctggagtggacctccagcaaactccaacagacctgcagctgagggtcctaactgttagaaggaaaactaacaaacagaaaggacatccacaccaaaaccccatctgtaagtcaccatcatgaaagaccaaaggtagataaaaccacaaagatggggaaaaaacagaacagaaaagttgaaaattctaaaaatcagagcacctctccccctccaaaggaatgcagctccagcaacagaacaaagctggacagagaatgactttgatgagttgagagaagaaggcttcagatgatcaaacttctccgagctaaaggaggaagttcgaacccaatgcaaagaagctaaaaaccttgaaaaaagattagatgaatggctaactagaataactagtgcagagaagtccttaaatgacctgatggagctgaaaaccatggcacaagaactacgtgatgaatgcacaagcttcagtagctgattcgatcaactggaagaaggtatcagtgattgaagatcaaatgaatgaaatgaagtgagaagagaagttcagagaaaaaagagtgaaaagaaatgaacaaacctccaagaaatatgggactatatgaaaagaccaaatctacacctgattggtgtacctgaaagtgatggggagaatggaaccaagttggaaaacactctgcagggtattatccaggagaacttccccaatctagcaaggcaggccaacattcaaattcaggaaatacagagaatgccacaaagatactcctcgagaagagcaactccaagacacatatttgtcagattcctcaaagttaaaatgaaggaaaaaatgttaagggcagccagagagaaaggtcgggttacccacaaagggaaacccatcagactaacagcggatctctcagcagatactctagaagccagaagagagaggggaccaatattcaacattcttaaagaaatgaattttcaacccagaatttcgtatccagccaaactaagcttcataagtgaaggagaaataaaatcctttacagacaagcaaatgctgagagattttgtcaccaccaggcctgcgctacaagagctgctgaaggaagcactagacatggaaaggaacaaccggtaccagccactgtaaaaacatgacaaattgtaaagaccattgatgctaggaagaaactgcctcaactaacgagcaacataaccagctaacatcataatgacaggatcaaattcccacacaacaatattaaccttaaacgtaaatgggctaaatgctccaattaaaagacacagactggcaaattggataaagagacaagacccatcagtgtgctgtattcaggaaacccatctcatgtgcagagacacacataggctcaaaataaagggatggaggaagatctaccaagcaaatgggaaacaaaaaaaggcaagggtcacaattctagtctctgataaaatagactgtaaaccaacaaagatcaaaagagacaaagaaggccattacataatggtaaagggatcaattcagcaagaagagctaactatcttaaatatatatgcacccaatacaggagcacccagattcataaagcaagtgcttagagatctacaaagagacttagactcccacacaataataatgggagactttaacaccccactgtcaacattagacagatcaatgaggcagtaagttaacaaggatatccagtaattgaactcagctctgcaccaagcagacctaatggacatcctcaggactctccaccccaaatcaacagaatatacattcttctcagcaccacatcacacttattccaaaattgaccacatatttggaagtaaagcactcctcagcaaatgcaaaagaacagaaattataacaaactgtctctcagaccacagtgcaatcaaactagaactcaggattaagaaactcactcaaaactgctcaactacatggaaactgaacaacctgctcctgaatgactactgggtacacagtgaaatgaaggcagaaataaagatgttctttgaaaccaatgagaacaaagacacaacataccagaatctctgggacacatttaaagcagtttgtagagggaaatttatagcactaaatgcccacaagagaaagcagggacgatctaaaattgacaccctaacatcacaattaaaagaactaaagaagcaagagcaaacacgttcaaaacctagcagaaggcaagaaataactaagataagggaagaaccaaaggagatagagacacaaaaaacccttcaaaaaatcagtgaatccaggagctggttttttgaaaagatcaacaaaattgatagacagctagcaaaactaataaagaagaaaagagagaagaatcaaatagatgcaataaaaaatgataaagggaataacaccactgatcccagagaaatacaaactaccatcagagaatactataaatgcctctatgcaaataaactagaaaatttagaagaaatggataaattcctggacacatactctctcccaagactaaaccaggaagaagttgaatccctgaatagaccaataacaggctctgaaattgaggcaataattaatcgcctaccaaccaaaaaaagtccaggaccagacggattcacagccgaattctaccagaggtacaaggcggagctggtaccattccttctgaaactattccaatcaatagagaaagaaggaatcctccctaactcattttatgaggccagcatcatcctgacaccaaagcctggtagagacacaacaaaaaaagagaattttagaccaatatcccaggtgaacatcaatgcaaaaatcctcaataaaatactggcaaacccaatccagcagcacatcaaaaagcttatccaccatgatcaagtgggcttcatccctgggatgtaaggctggttcaacatacacaaatcaataaacgtaatccatcatataaacagaaccaaagacaaaaaccacatgattatctcaatagatgcagaaaaggcctttgacaaaattcaacaccccttcaagataaaaactctcaataaattaggtattgatggaacgtatctcaaaataataagagctgtttatgactaacccacagccaatatcatactgaatggacaaaaactggaagcattccctttgaaaactggcacaagacaagtataccctctctcaccactactattcaacatagtgttggaagttctggccagggcaatcaggtaagagaaacaaataaagatattcaaataggaagagaggaagtcaaattctctctgtttgcagatgacatgattttctatttagaaaaccccattgtctctgcccaaaatctctgtaagctgataaacaacttcagcaaagtttcaggatacaaaatcaatatgcaaaaatcacaagcatttctatataccaataacagacaaactgacagccaaatcatgagtgaactcccattcacaattgttacaaagataataaaatacctaggaatacaacttacaaggcatgtgaaggacctcttcaaggagaactacaaaccactgctcaaggaaattagagaggacataaataaatgcaaaaatattccatgcttatggatagggagagtcaatatcttgaaaactgccatactgcccaaagtaatttatagattcaacgctatccctatcaagctaccactgactttcttcacagaattgtaaacagctactttaaacttcatatggaaccaaaaaagatcccacatagccaagacactcctgggcaagaagaacaaagctggaggcatcatgctatctgacttcaaaccatactacaagtctacagtaaccaaaacagcatggtactggtaccaaaacagatatatagaccaatggaacagaacagaggcctcagaaataatgccacacatttacaatcatctggtctttgacaaacctgacaaaagcaagcaatgaggaaaagattccctatttaataaatggtgttgggaaaactggctagccatatgcagaaaactgaaactggaccccttccttatatcttatacaaaaatcaactcaagatggatcaaagacttaaacataaaacctaggaccataaaaatcctagaagaaaacctgggcaataccattcaggacataggcatgggcaaaaactccatgtttaatacaccaaaagcaatggcaacaaaagccaaaattgacaaatgagatctaattaaactaaagagcttcagcacagcaaaagaaactatcatcagggtgaaaaggccacccacagaaagggagaaaatttttgccatctatctatctgacaaagggctaatatccagaatctacaaagaacttaaacaaatttataagaaaaaaaaaaccatcaaaaagtgggcaaaggatatgaacagacacttctcaaaagaagacatttatgcagccaacagacgtatgaaaaaatgcccatcatcactggtcattagagaaatgcaaatgaaaaccacaatgagataccatctcatgccagttagaatggtgatcattaaaaagtcaggaaacaacagatgctggagaggatgtggagaaatagggatgcttttacactgttggtgggagtgtaaattagttcaaccattgtggaagacagtgtggcaattccccaaggatctagaactagaaataccatttgacccaggaatcccattactgggtatataaccaaaggattataaatcatcctactatagagacacatgcacacatatatatactgcagcactattcagaatagcaaagactcagaaacaacccaaatgtccatcaataatagactaggtaaagaaaatgtggcacatatacaccatgaaatactatgcagccataaaaaaggatgagttcatttcttttgcagagacgtggatgaagctggaaaccatcattctcagcaaactatcacaagaatagaaaatcaaacagctcatgttctcactcataagtgggagttgaacaatgagaatacatggacataatgagaagaacatcacacactggggcctgtcaggctgtcgggggctagggaagggataacatcaggagatatacctaatgtaagtgactggttgctaggtgcagtgagccagcatggcacatatatacctatgtaacaaaactgcacgttctgcacacgtacccaagaacttaaagtataattaaaaaaattatatattgaaacaaacaagagcctgaatactcaagacaatcctaagcaaaaataacaaagctgaagatatcatgctacccaacttcaaactatgctacggggctatagtaaccaaaaaggcatggtactggtacaagaagagacacacagaccaataaaacagaatagagaacccagaaataagaccacatggctacaactatctgatttttggcaaaactgacaaaaacaagcaatgggaaaaggacaccccattgaataaatggtgctgggataactggctagccataggcagaaaattgaaacggactctcttcctccatcatcttcagcaaactaacataagatcagaaaaccaaacaccacgtgtcctcacttgtaagtgggagttgaacaatgataacacatggacacagggaggggaacaacatacactagggctagtcggaggatgggaggtgaggagagggagagcataaggacaaaaagctaatgcatgcatggcttaaaacctagataatgggttgataggtgcagcaaaccaccatggcatatgtatacctatgtaacaaacctgcacattctgcacttgtatcctgtaacttaaagtaaaatttaaaaaaagaaactgaactccttccttacagcatatacaataatcaactcaagatggtttaaagactaaaatgtaaaaccccaaactataaaaactttggaagataacctaggcaatacaattcaggacatacacatgggcaaatgttttatgatgaagatgccaaaagcaattaaaacaaaggaaatattgatgaatgggatctaagtaaactaaagagcttctgcacagcaaaaaaaaaaaaaaggaaagaaaaaaagaaaagaaaagaaaaaacaaaaactatcagcatagtaagcagaccacgtacagaatgggagaaaatttttgcaaactatgcatctgacaaagatttaatttccagcatctgtaagaacttaaatttacaagaaaaaagtaaacaaccccattaaaaagtgagcaaaagacaaaaagagacacttctcaaaagaagacatacatgcagctaaaaaagcatatgaaaaaacctcaacatcactgatcattagagaaatgcaaatccaaaccacaatgagatattgttttataccagtcaaaatggctattattaaaaagtcaaaaaataacatatgctggtaaaactttggagaaaaaggaacgtttttaccctgttggtgggagtgtaaatgagttcaaccattgtggaagacagtgtgatgattcctcaaagacctaaagacagaaataaaattcaacccagcaatttcatcactgagtatatacccaaatgaatatgtcattctattataaagtcattctattataaagacacatgcacacacacattcattgcagacctattcacaatagcaaatacattaaatcaacccacgtgttcatcaatgatagactggatgcagaaaatgtagtacatatacaccacagaatactatgcagccattaaaaaaaaaaaccaagatcatgtcctttttagacatggaagaagttggaggccattatctttagcaaactaatgcaggaaaaggaaaccaaataccacattttctcacttacatgtgggagctagatgatgagaacacacagaaggaacaacatgcactggggcatatcatgaggtggagagtgggaggagggagagaagcagaaaaaataactaatggatagtaggcttaatacctgggtgataaaacaatgtatacaaccaatctttatgacacatatttacctatgtaacaaagctgcacatcctgcacatgtacccctgaacttaaaagttagaaaaaaagttgtagcaaaaagatagattatttttgactgccttggtgcacagtccagagtcagcatggactgtccagctctaagattcttatttatcagaaagaaagcattctgtcttttgtctgcactactattatattgggtatccttctacttgtaggcaaatgtaatcctaaccaaagtgctagctttgacatggaatccctggtaatcttcggtaagacatgtctctttcttaagacattttcttatctgcatagtggtggaggcaggagtggggagatttaattctgaagttctagtgcttctatatggcccacctccataattccttgtacagtaatagcatctcagattctttttgtaggactactccaccacaaagggcttatcagtccgtgtgttaagtgtggatgtcaccactttctagatgcagaggacaggggacatattgggtatgctccagtgggagctgctgggggataaaggtgggtcccacatgcacacattgtctgtgggccttgaaggatcctgtgtgcatgactttttggacagaaggtccagctgcccagtgcagaacccatctatttctgcccaagtgaggaagatctgggcacaccctcatcacagccctgctacacccatcctagttggtagggaacttgcaccatgtgcaggctgagctgtggtttaagcactttgacatctaacatctcactggataactgggaaattgaagtctggagagaagcagagaatggcccagagaacataaagttggcagagtccagaggataaaagagcattctgacctcataggccaaggttcatccttataatggggtttgctttaggaatgagagtccctgagatcctgagaatttctgccaattttctcatatgcagcaaactcatgtctgcatcattaaacctgcacagttttgcatgcacgtgtgcacacacagacacacacacacacacagacttctcaggttaaaggaagagttaacactgatggagtgacgagaagaaagaagacagaggatggcggcagctttgccatggggtaggggcacccagtctcctggtaacatgtccaggacctataactgatgacttgggaacttcaaggttcccatggatctgcctgggctgtggccatccccaggaaagctttcagaggacaaaaacttggcttctgcattcactgctctctgtaattaaaaccgggaggaatccccctacacccagtatggaggggaatacagtagtgaaaacctcaaacttttttctctgtaaattgaagtaattgacctgagtggcctctaaatttcaaaggcttaaaaaggtgagttgaccttgctgtctatcagttacccactctactctcagatccttagaaatttctctattatcctctggaggtttttcagagcaaaaattggcctggcggtttgtgggactgagcactcagcttagtatagaacatggcagagcatcctatcactgatctgaaggccatccctgtcatagctttggggttcttttttggaagtggaaccagagtcattttccaggctgggatgatggagtcttgtgagttaactggatacctcagaacagcggaggcaaacaagaaagcatgggaggcttctgagatctcttacattgtcctggagcctgtaggcctcactaacttgccctcttgtttcttagtttatttttttgtttgttaaattgttttaaatttggattttaaaattttgtttagtctgctgaaggtttgtcaatttttaacttttcaaaaaagccaaattttttcattgatttctgctctaatctttatgatttttttcttctaataactgtgggtttggtttgttcttgcttttctagttcttttttttttttttttttttttttgaggcggagtctcgctctgtcgcccaggctggagtgcagtggcgggatctcggctcactgcaagctccgcctcctgggttcatgccattctcctgcctcagcctcccaagtagctgggactacaggcgcccgccactacgcccggctaattttttgtatttttagtagagacggggtttcaccgttttagccgggatggtctcgatctcctgacctcgtgattcgcccgcctcggcctcccaaagtgctgggattacaggcgtgagccaccgcgcccggcctctagttctttaagatacattattaggttgtttatttgaaaatgttcccatttttgggatgtagtcacttatacctataaacattcctgttagtactgcttttgtgtatcccatagattttgatacacagtgcttttattatcatttgtttcaagaacatttttaattttcttcttaatttcttcatggacccaataatcattcagaagcatattgtttatttttgtgtatttgtatagtttttataattcctcttcttattaatttataattttattccattgtggacaaataagatgtttgatattatttctagtttttgaatgttttaggacttttttgtgacctaacatatagtctatccttgaaaataatccatgtgctaaagaaaagaatgcattctgcaaccattagataaaatgtcctgtaaatatttactaggtacatttggtctatagtgcaacagattaagtccaatgtttctttgttgataatgtgtctggaatatctgtaacatctattcaatgctgaaagtgggtttttggagtctccacctattattgtattagagtctatctctctcaggctctaataatatttgctttatatatttcagtgctcaagagttggttgtatttatatttaaaattgttataccctcttgttaaatttacccctttatgattacatagtaacctctctgtctttttttttttttttttttttttttgagatggagtcttgctcttgaagtgcagtggtataatctcagctcactgcaacctccacctcccaggttcaagcaagtctcctgcctcagcctcccaagcagctcggactacaggtgcatgccaccacgaccaaataatttttgtagctttagtagagatgggatttcaccatattggccaggttggtctcgaactcctgacctcgtgacccacacactttggcctcccaaagtgctgggattacaggtgtgagccaccgcacccagccctctttgtctttccttataaattttgtctaaaaatctatttttctgatgtaagtatagctactactgcatttttttaattgacattgaatatctttttccatttctaaaatttttagtctatgtatgtctttatagatgaggtgaatttcttacaggcaaaggatcaatatgtcttgtttttatatacattcatccactctgtcttgattggcgagtttagtccatttacattcaatgttattattgataagcaaaaccttacttctgccattttatttgttttatggttgctttggggtcttttttatctttctttgctttttgtcttccttttagtgaaggaggtcttctcttttatctttctttgctttttgtcttccttttattgaaggtagttttctctggtgatgtgacttagttttgtgctttttattttttgtgtattcttgtatgttttttggtttgaggttaccatgaagcttgcaaatgctatcttgtaatctattattttaatctaataacaacttaacactgtttgaataaacaaagaagcaaaaagaataataaaaactgtatgctttaaatctcttccctcagtttttgttgtttctatttatatgtaattttactgtctatgtcttgaaaagttgttgcagttgttatttttgattggtttattgtttagtctttctaccttgcataaaagtagttcacacaccacagttacggtgttataatattatttaattttctgtgtacttactatcaccagcaactgtatttaactatatggtttaaataattcctccatcagcaagtgttagccgagtttggtttgctttttctttccgttataacaggaaagcactgaattcaatgcctcacaattgctgaactctccctttctgcaccatgccaccattgttgggggatgtgggaaaaatagtgtaaaagattcaagactgttattcctacccgttcagtgcctctttcagcaatatgaagttaaaaccaggtaccatgagtgctcacctgacttttggttcttacgaaggtgctttttaaatgtaggtcattgttaaattggtgtccttgcaggggggatggttggcgaagccttccattctaccatcttgatgtacctatgagccatctatgacattttaacttaattagtttaaagctacataaccatataagctttccattgtctaaattattagaggcccaattttaagataaatttttggcctctacatttctttattataacatttagtaaatagaaaattatcaaaaaactattcaaaacatttagtctgtaactgtcattgctaccatacaataaattctatgagggcagggactcagtctgtgattcacaggttctctgatatgtgactgctctttgtgggaatttaacctctgcataaaataatgaatacatgtctgcacatttaaaaaataattccacataaaatgtagatctatctgattatcttaggaaactgtatattccttccacagcatgaagaggttatactgtttatcctggggtcatggcttaggagaacaatgggcctgactatagaaaaaaacaagcggtaatcagtttagagttgttcataagccaacaatttgaattatacaaaataaccatatatactgaaaagatgtaggagagagtgtaaaatgatacaaaggtgctcctttaggacaaagatgctttgggtgactctggactcatgtgagaatttaggagtggtgttggacctatgaatatgttggacccaccacttgtgttgaacagaataaaggtcatggagctgttggcccaggttataatttccaaacacaaaacactaaaaaatgataaaaacatgacatgtcataaatgtggaattctgttattaactactccagaacagtgtttaaaataatctttgtgttctttatggtgttccacttaccagtaacatacacaggaaaaaatgacatttacaagcctattcagaattcagcacataatttggatattagagattcaaatatatttggaagcatgtagtttaagctacgttcacctgaggttttgggggctgatggtgatgacctgggagatactcaagaggcagatggtgccaatgcacatgctgtggccactctgtgaatacagaaaacaactttctatctaatattactgaaaaaatatttcaactccaaatcagtcattgtctaagggacctttttggagagtaccaaggagttggccataggtgcttgagagtcaaatctgtgtatcacaatgtgcatctggtaattaaagaaaatctgatgtcaaggaagaaaaaaaatccaactatttaactatggtctgagataagatcattcctactgctatattactggagacaatctgatattttcaagtaactgataatttcatttccatgtgaggagatctttcatggacagatgaggtctgttttatggagaaaatagaaacattctactgtgtacttcccattgtatccaactcagaaatattttattgaaacttttatttcacaatacttttgttctaaagagaaaaacatatatattcccactatactataacactactctagaatactataacaggttttacatgtatttttatcatacatctacaatgtgctttattgttccctttttacaggtaaggagatattaaacaaaagaaggctgaatgacatttctaaagtcacctcattgtaaaaagaaagtttcaggtgtagacaatgtgcttatccactatgtttctcaatcttacagacacagatacactttaatatgtcacaaatttgttatttttaattttgcatatttgtcagttataaaatatatttgtactttaaaagagttttgattgtagcgatctcatttaaatctaaccaaattaaatctaaccatttattacagggaaaattgtatttttagtgaatgaaaacatcaaataaagttatttcaatgttagaatcattaaatatattaaaacaaatccattttggagaggaaaactggaggcacagatacttatttacttaaataattgaaatagttgaatattaagcctggcaagggtttagaattttttttttctttgagacggagtctccctctgttgcccaagctagaatgcagtggcacgatcttggctcaccacaacctccgcctcttaggttcaagtgattctcctgcctcagcctcccaagtagctgggactacaggcacatgccaccatgcccggctaatttttgcatttttagtagagatgggctttcactatgttggccaggctgcggctttagaatatttttaaaccaagaagaaatgtcacaaactattcaattctgaaaacaattgaaatccatgcttttttttttctaatgtgaaaacattaaggtcatcaagttacctttccttgaatcctccttccctgatttaatgaagcaaatagtcttatcataattgacaaagaccagatgttttctgtcgccatccaattatgatctttcttaagtatataatatgccctagcaggtaaaataacacaacaaaaaacctacatttaatatttttgaaaagaataagataattcaatcagctacattctatgcactttatatgcatgaaggtattggagaaatatatctactaatcttggagtcattcctgactcttgtagagaaaataagagttagcggattaatagtcaaaatgtattgaagaacttttcataaaacatattccatatctttatacatcacaaagcaacaatgaggaccactgagaattacattatattaaattatgatcagttatggaatggcttatgttcttgatattatattctttccacaatttcagcctatgagttagtaattatttcacaccttatgcatggttttggcagtggtcagtttctggaacagaagagttactttttcagacaaggcacaacctacaacaaatttaatttaaagatggaattggcttatatttgtaattgtagagttttatggattctactttgaggctcaaacagcactaattcacttgggttagcttcaaatgcattatgaagtcaaacttagccagttttttggtatcaatatttgttgtctaagattccccaggtcttcctggatattaatgcaccattacatgtgcattttgtttaattttggttcagagaaagcagatggtacctccagatgtggcccctaaacaatccctgcagctcaactctactgaacccacagagcccactccgtgtcctcaatctaggtctggagtgaagctttgcccaagacaatctatacagagccttttcacaagtgccatttcatgaaatgacagttaaataaagatgggaggagactgaggtaaggtcctgggtgagtgcaagccaatgtgtcaggtaggagactgcagaatcaaaggttagtcagtgctaaacacagcactgcattaagaagataatcaaccaagaatgactatcacctgggttgatattgccattcttcatgtctctttcttttctctctttctccagacttctttcttagataagatcagtcctgagaagtcacttcacaatgtataatatgacatttagaacttcaaatatgccttttttttttggtgccacaatccagtaattaggaagaaactcacatgttgaaaaaaggttctatgctgaccagtagaagaaaaaaaaaattcacactgaaaactcttatatgaagtctgggcattgtggctcagcactttgggaggcagaagagggtgaatcacctgagctcactttgggaggcagaagagggtgaatcacctggggaacatggtgagacaccgtctctacaaaaatataaaaattagctgggcacggtggcattcgcctgtagttccagctacttgggaggctgaggcaggataattgcttgagccccagaggcagaggttgcagtgtgccaagattgcactattgtactcctgcctgggtgacagagtgagactttgtcttaaaaaaaaaaaattacatggagacaaacaaatgatctatttctactcttttccccaaattactatctaatgttagtgaagcccacacattaggtaacagccaggggtatgtggctggactcatcctccctttcaaatcacaaaaccctcagtttctgctagtccctgctgagcatagggtcaccaggggagaatgaacacagcttttcatttcttgtggtcctgcatttcccagccttccttccatttctgagccctaacccggaaactattcttttatgctccatcctgcatgctgaagttgaccttttggtttatttttttgtcacactcgagcctgagtgtgacaaacagggagagaaagagagagagagaaaaaatgagagtaaggggagaaggtcttaattgtaatattaattatcttttacctttgttcactcatttatttattggtctttcatactgtttgctattttttgttattgttatatattcactgttggtgtttaaatttattttgagacagatgttggtcgcaagtgttggacttagccaacagcttgcattgtctaaagtcgaccaggtggctcttgccggcggtagtaccacacaggtccagcagagggatgcaatggtgattcactgtggcctccatctccccggtcttgcccaggtggtctacccatcttggccttccgagtagtacgtgggagtactcgcattttcttcttctgtttgttctctaaccccactttcagattgtttccatagtacttagagtgatttgttgttgtttttcttctttgttcttttctctattttccttagctccttcctggacattgaaattgaagttttagattttattttttgtcacactccagcctcggtgtgacaaatggaaaaaagagagagagagatagaaaaaagagagaggaaaggagaagatctcaattgtgatattaattaccttataccattgttcactcccactttattggtctgtaatattggttgttattctttgttattgttaaatatttactgttgggtttttttgtttatttattttgagactgatatcggcctcgagcctcggacttagcttccagcttaccatctttaaggctgaccagatgactctcgctttgccatatctaaggtcgactggatggctgtcgctggaggtagtaccattcaggtccagcagagggatgcgattgtgaatctctgcgtccttgatctccctggttccacccaggtgatcttcccatctcagcctaccagtacctgggactactcggaccttcttcctctgtttttttcctaaacacacttccagtttgtttccacaatacttaagagtgacttgttgttgtttatcttctttgttcttttttctttctattctcctatgctccttcctgtacgctgaagctgaccttttggtttgttttttttggtcacactccagactgggtgtgacaaagagacagagagtgtgtgtgtgtgtgtgtgtgtgtgtgtgaaaataaatgttaattttgacactaattaccttttacctttgttcactcccatttatttatttattggtctttaattttttttgttgttatgtatttactgtaggtttttaaatttattttgagacagatgtcagtcgcaagcgttggacttagcctccagctttccatgtctaaggttgaccagatggctctcgccttgccatgtctaagatcgtccatatgattttcaccagtggcagtaccgttcaggtccagcaggaggatacgatggtgattcactctggccttcacttccccggtcttgcccaggtggtcaacccatctcggccccttgaatacctgggactactcggaccttcttcctctgttttttctaaccccattttcagtttctttccacagtacatagagtgatttgctgttgtttttcttctttgttcttttctctcagtattttcctacactccttcctgcacactgaggttgacttttagatttttttatcacactgtagcctgggtgtgacatacagggagaaagagaaaagagatcttaattgtgatattaattaccttttattattgttcacttccacttatttattggtcaataatattgtatgttactatttctttattgttaaatatttactgttgttttttgtgtatttattttttgacagatctcagccacaagcattggacttagctgccagcttgccatgtctaaggtcaactaggtatctcttgccttgctatgtataaggtcgagcagatggctctcgctggtgacagtacagtttatgtgcagcagagggatgcgatcgtgattcactgtgacctcaatgttcccagtctcacctgggtgatctatccatcttggcctcccgtgtacctgaaacaaccttcttcctctgttttttatctaaccctactgatagtttgtttccaaagtacttacagtgacctgctgttgtttttcttctttgctcttttctgtgttttcctatgctccttcctcctcagtgaagttgaccttttaaatatttttttatcacactctagcctgggtgtgacaaaggggagagacacacacacagaggagagagagagaaagatcttaattgtgatattaattacctttgttaactctcatttatttattggtgtttaatattgttatcatttctttgttattgttaaatatttactttttttgtttatttattttgagagacattggcagtgagcattggatttagctgccagcttgccatgtctaaggttgaccagatggttctcaccctgacatgtattaggtcaaccagatggctcttcccttaccatgtcgaagattcaccacatggctctcactggtagcagtactgttcagttccagcagaaggatgtgatcgtgattcactgcagcctcaatctccctggtcacacctgcgtgttcttctcatctcagcctcccaagtacccgggactactcagaacttctttttctgtttttgtttgtttgtttgtttttttctcaacccactttcagtttatttccacagtacttatagtgacttgctattgtttttcttctttgttcttttctctattttcctacacttcttcctgtaagctgaagttaacctattttcttttctttctttctttttttttttttgtcacactccagcctgggtgtcacaaatggagagaaagagagaggagaaaatcttcattgtgatatttattgtactctacctttttcactcctccttatttattttctttaatattgtttgttattatttctttgttattgttaaatatttactgttgggttttttgtttatttattttgagacagctgttggctgtaagcattggacttagccaccagattgctatgtctatggtcgaccagatggctcttgccttgccatgtctaaggtcctccagatggctcacgttttgctgtctaaggttaaccatatggctcttgtcagcagcagtcccattcagctccagcagagggatgcaatcctgattcactgcagccttgatctttccagtcttatccaggtagtcacacaacaaaacgtcaacctcggcatgcaggaaggagtgtaggaaaatactgggagaaaagaacaaagaagaaaaacaacagcaaatcactctatgtactgtggaaagaaactgaaagtgaggttagaaaaaaacaggggaagaaggttcgagtagccccaggtattcaagaggcagagatgggtagaccacctgggcaagaccagggaggtcaagggccacagtgaatcatgatcgtatcttcctgctggacctgaacggtactgccactggcaagagtcatatggatgaccttagacatggcaaggccagagccatctggtcgaccttggacatgaaaagctggcggctaagtccaatgcttgcaaccgacatctgtctcaaaatatatttaaaaacctacagtaaatatataacgataacaaaaaataataaaccatattaaagaccaataaataaataaatgggagtgaacaaaggtaaaaggtaattagtaccacaattaagatttattttctctctctcacacacacacactctctctctctgtctctttgtcacacccagtctagagtgtgaccaaaaaaaaaaaaaaaaaacaaagattagcttcagcatacaggaaggagcataggagaatagagagacaaaagaacaaagaagataaacaacaacaagtcactctaagtattgtggaaacaaactggaagtgtgtttaggaaaaaaaaaaaaaaaacagaggaagaaggtccgagtagtcccaggtactcggtaggctgagatgggaagatcacctgggtgggaccagagagatgaggccacagtgaattacgatggcatccctctgctggacttgaatggtactacctccagcaagagccatccagtcaaccttagacatggcatagcgagagtcatctggtcagccttaaagatggtaagctggaagctaagtccaagccttgaggctgatatcagtctcaaaataaattaaaaaacccaacagtaaatatttaacaataataaagaaagaataacaaacaatattacagactaaccccactttcaatttgttccacagtacttagagtgacttgctgttgtttttcttgtttgttcttttctttattttcctatggtctttcatgcacattgcagttgaatttttaggttatttttcatttgtcacacttcagcctggatgtgacaaaaggagagagacagagagagaagatcttaattgtgatattaattaccttttttttcgctcccacttatttacttttggtccttaatattgtttgttatttctttgttattgttaatttttttttactgttggtatttttgtttattaattttgagaccgatgccacccatgacccttggacttagctgccagcttgccatgtctaagtttcactagatggctctcacctgtggcagtaccattcaggtccagcagagggatgcaactgtgatccactgcagccttcatctccccagtctcacccgggtggtcttcccatcttggcctccttgagtacctgggactactgagaccttcttcctattttttttctaaccccactttcagtttttttccagagtacttagaatgacttgctgtccttttgcttttttttttcttttctctctctcttttcctacgtagctttctacacgcttaagtttaccttttagggtgggaggagccaagatggccgaataggaagagctccggtctacagctcccagcgtgagcgacgcagaagacgggtgatttctgcatttccatctgaggtaccaggttcatctcactagggagtgccagacagtgggcacaggacagtgggtgcagcgcaccatgcgtgagccaaagcagggcgaggcattgcctcactcaggaagcacaaggggtcagggagttccctttcctggtcaaggaaaagggtgacagacggcacctggaaaatcgagtcactcccaccctaatactgcacttttccaatgggcttaggaaacggcgcaccaggagattatatcccgcacctggctcggagggtcctacgcccatggaggctcgctgattgctagcacagcagtctgagatcaaactgcaaggtggcagcgaggctggggaaggggcacccaccattgcccaggctcgcttaggtaaacaaagcagctgggaagctcgaactaggtggagcccaccacatctcaaggaggtctgcctgcctctgtaggcttcacctctgggggcagggcacagacaaaccaaaagacagcagtaacctctgcagacttaaatatccctgtctgacagctttgaagagagcagtggttctcccagcacacagctggagatctgagaatgggcagactgcctcctcaagtgggtccctgacccctgacccccgagcagcctaactgggaggcaccccccactaggggcagactgacacatcacacggccgggtactcctctgagacaaaacttccagaggaatgatcagacagcagcattcgcggttcacaaaaatccacagttctgcagacaccgctgctgatacccaggcaaacagggtctggagtggacctctagcaaactccaacagacctgcagctgagggtcctgtctgttaaaaggaaaactaacaaacagaaaggacatccacaccaaaaacccatctgtacatcaccatcatcaaagaccaaaagtagataaaccacaaagatggggaaaaaacagagcagaaaaactggaaactctaaaaagcagagcacctctcctcctccaaaggaagcagttcctcaccagcaatggaacaaagctggacagagaatgactttgacaagttgagagaagaaggcttcagacaatcaaaccactccgagctacaggaggaaattcaaaccaaaggcaaagaagttgaaaactttgaaaaaaatttagacgaatgtataactagaataaccaatacagagaagtgcttaaaggagctgatggagctgaaagccaaggctcgagaactacgtgaagaatgcagaagcctcaggaaccgatgcattcaactggaagaaagggtatcagtgatggaagatgaaatgaatgaaatgaagcaagaagggaagtttagagaaagaagaataaaaagaaatgaacaaagcctccaagaaacatgggactatgtgaaaagaccaaatctgcatctgattggtgtacctaaaagtgatggggagaatggaaccaagttggaagacaccctgcaggatattatccaggagaacttccccaatctagcaaggcaggccaacattcagattcaggaaatacagaggatgccacaaagatactccttgagaagagcaactctaagacacataactgtcagattcaccaaagttgaaatgaaggaaaaaatgttaagggcagccagagagagaggtcgggttacccacaaagggaagcccaccagactaacagcggatctctcagcagaaactctacaacgcagaagagagtgggggccaatattcaacattcttaaagaaaagaattttcaacccagaatttcatatccagccaaactaagcttcacaagtgaaggagaaataaaacactttacagacaagcaaatgctgagagattttgtcaccaccaggcctgccctaaaagagctcctgaaggaagcactaaacatggaaaggaacaaccagtaccagccactgcaaaatcatgccaaaatgtaaagaccatcaagactaggaagaaactacatcaactaacaagcaaaataaacagctaacatcataatgacaggatcaaattcacacataacaatattaactttaaatgtaaatggactaagtgctccaattaaaagacacagactggcaaattggataaagagtcaagactcattagtgtgctgcatacaggagacccatctcacgtgcagagacacacatagactcaaaataaaaggatggaggaagatctaccaagcaaatggaaaacaaaaaaaggcaggggttgcaatcctagtctctgataagacagactttaaaccaacaaagatcaaaagagacaaagaaggccattacataatggtaaagggatcaattcaacaagaagagtgaactatcctaaatatatatgcacccaatacaggagcacccagattcataaagcaagtcctgagtgacctacaaagagacttagactcccacacattaataatgggagactttaacaccccactgtcaacattagacagatcaatgagacagaaagttaacaaggatacccaggaattgaactcagctctgcaccaagcagacctaatagacatcctcaggactctccaccccaaatcaatagaatatacatttttttcagcaccacactacacctattccaaaattgaccacatagttggaagtaaagctctcctcagcaaatgtaaaagaacagaaattaaaacaaactgtctctcagaccacagtgcaatcaaactagaactcaggattaagaaactcactcaaaaccactcaagtacatggaaactgaacaacctgctcctgaatgactactgggtacataacgaaatgaaggcagaaataaagatgttctttgaaaccaacgagaacaaagacacaacataccagaatctctgggacacattcaaagcagtgtgtagagggaaatttatagcactaaatgcccacaagagaaagcaggaaagatccaaaattgacaccctaacatcacaattaaaacaactaaagaagcaagagcaaacacattcaaaagctagcagaaggcaagaaataactaaaatcagagcagaactgaaggaaatagagacacagaaaacccttcaaaaaattaatgaatccaggagctggatttttgaaaggatcaacaaaattgatagacctctagcaagactaataaagaaaaaaagagagaagaatcaaatagacgcaataaaaaatgataaaggggatatcaccaccgatcccacagaaatacaaactaccatcagagaatactacaaacacctctacgcaaataaactagaaaatctagaagaaatggataaattcctcgacacatacactctcccaagactaaaccaggaagaagctgaatctctgaatagaccaataacaggatctcaaattgtggcaataatcaatagcttaccaaccaaaaagagtccaggaccagatggattcacagctgaattctaccacagacacaaggaggaactggtaccattccttctgaaactattccaatcaatagaaaaagagggaatcctccctaactcattttatgaggccagcatcatcctgataccaaagccgggcagagacacaactaaaaaagagaattttagaccaatatccttgatgaacactgatgcaaaaatcctcaataaaatactggcaaacccaatccagcagcacatcaaaaagcttatccaccatgatcaagtgggcttcatccctgggatgcaaggctggttcaatatatgcaaatcaataaatgtaatccagcacataaacagaaccaaagacaaaaaccacatgattatctcaatagatgcagaaaaggcctttgacaaaattcaacaacccttcatgctaaaaactctcaataaattaggtattgatgggacatatctcaaaataataacagctatctatgacaaacccacagccaaaatcatactgaatgggcaaaaactggaagcattccctttgaaaactggcacaagacagggataccctctctcaccactactattcaacatagtgttggaagttctggccagggcaattaggcaggagaaggaaataaagggtattcaattaggaaaagaggaagtcaaattgtccctgtttgcagatgacatgattctatatctagaaaaccccattgtctcagcccaaaatctccttaagctgataagcaacttcagcaaagtctcaggatacaaaatcaatgtacaaaaatcacaagcattcttatacaccaataacagacaaacagagagccaaatcatgagtgaactcccattcacaattgcttcaaagagaataaaatacttaggaatccaacttacaagggacgtgaaggacctcttcaaggagaactacaaaccactgctcaatgaaataaaagaggatacaaagaaatggaagaacattccatgctcatgggtaggaagaatcaatattgtgaaaatggccatgctgcccaaggtaatttatagattcaatgccatccccatcaagctaccaatgactttcttcacagaattggaaaaaaccactttaaagttcatatggaaccaaaaaagagaccacatcaccaagtcaatcctaagccaaaagaacaaagctggaggcatcacactacctgacttcaaactatactacaaggctacagtaaccaaaacagcatggtattggtaccaaaacagagatatagatcaatggaacagaacagagccctcagaaataatgccgcttatctacaactatctgatctttgacaaacctgagaaaaacaagcaatggggaaaggattccctatttagtaaatggtgctgggaaaactggctagccatatgtagaaagctgaaactggatcccttccttacaccttatacaaaaattaattcaagatggattaaagacttaaacgttagacctaaaaccataaaagccctagaagaaaacctaggcattaccattcaggacataggcatgggcaaggacttcatgtctaaaacaccgaaagtaatggcaacaaaagccaaaattgacaaatgggatctaattaaactaaagagcttctgtacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaccccatcaaaaagtgggcaaaggatatgaacagacacttctcaaaagaagacatttatgcagccaaaagacacatgaaaaaatgctcatcatcactggcaatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaattaccatttgacccagccatcccattactgggtatatacccaaaggattataaatcatgctgctataaagacacatgcatacatatatttattgcagcactattcacaatagctaagacttggaaccaacccaaatgtccaacaatgatagactggattaagaaaatgtggcacatatacaccatggaatactatgcagccataaaaaatgatgaattcatgtcctttgtagggacatggatgaaattggaaatcattattctcagtaaactatcacaaggacaaaaaaccaaacaccgcatgttctcactcatagatgggaattgaataatgagaacacatggacacaggaaggggaacatcacactctgggcactgttgtggggtggcaggagggggaaaggatagcattaggagatacacctaatgctaaatgacgagttaatgggtgcagcacaccagcatggcacatgtatacatatgtaactaacctgcacattgtgcacaggtaccctaaaacttaaagtataataataataaaaattttttaaaaagtttaccttttagattttttggtcacactccagctgggtgtgacaaatgaagagagagagagagaaaaagagtgaagaagatcttaattgtaatattaattactttttacctttgttcacttccacttatttatttactggtgtttaatgtttgttgttattatttctttgatattgttaaatatttactgttggtttgtttatatattttgtgatggacattgaccatgagcgttgggcttagctgccagcttgccatgtctgaagtcgaccagatggcctcgctggtggccataccgtttcaggtccagcagagggatgtgattatgatccaccgtggcctcgatcttggtctcacaagggtagtcttcccatctcagcctctcaagtacctgggactactaggacctacttcctctgttttggttctaaccccactttcagtttcttccacagtacttagagtgacttgctgttgtgttaaatctttgttcttctcactctatttttctatgttcctttctgcatgctgaagttgacctcttagatttttttttgacacactgcagcatgagtgtgacaatcagagagagagaaaaataaagaagatcttaattgtgatattaattaccttttaccctttttcactctcatttatttattggtctttaaaattatttgttattatttcttttttttttttagacggagtctcactctgtcacccaggctggagggcagtggctcgatcttggctcactgcaagctccgcctcccaggttcatgccattctcctgccttagcctcccaagtagctgggactacaggtgcccgccaccatgcccagctaattttttgtatttttagtagagacggggtttcaccatgttagccaggatggtctgaatctcctgacctcgtgatccgcccgtctcggcctcccaaagtgctgggattacaggcatgagccaccacgcccagcctattatttcttagttattgttaaatatctactattgggtttttttgtatatttattttgtaacagatgttggctgcgagcgttggattagttgccagcttgccatgtctaaggtcaaacagatggctctcgctggtgataaggttgaccagatggctctcactggcagtagtattgttcaggcccagcagagggatgccatcatgattcaatgcagcaacgatcttcccgatgtcacccggaggacttcccatctcagcctcccatttaccttggactactcaggccatcttccttcttttttttttctactcccactttcattttgtttccacggtatttagagggggttgctgtggtctttcttctttgttctttgctccatttcttttttcttttttgttaccctccttcctgaacgctgacgtggatgtttaaatttgatttttggtaggtcttctcactgtcacaccctggctggagtgtaggtgctggatcagcagtgagccgttaccatgcccctgccctccagcatgtgtgtgagagtgtgacacatggagatcgatggagagagggacagaaagacagagacacaaacagacagtggcagagagacagaaacagagagagacagggaggcagacaacaattagttgttatattaattacattttacctttgttcactcccacttatttatttattggtcttatcattgtttgttatttctttgttattgttaaatatttatgtgccaggcgaggtggttcacacctgtaatcccagcactttgggaggccgaggcgggcaaaccagctgaggtcgggagtttcagactagcttgaccaacacgaagaaacatcaactctactaaaactacaaaattagccaggcgtggtggcgcatgcctgtaatcccagctactccggaggctgaggcaggacaatcacttgaacctgggaggcagaggttgcggtgagccaagatcacgccactgtactccagcctgggcaacaagagcgaaactccagctcaaaaaaaaaaattattgtttgtttatttgtttatacattttagacagatgtcagccacgagtgttggacttggccgccagcttgccatgtttaaggttgaccatttggctcttgctggcagcggtaccattgaggtccagaagagagatgtgatgatgattcactgcagcctggatctccccagtctcacccgggtggtcttcccatcttggcctcccgagtacctgggactactcagacattgttcctctgttttatttctaaccccactttcagtttgcttccacagtacttagagagagttgctatagttgttcttctttgttctttgctctcattctctctctctctcttattttttttttacgctctttcctgtatgctgaagttgatgttttatatatacacatatatttttttagccaggtcttctcagtctgtcacaccctggctggagtgcaggtacatgatcagcagtgagctgtgaccacacacgttcactccagcctgggtttgacagtgtgacacacggagatcagggaagagagattcagaaagacagagagacagagacccagactaaaacagaaagacagagagaggcagagaaatagagacagagagagatacagttaattgtgattttaattaccttttatttttgttcactcccacttatttatttattggtaatattattgtccattatcatttctttcttattatttactgtcggttatttattaattttgaggcagatgttggctgcgagcattggacttggctgccagcttgccatttctaaggtctaccagatagctctcaccagtagtagtgttcaggtaaggcagagggatgcaattgtgattcactgcgatattaatctccctggtctttcacaggtggtcgtcccatccatcttggcctccagagtacctgaaaatacttggactttcctcctctgttcttttttttttccagctccacttttagttttcttccgcagtacttacagtgagttgctgtggtttttttttttttcctttcttctttgctctttctctctcttttattttcttatgctcctttctgcatgctgaaattgacgtgatatatatatatatatatatatatatatatatatatataaaattattatttttagctaggtcttcctactgtatcacattctggctggagtgcaggtgagtgatcagcaatgagctgtgaccacacacgtgcactccagcctgggtgtgaaagtgtgacacatggagattgaggaagagagagacagagaaagagagacaacaattaattgtgacattaattaccttttatctgtgttccctctcacttatttgtcttgttattatttgttattacttattattgttaaatatttactgttagttgttagtttatttatgttaagacagacttcagccatgagcattggacttggccaccagcttgccatgtctaaggtagaccagaaagcggtcaccagtggcagtactcttcaggtccaggagaaggatgcgattgtgattccctgcagcctcgatctcctcagtcttgcccaggtggtctttccattcggcctcccgagtacgtgaaactactcaagcttcttcctctgtttttttttctagccccacttttagttggcttcaacagcacttagagggagttgctgtggtttttcttctgtgttctttgctctctctctctttttaaaatcttttatgctccttcctggatgctaaagttgatgagatccacccacctcagcctcccaaagtgctgggattacaggcatgaggcaccgcgcctggctttaattttgtatttttagtagagacaggggtttctccatgttggtcagactggtctcgaactcctgacctcaggtgatccactcgcctccgcctcccaaagaaaaactggtctaagatctagctattttcttaaattttaggtttgattagctcacttttggcatgagtgactcattttgttttgttttggtctgtttgggaagagtgcacatgctcagtccagatgatggccataaataattttgtttaaaaaattcaccccaggccgggctcagtggctcaggtctgtaatctcagcactttgggaggctgaggctggcggatcaaaaggtcaggagatccagaccatcctggccaatatggtgaaaccccgtctctagtaaaaatacaaaaattagccgggcgtggtggtacacacctgtagtcccagctactcgggaggctgaggcagaagaatcacttgaacccgtgaggcagagtttgcattgagccgagattgcaccactgcactccagcctgggcaacagaacaagattccatctcaaaaaaaaaaaaaaattaccctatttgtaagctctcacataggtcacggtgtgaccaaaactcagggccttagtgccactctgtttccattatctttttttctttcttttttttttttttaagatgaaatctcgctttgttgtccaggctggagtgcagtggcactatctcagttcactgctacctccacctcctgggttcaagcaattctcccacctcagccttccgagtagctgggactacaggcccatgccaccacggctggctaattttttgtatttttagtacagacagggtttcaccgtgttacccaggatggtctccatctcctgacctcatgatccacccacctcggcctcccaaagtgctgggattacaggcctgagccaccacaacaggccaatttttgtatttttagtagagatggggtttcactatgttgcccaggcttgtctcaaactcctgacctcatgatccacccacttcagtctcccaaagtgctgaggttacaggcaccgcacctgtcctattttgggtttttgtacttatcatgtcattcataggttatggtgtcttcgtagtcacatgtgtctttgagtttctgccattctggtttaaaagagatcatttgacattttggagatgaccgcatgcaaacatttataacttttgagagaatacggtgaagtagggagacactactatttcaactatcaggagaatgataccaagagtttgaagcatgctttttagccagggtccccacgaaacaccaactaaaattaaataggccgaatagttagctagataagtggtctactcatttcaaccaagcacactgttcattaatccgctgcaactgcatctccgtggatgcagagtaggctcagggagcctacactacgtatttctccatgtgcaactacaagtgttagcaacttcataggtacttctctgttcatccaataagtaattaaaagaaataatattattgctgggcgcagtggctcacgcttgtaatcccagcattttgggaggctgagacaggtggatcacgaggtcaggagatcgagaccgtcctggctaacatggtgaaaccccatctctagtaaaaatgctaaaaattagccaggcatggtggtgggcgcctgtagtcccagctactcgggaggctgaggcaggagaatggcgtgaacctgggaggcggagcttgcagtgagccgagatcgagccactgcactccagcctgggcgacagagcgagagtccatctcaaaaaaaaaaaaaaaagaaagaatgaaataatattatttagcacaactttagtaagtaaatttaaaatatattgtgtaatcatagcctttacagtataatcttctatagagccctattggggggatacatttctaaccattgcctcatttactttataccatggaaagaaagacctaacaaatcatggccattcagaagagtaagggcatcctggaaatgctccttaacttattgtgaaaaagttgtccttaacttatgaagtaggttaagagcagtggaccaatattctgtttctgatattgtgagggaacaaatatcccataaaaatttctcacacaggctggcccttcatcttttacctatcaaggtgtaagttttttcatatataatgttggctgcaaaattctctacatttaagtataccccataagtgcacacaagagaccccttctttatttctattgtttgtagagccataaaaaactgtgaaataagtgtgtcatgatagcagagaagtatgatcatgttctgagtgtgtctcaccatgaaacaagcaaaaaaaaaatactgctgttattttgagatagtgagttagcattttgtgcaaatatgtactatgtaattttttattgatatgtaacatgcatagagaaatacatgaagaaattcttcattcaagtaaagctcagtgaattgttatgaagaaatatacttgtgtaatcagataataaaactaggccgggcacagtggcttatgtctgtagttcagtacattgggaagccaatgcgggtggattgcttgagctcgggagttcaagaccagcctacccaacatggcaaggctctgtctctactttaaaaaaataccaaaaaaaaaaaaaaaagaaccaggcaggctggtgcatgccggtggtcccagctactggggaggctgaggcaggaggatcacttaagactgaaagtttgaagctgcagtgacccatcattcagccactgcactccagcttgggttacagagtgagacctgtatgtgtaaacacacacacacacacacgtgcacatggtgggggatatgaaaaagagaaagtgtggctcctgcaattcagtgagacctggttctccatcttgggaactgcccatccacactgaaaccacaacctagcacatgccaattcttacgctaaacctgctaagataccactgtttacccttaagaaaaaaactgaagtatttcacctaaaagaagggaaaaagaaaagaaggatttcacatccaaagcctttgtttcctttataaaacaacagccccttgtcatttgagttgtccagaggtgtctgacaacactaacacacttatggaatcagccaggaaaagtgagcctctcaggtgacaaagaggcacaatggtaactaaagacaatccattctcatctctacatgatgcccccctctcatgaagtggtgttaaccatgtgaaccatattcaccagaggaaagtatgttcagggcaacacaatcatgaggttgcaaatcaaaccaggggtgggaagcacataggaggtttccatggccaagacactggtggctatccttgggtgtcatttaaaaatttcaggtgaaaaatccttttcttccagttggctcaggaaaactaacagacattacaattggaattcgttttactttttagaatttctaagacataaagcatgcttcaaacactccaaaagacattcagctatacctgaggctgaggacctgcctccttctccacgttagggccctgacagcaggcaaagagaaggagcacaggggccgggtgtggtggctcacagctgtaatctcagcattttgggaagctgaggcaggcggatcacctgaagtcaggagtttgagatgaggctggtcaacatggcgaaaacccttctctactaaaaatacaaaaattagccatgtgtggtggtgtgcacctgtaatcccagctactcaggaggctgaggcaggagaatcatttgaaccgaggaggtagaagttgcagtgagtcaaaatcgtgccattgcactccagcctgggcaacaagaatgaaactgccatctgaaaaacaaaacaaaacaaacaaacaacaacaacaacaacaaaagagagaaggagcacaggcaggtggggacagagagcagcccaggcctatagggatccccaacaacccccagagccaccctacagtgtctgtaggagggactgtgtggcaaaaatcaggtagggagctgggcttcatggagaggttaccaccacttctgtatctttaacttttcccaaggatttatgattccactctggttctccccaggtccccaacccatcctaccctcactcccacactgtgtgtttatgtgggtctggttaaaatgaggagaataatacttccagattgtagccttcaaggtattcccatctggggtatggggagtagggaggcaagtcagagtctgtggtggtgcttacttctgggtctgagggcaggaaggccagggctgggcacatggatatctggggaaacaccactgttgattccttctccccacccggagctacaaccaggccagggcaatcacaattaataaaaccactgcagctcacatcctacacgaaactaaagtgtaccccaacacccagtcctaccacagatcgagaacttcccatcccagaacacaggaagccctccgtctttttgacctaaagcctggactttaagccaggttgggcttgggggtagtggcagcaaaagcagcagccacaaggtcaaacataccaatgacctgagaaatctcatctgcacatcattcactcagaacagacctggggttgtgaacaaattaagaaaaaggccagatctatacactcatgggcatggacaccttccacacttgctggggagaatgagaggcacctgtttcccagctgcaagctgatgtccacatacacccattcatgtgtcttcatttaggtctctgcattgtatattcattgaaccaatacaaacacatcttcagtggtgggaggaggggggacatcatttagtgcaacaccactccccatttgttatagggggcactcaggaggtatctggtcagctcctaattccctaggacaaaggtggcgccccatttccagcactcacatccagcagcgccatctcagattttttttttttaaacatgaacagcatgaggaagcaggcatggtacgacaggctcagggccacagacagctggctgctggagaagcagcacaggcagtcacatctgtgggtggggccatgacaagacaaggccaccatagttcctacccctgacagccctagcccagatagcattcaaatcttccttgatgggcttcatggctgtcactcaccggctctttagcaccgccttgtgttggttactcagggcctgggagaggtagtggggatcgtagatccagggtgggaagcacctcacacccagagttcacctggccacaggccagcaagcaagcccaagcagcacagttctagacactgagcctcggcacctccagctgcactttctatttatatatcaggtttttaaattccataaataaagagacacaaaaacagccactttgattgaggagaaagtgggagcctaaagcagctgaccctcaaacatctccaccaagccccaggccaggccaggccatctgaacactccaaggccacatgatagttacagaggatgacagttcccacaggtacttgtcaagcactgtgctagcttctcaatcacagtctcagaatgcctccttgccaataccctgtgaggggaggctctgcctcactagagcacaggagtttcctaagctcttcccaggaaatggttagcaaagtgtcgagctaggagaaagcccagtcagaacaagtgactccccagggtcttcctagactccatctgctcctccacatgccgcccggaggtgatatgggcagcctcctaaccccctccatcccactctctcctcaatcaaagtggctgattttgtgtttgcttgtttctttatgggattttaaaaacctgatattttatttagagtagtttcaggcttgtatgtgtgtatttgtatagactttattagaaggaagagggcttaatataataacattttttttcttttttttgttattgatcattcttgggtgtttctcacagagggggatttggcagggtcataggacaatagtggagggaaggtcagcagataaacaagtgagcaaaggtctctggatttcctaggcagaggaccctggggccttccacagtgtttgtgtccctgggtacttgagattagggaatggtgatgactcttaacgagcatgctgccttcaagcatctgtttaacaaagcgcatcttgcaccgcccttaatccatttaaccctgagtggacacagcacatgtttcagagagcaccaggttgggggtaaggtcaacagcatcccaaggcagaagaatttttcttagtacagaacaaaatggagtctcctatgtgtacttctttctacacagacacagcaacaatctgatttctctatcttttccccacatttcccccttttctcccttttctattcaacacaactgccgtcgtcatcatggcccgttctcaatgagctgttgggtacacctccccagatggggtggcggccgggcagaggggctcctcacttcccagaaggggtggccgggcagaggcgccccccacctcctggacggggcggcggccgggcagaggagccccccacctccctcccggacggggcggctggccgggcaggggctggcccccacctccctccgggtcggggcggctggccgggcgggggctggcccccacctccctccgggacggggcggctggccgggcgggggctgccccccacctcctggacggggcagctgccgggcggagacgatcctcacttcccagatggggcggctgccgggcggaggggctcctcacttctcagacggggtggctgccaggcagaggggctcctcacttctcagacggggcggccgggcagaaacgctcctcacctcccagacggggtcgcggccgggcagaggcgctcctcacatcccagacggggcggcggggcagaggcgctccccatatctcagacgatcggcgcccgggaagagacgctcctcacttcctagatgggatggcgccgggaagaggtgctcctcacttcccagactgggtagccgggcagaggggctcctcacatcccagacgatgggcagccaggcagagacgctcctcacttcccagacggggtggcggccgggcagaggctgcaatctcggcattttgggaggccaaggcaggcggctgggaggtggaggttgtagccagccgagatcacgccactgcactccagcctgggcaacattgagcactgagtgaacgagactccgtctacaatcccggcacctcgggaggccgaggctggcggatcactcctgattaggagctggagaccagcccggccaacacagtgaaactccgtctccaccaaaaaaatacgaaaaccagtcaggtgtggcagcgcgcacctgcaatcgcaggcagtcggcaggctgaggcaggagaatcaggcagggaggttgcagtgagcagagatggcggcagtacagtccagcttcggctcggcatcagagggagaccgtggaaagagagggagagggagaccgtggggagagggatgggggggagggggagggggagagggagagggagagggagaataacatttttaaaatgtctcagtggggaatagacttccatgtcagaaaccatgatgttggcctatttctgctgcctttgagcaaagtataaatagtgtgagaactggcatgtgctgggttgtggtttcagtgtgggagagcagttcctcaagatggaaaaacaaatctcactgagccgtaagagccatgctcatcttttaccacattcccaaccagggtctttcacttttcttctgtgcttgaatttctttcaacatacatattattttgattatatacatagggtacatatatatgtgtgtatatatatatgtatgtgtctctgtgtgtgtgtgtgtgtgtgtatacactctgtcacccaggctggagtgtagtagctgaatgatgggtcactggtcactgcagcctcaacctccagtgatggttccacctcagcctttcaagtagctgggactacaggcatgcaacaccacatgaggccaatttttaacgtttttgttgagactgaatctcactacattgcccagactggtcttgaactcctaggtttaagcaatcattccaccatggtcttccaaagtgtttggattacaggtgttagccatcaaactctgccaaaaatattttttaaggaactgttacaaccaagttattagctatggttgtgccactgtactccagcctaggtaccagagtgagaccttgtctccaaaaacaaaacaaaacaaaaaaacttacgaccaaattaaaattctaaggttgtgtcatatgtgtccccttcctgccctgtaagctatcactgttaaatataatggtattggccgggcacggtggcaaatggctgtaatcccaacactttgggaggccgaggtgggcggatcacctgaggtcaggagttcaagaccagcctgaccaacacggagaaaccctatctctactaaaaatacaaaattagccgggcgtggtggcgcattcttataatcccagctactcgggaggctgggaggattgaggcaggacaatcgcttgaacccaggaggtgggggttgaggtgagctgagatcatgccattgcactccagcctgggtaacaaaagtgaaacactgtctcaaaaaaaaaaaaaaaaatatatatatatatatatatatatatatatatatatatatatatacacatacatatacatataaaatgggtattgagaaaactgttatatattattaagaaattcctggctgggcgcggtggctcatgcctgtattcccagtactttgggaggccgaggcaggtggatcacctgaggtcaggagtttaagaccagcctggccaatatgatgaaaccctgacagacccagggcatggtggtgggagcctgtaatcccagctactcgggaggttgaggcaggagaatcgcttgaacccaggagaagaaggttgcagtgagccaagatcacacgattgcactcccttctgggcaacaaaagcaaacctccatctcaaaaaagaaaaaattcctatatattctctaaatgagaataagttattctgatgtgacccaatatttcctcactcttacctccatggtctaacccagcaaatcaaatcaggacacccacaaaggacagttggccattttcaaatagaaataaaatagaaaataaaataccccattagtgacagtaatccagtgattttaaaaaagagaagtcagattgagatgcagtgcagtcagggcacaattaccctggaatacacacttcacacagaatgattgagaagtctttctaaaataaacaaatttgggtaacataatttttgcttaaccattctcagccaccgctttcccccacccctgccccattcctaatggccatcccacgatgtggtcaacagcgtggtatagcatgatgagagaggtactcagggatgggatgagggtctttcctgcattatcaaaatcattaaaaagttgttaaaatatgttcaaatgggccgggcatggtggctcacgcctgtaatcccagcactttgggaggctggggtgggaggatcacctgaggtcaggagttcgagaccagcctgcccaacttggcgaaaccccgtctgtactaaaaatacaaaaagtagctgggtgtggtggcatgcgcctgtaatcccagctactcgggaggctgacgcaggagaatcacttgaacctgggaggcagaggttgcagtgaaacaagatcacaccattgcactcaagcctgggcaataagagcaaaactcagtctcaaacaaacaaaaataatccaaatgttcttttcttacccttaagtagcaaataagatgcattatacaagcagacccaggtaagggaaagagcaagttcatttcaagtctcagcttacttcttaattggctgtaattccctatggttgacactccctgctttagcctgttttcctgggggtggagggagtggtactgggcgagtgctggtgctttatcgaatcagtggcacagttggagaggagggcgtggcatccggcatttggcggggcttttgtctctcgctgcagccagagcttgggatcgctttctgctattcaacgtcctccacctctgcccccctctccccccagccggtgacaggctgttgccctgtgatctgcaggtcctgggacgtgcacagacagctaagatgccaggacattccagaaggtgggaaagggtgagtgtgaggggttgagcatcccgagaggggagagctggctgagaaaccgacgggactggcctcctcaccgctcctgggttgccgacctgagtccctgctggcgcagctccgtcccaggtccctctggccgcaagatggtggctgggcccgcagcaatgacccgcgcgtcccgcccagtccctgcggcgccctatctggagctccctgggcagctctgcacgcagccccgagtgtttcccagattgttcagggatgccaggcgggtcatcagggcagaatcccgactcgtgtgtgcgtaggaggagctgtggccggtggggctcccagtctcttttgttaaacattttgttggtttgtttgagacaaagtcttgctctgtcgccgaggctggagtgcaatggcgtgatcactgcaacctccgcctcccaggttcaagcgattctcgtgcctaagccccccgaaaagctgggattaaagacctgcaccaccacgcctggctgatttttgtatttctagtagagaagtggtttcgccatggtggaagctggtctggaacccctggactcaagtgatccccccaccgccgcggcctcccaaagtgctaagattacaagcatgagccaccgcgcccagcttcttctcttgcaaagtaaagggagtcaacgttaaaacgttaacgagtttatctgagcagtgattagtgaaatggaaagcacccagccataatatgtgggccacctgaaaggcaaaaagggaagggttttgaaaagggcgtgtgagaaggcaaaccaaattcaagaattggttacagttatgtagtcaccttatttgtatgattcgggtggaaatttcctggttatgtaatcagaggttaattgcaggttaagcctgaattttgtttctgcctaaaataatttataagaagtgaatccgagataggttttacattttttacttatgaacacagggcactagagccccttcagtctaatttcctgctttttaaataacactccacaggaggactggttttcctctgtgacttcctaatgtatggcaagcaggacttctaatccactacccttttaccctagcttaactcaggcttgtagtaaaattataaatttccacctttgttcctacattctcaaaagtggaaatgagaacaacttcctctctccaatttacaacactatcaactatttgtcctttattttacatttcaaacacagtgtttttgttattaatcatgttcttacacagcagtggatggcaggttttaaaataattgttgtctgtatacaattttttttttttctttttttttttggagatggagtttcactcttgttgcccaggctggagtgcagtgcaatccccgcctcccagattcaagcgattctcatgcctcagcctcccaagtagctgggattacaggctcccaccaccatgcccggctaatttttgtatttttaggagagacggggtttcctcatgttggccaggctgctcttgaattcttgacctcaggtgatccacccgcctcaacctccgaagtctgtaaacattttacgtgagaaaataatcctctggaactccactgttaaaaagaaaaaaaatctctgtgactgtccttttatcttccctggtgcatacaccttgttagtaggtctttcggttgaagttttgctttggagaaattccagggccctttgtggcagccctccggtcttttcttgttcatgattttcagaaccgtcagggataacccaagatgcccacagtggccatatctcttggagtgtctaatgaatatcatcccctgggtcatctcttagaggacagcctgaggaggaagagtgtagcctctcagaagagcagctggatggcttaggcctgtggaaatttcctcgcataccatttgtcttagaaagctaaccttttagaaaattaaaattattttttcacaaaggaacgtgtatacactgttgatgggagtgtaaattagttcaaccattatggaagacagtgtggcaactccttgaagacctagagacaaaataccatttgacctagcaatccattattgggtatttacccaaagcaatgtgaatcattctattataaagacacatgcatgcatatgtgcattgcagcacaattcacaatagcaaaggcatggaatcaacctaaatgcctattaatgatagactggataaagaaagtgtagtacatatacaccatggagtactgtgcacccattaaaaaaaaatgagatcatgtcctttgcaggaacgtggatagagccataagacattattcttagcaaacagaggaatagaaaactaaatactagctggatgtggtggctcacagctgtaattccagcactttgggaggccaaggcaggtggatcatctgaggtcaggagtttgataccagcctgagcaacatggtgaaacctcatctctactaaaaatacaaaaaattagccaggcgtggtggcagatgcctgtaatcccagctactcaggaggatgaggcaggagaatctcttgaacccgggaggcagaggttgcagtgagctgagatagtgccactgcactccagcctgggtgacaagagcgaaactccatctcaaaaaaaaaaaaaaaagcaaaacaaactactacatattctcacttataagtgagagtcaaatgatgggaacacatgggcccatagaggggaagaacacatactggggcctattggaggagggagaggatcaggaaaaatacctaatgggtactaggccttaatacttgggtgatgaaataatctgcacaacaaacccccgtgacacacgtttacctatgtaaaaaacttgaacatatacccttgaacttaaaagttaaaaaaaaaaagaatttggtagcttttccaataattccctgacagcattttgattttatgtgtatatgacacctattaagtatcagacatttggattacacagatgaacagggttcaacatacctgccccataggagtttatagttcattagcatggataggtgtgtaaatgattaatttattctggagagaataacccttgtacataaaaagacttataaagtattgaggagctaaatggtaatagtgatcaattctgccagtgacatagcactgggaaaatcaaggagggctttatagaggatgtgacatttgagtgggtgtcagggtttactagaactttttgtgttaatgctgctagtgcagagtatgctttttttttgagacagtctttctctgttgcccaggctaaagtgcagtggtgcagtctcggctcactgcaacctctgcctcccagcgattctctcacctcagcctccctccgcctttaagcgattctctcacctcagcctcccaagtagctggaattacaggcatgagccaccacacctggccgcagagtaaaaaattatttccagcttggccaacatggtgaaaccccatctctactaaaaatacaaaaacattagtcaggcattgtggcatgtgcctcttcctgagttttttaccttggaaagattttttcacattactatttcagttttttaataactgtaacttatattttatcagaagagtttaaaagatgtttaaaaagtcagactatgaaaggtatatttcagaaaaatctactcatatattttatgtattaaagattcttatttacctttatcttctccagagtgagtgtagtaagtttctcatgtctgcttttcctggttgcatgattttaaatagaaccccagggctttgctttgggaatgctaccagagaaaagaaataggaaaaatctttttttcattatggctatacaaagtgaatatatttccacaagcaaatgtgatagattaattggtgcattgtatatatttctcaaaccatcagctcctcttttttgtggtgtctagaatttgtaacagtggataatctctgttctgtattctgttgtctagatgtccaagtttaatgctaaattttatgagatggaacttgacatcttctagaaatgttcacatatgattgtttattaaattatctatcatggaaatagttaaatgagatgtttatcatctgaaaaggacagatgcttttttttttttttgagatggaatcttgctctgttgcccaggctggagtgcattggcacaatctcggctcagtacaacctttgcctcctgaattcaagcgattctcctgcctcagcctccctagtagctgggattacagttgccagctgccacactcatctaatttttgtatttttagtagagatgggtttcaccatgttggccaggctggtctcgaactcctgacttcaggtgatcctcctgcctcggccttccaaagtgctgggattacaagtgtgagccaccatgcccagccttacttaagctttttatattgtagttgaaaatttaagtcttacaatttccttacactattctataaacagtgtgttggagtgattttgcacttttttgaaacattggtcatttttttaattattattatttatttatttttgagactgagtctcactctgttacccaggctggagtgcagtggcacgatcttggctcactgcaacctgcgcctcccaggtttaagggaatctcgtgcctcagccttctgaatagctgggattacaggcgcatgccaccatgcccggctaatttttgtgtttttagtagagatagggtttcaccatgtttgccaggctggtctcgaactcctgacctcaagtgatccacctgcctcagccttccaaagtgctgcaattacaggcgtgagccatcatgtctggccatacattggtcattttcttatttcaaactaagtgaataatcctgactgggaagtagaagcctgaactcagtgactgcaagctaaggatagttttgcctgcaaagggagatcattgaaaaagcagctcttctgcctgaggagcctcccctgcagatgtcctggcctgctcacaatagccatggacagagcctttatacttagagaagccacagagccttgaaaaccttgaaatccacaggcagatgcagttgggattggcacaaaggtggggttgggaggctctttctgggaatggagttgttattgttctgaggttgtttctagattttgtaaaatatgatgaatctagatttaggtaagaagttatttatttatttatttttattttattttatatttttttgagccagggtctcattctgttactcacgctgtagtacagtggcatgatctcggctcactgcaacctcagtctctcagattcaagccattctcctgccacagcctccctagtagttgggactacaagcaggcacatcaacgcccacctaatttttgtatttctagtcagaaggttttgcaaagcctcctgggagaatagctgaaggcagctgctttataaccctgaggcagagggcaaggagtaggtacaacagagtataggggaatttatcttaaacaggcttgtttacttttattgaccaggaactgacctttgatcatcagtgcgagtgatgttccctgaacttttttggttttatttttccttccttcctacctttctttcttctctccttcctcctttcattctgctttgtgttcccagggctggtgtcaaaattctgtgctcaagcaattctcccatttcagcttcccaaagtgttgagattacaggtttgagccaccatgctctgtcctcttttattttcttcttgtttttccttttcattcttccttttcctctcttcctccctccctccctcccttccttcttccccatcatctttttttttttttttttccgagatggagtctcactctgtcacccagggagtgatgggaagctcgcagacttagacgccagagggacgttttcaggggcgagctccacacatggcctgcagggtggacacgttggcttctcggtctggccgccgggtgaccagatgtgggtggcgagctgtggccagtagttgtggctgctggcctctcgtttgggtggaccagggattcaaagcttaggaaggaaggtcggcagacttagaggctggctgcggaggtgggccaccttgggggaaataaggttccaacagggacagcttcaggccgcgagtgccacatgtggcctgtagggtagacacagtgggcttctgcttctgccaccaccaccagctggcttctctttctggctgccaggtgtacaggatgtgggccacgagcgtaggacttggttgccagctggaaatgtttacggtggaccagatggctctcaccgggacagtacagcttcggtccagcagaggagttcaatgatggctcactgcactctttaccttcctaggctcatccagttgatcctcttattttggcctcccaaataggtggggctctcaggatctttctgtttctttttcttttcctttttttttttttttttttttttagcaccactttgagtttgttttcacagtacattgagttctgttgtttttttctttttttctctttgtctctcttgctccttcccgtacactgaagttgctgttgttttagatttctttcacccaggctaaagtgcaggtgcatgatcacagctcactgcagcctcgacctccctgggctcaggtgatcctcccgtctcagacaccccacttcccagtagctgggactaaaggcatgcgccaccacactggcactttattttgtatattttactttttatttttgtagagatagggtcccatcatgttttccaggctgatctcaaactcctgcagccagacgatgtgctggcctagacctctcaaattactgagcttacaggcgtgagccaccatgactggttctatctatatctatctatctgtctatctgtgtgtctctctgtctaccaatcaatcatctatgtttttttttttttttttcagtagagatgtgttcttgctatgtttttcaggcgctggtcatatatatatatatttttttttaactgtaattattattttttaatataggtgttgtctcaccatgtggcccccaggatagtctcaaaatcctgggctccagatattctcccgccttggcctcccaaactgctgggattacaggcatgagccactgtgcctggtctggtcatttttttttttttttttttttttttttgagatggagtttcactctcattgcccaggctagagcgcaatggcacaatctcggctcaccacaatctccgcttcctggattcaagcaaatctcctgcctcagcctcccgagtagctgggattataggcatgtgccagcacactggctaattttgtatttttagcagagacggggtttttccatgttggtcaggctggtctaaactcccgacctctggtgatccgcccgcctcggcctcccaaagtgctgggattacaggcgggagccactgtgcccggcctggtcatatttttgatgtgttgattcttcccagtccagatgtataatctcatccctgaacatttttgatagtgtaattatgacatatgactttacccgacaccagagtgagttgatgctcctgcccagcttacagaagggattgtgacatatcactggacccagcaccaaagtgatgtaactgttctactgctttggcacttcccacagtgggcattgtgacatatcactgggtcttgtacccagatggtgtgaatcttctctccagcctggctctttcacagggggcattgtgtcatattgctgggccccacacataggttatgtgagtctcctgcctgtgccctacccatgtaggccattgtgacatattgctgggtccaacacccaggtgatgtaactctactgcctcggtcctgcctacagcggacattgtgatataaccctgcacccatcacacaggtaatgtgactctcttctcctgcctggcccctgctcacagaagggattgtgacatatcactgggctcagcacctagctaatgtgacttttctcctcttcctgtgttttgcctgcaggggatattgtgaaatgtcactaggcctaatactaaggtgacattactcttttgtcatggcactgccctcagaaggtatggtgatatattgctgggcccagaacaaatgtgatatgagtctcctgcctggaccctgcttacaaggtgtattgtaacatatctggggccctttgactattttatttattttatgttatttattttaattttatttttgagacagagtctcactctgtcacccaggctggagtgcagtggtgtgatctcaactcacttcaacctttgcctcctgggttcaagtgattctcctgcctcagcctcctgaatagctgaggttacaggtgtgcaccaccacgcctggctaatttttgtatttttagtagagacgaggtatcaccatgttggccagactggtctcaaacccctgacctcagccgatctgcccgactcagcctcccaatgtgctgggattataggggtgagccatttcgcttggccctttttgactattttatgtgactctactctcttacctggacattgcccaaaaagagattgtgacatatctttgggcccagcaccaaggtgatttgactctccttttctgcgtgggccttgcccatagtagagagagtgacttattgctgagtttagcatacaggtgatagattcttctgctggctcccaaaagtcactgtaagatatatctgggccaattgctgagattgtgtgactcttctcctgggacctgtccacagtggggattgtggcatattgcttggccaagtacctacatgatatgactcttttcttaggtctgggccctgcccactgaagtaattttgacacatagctgggcccagctcaaaggttatgtgacttcacacttcttcctgagccctacccatgagggccatggtgtcttatctctgagaccgcttattaggtgatgtgactctttattttttttgagatggagcctggctctgttgcccataatttagaagatgtgactcttttgcgccagaatgggtactgtgacatattgctgaacccgttacataggtgatgtgactctcttgcatgggccctcctcctaagggggtagcgtgacacattactgagcccagtacataggtgatgcgactcttttctatggctttgcccaagcagggatttgtgatgtgttgctggactcaccacctatgtgttatgactctcctcttctgcctaagccctgaatgcattgtgtgttgtgacatatgcctggattcagcacttaggtgatacaactttatgacatgggaactgcccacggaagtattatgacatgtctcctttccatcacctaggttatgtgacccttttatttttcttatttctggcatattttggatatagtgatgtatcattgagttcaacagacatgagatgggaggcttctgcctgagcccagcacataagtggccttgtgacatatctttgtacccattatctttgagatttaaccccccttttctgcctgcaccctcaccactggaaagattgtgatgaatcactgttctcaggaatcaggtgatctgtttttccttcctggtccttgcccacagatcattgtaacatatcactgggcctagcatccaggtgatgtgactgctgactgtattctgctttcaggaggagactgtaacgtatccctaattgagcacccaggtggtgtgacacttctgccctgtccctgccctcagaggagattctgacatatcactgccccaaaatgcaggtgctgtgagtctactagtcagtcccttttcattggtgggattgtgatgcatatcttgttcaaacttaaaggtgcaataatgattttcaaacttcgaaaaaaccaatagcagatacactatctctcatagccagggtcaggaaaatgagtaatgtcttgggtctcctctttgtatgaaggtcataaagaacactctgtcacatactgtgtaaagttgtcaagaggtacagagaatgtcctaacagaactcagcacacagaggaggttgtgacactcatatgcatagcctgccaacagtaaagactgtcatccttccacataaacacagctcactgttgaggttctgaagctcttatgcagatgcagtcaaaagttggaaaattgaatctcattatgtgaattcgatccatagagatgttagtgtctctgacaccaagattcagcacacctgtgagtcggtgacttcactaaaatgacacaatttgcaggagggattgaggttctcatatgcaaattcagactatcattgagattgtcactcaggtacttacacccaagatacagagggaattatgtctcagctagaactaaaaaatgtgtgaaattgttaatctcatacctcaaccttaattcagctgtgtttgtgacatacacctttttttagcacctgagtaatttgactctcctgcctggacccagcgtacagatgggattgtgcttcattgctggacccagcatttaggtaatgtgagtctattcttatttcacagagggcattttcacagagggcaagggaggattgtggcatatcactagacccagcaactaggtgttgcaattctcctgtttttcctcggcctcacatatttttggtattgtaaatattactaggcccactacctatgagattgcatgctcctgcctgggctgtgcccacagtgaccttgtgacatatatctgcatccatgacctaaaagatgtgacacttcttgcctgcaacctgccctgcacaggaaagattgcgacttctccctggaagcagacaccaggtgatgtggctctcctgcctctgtcttgcccccagggagcattgtgacataatgctgagctcagcacttaggtgttgtgactgttgcctatgctgtgctttcaggagagaactgtaacatatccctggatgagcacccaggtgatgtgatattcctgcttggttctttccctcagggaagattgtgagatacccttggctgaaatcccaggtgatgtgactctcctgctaactctctacctacaggttaaatggaggcatgtactgtagtcagcttataagtgtaatgatgactctcatacctctagtcagctattagaagaaatactgtctctcatagctcgacttagaaaaatgagtcacattcttggtcttctctttttatgaaggtcatacagaattgccaccctccaacatatcatataatgccctcgagtgttacaaagagtgttatcccaaggcacacagcacaaaggtgagattgtttcttatatgcacacctcaccaaccattaggattatcacccttacacatgaaaagagcccattgctgaggtcttgaatctcaaatgcaaacactgtccagagttggaattgtgactgtcatatatgagcctccggccacagttgagatggtgacacacttctaaactcagaacatagcagatgaggactctactatataaaccctaccaactggagagatgttggctctaatacctggacttagagccacaagtatggtcatgggtgcttacaaacatgactttagagtaaattgtgactcttatttatactggataaagcctttgagtagtatagagagtgtactagctgggcgccatggctcatgcctgttatcccagcactttgggaggctgaggcaggtagatcatgagtcaggagtttgagacaagcctggccaacatggtgaaaacctgcctctactaaaattgcaaaaaatcagctgagcatggatgtggccgcctactgggcctttcctgcaggccctggctgatggatagaattagtactcagacacaggtatgcagtgtaacagcagctagataatggcctgcctctagtggccagagagctgccccaagaagctggagctgcttgctttctttcagtgcaggcacaatgccaaaaacctggagcaaacacaacctgcaggtaattaacatttattgttctcctttcagggatcgtcactcccgtggatgatcaaaggtcagttcctggtcaatataagtaaacaagcctgtttaagataaattcccctacactccactgtacctactcctggccctctgcctcagggttataaagcagctgccttcagctattctcccctgggtctttgcagaaccttccgaactttcagaaggtttgcgtcctttccctatagtttttcttaccattctgactgatccctcacaggcgcctgtaatttcagctactccgggggctgaggcaggagaatcgcttgaactcgggaagcagaagttgcagtgagccaaggtcgcaccactgcactccagcccaggcgacattgtgagactccatctcaaaaaaaaagaaaaaaagtgtactaacaagacccagcacacagaggagacttttaccattgtatgaacacccatcaaacagtacacatcatcattgtgagttctgaatctcacacatagaggaagtcaaaggtggaaaacttgactctcatatttggatccagtccacaggtgagttggtgacattcagagcaagaatcagcacgcctatgaggctgtgacttcactaattagactaagtccacagcaggagtatgggctgttaggtacaaattttgtctactgttgagattgtaactcctgttcttagacacaacatataggaagggttaacctcctatacctaaaaccggaacatgtgtgggattgttaatttgatccctgcaccttctcacaggtttacttggaacatatttctctgcccagcacctgagtgatctgactgtcttgcctacagatggaatagtgacatatagctgaacccagaactgactctctttttctgcattggtgctgctcacagggggcattgtgacatatcgctgggccttgcacttaggtgatgtgagtctcctttgccttggcactgcccacagaatgcattgtcacatatctctgggccccacaccaggttttttgactttcctacctgtcacctgaccacataagcaattgtgacatattgctgggacatacaccctggtaatgcaactctactacccacaaggagcattgtgacatatattttcacacctcacccacatgatgtgactttcttctcctgcctggtccctgctcacagggggagttgcgacatatcatgtggctcagtaccaaacaagtgtgattcttcttccatcataggttctgctagcaaggaagactgagacatattgtggggctctacgccaatgtgacattactgttctgccttggcctgtacctgaaaaggcattgtgacatattgctgggcccagcaacaaggtggcatgagtcttccgtatggaccctgacaacagagcattgtgacatatctttaagagcatcaactatttgatgtgactctccttttctaccaaggctttcctcatatgagagattgtgacacatcttctggcacagaaatcaagtgatgtgtttctcctgcctgagctttgctcatagggagcattgtgacatatctctggtctcagcacccaggtaatgtgactctactctctgtgccctgatttcaggagaaaatttatatgcctaagcacccagtttttaactcttctgccttgtgcctgttctcagagaagattgtgacatatacctggcctattacacagatgatataagtctcctgctctctccctatccacaggggagattgtgacatatatctttgttcagatcattggtgcaatgttgactctcatatctgaaatcagccaataggagacatactatctctcatatgtgggcttaggaaaatgggtaagattctggctctcccctttgtaggaaggttaaagaaaattacagtctctcccatattgtataaagccctccagtgctccagaaagtgtcataacagggtccagaaaacgagattgttttatatttgcacagtttgccaattgttaagattgtcaccctcatccatggacagagcctactggtgaggtcttaaattttacatgtggatgcagtgcagagttaaaattgtgactgtcatatgtgaacatcaggcaacatgaggtggtgactcattagcctagcttataggcaggtgtcaactctcatatctggacccagccattacagagatgttgactctctcatctgagcatagagccacaggtatgatcatgggcccataccagcacaaatgtttcctagtcacaaaagattgtgactctcatgcataccttataaatcctcggttggtacagagagtattctagctagactcagtgtacagctgaggttttgacattcctgtatacccagtcgacagtaaagattatcatcttttcacaagaacggtccactggaaattctgaatctcatatgcagagacagttgcaagttgtaaaatttactcataagtgaatccagtccaaaggtaagttggtgactttcagaccaagattgaacacacctgtttgtctgattccactaaggtgacacagccagtaagagggattgagtctctcattcagtgattcagctcattctaaaaattgtgactatgtacttagacccaacatacaggaggtgttgactctcataccaagaattagggtacgtacaggattgttaatctcatctctggtctttccttcaggtgtgattttgacgcacacttctgcccagcacctgagtaatgtgattcttcagaattggcccggcccacaaataggattgtgccacactgctggacccagtgcctaagtgatgtaactctattcttctgccttggtgctactcgaaaaagacattgtaacatatctcagagccttacacccaggtaatgtgagtctcctcttctgccttgctgctgcacacagaagcggaatatgtacaggattgttaatctcatcttggatcttcctgcacttgtgattgtgacacatgcctctgtgtagaacctgagtgagtttactctcctgcctggatttaacccatagatggaatcgtgacatatcactgtaccagaaactaggtgatgtgactctattttcttgcctctgtgtttttatatggggcatcgtgacatatcactgggccttgcacccaagtgatgggagttttctctcctgctttggtgccgtccacaatgaaaattgtgaaatattgctgccctccccactaggttatgttactctcctgcctctgctttgcccacatgggtcactgtgacatattgctgggtctaaaacccaggtaatgtcactctcttgtttgggttctgcctgcaggagtcattgtcacatatctctatgctcatcacccaggtaatatgattcccttttactgcttagttccttctcacaaaacaacttgtgacatattgctaggcccaatacacctagctggtgtaactcttcttttcttttctttccttttttttttttttttttgagatggagtctcactctgttgcccaggctggagtgcagcggcatgatttcagctcactacagcctctgcctcctaggttgaagcgattgtcctgacttggcctcccaagtagctgggattaaaggcatgtgccaccacgcccggctaatttttgtatttatagtagagacagggtttcgccatgttggctaggctggtttcgaacttctaacctcaggtgatcctcctgcctcggcctcccaaagtactggaattacaggcatgagccactgcacctggcctgattcttctcttctttctaggtttcaactgcagcagagattgtaacaaaccactgggcccagccgcataatgatgttactcttttgccttgggcctgccctcagaaggcactgtcacatattcatgggcccaacgccaaggtgatatgtgtctccagcctggaccctgcccacagggggcattgtgacatatctcttggcccatcagatgtttgattgttatcccctcccctcttctaccctgtgtttgcctataaaagacacagtcatatgttcctgggcccagcacctaggtgttgtcttactggaatgtgtccacatggggattgtgatatgtcacgtggcccagtacttaacttgatgtgactctcctctcatgcctaggccttgtagagaatccccttccccttttgttttcctttttttctttgcagatccaggagataatcaactaagagccaggcacccgtttaggtctaataaacattttacaaactgctctctcttttaattcacctatctgagagattcctctgtacaataaaacttggtctccacaatcctttaccttaacctaaaccttccctttcattgatcccaggtcttcagattccaccacttgtcaaccacaaaatatttaaatttacctggaagccgcccgctttgagttgtcccgcctttctgaaccaaaccaatatattcctgcaaaaccggccatgattaaaacatcaaaaaataatacatgttggcgtggctgtggtgaaaaaagaatactttttcactgctggtgggtatgtaaactagtacaaccactatgaaaaacagtatggagattcattaaataaaagtaaagctaccatttgattaagcaattctactactgcgtatctacatgaagaaaaagaaattatatgtgtaagacacttgcacacacatgtttatagcagcacaatttgcaattgcaaaaatatggaagcagcctaatgcccatcagctaatgagtggaaaaagaaaatgtggcatatatataccaatgcatactactcagccctaacgaggaataaaataatagcatttgcagcaatctcgatttagttggagaccattattctaagtaactcagcaataaaaaaccaagcattgtatgttctcacttgtaagtgggaactaagctatgagaatgcgaaggcataagaattatgtaatggactctgggtactcagcagaaagggcgggagagaggggtgagggataaaagactacatattgggtacagtgcacactgcttgggagatgggtgcacctaaatcttagaaatgattacaaaagaacttatccatgtgaccaaacatcacctgtaccttaaaaactttggaagtaataataattacaaacaaaaacaaaaaaacacaaaaccccgtaagtttaactttctatgttttggctgttttgttttgttttgtttagaaaaggtctctgtcacccagaatagagtgaagtggctcaatgagggctcactgcagcctcgacttctgggctcatgcaattttcctccctcagcctcctgaatagctggtactaaatgtgcaggctaccatgctcagttaatttttaaattttttttagacatgtgtttttgccatgttgcccaggctggtctcaaattcctgggcttaaacagtcttcattacttgctcccccaaagtgctgggattataagcatgagccaacatgcctgactataatttttttattttattttactttttattttttgagacggagtctcactctgtcagcaggctggagtgcagtggtgcgatctcggcccactgcaacctctgcttactgggttcaagtgattctcctgcctcagcctcctgagtagctgagactacaggagcgcgccaccatgcctgtctaatttttgtattttttagcagagacagggtttcaccatatttgccaggctggtcttgaattcctgacctcatgatccacccacctcagtctcccaaagtgctgggattacaggcgtgagccactgcacccagcccagaatctttaatatgttataaaaaagctaactatatttagattcgtttacagaaaattaaaaaaaaaatcttttattaaatgttagaagcaaatttttgatgccgcaaaggaaatagtacttgaatgtaaattttctcagcaagacaatatttacttttatagaagggtgcatcttgcgaatggagcaatggcaagagcacacctgaacaagggagggaaaggagttcttagccctgatgcaggtagcccctactgctgtgtcattcccctattggctagggttggactgcacagtctaagctaattcccattggctattttaaagagaggaggagtacaagccagagtggtggggtgagcagtttgggtgggaactactgttatggaacaggtgaccaaggtgactcaggtcagagcaggtgaccaggggtgactcaggatggagcaggtgaccaggggtacagatgtaaactactgattagaactggcgggaaggttgtttactaaaactggagacaaaaacaacaaagaagttaaactttaaaatggagaatgaagaacagggagctgaatatactgacatactgattctttgaagagcaatttagaactcactgtatttaacattaaaatatataaatgttttttatctacaaatattaatataaaacagttcaaaattacttcctagggatttcactaaaaattagtttgttaagggttaatgtaattaataaaagaccactagatgtaaaaaaactaattcttcaaagagaatgtttaaggccaggtgttgtggctcacgccttgtaatcccaacactttaggaggccgagataggcagatcattttgagcttaggagatcgagaccagcctgagcaacatggcaaattccagtcactacttcaaataaggaaataaaccgggcatgatcgcgcacgcctgtaatcccagctactccagaagctgaggctggagaatcgcttgaatctgggaggtggaggttgcagtgagctgaaatcatgccactgcacttcagcctgggtgacagaacaagcttctctcttggaaattaaaagaaaatagagagagtataaacaaaagcaaaatatgcttttgatgaagaaagttagaaacatttgtctgctttgaaattacttaaaggttccttcaaattgaaaaagtaaaaataatgtagattaaaatgaaatataaaaagttaaacaatggaccggcatcatggcttacccatgtaatcccactactttgggaggctaaggcaggtggatcacctgaggccaggagttcgagaccagcctggccaacatggtgaaaccgcatctctactaaaaatacaaaaaattagtcaggtgtggtggtgcacctgtcatcccagctactccagaggctgagggaggagaatcccttggacctgaaaggcagaggttgcagtgagccgagatcgtgccgctggacttcagcctgggccacagagcaagactcagtctcaaaaaaaaaaaattaaaaaattataagagatcataaaatatgtataaaaatctagagaggtcaaaaaaattttaatgtatttttatttttattttttgctggggtgcagtggcatgatctcaactcactacaacctccgcctcccgggttcaggcgattctcctgcctcagcctccggagtagctgggattacagacgtgtgccaccatgctcagctaatttttatattttatttttcatttttttgaaatggaatttcactcttattgttcagtctggaatgtattggcgcgatctaggcttactgcaaccttggcctcccgggttctagcaattctcctgcctcagcctcccgagtagttgggattacaggcacgcaccaccatgctcaataattttgtatttttagtagagatggggtttcaccatgttagccagactggtctcggactcctgacctcaggagatccacctgcctcggcctcccaaagtgttgggattacaggtgtgagccacggcgcccggctgagagacttacaatgttttatcaaattagctttattattgataatacacaataaagtaaaagttgattttctctggaacaaaaattttatgtattattaatatacatcaaatatttttgttcacattttgaatacattgaaagagagcaaagaagagagaggattttcccatgctctgaggtgggcctggctgagctgaggaagccctgcctgaaaaggctgcagcctacgctgtcactctttcttcattcagcccagtgtctgatcacatcttctgtcactcagggcctgagaaggcggggccttaaacgttatctaatcagggacgctgggctgggaactgtccaatcaggcacaaagctggagcggacagggcggcttccgggatgtggctgggcctttgtctctcgctgccgccggagtttccaggtctcgacttcactgctctgtgtcctctgctccaggaggcccagcctgtgtggccctgtgacctgcaggtattggagagccacagctaagatgccaggaacccctggaagcctagaaatggtgagactgccaggtgcgacgtcccgagagagggaacggggctcgttgaaaccggtgggatgcggctgtggcgagcctcaggccttccttcagtcagctccacaatccgtgcccgggttctccttgcccagctcggcctcagtccccttcagcgataagatggcggctgcgttgacaggcgggctccgggcgtcctgtctcttccctgcccagtgactgtgtcctggcctggagccctctctgggcagctctgctcccgcagcgccgcgtctctcccagattgtgcagggatcacgggagggtcgtcaggggagaatcctgactggaggtgctggctcatgaataggaagcactttagtccgtggggttcccagggcctctttttttctattaaaaatttatgggcgtcaccgcgaaaagattaaataatttaatcaaagagtgattcaaacattgtagagcacccagctatggtttgtaatttgtggtctatgaaaggccttgaaggagatatttttataaggttcatgataaagaaaaccaaattcagtaatttgctaggtacagttatgtaggttttgttttgttttgttttttgaaaaggagttttgctctctcgcgcgggctggagtgcagtggcgtgatctcggctcaccgcaacctctgccttccgggttcaagcgattctcctgcctcagccctagtagctgggattacaggcgcctgccaccacaccaggccaatttttttatttttcggagagacggggtttcaccttgttggccaggctggtctggaactcctgaccttaggtgatccacccaccttggcctccgaaagtgctggaattacaggcgtgaaccaccgcacctggcctagtttcttaatttttacaatctaggtggaaatatccttcttatgtaatcagagcttaattggcagtttatagttgcttaagcctaaattttgcttctgccaatgtagtaatttaccaaaaaatgctcttgagtttagatttttatttttagaagtagaaatccgaggactagagccacctcaatctaattgcctgccacttaatttttctcacactcaaaaggggacgatttttccctgaattttttacatgtgtctcaagcagggcctcaagtccacccctcatcccctgttcctccagcctaactctggcttgcagtaaaatactaaatttccagtttcgtctgacattcccaaatgccaatttcccctccctaattcactttatcaactatttgtcctgtagtgtacattttgataccgattttaatcatttttatttttaatttttgagacagagccttgctctgtcacccaggctggagtgcagtgacgcactaggctcactacaacctccgcctactgggctcaaatgattctcctctctcagtctcccaagtagctggacttacaggtgcccacgaccacgtctggctaatttttgtatttttagtacagacagggtttcactatgttggccaggctggtctcgaactcctggcctcagctggtctgcccacttcggcctcccaaagagctgggattacagacgtgagccaccgcatctggccaattaattttttttttgacaaagcatttgatggcacatttaaaaagatttgttttttttggtaaatactccctgtgagaagaaagcaaagaataatctcctgacactgtatggtaaaatatctctgtgcgtttttttcgtctattttccctagacgcagctatcttaccagaatgtttttgggtcaggttttccttttggaaactgtatagggtgatgtgtcttcagtcacccttcagttttttcttggacctagatttcagtactgtatggggataaaccaagatacccaccatggctatgtgtgctagagtgtctagtgaatatcagcttctgggtcatattctctcataggacaacctgaggtattgagtttagcttctcaagtgtggacgtggatgccctgaggctgagaggcatttcctggtgcacttttttttaaagttaattccttgagacattaatattgccttcacccaattcagctttcatttcttggagacacattgctggccagccaatcagatactagtattgaggagaaaacaaataatttctgcctcctggattcctttagggggcagaaaaatagtgcaagaaaaatagtaaaaaaatttctagaaaaaaaatacccagcactccaaaagacaaaaaacaaaaaaaaacccaaaaaaccaaaaaactgaccccagttagatggcgtaagaacttgcagagtataatgtgcctgaggcactcactggggcatagttcagagtctcctgagagggggttattgagcacttaagtgagcaggatgggatgggacaatctctcaagtaattgaatggcctgacttgacacatgaggaagacatatctgtatcttgaaaagctttgttcacttattttgacctaagggtttttttttgtcttatttatttatttgtttatttatgagtcgaaatcttgctctgtcgcccaggctggtgtgcaatggtgtgatctcagctcactgcaacctctgcctcctggattcaaacattcaaggaattctcctgtctcagctccccagtagctgggattacagacgtgcaccaccactcccagctaatttttgtatttttagtagagatggggtttcaccatgtggcccaggatgctctcaaattcctgccctcatgatttttccaccttagcttcccaaagtgctgggattacagatgtgagctgtcgtgcctggttctatatcctggtattttgatttttgagtttaatgctaaattttatgtgatgaaacttgatacctcctagaagtgttcccatgtgactatttttttttctttttttttttttttttgagatggagtttcactcttgtcacccaggctggagtgcagtagtgcaatctcaactcactgcaacctctgccttttgggttcaggtgattctcctgcctcagcctcccaaatagctgggattacaggcgcttgccacaacgcccggctaatttgtgtatttttagtagaggcggggtttcaccatgttggccaggctggtctcgaactcctgacctcaggtgatccacccacctcagcctcccaacgtgctggaattacaggcatgagccactgtgcccggcagactaattgtttgctacgtgatttttgatacaaataataacataatatatttattgtctgaaaggaataaatacttttgcttttcttactgaggtataagatgtaaacaccttaaacttttcttcccttatatgaacactgtgtttgcataattttgctgaattattctaccacctagttatagtttcaaaagccaagttaataactctgacatagaaattaaagcttaaacccagtgactccaagctaagccttttgcaggcttgagcctgcaaaaggaggtttttaaagacccacttagttccttctggggagcctcccctgcagatgtcccagcttgctcacctcagctatggaagaagcccctatactgagacaatctacagagccctggaaagctggcaacccacacgcagatgcagttaagattaatataaaagggtattgggagggtcttactgaagatgaagttattgttttgaggcagtttctagactttttaaaataaaagttagatgtatgtaaaaacttgaatttcaaaggagtattgcaacaggaggaagtagcgactataagatttttaaagattgcaaagatgaggcagacagtggctttttttcctagggaaaagcaaacaagattagtaaggaggtaggaggggaatgtttaaacagagggtaataaaatcagattttgagaatgttttaccctgaagtcagcatgttcttaggataaacataaaatggggttgtatggtggctcagactgagggtagctcaaagttcaggagcctgtgggaagaaaataaacttaagttcagttagattaagaagtattttatgtttaccactgaagacaaagtcagctgatttttaatgaggaagaggagaaaatgcacaaagcgtttttctggctgtgtgataggtaagaaaagagagcaaaaaaatagatactgtcaaggtttcagagaaaagggaatacttatacattgctgttaacagtgtacattaattcaaccattgtaaaaagcagtgtggcaatttctcacagaactaaaaacaattaccatttcaccaagcaaccccatcactgggtatatacccaaagaaatacaaattattctctcataaagacacatgcacaagggtgttcactgcagcactattcacaatagcaaagacatggaatcaacttgaatgcctatcaatggtagactgaataaagaaaatatggtatgatcaggcacaatggctcatgcctgtaatcccagcactttgagaggccaaggcaggtggattgcctgagctcaggagtttgagaccagcctgagcaatatgggaaaatcccatctataaaaatgcatctctaaaaaaaaatacaataagaaaaattaggcatggtggcacacgcctgtggtcagagctacttggacagctgaggaacaagagtattgcttggcccaccacgatggctcatgcctgtaatcccagaactttgggaggccaaggtgggtggatcccttgaggtcaggagttcaagaccagcctggccaacatggtgaaaccccgtctctactaaaaatacaaaaattagtcgggcgtggtggtggtgggcatcataatgaaaagggtttttccgcccccccaccataaagtgttcttggagaacacaaaagatagagaattttattaatcacagctgtttatcatctatgtgcttcatctttttccacctttattcttggtcttatacatttttttcacatgactttgttggggttgtacctttttcttttctgagacggagttttactctaattgcccaggctggagtgtaatggcacaatctcggctcaccacaacctccgtctcccgggttcaagcaattctcctgcctccacctcccaagtagctgagattacaggcatgtgctaccatgcctggctaattttgcatttttactagagacagagtttctccatgttggtcaggctggtcttgaactcctgatctcaggtgattcgcctgtctcagcctcccgaagtggtggaattacagaagtgagctggcgcgcctgtcccgggttgtatcttttatgtgaaaatggtaaatatgactacagtgttccgctgagttctgtgagtagctctaacaaattagtaaatttcagtaacattatgggagtccccagtttctaaacagtatctcagaagcacagatgggcttatagagtttgtgactggcatctgcagtgaggacaatgttgtgggactgagccctgaatcaaggtctgtgctgactctgggtggtgtcagaattgaagttttagataataagttggtgttggagaattgcttggtgtttagcaaactctacagatttggtgccagaagaaagataccacagactcctggattagaataaacctctgggtgtccaggaatgagaggctgtgcactctacacaggctgtcacactgtcccttgttctgtgattccagctccccttccagggtgacagaggacctaaaacttagaggaaaggagctctgatggcagatccccttttgccacagccaccaccacaagattttcacccactcactaacatacccactagacattaatgtgtccacacctctcccaggacagggaaccacactcaggaattttactacagcatttttgatcctagtgtttttttttttttttttgccaaaaacttacagaagtatctccaagtcttctggcatattcccacctccagacactgaatctgcagcagcaggctgttttgtccaccagcctggggttctggaccacctgtttataaactcatctgcctgcatggacccagaaataaatcagagtacagccccacctgggccactatctgtagcacaaaccagtctttctacctggagtgtactcttccctacccagggagtttttttttttaaacttctatttttggtttaggggtacacatgcaggtttgttatacagctaaaattgtgtcatggtggttttgtgtatagattattttgtaactaaggtactaagtatagcaccaaagaggtattttttctgaccctgtttctcctgccaccctccaccctcaactaggcgtcagtgtctgttgttcccctctgtgttcatgtttttattatttagctcttacttataaataacatgcatttggttttccatttacgcattcgttttctttctttctttttttttaaaagatggtttcactcttgtcaccaggctggagtgcaatggcgtgatctttggtcactgcaacctccacctcctgggttcaagcaattctccatccccagcctcccaagtagcttgggattacaggtgcccaccaccatgcctggctaatttttgtattttttagtagagatggcgtttcaccataatggccaggctggtctccaactcctgacctcaggtgatttgcctgccttggcctcccaaagtgctgggattacaggcgtgagccactgcatttggcctccgcattggttttccaagaataatggtctccagcttcatgttgctataaagggcataatcttgtttttttctgtaccagttccatgttactttgtttactgtagctctgtagtataatttgaaaacaggtaatgtaatgccttcagttttgttgttttgcttatgtttactttggctattcagcctctgttgtggttttatatgaattttacaatttggttttatatgaattatacaaaaacaatgtttttggttattgttttctgtttgttttttatgaccacacggtattccatgatgtttatgtatcatatttttttattatatattttattttattttagagacagggtctcactctgttgcccaggctgaagtacggtggcataatcttggctcactgcaacctccgcctctcgggttccagcaattctcctgcctcagcctcctgagtagctgtgattacaggtgtgcgccaccacgccctgctaatttttgtagttttagtagagacggggtttcaccatgttgaccaggctggtctggaactcctgaccttaagtgatctgcccacctctgcctcccaaagtgctgggattacaggcatgagccactgtgcctggccttttttttttttttttttttttgagacagtctcactcttgttgtctagaatgaagtgcaatagtgccatctcagctcactgcaacctctgcctcccgggtttaagcaattatcctgtctcagcctcctgagtagctgggagtacagatgcccaccaccaccatgcccgactaatttttgtatttttagaagagatggggttttaccatgttggccaggctagtcttgaactcctgacctcaggtgatccacccaccttggcctcccaaagttctgggattacaggcatgagccatcgtggtgggccaagcaatactcttgttcctcagccttccaagtagctggggccacaggtgtgtgccaccatgcctaactaatttttcttattgtattttttttagagatgcatttttatagatgggattttcccatattgctcaggctggtctcaaactcctgagctcaggcagtccacctgccttggcctctcaaagtgctgggattacaggcatgagccattgtgcctgatcataccatattttctttattcagtctaccattgataggcattcaagttgattccatgtctttgctattgtgaatagtgctgcagtgaaacacccttgtgcatgtgtctttatgagagaataatttgtatttctttgggtatatacccagtgatgaggttgcttggtgaaatggtaattctgtttttagttctgtgaggaattgccacaccgctttttacaatggttgaattaatgtacactgttaacagcaatgtataagtattcccttttctctgaaaccttgacagtatctattttttgacattttaatagctgttctcactggtgtggatggtatctcatggtttttcttggcatttctctaatgattattgatgagcattttattgcatgcttgttagccaaatgtttgtcttctttcgaaaagcatctttttcatgtttcttgtctactttttaatgaggtattttttccttgtaaacttgtttaagttccttatggattctggatattagacgtttgtcagaagcatagtttgcaaatattttctattattccgtaggttgtctgtttactgtgttgatagtttccttttctttgaaggagatttttagtttaattaggtccaatttgtcaatttttacttttgttgtaattgcttttggtattttcatcatgaaatctctgccagtttctgtgtctagaatggtatttctttggttatcttccagggttttttatcattttaaaattaacatttcagtctttaattaatcttgagttgatttttgtgtatggtgtaataaaggggtccagttttagtcttctccatagtgctagctggttattccacaaccatttattaaatagggaattctttccacatttctattgttacttttggtgaagatcagatggttgtaggtgtgtggcattatttctgggctccctattctgttacattcatctatgagtttgtttctgtaccagttccatgttgctttgtttactgtagctttgcagtataatttgaaaacaggtaatgtaatgccttcagctttgttgttttgcttatgtttactttggctattcagactcttttttggttttatatgaattttacaacagtttttttttcattctgttaaaaatattttggtcatttgatatcgaacagcattaaatctgtaaattttggaggacagtatgatcacttttaggatattgattttttctatttatgagcataaagttgttttccatttgtgccatttctgacttctttaagcattgttttgtaattcttatagagatctttcaccttcctggttagctgtattcttagatattttattatttttgcagcaattgtgaatgggattatgtttatgatcacatttggcttggatgttgttgattcacagggatgctactaatttttgtccatttattttgtatcctaaaattatttttttccaaaggcatgtaaaaatatatttttactttaaaaataacttagttacagtagtactttgcctgtatcttaccaacatgtagctgacagttaaaattttgtaatatagatataatatatagggatatataagaactacaagaaaatctccaaaacccgtaaaattcaaatgtgaaaacagaaaagttttaacactggagaattctctacggtgagcccaagcaatatatagaaaagagtctagaaaaaaggctgaggtgttaaatatgtttttacttcctcttgctcagaaaatattggagtgctgtaaagttctgtaaatttctaatgtgacgcgtccagccctttgtagctagtgccaatcctggccaagctagatttcttgtgtgtctgcaaacaatatctgagccaaacatcaccaatgcctgctgaaaatggattctgactgacagatttcctcgttttgccaagacaggattttttttttctaaattgtttttgcaaacaagctataacaggtaaaaaataaaaatgctttataagaatattattttagaaaacccatcacaaaactgcaaatacagcttcagaagcccttctgttcaactgcagttagtttagtttgtttttgtaccttctaccccaaaggaaataagttcgcatcctgttacttatttttttccgtgacattcagcccctcatccaaaagtgagggcccaatatcaagctgcagggggaggagggaacctgtaagatcagagagggactcctctgacttagtctttcccttgatgagcttgcatgacgcaggatggtgaaacatgtcttcggctggccattcggggtactgttcggacaggttggaggagtggctgtccctgccctgtctggactgagatgcggaaccgctggagccccatgaggtgtctccctggtggactgtcccgttctccaacagactgcttttctcctgacctttttcctccatgacgggctcgcagctaagccttggcaactttgctggccgaaaggactcctgtttggaattaaagttcaccggtgacaataagagcaacatgagagcttgggaccctccagtgatcgtgagggagatggtatttttgaccactgaggagggtgtttctgtgaacacagagtctgaggtgctgttggcccggaagaacttactatgcccggggagctgacccaggtgtgctttctcctagtttccaggtaaaagctcattgttcccttgaagaaaggaaatatctccaaagacgtcatgcttggccctctttgccgatttggatggtatggcaaaagcctccaagagggggactgatgatatcgggagacagaatgtctcagtttaaatttctttcctttcttgttattggctgctttcaggtaaattggggccttggctggcattttggaatttgagaatgtctgttttgcaagcggaagaaagggcaacttttttcacagatggtatatgtttctgaagaatctttttcgttaggaactgtcaaatttttctcaagtggcttcagaagtggctctagctgtgcgcggttccggcgtggtgggcggtgacctgcagggaagcgaggccacctgagtgcactgccctggccaggctgcagctccccaggtcccttgcagcccgggattggttgggcgcggagggctgtatcctgaaattatactgaagttatttgtaagtttaaagagctattctgccaagtctctacggttttcctgatgtggaaacctgttgtctgcaaacagggatagtttgacctcctctgttcctgtttaaacgcctttaattttaattttaatttttttttagatggagttttgctttgtcgcccaggctggagggtagtggcacgatctcgctaactgcaacctctgcctcctaggttcaagcgattatcctgtctcagcctcgtgagtagctgaaattacaggcacgtgacaccacgcttggctaatttttgtatttttagtagagacagggtttcaccatgttggtcaggctagtctcgaactcctgacctcgtgatccacccaccttggcctcccagagtgctgggattacaggtgtgagccactgcatccagccaaatgccttttatttttatcttttgcctgattgctctgaccaggacttccaattttatgttgaatagtagtgttaagagaaggcatcttttgccttttgccagttttcaaggaggaatatttcaagctttttttttttctttttgagatagtctccctttgtctctcatgctggagtgcaggggcacaatcttggccaactgcagcctctgccttctgggttcaagcgattctccttcctcggcctcttgagtagctgggattacaggcacccgccaccacacctggctaatttttgcatttttagtagagatggggttttgctatgtcagccaggttgatctcaaactcctgacctcaggcgatccacctgccttggcctgccaaattgctgaaattacaggactgaaccactgtacccatccgcttccaggttttgtttattcagtatattggggctgagggtttgtcatagataacttattttaaagcatgtaccttcaatgcctaggttgttgaggatttttaacatgaaagatgttaaaatttaccaaaagctttttctgcatctactgaggtaatcttgtggtttctgtctttagtagttctttttatgtgatgaatcacatttattaatttgtgtatgttgaaccaaccttgcattcccaaaataaattctacttgctcatagtgggttagcttttggatatgctgctggattttgtcatgattttgttgaagatttttgtatcagtgttcaaagatactggcctgaattttattggtttgttttatctctgccaggttttggtatcagaataatgctgttcttatataatgagttggagagaagttactttttcttaatttcttaaaatagttttagtagaaataataccagcacttttttgtacgtctggtccacctgtgaatgtctggtccttggctttatttggttggtaggctatttattacagttcagtttttgagcttcttgttcatctgtttagggctttgatttcttttttgttcattcttggaaggatgtattccttaatactttttttcattttttctagattttcttgtttgtgtgcacagaggtgttcataatagacttcaagatgtttttgtggggtcagtggtaatatctctgtgtgtttggtttgtataattttgagatttttgaatttcctgaggatttttttatttctgattgtgtggtcagtatgtgccacgtggcgatgagaagaatgtatgttatgttatttttagatgaagagttctgtagatacctattaggaatatttggtcaagtgttgagtttaggttctcatattttgttaattttcttcttcaattatctgtctattagtgcctgtgggatgttgtaatctcccactattattgtgtctgaatctaaatctcttcataggtctctgagaacatgctttattcatctgaacctatgaattttatgtaacacctttctctcttctgttttttcttccataaacattctttcatgtgcacacagtgtgcaaaatttagatgtccaggagttcaagaacatgtttagagacctggctgttgtaaaagaaaatataaattagaaataagaggcttaattagtctacataaaagtaagaaaatatcttactaaaatctcttttcttataacatttagattacgtatatattttatctccctttttttgaaatatatataaatcaaataacagctgaataaaccttttgtcatttttttttttttttttttgtctcaggattgtctttatctgggacccgagattaattgcttcgtttttgctttggcaaaagattgttcttacaatttttagtcttttaaagttgacacagatttgttcagtcttgctcattctaaaagcacacaaaagttgagcataaaaataggattaaatttagcaataaagaattataaagactaaaagatactgagtaagttgtttgacagaaacctgattatccatgatgattatttgcaggctaaagtatttatactacaaaagaaaaaagagttcagtttatggctgggcgcggtggctcatgctggtaatcccagcactttgggaggccaagtcgggcggatcacctgaggttgggagttatagaccagcctgaccaacatggagtaatcttgtctctactaaaaatacaaaattagctgagcatggtggcgcacgcctgtaatccagctactcgggagattgaggcaggagaatcacttgaatccaggaggtggaggttgaggtgagccgagatcatgccgttgcactccagcctgggcaatgagagcaaaactcagtctcaaaaaaaaaaaaaaaagagaaagaaaaaaagagttcagtttataaactgaaaagtggagtgtgttgtcatacctttgtttctatttattcagtacaattagcatagtaatgtataatgtttgtagacaacctgcattcatatacattcaatagtattttctgcaagagtatgaatataaagccacaatatttactttgaatgaattccttaaatagttgttttaatattgtgattcatagttttgaaatgtagtttttcaactgaattatagttgcagaaaattttttaaaatcctacatacattatgagtagtatattaaaattattcataattacatatttatatctaatatccaaagaaaatgtattaccaaattgttacagtagagattagtctgatatacttattaatttaaccaatagggatagttataggtaagtataattttagtggctttcatttcagaaattggaatgctgctattacaggacaaataaaggcaggtgatttggccaccccaaaactgtatagctgtttagttagttatgttgcaggctcacatatattccattatattaacacaggttttaatttttttaatcaaaaagtgctggtggtagttgtcagatatatttctatatagattccacatttaatgggcagcagattagagagcagcagagatagaaaaaaatcttctaaaattctgctgataatgtgccctttcttcataacactcatgtttctcatgctgtgagtagctatgcactttggatatttagagagaaattatttttagaggaatattttctggctgacttgatcaatcttatatgtaatctcagttttttcttaagacgcttttaacttgtttttttctctcaatataatctttctcggaatgagagctgtttttctttctaatgctttgtgtatctgttttagaaaccctattagtatcccataatgtctgtgaaagacatgggctgtcacagtgagaactcttagagctatctctatctggatgcatgctggaaacccagcagtatattttccatgtcaccattataaatagaaactgtggcttagataatgctcgcattcccattattgtgaaggtgcgattctacccgggaggcctgcaagctctccttctgcagctcaagcttcactcttttttttttttttttttttttttttttttgagacggattttccccccattgcccaggccagagtgcaatggtgcaatctcgcaatctcggctcactgcaacctccgccttctgggctcaagggattctccttcctcagcctcctgagtgcttggattacaggtgcccaccaccatgcccagcaaattttttatttttatttttagtggagatggggcttcactatgttgaccaggctgctcttgaactcttgacctcatgatctgcccacctcaacctcctgaagtgctgggattacaggcatgagccaccgcacccggccagacttcactctttgatgtgacactaaagtgctgctgtggcaattgtcgttcatctaagatgtgagctgccagctgtgagccgtgtgctgtgggctgtaccacagtggcagatggtaggaaacaaaagaggacactggccaccagaagaggggaagcaggagtgcactagtcaagtcctcagggagtagagagccagtgctttaaaatgcaagtagccaaaaagatagcaccctattcaaccacttttgtagaagagtgaaagtctaccttaagcaggcacctggcttcaagttgcaaaactaccttctgccatgaagatgtgaaaagcttattttgtcattgaatataaccaattagcatacatggatgacctccccaatgaccaggtgaatttaggatgaactacctatgacatggcgctgtaaattcttctacttgtgaactaattacggtaaccgtctttatttcttttcaatctcttaagcagatggattgtaatgcatgtgacattcagacttaattgtgtaatgagacagttttctttctgttctattactgtggtttctctggtgctgaagagaattaataaaaattatatttcccaaacactgtgtagaattaccagacataatataaacacataaggtgccaaccaagctctactctagaggggactttccctctcaggcttccagtcaactcacagttacgctgtaaaatgtgtgctgtcacctaaatatgcaggcagaattgtgtctctgcctatttggtagtttcattttctatttagaatcagcctgagtctctcttgctggcttattattggaccatcagcccagggtcactggaaatgctctcacagtcacctaggtatctttgagacatttgagaatctccagaacagaattgtgtcaggctgactagagtggttaattttgcttctaacttagtgtaaaagaaatgagtcatcctgtgtttgctcctcccctcatacaagagatgtctttggttggtacccaggtgagagtttctctagttccctggtacttgagtgaaaaatgatgaggaggtctggagactcaaacaaataaactaattgcttccaattcatatagtcattagaaaaatagatgaagcagtcatggtccctaccatgcaagaacttttagtctagactagcaactggataagtggtttaattatgcatcaaaaggttgggtacaataaatagatgtgtgcaaaaatatgggctttatttgggccgttttctttatatttttgtgacttgtgatgtctacacctgaacatatattaataaacaaaaaagttattatttgtattttttatgccctgctaagaatacttatttatcatctaaaaaattattctagaaaaccttaagggatttgtttaaattgcttattagtatgtgatataaaattgaaagggcagtggggctaaaaaagattaaaattacacaaactctgagatttaagtttctgttttcgtttttgttttttagctaagtttaaaaaaagaaacggaactaaaaatactccccagtggcataaagaacagaattttacatcaactctacaccctgcttcagccctgtttagattcaccctttttgaaggccttatttaagtcttgccctaccctggagttttgcctcgcagaactaactagtagagatcagagttttgggtaatgaatcctgttgccttttagagttggtgctcacacttttctgaaacccaatagcagataaatggaaaaataacatgtattatagggtcttaatttaataattttatattaaaaccagtgtttacagagacattccatttagcaacttgttttctgttcctgcagatacagtagttgattcacaagtcacaaaatagtaaatataaacataataattcatctaaattacattacactctatctgtatccctctcatctgtctatatttagattttattctatgcatttttttaaaaaaatgagtgacaaaaacagaagaagaaataaaaatgctggatccttattctaaatccttgggattattcaacacttagtatcaactcacagggtgttattagaattaaatcaaataatgaattatcacagtgctctgtaacatcctgttgattacatagtacctgcttaataaacattgcattagtacatgtgcacatgttgttttccaaatgcagacttactcagaaattgctgttttctgttttctttgtgaactttaaagagccagcaagtagtatactttaagatagagaatggttgtcttcatttgtatcagaagtatttgtgttgtgacaggagtgctgagtgtaagggactctgtgctgtgcctcatttttctaacaaatgctaataatgagaccagagagagtgacatcagcactgacaggggacttgtttagaacacccatttatggaccatttccaaacctgcggaatcacattacatagagtggggccaagtttaccaagtgatttataagctaattaaagcttgagtggcaatgcttaggtaagtggttataagctcaggattctaattagaagcacatggccaattcacagaactctcttgtgcccttttcacagtttctgtttaatgttctgaagatagcatctatttgttttaattaagtgtctcctgtgactctaaggtgccagaatcaagtatgagaagtttaagatacattcatgagagttaagttccacctttgcactaaagggtggtccaggaacctgttctatttggatttggtaaggacaggacagtgtggccaatatttgtattactgtagcagaaattgctgatgtccgtagcaggggagggcacctgaggacaaaaaaaaaagagaaacttatatttttatctctgtggagcagctcattgttctgaatcttttctgttattcaggacagaaatgggtagagtttttgtgtcttgggccttctgcctttgggtgtggtggtaataggtaaacatgtgctcaaattattaaaggcaaattctcaaaatgcagacataattagtccagaaaaactcatctgagaaagaatttgagaggaggaggagaaagagaaaaaatggctttttttcagctaaacatgtctcagatcaagagctgtgtccactctgcctcgtggaatgccacgcgtttagtacttgcaaatttttacttctgtacctgtattttttctccctaatgagtttgtcttaactacttttaaaaatgcttatgataggccaggcgtggtggctcacgtctgtaatcccagcactttgggaggccgaggcgggcagatcacctgaggttggcagtttgagaccagtgtgaccaacatggagaaaccctgtctctacgaaaaatacaaaattagctgggtgtggtgatgcatgcctgtaatcacagctactcggcaggctgaggcaggagaattgcttgaacccgggaggcagagcttgtggtgagccgagatcgtgccattccactccagtctgggcaacaacaagagcaaaactccgtctcaaaaaaaaagagaaaaaaaaaaaagcttatgatagtcaaggatctctgaaaatatttcttttctatctaccagagccttctctgcatgatggcttcttatatgccatgcagaattctcaccatgaatttgtgatctgcaatattaaaaatgttctctttgtggctgttgaacatggaaaggtgtggataatctatttctatggagaaaacctgggattcttagtgaagatggagaacatataatgttgaggttctgtttttttattatctctgtgcattacaggattaagaaagtgctcatttaaacaggatggcatttattacccagaaagtttggaaaaaattatcaggatatagctgcttattagggtgttaaagaaagtacttaaaatcactattaaaaattgtagaacacggaagatacctgtaccttgaactttccatgcaactgatattttcttatggttaaattgagactgtaatttactttagtgggggcaatatggtgcatcagcatactatagaaacttgtcctagtgcaattggtattaataactcacttgcttaataagctctcttacagattttttcactacagagttatttttctcttcatcattaagtatctttatgcaggtgatgtgcataaaacatcacatttaatctggcagctgcccttttttttttaggttttctttgcattgatctttttttggtaaatgaaagctctcatctttgtttacaggccagaaaaactgaaaaaaacacaggctgttccacttactggatgtttgacagaatagtcttttggggtcaaaacattggcattactagtgaactttttagaaattcagtaattcagactttatttcagatctcctgaaaaaataatctgcattaacaagatgtctagtttatcatacacattaaaatttgagtggtactggccaggcatggtggctcatgcctgtaatcccagcactttgggaggccgaggcgggaggatcacgaggtcaggagatcgagaccatcctggctaacacagtgaaaccctgtctctactaaaaatacaaaaaattagccgggcgtggtggtgggcacctgtagtccctgctactcgggaggctgaggcaggagaatcacggaacccgggaggcggagcttgcagtgagctgagattgcgccactgcgctccagcctgggcaacagagtgagactctgtctcaaaaaaaaaaaaaatttttgagtggtaccttctaactcaacgtgtctattgtgtctgaaatatataacaactatgcctttttcacctgaaaaaaatacacaagtcattctgtattatgtaaatataacactcaaaaatgtacttgttaatatttatgccctcaattttacactttatcatctagacaagtatcatatatacactgatattgtgggtattatgccactctcttttctcagagttagagaatacattacaaaacgtttgtgtgttgacaattattttattggataatttcagccactcttataagtcagaaccagttctagtcactttctgattttaccttgagtcaaatgaaaaattctgcccatagccactttgtaaatatgtgtgtttgtgtgtgtttttcagggactgttgacatttagggatgtggccatagaattctctccggaggagtggcaatgtctggacactgcacagcagaatttatataggaatgtgatgttagagaactacagaaacctggccttcctgggtaaggaaaactttaatactaagtttctaatataaactaatggttttacttcttttctttttttttttttttttttttgagacagagtcttgctctgttgcccagactggagtgcagtggcgagatcttggctcattgcaagctctgcctcccaggttcacaccattctcctgactcagcctccggagtaactgggactacaggcgcccaccaccatgcccggctaatttttttttttttttttttttttggtatttttagtagagacggggtttcactgtgttagacaggatggtctcgatctcctgacctcatgatctgcccgccttggcctcccagagtgctgggattacaggcttcatttctgttttgtagaatgttttctggaaatttatgctttcagatttctgttttcaagaaaatcctggggatttgtttgtttagaaaagaatttcctcaagatgtttcatcttgacctgaactttccacattcctgagctgatctgtgtccttcactttagattagtggtaatttcagaagttttgtggcataaaatactgttactcacaccttaaaatctaattgccatcaccagtttttgatacagtagtaccaagcagtaaaattaagaacctataaaattaaaatatcttctaaatatttaaacatttctgttacaaattagtatattgggacaatttattagaatattctattatatgctctttactgagcacattactaagttggcaggtggagaatatgagcaagactcatgttagttatttttaataaaacaggtattgctctctctaagccagacctgattacttatctggagcaaggaaaagagccctggaatatgaagcaacatgagatggtggatgaacccacaggtaggtgagagtgaatacaacagacgacaaggatgagaggcccaaagtcaagaagaaagcaggtctttaaagtgatctgagaagctgtgttccaaaggaaatagtttctgggaagcctgaatgttttttttaaattatgctatcacttctgttaatgcttataaaatctctaagaattctactttcccttcaatgatctttcttcaagtttacagtgacagccagagtactgttcatggcatagaaaagagtgcattttgctaattttacattttgctaattttttgcattttacattttgctaattaactgagtgtattcattagtttaaacaggttttaaagtactgtttatttatatatatatatatatatatatatatatatatatatataagattacatgatctacaaaaagcaacattttacttactggtcttcaatttcaatgactttaaatttttcttttgactgttttgtcttccacatactttgagtgctatgttaaaatagaagcattgacaataagaaacaatagttttgcatcggtgactgtaaagaaggagcaaacacttgttcaagtatttatagactggtttcagaaagtaaaaatctatttttattgggtcctcagagtgatagaatgtcatctgggtttgtagtgaagaagggttgtagcttggtcttaagtctgctgggtttgcacaagggtccacctttagttgtgttgttaaaaggggcttggatagttataattctcatttaatttttggacagagtgaatatccttcaggactttgctctgcagggcagacccaagggcaggtttctgcagtcaggtctgcatatggtgggctttatatgaggatgtggatgagcatggctttcatctagtacaagagaggattttcccaggttactttgggtttctacataggcagaaccggccatgaactgtggctcagagagctggaactgaatcatggacctgcttcagggaccacagtaaaggccaaagtctgcaggcctgctgcatggctataaatgggtgtcttcctccaggcctctggaagggcagaacctccccaagtctgtagctgggaagagtttgggatggttacagagtacagttcaaaattctcagtggaaccaagttaagtggaatattttcttgtctgtagccaaaaacagtagtcctgtagtttgctgcctgaatgaggcttgccttctaaaaaggattaccttcaatcttgggcttcagcagagtttcataactcccatcctggatctcagagctctcttaaaggcacttatttttgagatggggtcttgcaacataacccaggcaggtcttaatattttgaccggaagcagttctccaactttaatgtgccatgtagctgtcattacaggtgtgaaccatgatgcctggttctctcacaaacgcatttttgtcaggaatggctgccaaattttcttgctgtcaggagataagcaaatagggcatctttttttttttatcttattaatgtcactctccatataaatttttatttttattttctacttcaaatttgtctgtagttttggattcagacatttaggacaatatactagaatgtacatgttgtgtgtgagttaggtaattagtatacaggcaggcaaataggaattacagaattttcagccacttttgtcagcctgtaactaaataataacataatgtattcctcaaatatttgttttatacatgaagctctaaccatattttgctaaatatatacataatttagcaatttaaggctatagttggttctaaacttgaattacagtaattttattttgtgtaaaaatagcacatatttaaaacataaaaattgacactagtttcttttaaatgcttatctattaagtttctcattagcatctcctatttatgattgtactacattttctctgggattttattgccatacaatagataccagtaatttaaagtgcctgccttccatgactgcacagttagtcaaacattgccgttttctagacaaattatttgttaacgtacattaatgttgccaactagattttatgagtaaacatttctttcattattttcttgcagttctacattagtgtgttttttagtgtaagttccttaatatgagtttattgttttttggttttacttatgtattataattttagacaatttgcaattctgtttgtatactttaagtcagtgtgggatttaattaaaagataaatgagccatatgtctatcacaatcagattatatatatgtgtttttatgtctacaaatatgaccccagttttggttatagcttatcttgtatatattctttcttatctcatttttttttcttttttgtttttgagatggagttttgctcttgttgctgaggctggagtgcaatgcatgatcttggctcactgcaacctccacctcccagattcaagcgattctcttgcctcagcctctaatgtacctgggatatcaggcatgtaccaccatgcccggctaattttgtatttttcttttagtagagacagggtttctctcatgttggttaggctggtcttgagctcctgacctcaggtgatctgcctgccgtggcctcccaaagtgctgggattacaggtgtcagccaccttgcccagcctcttagttcactttcaatgttggttttgtcttgtctaagtgagtagcctttgaaatagcattattttcaccatgtgtttaatgatgaatatgtatttcctttgtgtgaaaaaaagtttttgtgatttgaaggtaattttcaagaaaatttataattctttattttttctgtcttttttcctaaaataattgttgtaaaaacacataacatataatttaccttcttaaatctatttcaatgtacatgtcagggccaggcatggtggtggctcacttctgtaagaccaggattttgagaggccaggacaggaggattgcttgagcccaaaagtttgagaccagcctgggcaaaatatggagacaccctctctacaaacatttttatgtaagaaatatccaggcatgatggtgtgtacctgtggtcccagctacttgagagattgaggggcaggattatttgagcctgggagtgtaaggctgcagtgagccataatgtgccactctactcaagcttgtgtgacagattgagaccctgtctcaaaaaactaaacaaaactgtatatttcaagcctgttaatattaacattgttatgcaaaagacttctagaaattttacatcttgcaaaattaaaatgaaatgcccattaaataacatttgaccattttatgctctctctagcccttgacaaacacccttccactttctgtttttatgagtgtgactattttatatatcttagtgaaatcataacatttatcgtttcgttactagtttatttcagttgacataatctcaaagtgtatctttaaatgtgacaagttttttgtgtttttttttaaggttgaataatactccgttgtatcaaatatgtcttcagggtcttatgatgcatattttagatatagattcataaatggaattgctgtatttgataataattttatttaaagtaaatttataacattataaaataatgggtgcatcctgctttccaccaacaatcaatataagttttttttgtttgtttgtttgttttttgcttttttttttttttaattgatcattcttgggtgtttctcggagagggggatttggcagggtcataggacaatagtggagggaaggtcagcagataaacaagtgaacaaaggtctctggttttcctaggcagaggaccctgcggccttccgcagtgtttgtgtccctgggtacttgagattagggagtggtgatgactcttaacgagcatgctgccttcaagcatctgtttaacaaagcacatcttgcaccgcccttaatccatttaaccctgagtggacacagcacatgtttcagagagcacagggttgggggtaaggtcatagatcaacagcatcccaaggcagaagaatttttcttagtacagaacaaaatggagtctcctgtgtgtacttctttctacacagacacagcaacaatctgatttctctatcttttccccacatttcccccttttctattcgacaaaactgccatcgtcatcatggccccttctcaatgagctgttggttacacctcccagacggggtggtggccgggcagaggggctcctcacttcccagaaggggcggccgggcagaggcgccctccacctcccggacggggcagcggccgggcggaggcgcaccccacctccctcccggacggggcggctggccgggtgggggctgccccccacctccctcccgggcgttgtttttttttttctgagacaaattcttgctctgtcgcccagggtggagtgcaatggcacgatcctatcacactccaacctctgcctcctgggttcaagcgattctcctgcctcagcctcctgactagctgggattacaggcacacgtcaccacacctgggtaatttttgtatttttagtagagacagggtttcaccacgtttagcaggctggtcttgaactcctgaccttgtgatctgcctgccacggcctcccaaagtgctgggattaaaggtgtgaaccactgtgcccagccaagggtttcattttgattgcattatcaagagatttggtgcttttaaaaaatggatagtgaccatttaagtgggtgtgaggggattttgtttctcattgtgattttaatgcatttctctacaaattagtaattttgtgtgtcctttcaaatgtttttttatttgtgtttttttatgaaaatttattttaattatttatttctaaataaagttatttaactttattgttccgttttaaaagttgtttatattttttggatattcacacttatcacatgtaatttgtaaatattttcatccattttataggaggcattatttctctattaaatgtttacttaagtatgcagaaattttgaagtgtagtgtagttaaattattctggtttttttctttgttgctcatgcatttaatgttgtatctaagaatttggcaccaagactaatgtcatgtgtttcatatatatatatagagagagagagagagagagagagagagagagagagagatggagtttcgctctgtcacccaggctggagtgtaatggtgtgatcttggctcactgcaacccccacctcccgggttcaagcaattcttctgcctcagcctcctgagtagctgagactacaggcacgtgccgccccgcctggctaatttttgtatttttagtagagacaggttttcaccatcttgttcaggctggtctggtcttgaactcctcaccttgtgatccacctatctcagcctcccaaagtgctgggattacaggcatgagccacagtgccctgcctcccctctatgtgtttaagagattaaaaatttatgcggctgggcctcgtcgcccagcgctttgggaggctgaggtgggtggatcacgaggtcaagatttcgagaccagcctggccaacatggtgaaaccctgtctctactaaaaatacataaattagccagacgctgtgcccggtgcctgtaatcccagctactcgggtggctgaggcagggtaatcgcttgaacccgggaggcagaggttgcagtgagccgagactgcgccactgcactccagcctgggtaacagtgagactccatctcaaaaaacaacaataacaaaacagcaacaacaacaaagttaccttcttatgtctaattaaaagattttcacatatggtttaaggaaataatctttattttatcagaatggatattcagtttctaacagaattttttgaaaaggttatcttccattgtgtgctcatgtcaattttgtgggagattatttggccatatacagaagggttcatttctggcctctctactctgttctttcatctgtttatctgtgtgagtacctcattgtttttgttattgttgcttttagtacgtttcaaaatcagaagttataatgcctttgttttttttccatgggtgtttggctatagttcgtaacaaaattttaacatctcaaacagtatttctttaaaaaactactgttgggatttttataaagattctattgaatttgtgtaccactgttggttgtattgacatctttgaaaaattaatttttttattcttgtgcaaaaatatgttgaagagttttttattttcatgtatttttggatttttcagttttaatctccagtttaattgagttttggtcagaaaacacaaagtggataatattgatattcttaaatttatttgttgtttttttgtgtttgttgtttttgtttgaagacaggatcttactctgtcacccaggctggagtgtattggcataatcttgactcactgcagcctcaacctactgggctcaagttatctttccacctaagtctctcaagtagttgggactacaaacaaagtaccatgtctgaataattatttgattattttgtagggatagggtctcactatgttgcccaggctggcctgaaacttttagctgtaagtgatcctcacaccttggtctctctatgtgttgggattataggcatgagctacaccacccacctggcattcttaaatttaataaaacttagtatgtgtcgtaacagaatacaccaggtgcaaataaaaatattgcgtattcccttgcttttgactgaaaagttttgtacatgtctgttaaacctagttggtctataatatggtattgatgttgatgttactcaaaccttatgctgcaatgtaattcttgatgttagatgtcggacctggtaggaggtgtttgggtcatggggcagagtccttatgaatagtttggcaccatcctcttggtaatcaaaatgtgtgcactttattaattcaaatgaaagctggtttgttagaagaacctggctccttcacctcgtacttgctctgtctgttatcttgtggtgtgtacagttaatcttcgccttcaaccgtgattgtaagcttgctgacactctcaccagaagcagatgctggcacagactttttatacagtctgctgaattgtgagccaaataaacttggttttttaataaattatccattctcaggtattcctctatatgcagaatgataaatcagtgtataatgttgtctaggttttctgttttcttattcatttttatatgaatcttctatttatcgaaaatgggattttggtgtctacaattaccatttttattctgttttaaatattctatagaagatctttaaggattttaagcatcatcattatgatagtaaagacttctggtcagccccccgccaggccagccgccccgtctgggagggaggtatgggggtcagccccccgcccggccagccgccccatctgggagggaggtgggggggtcagcccccgccgggccagccaccccatccgggaggtgaggggcgcctctgcccggctgcccctactgggaagcgaggagcccctctgcccggccaccaccccgtctgggaggtgtacccaacggctcattgagaacgggccatgatgacagtggtggttttgtggaatagaggagggggaaaggtggggaaaagattgagaaattggatggttgctgtgtctgtgtagaaagaagtagacatgggagacttttcactttgttctgtactaagaaaaattcttctgccttgggatgctgttgatctatgaccttacccccaaccctgtgctctctgaaacatgtgctgtgtccactcagggttaaatggattaagggcggtgcaagatgtgctttgttaaacagatgcttgaaggcagcatgctcgttaagagtcatcactactccctaatctcaagtacccagggacacaaacactgcggaaggccgcagggtcctctgcctaggaaaaccagagacctttgttcacttgtttatctgctgaccttcccttcactattgtcctatgaccctgccaaatccctctctgcgagaaacacccaagaatgatcaattaaaaaaaaaaaaaagacttctatatttgtctgtgtatttacatttaatagagagctttattttatatatggttttatgatactgtccagtatttttttaaaacaaaactgactcattttactgactcatttcagcatttcttattgttatttacagagtctcacattactcaggctgatctgaaactcctggtttctagtgttctgacaggcttgcctcctaaaactgtaggattacaggcatcagcccacggtgcctggacaccatgtagcatttttttttttttgtagaactgtgctagtggtgatgaacacgctcactttttattttggaaattttttattttcatcttctttttaaagtgaaataaatttaaatcaagtattcttagttagaattttttttcttttattacatcaaaatttgggaatttctcacctttttttattttcaagtaatctctgtattattttttcccatattcttcttctaagattttttaatgaatatgttaatctagttgatggtgcctaataaagtttacattccatgttttaatttggttttgcaattgtatatttttgtgttatatattttagggtatgccactacacatctgttaattgtgctttgatattttagtataatgtgcatgtcaatatttaactttatgcaatttaagacagtctggagcaacatcaaatatgattgagccatatgtctttttccaatagaattatctctatgtttgtttgcctgtataaatattatcgttgtattttttataacttgtatatttgttgtgtgggtttgttgtgagtgattttctaattctgtgtagctgagtagtcataaaattcttataatttcaacatcctatttatttctgaatctatatttttttatgggagaaacacttttaaatgtgaatataatttaaaactatcataactctgtacttttagttattattatttttacttgtcaaaaaaaaacaaaatttaccagaaaataaatatttaatttagtcatattaatcatcttgaaattttcatgcaacatattgctaaaatgtttttaccttgcaagctaaatcttaatacatattaaacaactaccattttttttttcttgagatggaattttgctcttgttgcccaggctggagtgcaatggcgcgatctcggctcaccacaaccactgcctccgggttcaagtgattctcctgcctcagtctttgagtagctgggattacaggcatgtgccaccacgcacagctaattttgtatttttagtagagaggggttttctccatgttggtcaggctgatctcgaactcctgacctcataatctgcctcagcctcccaagtagctgggattacaggcatgtgtcaccacacctggctaatttttgtagttttagtagagacggggtttcaccatgttggccaggctggccttgaactcctgaccttaggtgatctgtcctccttggcctcccaaagtgcctaaaatacaggtgtgagccaccatgcctggcctggcctggcacatcacttttattttgcagcttcaaagattttttttttgtctgtgacttttgaaattgtgcttatatatgtgtttgttataaatatctttctgtgatcctagtttgttgagcttctttatttttacatcattttttcttacttttaggatctatcagtttttatatttttacctccacaatttctgcttttttgaaatcttaaatatttttgttctcatcctcatttttccgattttccatagttgtctctgttcctattttaatcagtgagtattattcattaccaattcataaaattaatgtatacatctcttttatggtttctttcagaaaattttataatattttggtggcatcatattgccctattttgtatacattataatctttgattgagatttggacatttaaaaaagctaactgtcaaagtctttataatgtagttttgtcctggcatagtttgaaaacaactgtcttgtctaatgattatgggaatttctcaaatatgttcttaggatatgtgttgtctgaaattttgtgtttatgtcttaattaagagtgtttacttatgttactttgtaggagtcagtaatcacttgctatgcctgtttcctttctgtggtactgcagtctctctgctgctgtaacatttttctttggtctcagcagactcaaactttcattccaaattatgccacggtttctttcaacacttatgtcatgagagagggaaatcagtgtcaggaaaagcccctaaaagctgtaaataaaaatgaatgggctactattttacctttcttttaaaacataaaccaggagttggcaatttacttctaaaggcactctgttataatgggaagcaggaaaagctgtgtcaagtaaatttaacagacttttcttttttttctgtgtggttttttgcattgtgctcccctgagacactgcacacacttaactcattcataaattttccatagatgtaatttgatctgtatgtttttgttacatatatatgtctatgaaagaattagggcctgtgcagggtaatggcgtgaacccaggaggcagggcttgctgtgagccaagattgcaccactgcactccagcctgggtgacagagcgagactccgtctcaaaaacaaacaaacaaaaaaacaaaaatagaattagggcctgtggtattttgcagtgccatattgtttatgtagtttgtataattttgtaggtaagatttttaaactatattcatgtgagtctaggtgagtggagtaatttattatttttagtttttttttttcaggtatatgtcctcattttcctcaagacttttggccagagcagagcatggaagattcttttcaaaaagtattactgagaaaatatgaaaaatgtggacatgagaatttacagttaagaaaaggttgtaaaagtgtggatgagtgtaaggtgcacaaagaaggttataataaacttaaccagtgtctcacaactgcccagagcaaagtatttcaatgtgggaaatatttgaaagtcttctataaatttttaaattcaaacagacatacgataagacatactggaaagaaatgcttcaaatgtaaaaaatgtgtcaagtcattttgcatccgtttacacaaaacccaacataaatgcgtttatattacagagaagtcctgtaaatgtaaagaatgtgaaaaaacctttcattggtcctcaacccttactaatcataaggaaattcatactgaagataaaccctacaaatgtgaagaatgtggcaaagcttttaagcagctctcaacccttactacacataaaataatttgtgctaaagagaaaatctacaagtgtgaagaatgtggcaaagcatttctatggtcctcaaccctaactagacataagaggatacacactggagagaaaccctacaaatgtgaagaatgtggcaaagcttttagccattcttcaacccttgctaaacataagagaattcatactggagagaaaccctacaaatgtgaagaatgtggcaaagcttttagccgttcttcaacccttgctaaacataagagaattcatactggagagaaaccctacaaatgtaaagaatgtggcaaagcttttagcaattcctcaacccttgctaatcataagataactcatactgaagagaaaccctacaaatgtaaagaatgtgacaaaacttttaagcgactctcaacccttactaaacataaaataatacatgctggagagaaactctacaaatgtgaagaatgtggcaaagcttttaatcgatcttcaaatcttactatacataagtttattcatactggagagaaaccttacaagtgtgaagaatgtggcaaagcatttaactggtcctcaagccttactaaacataaaagaattcatactagagagaaacccttcaaatgtaaagaatgtggcaaagcatttatatggtcttcaaccctaactagacataagaggatacacactggagagaagccctacaaatgtgaagaatgtggcaaagcttttagccgttcctcaacccttactaagcataagacaattcatactggagagaaaccctacaaatgtaaagaatgtggcaaagcttttaagcactcctcagcccttgctaaacataaaataatacatgctggagagaaactctacaaatgtgaggaatgtggcaaagcttttaatcaatcttcaaatcttacgacacataagataattcatactaaagagaaaccttccaagagtgaagaatgtgacaaagcatttatctggtcctcaacccttactgaacataagagaattcataccagagagaaaacctacaaatgtgaagaatgtggcaaagcatttagccagccttcacaccttactacacataagaggatgcacactggagagaaaccctacaaatgtgaagaatgtggcaaagcttttagccaatcctcaacccttactacacataagataattcatactggagagaaaccctacaaatgtgaagaatgtggcaaagcttttaggaaatcttcaactcttactgaacataagataattcatactggagagaaaccctacaaatgtgaagaatgtggcaaagcatttagccaatcctcaaccctaactagacatacgaggatgcacactggagagaaaccatacaaatgtgaagaatgtggcaaagcttttaatcgatcctcaaagcttactacacataagataattcatactggagagaaaccttacaagtgtgaagaatgtggcaaagcatttatatcatcctcaaccctaaatggacataagagaattcatactagagagaaaccctacaaatgtgaagaatgtggcaaagcatttagccaatcttcaaccctaactagacataagaggttgcacaccggagagaaaccctacaaatgtggagaatgtggcaaagcctttaaagagtcctcagctcttactaaacataagataattcacactggagagaaaccctacaaatgtgaaaaatgtggcaaagcctttaaccagtcttcaatccttactaaccataagaaaattcatactatcacacctgtaatcccacactttgggaggccgaggcgggcggatcacgaggtcaggagatggagaccatcctggctaacacagtgaaaccccttctctactaaaaaatacaaaaaattagccgggcgtggtggcgggcgcctgtagtcccagctatgcgagaggctgaggcaggagaatggcgtgaacccgggaggcggagcttgcagtgagccgagatcacgccactgcactcaagcctgggcgacagagcgagactccgtctcaaaaaaaaaaaaagaaaattcatactagagagaaaccctacaaatataaagaatgtggcaaatcttttaaccggtcttcaacctttactaaacataaggtaattcatactggagtaaaactctacaaatgtgaagaatgtggcaaatcctttttctggtcctcagccctaaccagacataagaaaattcatactggacagcaaccctacaaacaggaaaaatttggcaaagcctttaaccagttttcacaccttactacagataagataactcatattggagagaaatcttacaagtgtgaataatgtggtaaagtctataaaaagtcctgaattcttaacagacataatattattcatactggagagaaactttacaaacctgaaagatgtgccaacgcttttgacaagtcaaacttttctaaacatcaagaaaatcatgctgctgagaaatcctagaaatgtgaagaatgtgacaaagcctctaaatgattgtcacacttgatcgtaggtaagataattcatactggagaaaactaccagtgtgaacaatgtggccaagctttgaaccaatgctcacaccttaatgcataggaaagcatttatgcttgagaaaaagtgaacaaatatagacaaaaagccattaatacctgctcacatcgtactcaaaatcagagcgttcatactaaataagaagtgtaattactgtcaaacgactgatcagaaaatatgtctttaaagtacagaagagtattttgaaaaagcattacaaatatgaagaggcattatttatgaccttttctatggaaaggtaaggacattaaaaatgtaagatgcatgatgaaaatttaagtagagaggatctttatggttaacttataatatcgagtgatgcatgaggtagatgttcagattaatattctgcattattatgaaagaaaaacattcttaattttagttaaagtttagtatgatttattgtatttttatgaaatatatgtagcatatttttaaattataaattgcatgtgaacttttcaactaaacagttttaacatgttaaatactatcatgaattcaatgaagtgttattatgccagtaactttaacctattccaccttactcaagggtgtaggtaaaagatggtaaaaatacactatttggtaagataatggactgacatctctagtgattttttttgccagtgagttttaattgccattaagttaaagaatattgttcccataggctaaatttttatttttattttctcatttaaatgtatttgacttaatttttgtggatacctaatatgtgtacatattatgccatatgtggcatattttgatacggacacacaatatataacaatcgcattagactaaatgcggtctccattacctctagcatttattctttgtattacaaataattcaattctacagttttagttatttttaaatgtacaattaaattgttgttgactacaggattatttttatggtcataataaaacttatatacaaacataagtaaaatccatatatttctgagtcccgaataaatcttttttaattttttcatatatttttcttcgaacatgtggcctctgcctgcaagcacatatggactgttagtattgatttacatagagttaaatatacacatctgttagtctaagatgaatcttaggtgtaaataaattatggagtgtgtttaagtttgaaactatttttagcagaaaaaagcaatattggaacaaaatcattttaaggaggtgtctaatttactacaaaacaaaaattctcaaaaatgctgaaagcaaatttatactctgctttgtattgaatttcttgctgtacaatcttttggcttatggttcagagtctccccatgcaaattctgttttaacttgactggtactcatgctagacccataattttttgttgttgttgtttaataggttttttgtttgcttaattgtttgttgttgttgttg

SEQ ID NO: 12228 - DNA, 15927 bp, Human
ccaagaatattataaatagttagtaaagggaatggagactttgaggttgaacaaatgttgcactagctgtttctcgactgagtgtaacagcttcatgattaagggaaaacaaaattattttctattccaaagattcattctatgaggtggccataaagtctagaattagatactaatgttttgtcattcattgtaatgcaatattagtaaaccatttaaaagatttgcctggtttcctgacttggtggccaccttgaataattcttgctgtcttctgggaagaacaatggaatttattcctgccttaaaaatcatacatcatgactatcctcagagaatgtccttttctatttctaggagtgacttctaatcttccacactggtgagaaaaagaaagcctatttcatcccgttagcgatgctgaaacccatgatttactttctgaagatgtcccagcgagtcccccgtcaattcactgccacatatatcctgttccataacgagtgtgtcttccttataaatactgcccagactcttgccggttcctctccctttgtcctttcatgtgagtgttcttcggctaccttagtggaaatatagatctgtctcctccttatcctctcaattacaacaaaataagattgtttactttttacgtttacgggatgaaagtgccccgttcaggtcaatgaaacatcagtgcattgcattgactctgaacacttcagaatttagagctgccattgaatgccagctgatggagatagagtgcatatcagacaggtagataaagttcaggtttcctggggaaccaggtatagagaaaaacaagtctgatatgaggaaaatcgcacaatttagagtagtattgccatgtaagtgatttctgcaaactaggaaaagtagagctgaagttattatgtggataagtcaaaagaggaaagtgtgtactttttcagaagcagaaaaatattcaaacttctttcttctttttgggtttagcagacgctccaatgtgatctttgcctttggagtttgggtgaggtataagaaatgggctgatccctgattccatactttattccccctccatcctttccttccagatagacaattctacccatcagtgaatcactcaataagtctcaacagcatttgcttttgctgagattgctcagcagttgagggtcctttgctaggtgagaccaataggagacaaacaccttttccatggtcttttatttttttttttttagacagagtcttgctctgtcatccagactggagtgcagttgcacgatctcggctcactgcaagctccacctcccaggttcaagcaattctcctgcctcagcctcccaagtagttgggattacaggcgtgcaccaccacaccctgctaacttttgtatttttagtagagatggggttttgccatgttggccaagctggtcttgaactcctgacctcaggtgatccacctgcctaggcctcccaaagttctgggattacaggtgtgagccaccacgcctggcccttttccatggtctttgaaagatgatgcttatttcatggtcagtggcttaaaaaaatccccgtcctggttttcttcaacaaactctctagttttccctttttacaaaaaagattttgtaaaaattagtaatcttaaaaatattctgacaaaaagtaaaattaaagggacatcttttcttggttttccttctacggccccatgtgcagtactttcacctttaagcaaagagagtggtttcgatagtctctaagatttcgacctgatctcacattctgccattctacccagctcttaattcagtttgcttccattatcctaacaggcttccacttatttagaacctggaaatgctgctatttaacaccctgcaacactgacgcaaacttatgataggtaccaattactgaaggccaaatgagtaaaatgtgtagttttaggacctttaaaaacatctcatttaatcttcctagcattctatgagagaggcatgattccacacttataaacaaagaaggaaaggttggggatgtgaagcatcttggccaggcttctgctgccagtgaacagtggagctgggactccagcccaggctttcccaactcagaagactgaacatccaggaggatgttaactacttgtgtcctgtcccaaacaacccggagttctcagtcggcttggttctgcttgtgacctcacatcaagaatagcagagatcaccaaagtgatgttcacctcagtgtgacactgttgttgttgttgtttccttggcttaagcaaaggaagcactagtggagagtctcagcccttaatcctcctccctaagtccccatttataatagaaataaaaggctgtaaagtcagctgggcttgggtccaggctcatctgtggaggaggcaagctcatgttcctcgccttccctttcaatgtccattgtgttgtgtctctgccacacaatgccattacccttgccattatctgtatacctcaatttgatcattttgtgtgtgtgtgtgtgtgtgtgttttgaaaaagatttagtaaaacatttcccaacaagtgaaagttcttggctgggcgtggtggctcacgcctgtaatcccagcactttgggaggctgaggcgggcagatcacctgaggtcgggagttcaagaccagcctgaccaacatggagaaatcccatctctactaaaaatacaaaatcagctgggcgtggtggtgcatgcctgtaatcccatctactcggggggctgagacaggagaatcgcttgaacccaggaggcagaggttgcggtgagccaagatcgtgccattgcactccagcctgggcaacaagagcaaaactgcatctcaaaaaaaaaaaaaaaaaaaagtgaaagttcttatatggcatagatatgaattccttcctctggtaataattaggttattccaggaagcacaatgtcattctttaaataaaagatttcctgtttaaaacttttcaaaggagcagaccatgttggagattctccttaggtttggttggtgtataattcattttattaagccattcttcattttaaggctttgctataaagttaaaagtgtaccaaataaaaataaactattttgtatttagagaagagtaaagggaagaaaaatgaatactcagtctttatgtaaactccaaggatagtagggcttagagggcttttctagttttatgagaatttgtactactgatttttgtatattcctgtttttgagataaatggatctctggggaaattgttgagttacaatggcatttcactgtgatccctgtcaagctcagatcagctctataactcaatgatgacctgtctctttgattactgtcctgtaaaatgtcagctaaagtttcccagaggtcatgcatgtaccataaggcagagtacttttcctcagtgcaacagttgctggctctcttcatttcggtatatgtgctttaatgcaaagtatctaaacctgcagtgtgatctgtatatgttatcctattaattgtattattgatcattttgattatcttgcttgaagatttattcatactttttgatttggtagaaacaaattttttttctgcttataaaaaggatctaaaagacaggatgagaatgatgtcccaccaaatagaaaatatcaatgagataaaaactattaaattggaaccccaaataaattatttggttaagaattacaataactgaaattaaacatgtactagaggtgttaattagtagatttgagcaggcagaagaactgatgggcatgaatacagattcagactacatagtatgagaaacaacaacaaaaagaatgaagaaaagtgaagagagcctaagaaacaccaccaggtggaccaacatgcattataggagtcctagagaaggagtaatagaggaatagaaggaaaagttgaaaaagtaatggccaaaaatttcccaaatttgatgaaatgcatgaatctatatattcaagaagctcaaaatactccaagtaggataaattcaaagagatcaacatgtagacacataataaactgtcaaaagataaaagactatgagagaatcttgaaatcagagagaaaagcaaatcatcatatacaagggatctgtaataagaaaaacaatggatttctcatcagaaacaatggaagtcagaaggcaatgagttgacatattcaaagtgctgaaagaaaaaaaaatgtcaatcaagaattatgtatccaacaaaattatccttttaaaatgaaggagaaagtaagatatttccacataaacaaaaaataagtttattgctaatagactgactctacaagaaacaaaaagagaattaagtgatacattaggaaaagtctaacataaaaggcagtaattgagaaatagaggaacatggaaaattcagaaaacaaatattaaaatggcagacatagatcctaccttatcaataactagattaaatgtaaatagattactctccaattaaattttagagattggcagaatgtatagaaactatgatataactatcacagtatccaaaagaaagatagagtggctattccaatatcagaaaaaaaatggactaagttaaaaaaaaaaaggtcattagagacaaagaaggacattttgtaacaataaaacggccaattattcaggaagatatatcaattgtaaacatgtatgcacctaacaatagagtctcaaaatacatgaagcaaaaactgatagaattaaagggagaactaactcaacaataatcatcagagacttcaatattccacttttaatagtggataaaacaattagtagatcatcaaggaaataggaaactgaataacactataaaaccctaaagaatttcaagcagggtctcacatagatatttgtacacccatgttcatagcagcatcattcacaatagctaaaacatgaaagcaacccaagtgtccattgccagaaaaaattgacaagcaaaatgcagtatatacatataatgggatattattcagcttaaaagaagtaaattctgatatatgatacaatgtggattaaacttgaggacattatgctaagtgaaaaaagccaggtgaaaggagggaaagggtcagaaaaaaataactattgaataccaggcttagtacctgggtgacaaaataatctgtatgacaaaccctcatgacacgagtttacctatataacaaacctgcacatgtacccctgaacctaaaataaaagtaaaaacaaaaagaaattgaaattacccttttctatcaaagtctttgttctttatgtaaaatattatatttgggaggtatatatgtatcataattctatttttcaaataagaattaaacaacaataatatatacatatacacatatgtttatatatacatacatatattacatatgtatgtgagatgagggttatatttaaaaagttaatcaatcacaaaagacaaatactgtatgatttcacttatataaagtatttagagtagtcaaaattatagaaagtagaatggtggttgctggaggctgggagaatgggagttaatgtttgatgggtacatagtttcagttttacaagatgaaaaagttctagagattgatggtagtaatggttgcacaactttataaatgtatttaataccactaacatgtacacttaaaatggttaaggtggtagcttttatgttgtatgtattttactacaattttacaaattggaaaaaagaagaaatggaaaatatgaacagacctataacaagagattgattagtgatttttttaaaagtttagtatggatataagggcttcagaggcatagaggggaacaccaagacactctgggccacctcaaagcatgtggacaggacaacagtaaggaagttggcttcaccctaacggaaataaggtaaattcctttacccattccatagcaaggcatggggaaataataacctgcccacctgctccatatcgtccttcttagaacaaagcctgagaaataactcccaagtccccttagccaaagcagtgtcactgagaatggggtgatatagtttgaatgtttgtcctctccaaatcttacgctgaaatgtgattcccaatgttaaaggtggggcctggtgggaagtgtttgcatcatgggggtggatctctcatgaatggcttggtgctgtcctcatgagggtgagtgagttctcagagatctggttgtttaaattgtgtggcacctccccactctctcttactcctgctcttgccataggatataccagctccccatttgccttctgccatgagtaaaagtttcctgaggcctcaccagaggcagagcagatgcctttgccatgcttcctgcacagcttgcagaactgtgagccaattaaacctccttccttacaaatcacccagcctcaggtgtttctttttagcaacaaagaacagcctaacccaaggagtaagtgcctgtacttaacaatctcctgttcgctagccatcgacttactaataatactgattatgcacaaaggcccaccagccactgagcaaaatcagtcatattacatataacagacatattggtgagcacatcacatctggcagccacatacgcatatatttaattatgtccatgtggtttaagaaaattaaaaactttccaattgttacctttggtgagtggatgggggagattagtgagagttccaggcataaaactatgcaccatacacttttatatatttcattactgtggatctttatattgtgtgaaaatagaaatgaagataacaaataggataatttacatatcttttctgttaaatctagcaagtttatatccatatgaactgagagtgccagttcaaattcatactccctaaataaacaagaggtctctccatgaaacattgatatgaagtctttactgaaaaagagatatggacacattaaggcaattagtccctttattaaggtaaatagcaatgttcttttcttaaaaaagaaagatggagaggaaaagagggtgagggaggggtataggagaggaaaaggaggtgatggctgggggaggaagaggaagggaaggttaggacatggagactggagaccagaggatgaacaggaggatgaaggtagtctagaggaaagaggttgggtaggagattgcgaagggaaatttagggcacatgggggcaaagcagagtctgaaatatttagtgaactccatggagatgtttattaggccctagccaaaacatgtcagtctgggtgtgtatcctaataaaaagcttgataaatttatgtatgttttaagaaatgtgttcaattctaggcttcctttgtctttagatgctcagggtatttcagagctgtccctgaagaaacacacagtctgcccagccatgggtaatgacagtcctgtgccacccccaagttaccatctctcactaccagcaaattccctgttcccaattcaccaagaaacagtcttcaacctaggaggaaagaaggaagaggaaagaagcatggggcacaggtggagggagagagcacatggtccctccttcctctccttgggatgctgctccgtggccccagcaccgctcccgagagatctgttctttcctgggacaaaacaaccatcagtttctggggttgagttctttcctggaaaggcagaagactgtctgttctttgtctaaggaaagcctgaaaatatctgtatgcttttgtctatcacttcaggactaaatgaagacggatgagcagagaaaggatggctcgtccatgtcttttatgtaaaggaaaccttcaggaagttgttatgaatgtttctgaggtgctggcgtgttggagagaaccaaaaaagtcttcaattttgtagttggccaaggaatagcaaaatcccggttctgaggcatttaaaaatagacaatggaaaaaagcaactggggtgagttcctgggactccctgcagtggtaaattggagaaagatgagacaaggatgcattccagcaagggagagacttacctttgtgtcaccatgagcccaactcctgacgctggggcccaggctgccagttagggacgtcaccattactggaccacagaggaagccctaccatccccaggagaagtcagtttcacactggagcatttgtgctcctagtaccctagttgcacggaactcagaatgcagggacttctaggtatattacgacttaaaacaggaggttctagaacacataagcacaggtgacccatgggagtagacatctgtggctgttctggaaaccaaccacagtgagcaccattttaagtaaaaatgttctaagttacagatgacttgaaggatcttactttgcagaagtccttgaacaatgttttctacctaatatcctcatgccatttttggcaactcactagaacagttttcagagaaaaagcctctccagtgatgatctaacttaacccaggcagcttggttttctgtcactgtagcataatgtcaaaattccttttctccatttattactcatcacataacaccctaaatcctcaagaaaactatttggaaatatcttaatatggcacatcactttcagcgtgtgctctataaatgtgttcttattttgaaaagtgaatggatgtctaaatcccaagaacaagcacagaaaggcagaacagggctagcagcttgtcttcccagaatgaatattgcgccaaccactgtgaaaacctggaactccaatagtcattccacacacaaaaaaaatctgatgcttagcatacatatttttggaacatctaataagttaatactttacattagtgggttttttttacatttatagtaaatctgacacataaagacctccatcctcagccaccccaactctgtttgaatggcacctggtggcttgtctgatgagctgcagccacactgccaccagcttgcccagcctcaggcttctcctccagggcttggataggtaagtaaatgactccactgacatagtgactcccagcttctggaaaccaggaaataaatatgatttctaagagagctgagaaattaaggcttgaatttggcacagatctgctttcttttcctcttctcgctagcttgtgaccagctgttggatcggagttgggtaaactcacatcttgcacacaggcctccagcttgtgcttggtatttatggggagacacgtctccagctttgctgagtgtgagcccctacaggatcctggggcaaagggaagacaagaagcctgagtgaagcccaggcaggccttttgaggggcttgtctttcttgacaagtggagggaggccacagaaactttctaagccatcactgtcatggtcccctctgtgcaggccactccggcagctctgaaaggatggtgttgaggaatgcaaggacagggttggggagatctgtagggtggcgattttatcaaacctgcaagagatgatcttggtctaaggtggctgttgtaggaataaagaggaggaaaaggatccaggatccaggaacaattgaggagatgcaacccacagggctgggcactggatgtgaatgggaggaggagggagagctgggctgactgtcagggaggatccttgagcatgttgggtgagaccagctgagtcagagaagaggtgacagggcagggcctcaggactagagctcacctgctgacacagcatagcagaggacgctgaggggatgaactcaggcagccaggcaggaagtgtgctgggccccagagcctccctttgccattgcctctgagtgacctccctggaggaaaaagtcacacacttgcttatacaaggctgcaatgatttgagagcataataaataccaaaacagtaaaattccatggtgctacttgctctcttccctagagaaaggaaaagcatggaaaaataatgttggatgtgctatcacctaagcagatcagcaacatggcttaaaggtgagcaccactgggcataatgcacacttcaattaaatgcaaagttatcatgtgctcttctttcagaacttttaaatgtaaaatataagacacataagaagaaactcgagaaagaatttccagcttttgttagacctcacagagaggcctgtccattgtgcaaataatcttgcatttgggtgcctatttgcccaggtcttatattaaaaaagatatttactatggtctgaatgtttgtgatcacagccccccaaattcatacgttgaagcctaatccctaatgtggtggtattaagaggtggggcccttgggaggtgattaagtcataacactccaccctcatggatgggattaatgccttcctaaaagagtcctaagggagcttatttgcctcttccatcaggtgaggacacaggtagaaggtgtcaactatgaggaatgggccttcaccagacaccaaatctgctatttccttgatctcggacttcctagcctccagaactgtgagcaataatgttatttgtaaattacacagtctaaagtattttgcagccaaaacagactaagaaagaatattgtaaggattcaaacaaagggagggatggtcaaagctacatgcaataccaaaagcctgaaaggacaaaggtacctgatcttagctataatgttaatctgggcatccttcccctagggatgatccaattcatgatccactaggcagaagacaaacactgattgacaggtgtgtgcacttaattccttctctctctcaatgtcacggcaaatcctcatgcacagaggtcacattttattcctttacctccaaaggaatagacacacactaaatacctttagattgcatcatttccatttaatgctggtcctgatattaaggaatttaagaagagagtaggagaaggaggtgaaataagcttcctactttcacagcaggtaacatgtttcttggtacatggattaaaatcaggatttttgttaataataaaatagatttcctgtaaagtctttatgtaaaacagtctatgcacagacctttaataaattgataatgtatggacaatatttcagtaatttttcttgatttgaattttctgcactaatttcttacaataaacatgtaatgttttacacaaattatttcaataggagaaatagtaaatcatttagtcggtcaaaacttgatgaacctaaatgttttcatgactacaaatgtgtccaagaggcaacacatcctgcaatgttacccaccttacaacacaaaagcccacataaccaggatatgatttgaatttttaaatacttattttgcaattttaagttataaggagttgatacccaaatatttcctaatttaactggcttaagtatttttatttttatttttatctacaatcttacatcagaactatcagatttgtttttatgtgtttttcatgcttaacagccaagacatccctgctgcaaagcctgatttttggctagaaaatcttttgcccataccaaaaacacagtatattttctcaataattatttcctgataatctactttgtgccaggaactggaatttgacataagactccacaccaacatattttcagtcttctgggaagatggcatctgaccaggcaagaactacccggaccgatggtttctgctggagggagaactagaggtggtttggggcacacagaggggaagccctcatctggtcttcagggcagggtggtggagacaaacaggcagaggcagccatgttcacatgagtcagggtaaagagcacatccctggggaacttttttatacccaggtacagtcaccatggggagtgacggctgggacgtgggggaccacggagtcgccagccaagtcgggaagggcgtttggatttctcaggaagacatcgcgggccacccagagaagggcaggacacagggcacgaggacatgaggaaggaggctcatgcccaccaagcgcagggcccggctgagaccagtgagggcagatgggagcctgaacaggtacagggtcaggagttacgaagatagtggtcaggttcctagagctcaggcattcagctggggcgtggtggggaagtccactggggcagctggaggcacaagagagaagggctggatgtccctgaggccagcatctgaatgagagcagagctcgtggagagcacagcaaagttaaacgaaagcctaccaaggtaggagcgaaaggtattaggcaagagaagacaacataagaagtaaaagtgataagttcactgatttatacactaactcacactaaggataggaactgtgcagtgttgatccacgcctagaggtggaagttatctaaggcagcagtccccaactttttgggcaccaggaaccggtttcatgaaagacatttttccactgaccaggtgcaggggcttgtgggggggtggcttcgggatgattcaagtgcagtacatttattgtgtactttatttctattattactacattgcaatatataatgaaataattatacagcttaccttaatgtggaatcaatgggagccctgagcttgttttcctgcaagtagatggtcccatctgggggtgagaggagacagtggcagatatcagggattagattttaataaggagtgcacaacctagatccctcacatgcaccattcacaataggattcacacttctatgagaacctaatgccaccactgatctgacaggaggcggagctctggtggtaaagcaagcaatggggagcagctgtaaatacagatgaagcttcacttacttgcccactgctcacctcctgctgtgcagcctggctcttaacaggccacagaccactccatggcccaaggatcggggacccatgatctaacccaataactctcacatgctgcaaccctggccacaaggaaggtgacaggacttagggctaggggaataacttcagcagaggaagtggctcctcagctaggttgaaaacatgcagggatttctagcaggcctgaacctggaggtgcaggatgatgctgcagagagggagatgcttatctcatcatgcagggagtgaatgctagtgaccggttgaggcagtttgagcaggactttttacctggtggaaggcaaaggaatccagtgtcttcagacccctcaggcaggagggggtccaagggaacatacaccaaccacagccccctttccaccatggcctgcaagaggagaggtcacgtggacctcttgctcttggcagaaacttctctctacttccttgatcatgaaagttttgttgcaaagtcaacaagactaaagcatgtgcttgtgacttggttgttccacattctaaaacaagattctcaacttcttgacatggaatcaagtttattgacaaaacgcattacacagacctccttttgaagagccatggttcttcacggtttcctattgttgtataacatattaccacaaacttagctgcttaaaacaacccacacttattatctcataggttctgtgggtcaggagtctaggcatggcttagcagagtcctctgcttaaggtttgaccaggctgcaatcaaggtgctggctggggctgtgatcccatttgagctcgagattcttttccaggctcactggttgttggtggaattcagttcctggcagttatagaatggaggcctccaactcctagaggctgcatggcagttgctgcaacgtagtcctctacactcatggcagtttacttcttcaagatgaacagaagataatctcagcattttgagtctccaatccttagatgcccctttaaagggctcacctgattaggtcaggcccacccaagataatctcccttttgaataacttaaagtacattgattatggactcgctttatgccccaaatcccttctcttttgccatataacataacctactcacaggtatgacatctcatattcacaggcccctcatggaaaagaaggaatgggaggagggatatgtatgagtgtgactcattgagaggcatcttcgaattctgccaaccacatctgggctttaccactttgtatacccagtttgaaggaaaaataagagagggcacatatggttggaacagcaaagaaaaaacaagaaattaaagcagcttttcaaaagaggggtgtggtgcctggggtgaggtgccagaagggctaggatgaggaaaataggaaacctcatgtgaagcttcgtttctctgtgcatgtccatagagccttggccgatattctcagatctcatctaattcctactccactctctctgccatgtgtgaagtatgaaagtgctgggagagacacagacttatacattttactgttatgtgctttttatatttttatatttatctacataataactttccgtttcaggtagtggactatgaaaaagtaaaaaccacgttttctgaagcttattgataattaccatggaatgcaaaccctttattctctagataatctactaattgactccaatttattcattctatttatttactcactgtggtagccagcttccaaaatggctcccagtgatccttacttcctggcatgtgtgccctcacgtggttgcctctcagctgaatagatatgaccacaatgggatatggtggaaatgatggttgatgatttccaaggtaaagtgataaaacacaagaggcttctgtcttgctgtctctgggatggctcacttgaggggaagcaggccgccatgttgtgatgccactcaagccgcccatgcagaggtcaacactgggagggactgagccctcctgacagtaaccagcaccacgtgagcaagtcctcttggaaacatatcttctggccttggccaagctttcagatgaccaaagcccttgccaacatcttgactaaaacttatgaaagactccaaaccagaacaactcaattcagcagcttctgaatttctcatccacagaaactgagatactgattttttataatttaggcaactaaattttagagtaatttgttaggcagcaataaatgcttaaatatatactgaccttctattgtttgcccggcctgggtctggatagagaaagaacagagatagcaacttccctgctggtatagcgtctctgaagtggagtgcctttgggtgagctgtggaggctgtggtggaaatgtcagctggagcagtaagagaagagtctagatgttctgagtgtatagggctgctggggtaagagggtggcatcaaaccagctcccccccacccactaaatctaatacaattttatttttaaaaaagtccactctattcaaacgttagagcaggaggtgttcagaggcaaacagacatttttagaaattatgtgtctcatactccatgagactaacacgtcacctccctcatcaaagcagcctaggggaagaatgtgaaaggtcaaattctaaaaatctctaatacttccccaaatttgaagggaaaacaactgagggagggaatacacttactaaaacaaaatacatgaatgtccctctaatggtgactcctccctaacaactacataccggcaaagcaaaccaaagctggacagtagttaaagcggtaaaaacagattttcttcaggactgcaacagggaaagagagatcacactgtagaactggactcaattctgaacacagtgaggataagtgggaataagccaggagcagggtggaggtcagtggatgggaaattactaagaagacatcagaggaaaggggcctcctggttaaacagattcaacaggattcttgctgaaggcaggccaggataatcacatattacttgggggatgc

SEQ ID NO: 12229 - DNA, 29671 bp, Human
cagggggcagcatagcctgaggccggtgatccacactgagactaatctggagcctgcaaagggagggaaagggagctcccccgattgcttcctgggcagcctgccttcccctgtaggtagtctccagctgctccgaacagctccagctccagctccaggagtgtggattctgagaagctgcagagccctggaaagcaggaacttcacaggcaaatgcacgtgcgggtttctctcctttctgaggttgtacctctagtttcccaaggtagttttccggaaaactttttgttttttgagacggagtcttgctctgtcacccaggctggagtgcagtggcgcgatctcggctcactggaacctctacctcccgggttcaagcgattcttgtgcctcagcctccccagaagctgggattataggcgcccggctaatttttgtaattttagtagagacggggtttcgccatcttggccaggctggttttgaactcctgacctcaagtgatccgcccgcctcggcctctcaaagtgttggggattacaggcatgaaccactgtgcccggccttgatttttctatgtatagagttgctgcagtcaggctgtaatttgtatatatgaagaaaatatgtaaagatcatatttagagactcatttaggtagcgttccagagaaatggtttatgagctagagaggttggaatttcaaggggcctaaattgaccacaggtgagagttttctgctggtgtaaattattaaggtattgaaggagggagcgttcccacattgtgatgctgtgacaggagggcatgttgagctcccagagttaaatccttaggtttcctgcctcatcatcagggtctaatgtactctgtggctccacttcagcagtcactgactcttaagcttgggaatatgttctaccttctgaattcatcttttcctttttaaatgttctgaagtgccctgcttatctgagctagttcaaattttcgctttacttcccttttgatttctttacagattacggaaatagaacttgtttttccatgtatttaataattttattcacttgttggcagttttttattttcttgggtgaaaatgagtagattgatttgggaggcgaaagtgggaggttcacttgaggctaggagttcaagaccagcctggacaacaaacgaaatcccgtctctacaaaaaattaaagaatttgccgggcttggtggcatgtacctgtagtctctactactcaggggactgaagcggaaggttcgcttgaacccaggagatggaggctgcagtgagctatgatcatgccattgcactctaacctgggtggcagagctagaccctgtctcaaataaataaataaagtaataaataagtaaataaagtaataaataagtaaataaagtaaaaaatagagagagataaagaggtatggtatgagaaagccttgggcacgcttcccatatcctcatcccaaatttccgatccctgggaatatcacgccctttcttctgttccagtcctgcctggaactccctgcgcacacctgtgactcctcatgcaagaggtagatgaagaaatgacccactgagtacaggaagtatctcctttggtaaacccggattaagttctgctaaaatgcaagtatctcccatctccccatcccccgcagaccaagtacagtgaaggggacgaggggaagaagtccaccctgcgtttgagggctggggccaagacccctcattcccgcttcactcatctatgcttcacatctcctgtcattcacatctgtcaagatgcagggggcagagcccgaagctgtacccaatcaggggcaccggggaggagctctgcgatcggtccaatcaggcgcgccgtcggggacgcagctgcagacgttcaaccttctcgcgggattttcatttctcgcgtctgccgtacttggtttcgcttcgctagtcccagaggcccagagtggctcgcctggagtctctgtggcgcggtttcctgtacctgccttgggatccggagggaggaagctgggacacccgggagtcaggaaatggtgagtgtgtcgggccctgcgtcccgagacagggaggaggggctggttggacgaccggaactggctgtggcgcggcccgggccttcccgtgggcgactctgggtctgcgtaccgagtccctctggcgcagctcagcccttggtaccctcggcctcagggtggggctgggccggcagccgggaccccgggcgtcctcgtcccgccctgtgccgcgattgcggccccggccccgaagacccaagtctcttcagattgtgcggggcccacgcgagggtcatggggtgggggaaatcctgacttgtgcgtggaaggagctgtggtgtatgaggttcccagttccttttctctccacagaggacacccgtttttccctgagttttctaagtgtatgggatgcagggtcccaaatcctcactctgtcccccagcctgctgtttccagggcttgcagtaaatccccaaatttcctgttctcttttcgcttttccaaacgccaacctctccccttccattcacgacattagcaaccgtttctcctatattctacatttcagatattgtgctttcattgtttatttttcaacaaagcaatggattactctttcatcaaggtttgttttctgttcatagccttgacactccgctgtaagaaacctttgtgcttgtccttttgtctcctctatgcacagatacctcatcagaatgtctttgagttgaggttcccctttggaatctttacagggtgatatgccttcagcgccccctcctatttattttttcctggttctgggtttcaaaactgtctggggctgactcaagctgcccacagctgccaagtctcttggaggatctagtgaatattgggtcttgggtgagtcttcctagaggacagttgaaatagaaggctgggagaatgccctgggactaggataaatctagcataccctgcttctaaatagccaacctctgggggcactcagcttttcctcccccaaccccagtttccatcctttggagacacactggtggtcagccaatcagatgctggtattgaggattgagaaaagaaaattttttgtgtgttttgaaagagtctcgctctgtcgcctaggctggagtgcagtgacgtgatctcggctcactgcaacctccatcttctgggttcaagcgattctcctgcctcagcctcccctgtagttgggaccacagttttgcgccaccactcccagataactttttttttttttttttttttttgagacggagtctctctgtcgcccaagctggagtgcagtggcgtgatgtcggctcactgcaacctctgcctcccggattcaagcgattctcctgcctcagcctccccagtacctgggactacaggcgcatgccaccacgcccggctaattttttgtgtttttagtagagacggagtttcaccttgttagccaggatggtcttgatctcctgacctcgcgatccgcctgccttggcctcccagagtgctgggattacaggcgtaactgtacccggcctcaaaaaaataattttcgtctgataaatgtgggtccttttaaatgaacgggcacatagagacattcaagtgatacagcaatcaccttctaactccctgaagctatgaattcatcttttgaaactgctattgccacaagtaggtataatcaacttactaatgcaacacgggaccctggaacccacaccctatagcttaacagtgcatagccacgcgcttatcaatgttacttctgtaaatcagtgagaattcctgacaaacaactttgtatcagcccacatcctgtccccctttttcagacactttgggtcatattttgtgtttcagcctctactttttaggtcgacaagggaaaagacggaaatgattcctgtcctttgtattctctcagccttgtgaagggagaaaaactatctcagcgaggtggtggaataacctgaaaaacaaaatgcactttgggtacacagtgtcgcgtaatgcagtgtctcttgggcgggtggtcactgagcatttcagtgagcactatgggggtagagggatgttccaactgatagataagatgacctctgctgacactggagtcagacgaatgtctgtattccaggtcagcactgcttctccctgggattcttgccttaacaacaagttcagcttgagtatttcatttagttgaaagtgcattttatcagtagagcttcatagagaagataatgtatttcccaagaggtagatttcagggggaaagagattagtcttatattccacattttaaaaattcttattttcaacggcttgtatctgtatttctccatattttggagtaattatctgcatgatatgtgtaggtgctgtggctttttacctaagaagcagaatctcattccagtacatttgagagtcatgatgccaaatctttgatggtctgtgtcagagacacaaagtctacaatgtgtgtgttcacagtggtgtggattttatgcctcaagtcacttagaaaagtgtcttagaaaacctggacagtgcccttgtgtcttcacaataattcttttgtgtatttatggagatgattctgtaatcttttgggacatggaccaatgtgtatctcttcatactcatattctgcaccatctgtatgtagcacgtcagacttagcggtgtgaccttaaactttttaaaagaaactggaaggtcaataaaatttaaactgctggctgggtgcggtggctcacgcctgtaatcccagcactttgggaggctgaagcaggtggatcacctgaggtcaggagtctgagaccagcctggccaacctggtgaaaactcgtctctgctaaaaatacaaaaattagccaggtgtggtggtgggcgcctataatcccaggtactcaggaggctgaggcaggagaatcacttgaacccaggaagtggaagttgcagtgagttgagatcatgctattgtgctccagcctgggtgacagagcaagactccgtctcaaaaaaaaaaagaaaaaaaatttaaactgcttaacaacaaattcttattttcttttattctttcccagatcatgtgtagtatatgtgtagtatgtttgtcagatctgtgttctgttgggtgacttgaaatggaattccagggcttaaccttgagaatattatcagggaaaagaaatgggggtggggagaaccaactctcctattatggcttcagaaaaatgaatatagtttcccaagaaagttagtagataaattggggaattacaaagattcaccaaaacatcaatttctcttgcaaggtggagaatttgtgacggtgaataactgttctgtttcctgttattggaacttagcagattctaaatcttagggaacaggacctggcaacaactaggaatcctctaataggatttttgtttactaaatgatttgttatcatagaaatagtagttaagtgacatctttgtctgaaaatagtagattcttgtgctttttctgttcagctatgatgtaaatgtgccttaattttcttccctcccataaacattaagattgattttgctggattcatcaaacatgagtcattaaacatgggtattttctttaaatatccacatgaggtatgtaaagggaagtgggtagccttgactggggtgcagaggcctgaggccagcgactccaaactgaggccaatccaaaggagtactgcataaaggaaggcaccaatcaaatataagatctgcaaagatctgaaagtttaggcagaaaagtgttttctttcataggaaggggcaaacagattagaaagaagatgaggaggaagaaggcaggatggagggtgcaaaatcagacctagatcagaacatgttttattctgaggttattctgttcttaggaagtgttgcctatttgttcaggctgagagtgggtcaaagttaagggcctggaggaaatttacaagtcaagggcttgcatctgtagttctctatattttggagtaattatctacatgatatgtgtaggttctgtggcttttcacctaagaagcagaatctcattctagtacattgaagagtcatgaagccaaatctttgatggtctgtgtcagagacacaaatttaaggaatgtttggttaacaaatgttttgttcccactgatcagtgaagacaaaactgttcagctaatgttttatgaagcaaagaatgggcatttgtagacctgatgccatggctcacgcttgtaagcccatcactttgggaggctgaggccagaggatagcttgagctcagcagtttgagaccagcctaggcaacattgccagactttgtctcaaaaaaaagaaaagataagaccgggtgcggtggctcacgcctgaaatcccagcactttgggaggccaagacaggcggatcacctgaggtcaggagttcaagaccagcctgaccaacatggagaaaccccatctctactaaaaaaaatacaggtgcctgccaccacaccccgtctctacctaaaacctttgtacaaaaggcaaaagcatctaagtctgcccctcagagactttcccaatttgtacagtttattctacaattaaactaattctgtgaaagcaaagccaaactgctaataatgttgagttttactcaagccctataatccagttaaatagatatggtcatagaaatcactgccttgttaaccactcagttctttctgttttgcagacgcagactcatgcaaagataccttttccattacttcacggcctttttttaaaaaataaagccagatactgactacaaatgcccatttttttttcttttctttttcttttttttttttttttttttttttttttttgtgagacggagcttcgctctcattgcccaagctggagtgcagtggcgcgatcccggctcactctgatctctgcctcctgggttcaagcgattctcctgcctcagcctcccaagtagctgggattataggcgcacaccaccacgcctggctaattttttatatttttagtagaaacggggtttcaccatattagccaggctggtctccaattcctgacctcaggtgatctgcctacctcagcctcccaaagtgctgggattacaggcatgagccaccacgcccccgacaagccccgtttttgatcacagtaaagggggagaggctggatattgagttctgttaatgtaaaaattctggaatgaagacattcggagagcttcctggttggtgaacgcagtgatgttctaggagggtggtactcaagtcctgtagggaagggggtcctatactcccttccctggagggtctagtgaatattggcccttgtgtgactcctcccagaggacagttgaagtagagggctggggccttccaggggacccccacttccctggtcatatatatcttttccatttggctgttcttgggtcatcctttttttttttgagatggagtttcactcttgttgcccaggctggaatgcaatggcaggatctcggcttcctgcaacctccacctcccgggttcaagcgattctcctgcctcagccgcccaagtagctagaatcacaagtgcctgccaccaggcccggctaatttttttgtatttatagtagagatggggttttaccatgttggccacgctggtctcgaactcctgacctcaggtgatccacctgccttggcctcccaaagtgctgggattataggggtcattctttaaaacaaactggcaaacttgtgtttttctgagttctgttagtagtactagcaaattattgaaattgaggagcgtttgttggatttctatgcagttggttagaattaagggtgcctccactcctccctgctgtaccaccctcccagcacatcagggccgggactggcatctgcagtgggggctgtgtcctggggtgggccctggacttgtggggtctgggctaatgccaggtgatgtcagaattgaattactggatccccagctggtgttggaaagttagttgatactgagcagtctccacatatttgttgtcagaaaaaatgacatcacaggtcagaaccttacatcgacttggtgagtggttgctggtgagaattaagaccctggaggagggagcatttccacactgagaaggggacagtagggtgagtagtgctctgcggattatattttctaattactcaaatattcctcactcattgcctaggagaagccactctgagctacatctccacagtgagagtgtagtaaacttttgaatgtgggtaaaggtaaacaaataagccttgggcatttctggcatgtctccctaatttcatcctccttctctgtacccagaggtgaccacagtactgattctgaattttttttttttttttgagacggactctcgctctgttgcccaggctagagtgcaatggagcgatcttggctcactgcaagcccagcctcccgggttcatgcgattctcctgcctcagcctaccgagtagctgggacttacaggcgcccgccaccacacccggctaatttttttgtatttttatttttatttttattttttttgagacagagtctctctctgtcccccaggctggagtgcagtggcgtaatctcggctcactgcaagctctgcctcccgggttgacgccattctcctgcctcagcctcccaagtagctgggactacaggcgcctgccaccacgtccggctaattttttgtatttttagtagagacggggtttcactgtgttagccagggtggtctcgatctcctgacctcgtgatctgcccaccttggcctcccaaagtgctgggattacaggcgtgagccaccacgcccggccatttttttgtatttttagtagagacggggtttcgctgtgttagccagggtggtctcaatctcctgaccttgtgattcacccaccttggcctcccaaagtgctgggattacaggcgtgagccaccgcgcccggccttttgtggtttctttgcctcagtccgttgcacacatgctgctgtctgaggctgtgggtcacccaggttactaaccattccactgcttgatttgagttgttagtattttatctgttgccaatgtaattgttgtttttgtctccaagtgctaatgcttcataaacttctttttttttttttgaggcaggtcttcttctgttgcccagactgaagtgcagtggtgcaatcacagctcactgcaaccttggcctcccaggctcaagcaatccttccatctcaccctcccaagtagctgggactacaggcgtgtgccacatgcctgattaatggttgtatttttttatagagatggggtcttgccatgttgcccagcactcaaacccttgggctcagcactgggattataggcatgagccactgtgcccagccatgcttcataaatttttttttttttttcgagacggagtctcgctctgtcgccaggccaggctggagtgcagtggcgcgatctcagctcactgcaacctctgcctcctgggttcaagtgattctcttgcctcagcctcccaagtagctgggattacagtcacatgccaccacacccagctaattttttttttttttttgagacggagtttcactcttgttgcccagtctggagtgcaatggcaaaatctcagctcactgcaacctctgcttcccaggttcaagtgattctcctgcctcagcctccagagtagctgggattataggcatgcaccaccacgcccggctaattttgtttttttaatagagacagggtttctccatgttggtcaggctggtcttgaactcctgacctcaggtgatctgcttaccttggcctcccaaagtgctgggattacaggcatgagccactgcgccaggccccacccagctaattttttttatttttagtagagatggggtttcaccatgttggccaggatggtcttgatctcttgacctcgtgatctgcctgcctcggcctcccaaagtgctgggattacaggtgtgtgccaccgcacctggctgctttgtaagttttttatacattggaaaaaaaaatccctgggatgtagcttatagatagattgacttgggaatgccaatggaatatatggattaaccatctgaccatgtatgcatgtgtatttactccttataagtagttctctttatttttctctgtgtgattacatgttgctttttacactaggattgagcattttttctgtgtggcctttcatcttctgtaaaatagttttcagtcatcttgtcacattaaagtcatttgtatatttattgcttcatttcttcccttttttctttttttaacttactctgtaggctaattctttttcatttatagggattgctaatattttgttccagggagtgatttatcttttcactccattctacattttgatggactcttaaatttttttgtttgttggcttttttggccgccttctgcatgcaccatcatcaagggtggggaagggtactcttcttgattttaattgagttgactttggctcttcctttcaggcctacttaattttcttgtaagagaacattctagagagtgtatatttagggcaacttgaatctgtgctcccaggttaaataaagaacactctccctactgtcaagttggaaaaaaaattgtaacttatgaaagtttgctactttttaaaattttaaaattttttattttctctctctctctttttttttttttttttggagacagagtctcgctctgccacccaggctggagtgcagtggcatgatgttggctcattgcagccttcgcctcctggcgtcaggtgtttccagtgcttcagccttccgagtagctgggatcgcaggtgtgagccaccatgcccggctaatttttgtagttttagtagagacagggttcctgacctcaagtgatctacttgccttggcctcccaacatgctgggattacagacgtgagccactgtgcctggctgcttttgtttttaagaggtttgtgtttttctgatttgatcttgtttatagctggagactggctaaaactttatccctgtcctggtgtggctctgggggatttcttggaggatatttaaaatgtgcctttcaagggatatttcttcattctgttggagggcctgatgcctagatgttatacccatgaccaggtgtccctctcacagcacacttgtttatacttgctctgtacaagcaggcaccttgtagatcttgtctgaccattgtcagtttaatcctagactagagtagccactaatccggtatctattagtggctaataaacactaccactctgttcctaccaagagagccccgattatgatagtagttaggttcaaatagtagtcaggtgtgtcagttaggcaattaggtgagactcggaggagacaattcaacaaacacaggaaataacagaaggagtttattacttataaatcccagaggccggctgtggtggctcacgcctgtaatcccagtactgtgggaggctgaggcaggcggatcacgaggtcaggagatcgagaccatcctggccaacatggcgaaaccctgtctctactaaaaatacaaaaatgagctgggtgtgatggtgcgtgcctgtaatccctgctactcgggaggctgaggccagagaatcactttaaccagggagtcggaggttgcagtgagccgagattgcgtcactgcactccagcctggcgacagagccagactccatctcaaaaaaaaacaaaaaaattcccggagagaggagagtagcatgtcttgtaggccagcaggtaggtggaactatttgtgacacataccctcagcctgtcagtggggagcaagggaaagagagggaattgtgggccaaatcctttattggggtccaaggtgttacctaacccaatttctcttcaggaggttttagttggtgtgtttagaagaaggaagcacagaggctaagaagagtcagcagacaggccttattggttttcccactcaatctattagtattagtccatactctttttgtccaattgcagttctacggggtgttccatacttttatcattcctattgaatgacgtctgtataaaacgccatgcttttatcattcctattgaatgatgtctgtataaaaggcccaagaggatagggtatggggagcttctggacagctgaactcagggagtcttgtattataataggaaggtgatcaagaactcatcctcatgccaggagcgagtcatactgtaactctaccggaatggaagctcctgtgcttgggacccttgtagactttgccctatgcttctccacctggctgtttatttgtagcctttaaaatagcctttataataaacttgtaaacgtgttttcccgaattttgtgagctgtgttggcgagttaattgagccaaaaaagggtgttatgggaccctcaatttgaagcctgttggtcagaagttccagaggcctggtcttgccactgctgtcggatgtgtggggtcagtctcgtaggactgagccctcaacttgtggcatctgctgctgtccccaggtagatagcttcataatcgaatcggtttggcaggcacccagcagctatatgctgcacaattgattacttgccttttttttttctttttgagacagagtttcactgttgttgcccaggctggagtgcaatggcatgatctcggctcactgcaacctctgcctctcgggttcaggtgattctcctgcctcagcctccccagtagctgggattacaggcatgcactaccacacctggctacttttttatttttagtagagatggggtttctccatgttggtcaggctggtctcaatctcctggcctcaggtgatctgcccgcctcggcctcccaaagtgctgagattacaggcgtgagccaccacatttggccaattacttgctttttgatgtggagaaatccccacacagttggtcacagaagccttttgtgttgatagttgtggtgtgaggggaatagcaaggtgtgtttttttcacttagatgatatgcagagggttgaatattctcttgtagataaccatttgtccctgtccctgtgtcgaagtatctgtaatctctatccctgcctgacagtgcctgctctgtcacaggttcttgggccttaaatagatgctcttgtttcagattttgctatttttcattggtctgtctgtctctctggtaataccatactctcctgattactacagatttcaaatcctcgatgtatgttagagaaagaacctccctatcttagtcatttttgcctgctgtaataaataaccacagactggatgcctgaaacaacaagcattaatttctttctttctttttttttttgagacggagtctcgctctgttgcccaggctggagtgcagtggcaccatctcggctcactgcaagctctgcctcccaggtccacgccattctcctgcctgagcctcccgagtagctgggaccacaggcgcccaccaacacacccagctaattttttgtatttttactagagacagggtttcaccatgttagtcaggatggctttcttttttttttttttttttgagacggaatcttgctctgttgcccaggctggagtacaatggtgtgatctcagctcactgcaccctctgcctcccggttcaagctgttctcctgcctcagcctcccgagtagctgggactacaggcgtgtgccaccacgcccagctaattttttgtatttttaatagagacagtgtttcgccatattgactagctccaagacagaaaggcagagtagattagagtgtatttttggtttctatggtctgccttgcagagaaaaaagagcaagtgaaaggaggtcagttgaagggcagagagaaagattctgttttctttcgattttttttttttgggggggacagagtcttgctttgtcacccaggctggagtgcagtgatgctatcttggctcaccgcaacctccacctcctgggctgaaacgattctcctgcctcagcttcctgagtagctgggattacaggcctgcatcaccacacctggctaatttttgtatttttagtagagacagggttttgccatgttggccaggctcgtctcaaactcctgacctcaggtgatctgcctgcctcagcctcccaaagtgctgggattacaggtgtgagccaccacacccggccttatactttactttttagagtagttttaggttcacagcaaaattgcacacatagtacagagttcccttatgccccctattcccactcagtcacaacccgtccagctatcaacattctgcaccaaagttgtacatttgttacaattgaacctattttgagacattattgtcatccaaagtctagcctacattagaatttattcttgcagttgtacattctgtgagttttgacaactatacagtgacatttctgttatggtgtaatacagagtagtttgattgtcctaaaaaccctctcatccacctatttatccctctccccctgacttctggcagccactgatttttgtactgttctatgattatgtcttttctgcagtgttacatagtttgaatcatacagtatgtagtcttttcaaagttgtttcttccacttagtaataagcatttgcgggcatgtgatcatgaaattttttttaaaaagtaatacgcatttaaggttcttccactaccttttagctcatttatttttagtacctccattgtctggaggtagctgttatgtatccatttgtctactgtaaggcatctcagttgcttccaaattttgaaaattatgaataacgctgctataaacatctgtgtacaattgtttgcctggacctaaattttcagctcatttggataaacctacctttggtctggaggttaagagacacccctgtgccacatgggatgggttgtaaagaattcactctgaaaatcaagtgaatgtgggcctatgatgaggtttgtgtaaaacccctgtgtgtgtatgatctcctgattcaatgagtacttttttttttttgagatggagtttcgctcttgttgcccaggtgggactgcagtggcgggatctcggctcactgcaacctctgcctccttgattcaagcgattctcctgcttcagcctcccgtatagctgggattacaggcgcttgccaccacacccagctaatttttgtatttttagtagagatgggttttcaccatgttggccaggctggtctcaaactcctgacctcaggtgatccatctgcttcagcctcccaaagtgctgggattacagacgtgagccactgcgcccagcctttccatgagtattaatctccttttttgtaacagatctcctagtgggtgctgcgttaaacagagctgaacaaataaccctatctgcctgaagcagggtgggagacaagaaacaagatataagtagaatatgcagtgtgtcagatggtgcttagtcctaaggagagagagaaagctggggaggagtggagaggcctgggctgtgtttgtctctgcaagcacctgtttatgtctctgaggtgttatctctgagggtttgtgtgtctacctgggtatggccacctatatgtgcagtgacaaagtgtgagtgattttgtatgtctgatggggagacagaggctgtgtttgtatgccctttaaaatctggaatgcttttatttcattttcttgcctgattgccctggtagcatcttttagcatgttaaatagctgtgtcaaaaacagacatccttgtcttgtatttgatcttagggggaaacattcagtgtcaccatcagtatgatgttatagtggggttttcatggataccttatttcaggttaaggaagttcccttccatttccagtttactgaatgtcttcatggtggaagaggtattgaaaggatattgacccttgtcaaatgtttttgatactgattctattaatattgtgattttcaaatgtgaaaacagtgttgcttttctgggctacgtcccacttaagtatagaagtttttgtttgtttgtttttgttttgagacggagtctcgctctgtagcccaggctgaagtgcagtggcgcgatctcggctcactacaacctctacctcccgggtcccagttcaagcaattctcctgcctcagcctcctgagtagctgggattacaggcacatgccaccatgcccagctaatttttgtgtttttagtggagatggggtttcactatgttggctaggctgctcgtgaactcctgacctcgtgatccacctgtcttggcctcccaaaatgctgggattacaggcatgaaccaccgcacccagacttttgaaaaatctttttggtaacagtcattctcgcaggtgtgatgtctcattgaggttttagtttgcatttccctaatgatttgagatgttaaacattttttcatgaatgtctttgtcatttatatttgctcttttcagaaatgtctgtttagatcctttgcccatttgaaaaattggaggccaggcccagtggctcatgcctataatctcagcactttgggagtctgaggcaggtggattgccagatctcgggagtctgagaccagcctaggcaacatggcaaaacctcatctctaccaaatatacaaaaaattagctgagcattgtggcatgtacctgtggtcccagctactcccagctgaggtgggaggatggcttgagcctgggaggcagaggttgcagtgagccaagattgtgccactgcactccaatgtgggtgtcagagtgagactcaatctcaaaaataaataaataataaaagttttaaattggattgttttcttgctattgagctgtttgaattctttatatattttggattttaacaccttatcagatatatggtttgcaagtattttctcccactccgtgtgttgcctgcctttccactctgttaattgtttcctttgctgtgctaaaaagctttttagtttgacatccacatccacaatggtgctgtcaaaaacagctacatgggaacttgtttatgtactctttctgcagtgtctggtttcacccagaactcttttgtgagattaagcaccttcctcatatcaggaagattgtgggtctttcctattattcacagctgaatccctgagttaggtttgattgtatgtgatcaaacatagtatgtattatttcctcaagcaacatttttggacatgtttcttagaaatagtttactaactggtttcgaacagcatgtatgctaacaaatgttaatgtctttttcatttgctgctaagttatataaaaaattccattgcaatcatggatcagatcaactttataataaactttataattttgtggcgttatttgttaaatattgtgaatcaggcggggaggggtggctcacgcctgtaatcccagtactttgggaggctgaggtgggtggatcatgaggtcaggagatcgagaccatcctggctaacacggtgtaaccctgtctctactaaaaatgcaaaaattagccgggcgtggtggcgggcacccatagtccctgctactcgggaggctgaggcaggagaatggcatgaacctgggaggcggagcttgcagtgagccgagatcatgccactgcactccagcctgggcagcagaatgagactctgtctcacaaaagaaaaaaaagaaagaaagaaaaaaaaaaaagaaaaattgtgaatcaatattctgtgcatacaattttaggtgtgtttttttcacataaattttcattttcatgctcatgtagtcacagtttttatcacaagaattatttctcattcacttatgataccaaaagttaaatcaagcttttaacctttttccaaagattatcaggaccatagctcctgtcaaagaaggtataaaaaaaagtcatcataaatatgatagtaaaccatacgtgactgtgtggtgtatcaataggagagcgctcaaaagaatttctttttttttttttcttttttttttgagatggagtctcactctgtcggccaggctggagtgcaagtggcacagtctgggcttactgcaacctctgccttccaggttcaagctattctcctgcctcaccctcctgagtagctgggattacaggcacaggtcaccatgcctggttaatttttgtattttttatagagacggggttcctccatgttggccagggtggtctcgatctcctgacctcaggtggtctgccagcctcggcctcccaaagtgctgggattacaggcgtgagccaccacacccagcccaaaagaatttcttctaggacgtgtgcttgcttcaggtgtattgattgctattcaaagcaagaagcttctctggattgtatactatgaagaagcaaggttatttctggccttggttattatgatagttcttacccagaagtaaaaaagatggagtggcgctaagtttattacctaaacactgaaatatttcttatgatgaattagacatggcttcccataagatacctcagttgaaatatataaattctaactattgataattttttttttttgagacagagtctggctctgttgcccgggctggagtgcagtggcgcagtctcggctcactgcaagctccacctcccgggttcacaccattctcctgcctcagcctcccgagtagctgggactacaggtgcccgccaccacacccggctaatttttttgtaattttagtagagacggggtttcaccatgttagccaggatggtcttgatctcctgacctcgtgatctgcctgcctcggtctcccaaagtgctgggattacaggcgtgagccaccgcccccggccaactactgataatttttaaaagtctcccttattagtcaaattaggctaatgcctctaggaaagttgtcagaatataaacctagcaagggacagagacatgatcactattctaatcaagcctctcttgctcagataatatgctcttgatgctaatttttcaatatgcctcatatgccagaactgtagactcagaacatccagaattaagcacaaatgatgcaggcactgaaggctctgatatgggaacacaaagtgaataaattcttgaaatcctggtgcttatatttttgtgagaaaggagaggggttgaaaaaatggtaagactggtttataagaaggaaataagcactttgaaggaaagtaaatgatggtgtgagataatacggaagctgagggtgtgtgtatatgttctctgtggagggtggcaacatcagtgagtgaagaaatgtcaccatcggtcatttatatttccacctcttatacatcttcagcaccatttcaggaactgcttaagtgtggatgtagatagtgcatagcaatatagacagtcctgcctttttgaggttaacaataatgattccccgtaaagatataggtatggcttattgtcatttttgcattggttaaaaattttaatgcatgtaatatgtgatgctgactttggacatgggtatctggaacctggaggaaggcacaccactgcatacggtgtgtgctagaaccacgttggatccctgttgaaacatcttaagtgttctgccccttaagccacaggggcggagcctgaagttatatccagttaggggtgccaggatggcatcctacttattgtccaatcaggcgcgcctcagagccctgtctgcccccaacctcaccccaccctgtacgatcttgtggtgaattttcttttcttgagctggctgcattacctttcttctggctcctggctccactgccctggctctgtgctctgtgctggccgtggtagccggagggaggacccaggagaccccgaagatgggaaatggcgagtgtgggaaatggcaagtgtgcaggggcctggggtccgacatggctggaggggcccaggcctcctcgccatcagcatccgattctgtttcatctgagttgctcaaatgtgtgggaagcagggtatcaaatccacccccggcctaactctccttgatctggcagcaaactgctaaattgtaggtataatttctgcagtccccaacaccagcttctgttctcggatgcacagtgttatcaactatttggtttttttgttttgttttgtttttgcatttgtttttgtttttttttttttggtggagtctcattctgtcgccgaggctggaatgcagtggcgcaatctccactcactgcaatgtccgcctcctggattcaagcgattttcctgcctcagcctcctgagtaggtgggattacaggcacctgccaccacgcccagctaattttttttggggggggacagagcctcactgagtcgcccaggctggagggcagtggtgtgatcttggctcactgcaagctccgcctcccgggttcacaccattctcctgcttcagcctcccgagtagctgggactacaggcacccaccactacgcccggctaatttctttgtatttttagtagagacagggtttcaccatattagccaggatggtttcgatctcctgacctcgcaatccgcctgtctctgcctcccaaagtactgggattacaggtgtgagccaccgcgcccggccatttttttgtgttttttagtagagatggggtctcaccgtgttggccaggctggtctcgaactcctgacctcaagtgatctacccaccttggcctcccaaagtgctggaattacaggtgtgagtcaccatgcccagctgactatttgtccttccttctccattagagaaagatgtcatattttaagtttatcatttttgcagaaggcagtggatgacagttttataaagatttcttttatgtttgtgaccttttcgcctgagaggtaagcagagaataaccacctgaaactccattgtgaaaaagctttgtgtctctcttttatcttctctaagtgcaaacccttatcagaatgcctttgcattgaggttcccctttggaaactttgcagggttgattgccctcagcctgtcctctcttttcctggtcctggggttcagaactgactggggctgccccaagaagcccatagcttccatgtctcttggagggtctagtgagtatcagctcatgtggcccctcaggggagcccctggatgccttggacctagaagcagtgacatggtttactcttcctctgaaaagctcacctcttgggacactcagcttgtttttctctagccccagttttcattctttggagacatgttagtggtcagctaattggatggcagtattgaggggaaagacagaaaatgattcttgccctctggattctctcagagtacttgaagggagaaaaatgatcccaaaagacaaggaaaacccacctctgccaggttatgcaagaacttgaaaagcaaaatgcacttaggcatgggggtgggggcacagtccactgtctctgggaagggtcggtgagcagcactttagtgacaggatgggggttggggggatgtcccatgtgataggatgacctgactgggcagttaagtcagatttctctgtgttccaggttagagtggccttccctgattttgtcaccttaagaagatttgtttacttacttcatcatgtaaaatgtattttaccattaaagcttgaaagataggctaaaatatttccaaagagatgagaggtgtatctcagaaaaataaatatctacccttatatttgttaaaaatttgtatttaatttttccccccagaacatatatgcagtaagtttctcaggtctgttcttttttgtgattttgttgttgttgttgttgttttgtttttttttggtttgtttgtttgagacacagtctggctccaggctggagttcagtggcacaatcacgtctcactgcaacctccacctccccggttcaagcaatcctcccacctcagcctcctgagcagctagaaccataggtgcaggctacacgactggctaattttttgtagagatagggtttcaccatgttgcccaggctggtctcaatctcctgagctcaagtgatcctcctaccttggcctcccgaagtgctgggattttaggcgtgagccaccactcccagctccttttttgtgatttcaaatagaatcctagagtgtagccttgagaaggctacagggagaaaaagctcagagaaatagggagaatcactcttcattatggcttcacataactgaatctatctatctatctatctatctatctatctatctatctatctatctatctatgtttatcttgagacagggtcttcctcttttgcccaggttggagtgcattggcacccatcatagcttgctgcattctcatactcctggtctcaagcagtcctctcacctcagcctcctgagtagctgggactacaggcgtgcaccaccactgctggctaatttttaaatttttctgtagagatggaggttctcactgtgttgcctaaactgatgttgaattcctgggctcaaacaatccttctgcctcaacctcccaatgtgatggaattacaggtgtgagccagttcacccggccactgatacattttgatgagaaagtaggtagataaattggtgaattcaccaatttattttcaccaatttagtgaagattcatcaagctgggtgtggtggctcacgcctgtaatcccagcacttcgggaggccaaggctggcagatacttgcggtcaggagtttgggtccagcctggccaacatggtgaaaccccatctctattaaacatacaaaaattagctgggtgtggtggcacgtgcctgtactcccacctcctcgggaggttgaggcgggataatcccttgagcctgggaggcagaggttgcagtgacccaagaccctgccactgcactccagcctgggcgacagagcaagactccatccaaaaaaaaaaagagggctgggtgtggtggctcacgcctgtaatcccagcactttgggaggccgaggtgggcagatcacgaggtcaggagattgagaccatcctggctaacatggtgaaaccctgtctgtactaaaaaatacaaaaaattagtcaggcgtggtggcaggtgcctgtagtcccagctactcaggaggctgaggcaggagaatggcatgaacccgggaagcggagcttgcagtgagccgagatcacgccgctccagcctgggcaacagagagccagactccgtctaaaaaaaaaaaaaaaaaggtaaaaaatccttcattagtctcatttagtacttaattatatttgatctgcaggataggtacaagcttgcaagtattctctcttagtataataacagaagatgggcttaattttcccagtaaccaattgtgagaacacatgcgaaatgcttcctggagtgtttctgggggctcatcaggtgggcactatgtgttgcgcgtgtaacaaattcccaaactctcagaaggtgggacgccagaaattttcatattttttccataaagagtttaggcaccgagctactcttacataggtcattgggctccttccccaaatccgtttcccagataccaggaatggatgtgatgcaggacaggtgcgccctaaaattggggcttatcccaggatggtttccagctttgcccagggaagaattcaagggcaggccagtggtgttagataacagtgttttatttaacagtactggtctttgtggatcagtgctaactcataggcagtacacccagagtcagcaacatatggtctcttggcaactatatttatacccactttcaattatatgcaaattaagtggtgggttatttaaaactttctaaggaaggaatgataactttcaggtcattgccatggcatttgtaagctgtcatagcattggtgggagtgttttatgctaatgagcagtgagagcatctagagatcgctgttcttgtcgtctgctggttttggcccctttctttactttatcctacctgtgccagatcttgttttggccagtagggttgtgatcagaatacaagtcctgttggtctcctacctcagatgaatgttgtgaggagtgaggagcctttttttaagggtaagcagtctcaggactgctaatataaactcttttgcatagtaggtggtaggacttcgttatgacaggttctacaggtccactgtatgagcagacattagctgggactcaggcagcacgtattactccttgcaaccaccaccaagaaagatgatcagacactgctattgttctacccgatagttccattctagtatgagagttgctgtgtggaaggaagtgagtatgatgaccaaacagtggagtaaatgtttgcagacccctgaaacatgtgaacttcttatgaattgagtacagctccccagccctgtctgtctcacccattctcctctccacatatgtgggatgtttcaggactcggtggcttttgaggatgtagatgtgaacttcacccaggaggagtgggctttgctagatccttcccagaagaatctctacagagatgtgatgtgggaaaccatgaggaatctggcctctataggtaaggattgtatacttccatcacttagcaattaaagaagaagtgcttcttgtgcagtgatgctgttccatggtttgcatcatggagggagagtacttggggggctaaaacaggcatagtcacagggtatcatgaacctagaatctaataatttttctataattttgcactaattcagaatttttctgggtctctgttttagggaaaaaatggaaggaccagaacattaaagatcactacaaacaccgagggagaaatctaaggtaatttgtactcagagaaagcaaattcacttgaaagtaccttagcatgtcatgaaattttaaaaacaggcaaacataactgataagccaagcttcaaattgatttattttttgaatattttccccaaatacatattcttcagtgtaaacagatgttcagtttttataaaaatgttcatttgtcaacagaattaagaaactatttaagaatatcactgtttgagtgatagttgcggtcaagcccattgcagagcattgaattcattcatgctcaaacaaatcagacttggcatcgagtctacgctttacctgataatattgaaaatgcaagtttaatagctattaatataaaatgattaacaaatccttagtaatgtccgtctcattttttacagaagtcatatgttagaaagactctatcaaactaaggatggtagtcagcgtggaggaatttttagccagtttgcaaatcagaatctgagcaagaaaatccctggagtgaaactctgtgaaagcattgtatatggagaagtcagcatgggtcagtcatcccttaatagacacatcaaagatcacagtggacatgaaccaaaggaatatcaggaatatggagagaagccagatacacgtaaccagtgttggaaacccttcagttctcaccactcctttcgaacacatgagataattcacactggagagaaactctatgattgtaaggaatgtggaaaaaccttcttttctctcaaaagaattagaagacacatcatcacacacagtggatatacaccatataaatgtaaggtgtgtgggaaagcttttgattatcccagtagatttcgaacacatgaaagaagtcacactggagagaaaccctatgaatgtcaggaatgtggaaaagccttcacttgtatcacaagtgttcgaagacacatgataaagcacactggagatggaccttataaatgtaaggtatgtgggaaaccctttcattctctgagttcatttcaagtgcatgaaagaattcacactggagaaaaaccctttaaatgtaagcaatgtggtaaagccttcagttgttccccaaccttacgaatacatgaaagaacccatactggagagaaaccttatgaatgcaagcagtgtgggaaggccttcagttatctcccctcccttcgactacatgaaagaattcacactggtgagaaacccttcgtatgtaaacaatgtggtaaagcctttagatctgccagtacctttcaaatacatgaaaggactcacactggagaaaaaccttatgaatgtaaggaatgtggggaagcattcagttgtatcccaagtatgcgaagacacatgataaaacatactggagaaggaccttataaatgtaaggtatgtgggaaaccctttcattctctgagtccatttcgaatacatgaaagaactcacactggagagaaaccttatgtatgtaaacattgtggtaaagctttcgtttcttcaacatcaattcgaatacatgaaagaactcatactggagagaaaccctatgagtgtaagcaatgtgggaaagccttcagttatctcaactcctttcgaacacatgaaatgattcacactggtgagaaaccctttgaatgtaagcgatgtggtaaagcctttagatcttctagttcctttcgactacatgaaaggactcacactggacagaaaccctatcattgcaaggaatgtgggaaagcctattcttgccgtgccagctttcagagacacatgttaacacatgctgaagatggaccaccttataaatgcatgtgggaaagcctttaatgctctgggttcatgtcagatacattaaaatactcactgaagagaagccctatgaatgtaagtaacgtgggaaagcatgaaattctgtcagtgccttttttaatacatgaaagaattctagagagaagccatatacatgtaagtaacatgggaaagctttcaatcattttagttcctttcaaatacatgaaagaactcatcatggagaaaaccaaacaaatgctttttggaaaggaacccatatttgagagaaaccctgggtaaagggtgtaggaaaggttttgtcatcacacaaccctgtcacacatgaatgtgtagtggagagaaccttggtaaatgtaaagagtgtgggagagcctttagtcattttagttccacttgaagccatgaaagaacacacaaaagagaaagctcttgaatataagcaatgtccacacgtttttagccagcccacatgctttcaacaacatgtaagaatgtaccctggatcaaaacactataaatgtgaaaactacaaggaaggttttccattatacttttaaagtcatttgagggctctggctctgtggctttgtgggttaaagtacttgtctggcaaacaggagatgctggatttcaatcccagcagggcctcactagttgaggtattgaatttgaacagatgttttggctctggctgggtgtggtggctcacacctgtaatcccagcactttgggaggctgaggcaggaggatcacttgaggtcaggagtttgagaccagtgtgcaaaacatagcaagacctcatctcagaaaaaaaaaaaaagtcatttgaaaacttctaatacagcaaaatcctataaatgtaagtacttcaaaaagcctcatgcatagcgggtcatgtagtctctagaaaatacataacctgatggaaatgtagaagctatatgtatattttgttaattagtggctcatatttaaaatagttctctgactatggatttcaaatgcttaatctcacaaagaaatgttaaattgatataatcctgtaagtaatctgaaagcaatagtgcatgaatttcataggtagtgttgttttaggtcagtaaataaaatatttgtctttccattttgaaatgtgtttaatccaacaatgaatttaaatgtgtttctcatattcaggtatgttaaattgtatatggttgcttaattgttctgtgattgaggaccactgaaaaataagtcttaataaatgttggtatgaacctacttgcttcatttagcaggttcttgattccctttccacattatatacattccatcatatttattggaacagctccttttttttccttttttcttttttctttcttcttttttctttttgagacagggtctcgctctgtgctctgttgcccaagctggagtacagtggcatgatctcggctcattgcaacctctgccttctgggttcaagtgattctcccaccttagcctcctaggaagctgggactacaggcatgtgccaccacacctggctaattttttgtatttctagtagagatggggtttcaccatgttggccaggctggtagaactcctgacctcaagtgatccacccacctcagcctcctaaagtctgggattacacgtgtgagccatcacacctagcccattttttttttcttggctcaaataattttattttgcttcctattaaagagttgttgttaattctaagtatgtaaagtttatcacagactgtagtctcgtgaattattattttaacctgttgttctttactccttgttatttattctggctgctctttgtataattgattttgggataaggagacagctatgatagaataataaaatctaaaatgggagatgcctttcatggattgtgtcatgtcaatctgggtaatgggaactaaacttttcagacttcatttctttctttctttctgaaatagggtctcactctgtcactcaggctggagtgcagtggcacgactgtggctcactgtaacctcaaactctggagctcaggtggccttccgacctcagcctcccaaatggctggaactataggtatgtgccaccaagcccagctaatctttttatttttggtttttcatctttttttttttttgtagagatggtgtcttgctatgttgcccagactggtctcaaactcctggcctcaagtcaccctctagcctcagcctcttaaagcactaggattacaggcataagccactgtgcctggcccagaatttctttctttcatggttacctgtagactgcatcaatagcctaaattcctggaagtttagaatgcagaagtgaagaacgcattagtcagattttggaggcatcatacggagagacagatgcatatgggctgtttggacatggtcatctagcccattttcctgattctttgccctgccaatcaagagtatcctcagccgggtgtgctggctcacacctgtaattctagcactttgggaggccaaggcggtcggatcacctgaggtgaggagttcgagaccagcgtggtcaacatggtgaaaccccatctctactaaaaatacaaaaattagctgggtgtggtgtcgcgtgcttatagtcccagctgaggcaggagaatcgcttgagccagggaggtgaaggttgcagtgagccaagatcatgccactgcactccagcctgggtgacagagtacagagtaagaccctgtctcaaaaaaaaaaaaaaaaaaaaaaaagagtatcctctaatccaccactagctacttcacctccatgttctcaaagtta

SEQ ID NO: 12230 - DNA, 7500 bp, Human
acaggcatgtgccaccaagcccggctatttttgtatttttaatagagacagggtttctccatgttggtcaggctggtctcgaactcccgacctcaggtgatctgcccaccttggcctcccaaagtgctgggattacaggcatgagccaccgcacctggcccgttctggtttttgaggagcatcacagaagcatctctcactggcactgtgacagtgttcatcacataaactaatgatcatcttctctaagcagcagtcactgctgtagaaattcctcctagggaggacatcattcaggctcactgcctcatatataggaggctcttgactgaactctttttttctggacatggaattttgctcttgttgcccaggctggagtgcaatggcatgatctccactcactgcaacctccgcctcctgggttcaagtgattctcctgccttggtttcccaagtagctggaattacagccgcccaccaccatgcctggcaaatttttgtatttttagtagagataaggtgttcttaaactttgaagatcacttttgggacgtttaaaataactgttgctttttgtgtaatatttacacatttcaatattaactattatttaccatctgtacttttttttttttgagatggattcttgctctgtcacccaggctggagtgcagtggcatgatctcgcctcactgcaagctctgcctccagggttcacgccattctcctgcctcagcctcccaagtagctaggactataggcacctatcactacacctggctaatttttttgtatttttagtacagatagggtttcaccatgttagcgaggatggtctcgagctcctgaccttgtgatccacctgcctcgtcctcccaaagtgctgggactacaggtgtgagccactgcacctggcctaccatctgtacttaattggaaacctattggtctttatattttttagatagctctttaaaatccatgatggagttctcatcaactgggcacggtaatacaggagaagtgattcacacagggacgttgcaaatacatgaaagtcatcacactggagatttttgcttcccagaaatcaagaaagatattcatcactttgagtttcagtggcaagaaatttaaagaaatggccatgaagcacccatgacagaaaccaaagagttgacaggtagtacagactgacgtgatcaaagacatgctggaaacaagcctattaaagatcagcttggatcaagctttcattcgcatctgcctgaactccacatgtttcagacccaagggaaaattggtaatcaagtggagaagtctatcaatgatgcttcctcagcttcaacatcccaaataatttgtaggctcaaaacccatatttctattaagtatgggaagaatttcctctattcttcattattcacacaaatacaagaagtacacatgagggaaaaacctttccaatgtaatgagtgtggcaaagcctttaatcatagctcatgtttaaggagacatcacgtaacccattcaggagagaaacagtataaatgtgatgtatgtggcaaagtctttcatcagaagcaataccttgcatggcaccatagtgttcatactggagaaaaaccttacaagtgtaatgagtgttccaagaccttcaatcagaagtcatcccttcagtgtcatcatagacttcatactgtacagaaacattacaaatgtgaagaatgcaacaaagtttagagttgaggatcacaacttgaaacacacaggagaattcattactggagaaaaaccatacaaacgtaaggtttgtgacaaggctttctgggataattcatgcctttcatgccgtaagagttcatactggagagaaatgttacacatgtaacgaatgtggcaaggcttttagtagaaaagcaaaccttgcacatcatggacttcatactggagggaaatcttacaaatgtaagggttgtgacaaggttttccaccatgatttatgccttgcacaacatcagagagttcatactggagagaaccttacacatttcacgagtgtggaaagacgtttgctcaaaattcagcccttgtaatgcataaggcaattcatactggaaagaaaccttacacatgtaatgaatgtggcaaggtttttagtagaaaagcacaccttgcatgtcatcatagacttcatactgtctaaggtttctaatcaacaatcaaaccttgcacaacatcagagagtttatactggagagaaaccttacaagtgtaatgagtggggcaaagccttaagtgggaagtcgtcacttttttatcatcaagcaatccatggtgtagggaaactttgcaaatgtaatgattgtcacaaagtcttcagtaatgctacaaccattgcaaatcactggagaatccataatgaagacagatcttacaagtgtaataaatgtggtaaaattttcagacatcgatcatatcttgcagtttatcagcgaactcatactggagagaaaccttacaaatatcatgactgtggcaaggtcttcagtcaagcttcatcctatgcaaaacataggagaattcatacaggagagaaacctcacaagtgtgatgattgtggcaaagtcttgacttcacgttcacacctcattagacatcagagaatccatactggacataaatcttacaaatgtcttaagtgtggcaaggtcttcagtctgtgggcactccatgcagaacatcagaaaattcatttttgagataactgttccaaatacagtgactatagaagatcataaagctttaattgacattagagccaaataggcattgacttgagattgagttgacttaaccttgagtttaagaattaatttacattaaagtgtttatgttaagaagattgggccaggtggggtggctcatgcctgtaatcccagcactttgggagcccaaggctgatagatcacagccacacctggctatgagagtgtgtaggtggccgttggggtgggacctgattagaaggggcagggccttgaacagaatctgggcggggcaagaatgaggaggctgcctggaggccgggccagagggtgatcgtcatcttgagggcaaggtctggaagtggtgttttgaagggcagggtctcgagggggcgggtcctggctttctcctcagctggaccccaggtgtcgtctgctgtcatcctcttgccctgcaggactagattctccgggtactaattggtggatagtttctgatgtgccgtgatattacccctaatatcacagggatgcctcctgtccattttagagacttgctctgtcgcccaggctggagggcagtggcgcgatctcggctcattgcaagctccgcctcccgggttcatgccattctcctgcctcagcctcccgagtagctgggactacaggcgcccgccaccatgcctggctaattttttgtattttcagtagagacggggtttcactgtgttagccaggatggtctcgatctcctgacctcgtgatccgcccgcctcggcctcccaaagtgctgggattacaggcgcgagccaccgcgcccggcccctaagttaatatttcaaacaatcgaaggtaaaacaacatattgtgttgggccacctgtactgaacgctgaatcgtttttcctcttaagttgaaaatggttttaatgcaaagcgccttttttgagcaggtagagtcacgcatccggcaggcggggcgagctcccctctgtctggggcagggtgggggagaggggcagggacctcggtaaaggggtggagtggcgcgctggttgccgcgggcactggcaattagaagggattattaaactaagcaaggtcctgggttgtttgagtggataatggaaactgaaaggtgacgtgcaaaactgcctattactcccaggagtggaggataatttcatatttcatggaaataaactcagggcccggagcggtggctcacacctgtaatcccagcactttgagaggccaaggagggaggatcgcttaagcccaggaattcgaaatcagcctaggcaacatagtaagacctcatctctactaaaaataaaaaaaaacagccaggtgtgttagtccacacctgtggtcccagctgcttggggtgctgaggtgggaggatcacttgagccagaaagttggaggctgcagtgagctctgatcttgccaccacactccagcctgggtgaaaaagctagaccctgtctcaaacaagcaaataaatgagaggtataagtcctcctttaaaagtaaaggaagagatttttctttccttttgtctcttagaacattcaattagaaaatttgtaaattcattttctctgtcttctgaggtttttttttttagacagagtttttctcttgttacccaggcttgagtgcaagccacgatctcgcctcaccacaacctccgtctcccgagttcaagcgattctcctgcctcagcttcccgagtagctgggattacaggtatgaaccactatgcccggctaactttgttttttttttttagaaattaaaccttttttcagcttaatgacccaggggtgtatttttgaaggacttgggagctctctttgaaaggcaaacaacaagggaaacagtacctttatctcagtaggaaattaaataattcaaacatcaaataacttcaatttaaggctatggactttgagataattctgagccttgagaggaatgtggtcaggcaacctgagtccagtggaatgcaggtgcaacttctaagagttttcctgtaagtaattaagaagactaagtagccccagagataagacctcctcggatcattgtcccttcttatgtagtgataaagtaaccttccttgaagtgtatctatccgtaatcaatcaagttgctgcagcctatgcactggcccagaataaaaaacgtggtgattctgctaaagcttctctgtctttccctgtgtgtgaaatcttaacgtctctacttgggaacgctgatcccattcatttagagttgatgtttccacgtggctatttccaagctttgccttcaaataaattctgtacttaatcatatattctaaattttattatttactgctgacatcagtttctgtcggattgtaggagcctcaccagagagggcccctgtcgccatgttgtaaaactcacacttgccaaaagttgtgggttagggtttctccccctccctcaggatgacgctagttagctgacacagatggtcacctccattaccaagtagagtcaggatgaactatgtgtgactgttcaactatgtgtcctcttccctgaggactgattagtgtttatcttgaaaacatgtccttaatgggttgtatagaacactgaagcatctgatttcaaactcttagctcttttcctctatttcccatcacattctggtctaaggcttatttattaataaaatgatttttatttctttattatcgtggagatgatttttcatttgggggaagatcattttgttttcaaatatattgtctcaacatttaaatagtgaagtaaagagtatttcttgtgccaggcatggtggctcacgcctgtaatcacagcactctgggaggccaaggcaggcagatcacttcaagtcaggagtttgagaccagcctggccaacatggtgaaaccccatctctaccaattatacaaaaattagccggacatggtggcgcgcttgtaatgccagctattccggagggtgaggcaggagaatcacttcaacacagggtgtacaggctgcactgagccgagaccttgccactgcactccagcctggacgacagagaaatactctgtcttaaaaaaaaaaaaaaggaaattaagaaagtaatagatctcctccacaaatgtgctgggacaactaacttgatattcacatggaaaagaataatgttggatccctacatcacacaatcaaaattttattttaaaaagttagagaacgaggaagggagccctgcgggagggggtgttactttgtcgcccaggctggtctggaaccccaggctcagcaaccctcccgctgctgcttcctgagtagctgggacctcaggctccctccccagtgcccgcatctctgctgtgtttaagcagcaggtggtgacttcgctcctccctggcctgagcactccgtcccgcatcccaggcggtggccctagggaagtctctgaagctgagcacagggtggactctgcccccaccgccgacccgccctccccgaccccgagtgaatggagaatagaaagggagaggatttctgttctgtcctgtgggccctcagtatgaaatcgtagttctgcccaggcaggactttgcatttcacattctagtttgcatccccgttccagacaattccagggcttttgactcatgcctcagccttcccggccagtctcccttccaaaacccgaaaaacggaggcgctgggctcaagactgactctgtcccgccccggccccgccctctgccggttctaaagggcaaagtctctccgcctcgcgccccgcttccgcctgcccaggccccgcccacctcctcctggaccccgcccaggcctggcttctgtcctgcgcgagcagatcagcgcgaacctggaagcggagagcgtggagtgaaggtcccaccgcagcgcgtgagtttctctctgttttatattaagtctgtgcgtcccaggtccccggcgcgtctgtacctgggacgtggggtccccacagacctggaaattctcgcccgtcttcacccagagcaaattgagacttccctttgagagtccggggttcacttccttttgggtttaaaatcgccttgaagctggtgcggtctctggtcttgctgctatagggcaatgtatacactttgtattgggtagttttcctgctcaaaacctttttctaactcctcccgccccgcgctttttaaagtccttacaggtgaggtggattcccgccctgggcgcctcccaccctcgccttcgacggcccctcgagtgcagcgccgtgcccccagtcccgcggaggctgcgtcctctgcctggtcctgagatccttcagaccccaccattgtcttaaggcgccgtcgtcccccacctcccttctcgtgccgggccctgctgctccccaggtctcctctccgccgtcaccgcttcccctgagcccgcgttgggaaggtgtccggggcctgtcctgtgacacggggtgtccttgcctgcccagctccagcccctggaaaatgagctcccccgggatgcagacgtcttactccaaaccctcctgtaattgtatgggccaaaggaatcaggtgagagagagcagtagaaaacctgagataagaaaagagcaggaggagaaaagcaactggagaaatgtagagaaaagctagatgtacagagagatgaaggacagcaaggaagagagggggcagcaaag

SEQ ID NO: 12231 - DNA, 30867 bp, Human
  misc_feature (1)...(30867): n = A,T,C or G
tctgaccttgtgattcgctggccacagtctcccaaagtgctgggattacatgcgtgagccaccacgcccggcctgtattttttttttatttttattttttgagatggagcctcactctgtcgcccaggctggagtgcagtagcgccaacttggctcactgcaagctccacctcccaggttcaagtgattctcctgcctcagcttcccaagtagctgggaatacaggcacccaccaccatgcccaggtaatttttgtatttttagtagagacgaggttacactctggcctgttggccaggctgattgcaaactcctgacctcaggtgatctgcccgccttagcctcccaaagtgctgggattacaggcatgagccacagcacccggcaactccatcttaaataagaactgggtaaaataaggctgaggcatactgggctgcgttccaagaccgttaggcattctaactcacagtatgagacagcaggtcagcatgagacacaggtcataaagaccttgctgataaaagtttacagtaaagaagccggctaaaacccaccaaaaccaagatggcaatgagagtgacttctggctgtcctcattgctacgtcttccactgtcagaggcggttgaaccagggcaactctatcttgagtaggggctggttaaaataaggctgagacctgctgggcagcattccctggaggttaaggcattcgtagtcacaggatgagacatgaggctggcacaagatacaggtcataaagaccttgctgataaaacaggttgcagtaaagaagccgactaaaaccgagatagcgatgagaacgacctgattgtcctcactgcccaccagtggccatggcaacgtcaggaagttaccctatatggtctaaaaagaggatgcatgaataatccaccccttgtttagcatatcatcaagaaataaccacaaaaatgcgcaaccagcagccctcggggctgccctgcctatggattagccattctttattcctttactttcctaataaacttgctttcaccttatggattcgcctcaaattctttcttgtgcaagatccaagaaccctctcttagagtctgagatccggacccctttccagtagcaaaaggtcttagactgaagtactgactccacagtcgttgttaagaatcctagttgtttaatagaggcggtcttgggctcttgctgggccgcggtgtgttctgggaagtgtagtcacctgagtctccagttccttgtctctgggccgtgtgtgcacgccagcgaagcactgtgggagtcgtagtaggggaggaaaaccctataccctctggcgtgcggcgcaggagtttgggggaatgtagtcgccagagctctgcgttgtcttccggctttgggcgtggccacgatgcactctgggagtcgtagtaggggaagaacgtcctccgctcttttgcgcacggtcgctagaggttctgggaagtgtagttgcctgaagctcgtgttctttgtctttcgatgatgtgcgcttggcctcaaagcaccctgggagttgcagtggggcggggaaagccatatgctctctcgcgcggggtcgcggttgtttctgggaagtgtggtggcctgagttccacgttcttcgtttctccgctagttgtgcgcttggccgcgagacactctggcagttataggaacacaaaggtctgtgtactcttccgcggggggccgcggttatttctgggaaatgtagttgcctaggacccgggttctttgtttctcggctctgggcgtgggaggatagcccctatgctctggcgcaccgggccgcgatggctctgggaattgtagttgtcgcaggccctcgttctttgtctcctggcgttctgggcacggcagcgaggcgctctgggagttccagtaggaacgaaaagcccttgcgcgcagggccgcattggtttctgggaattgtagtttcttgaggccggcggcctggttggggtgacgtcggcgaggcttctgaagacgcaattcctgcgacgcccgcggaggggccctggggggcggcgccgagcgtctggcctgtgttggctgtaggcaacgaaaggagccctcccggtctgcgccggatggccccgggcggtgactcggtccggagccctggaacgctacgcccacctggcggaaagcaccacggaaacgcatccttctgtggccactgttaggtgagggggttctggggaggcgcgccgtggcaggaagagaaagccggcgccagtggtccaagcgcgatctctcagggcgccctgctctctacgtgggaggcgcggagcgggggccacgggaatccccagtgcgggaatctagtgacttgggcgcggcctagctggcctgttcgctcagggctcctttctctctctgccaggtctgccattttacacttttctgatctcctccttcccttctgtgagctatgtctcaggtaagctaatgattgataaatatatatatatatatatatataaatttttattttttttttaagagagagacagggtctcctcctgtcgcccaggcagtggagcgatcatagcatcctgtaacctcaaactcttggcctcaagtgagccaacccacttggcctgtttccgcttttctttgtgaagtgcagccgtgtttttcaggacttgggacgtggctttctttctcctacaaccacctgcctggcagaaccccaggaccctgtcccttgttcctccttttcaggtgcttatacttaagtatacatgaagagagtgacaggaagctatccagatgtgggcggggtttctgacctggctggcatgttttagggtgagagggtagggtgccagctgttacatcgcctcctctttcccacagtgttagaatgaggagtgctttacgttactccagcgcccctttattcatttattcaatatgtttttactgaacctctactttcagtggttcccacagtgtgatccttggaccagcagtatcagcatcatctgagaacgtattagaaatgaatattcttgagtcctaccccagaccttctgaatcagaaactgagaatttggcccagcagtctaacagtccttccaagtgattctaatgtgcaactcattctaagtcttgaggatgcagaagtgaccaaaacaaaatctccgaatcctcagagctcatttttcagacatgacataaggaacacatttttattttgatttggcctaagggcttggctggtaattgtgcttcacagcagtggggataacagggtcaactattcaaaatgagtccctcatttcagttccacttctttatcctactttttgtcatacttctctccaaattcagaggttctctgagttttgctggggaatccaatttccacctctgctgcagatcttgctgtgtaggaaacagctgctttattagtcaacagtctttaatcacttttttattaaacttcaaaactgtaaattataactgccatccatctgggactgctactagtttgagacattttaaattcccattcatgccttatagatcaatgtggatcactcaagtggtgcaaaaccaggctgcaaagcaagggcttatatattattccccctaactctgagggaaagtgctttaggttctgtcctgggaggtattacattctcttcttgcggaatcaagattctttattgcttatcctccttgttctgtgacattgctaaaattaccactaagtttcacaggtatttctttaggattagggataactgtgacaaacttgagactgtatgccccatttgaagggtggtgctgttatctgctgtagccaattattaccctgaagaaattctggctgaattatattaaaataggctggtattaaggaaaatatacattgtttattaacataaaggaatactgtaaaatcttaagaatttttacaaccaatgccaaaaatccatattgttcatgtgtataatcctttattttgaataaaattgtaaattatctcaggacagataatttatgtttttctccttttctccagttatacaacaaaacacaagagctaggctcttcattatataattactcagaattctgaaaactctcactgttactacttagacacattgcctaacctccacagtgagactcattttattccttgatgagggagtttgggggcatgcgtgctggtcatgcaaatatctgtccgtcatttcaggggtcagtgacattcagagatgtggccatagacttctcccaggaggagtggaaatggcttcagcctgctcaaagagatttgtacagatgtgtaatgttggagaactatggccatctggtctcactgggtaagtattcttcttcatctccctcaaggcaaaatttgaccgttagggtggctgttataattatctggctgaatattcccaagagaggtatggggtttcttaaaattagttttaagatggggacgtaactgcaccttatttttagacattttaaaaacttacatctgacatttcctttgtggcccctcttaggattcaatgactgatcttgaatttatttcattttctgcaagcaggtctttccatttctaagccagatgtggtttccttattggagcaagggaaagaaccctggctggggaaaagggaagtgaaaagagatctgttttcaggtgagtgagttggaagctgatggggaaattttttaaaaccactcaattagtcaatgaaaaaggaatactttttaatatgttgattggaaaattttcccttaaagatactagagatacgctaggcacggtggctcatgccggtaatcccagcactttgggaggccgaggtgggtggatcacgacgtcaggagatcgagaccatcctggctaacacggtgacaccccatctctgctaaaaatacaaaaaaatttgccgggcttggtggcgggtgcctgtagtcccagctacttgggaggctgaggcaggagcatggcgtgaacccgggaggcagagcttgcagtgagtcgagattgcgccactgcactgcagcctgggagacagagcaagactccatctcaaaaaaaaaaaaaagataccagaggtataaagactgaagtttcacttacaactccataaaacactacttcatacccaattctgttttttctatattacctaacagctgacatagtcgaccagttctcaccttatactttcttttctttctcacaggtgtcttttttgttcccgttgttagttctgtctggtctctgaatttcatttctttttgttttttctttcctttctttcttcaaatggacatacatttctattgcctgaattcaacctgagaaagaaaaaaaaaattaaaagtacatattttgctgttctatttaatcaccttgaaaagattaattcattactctttgattaattgatatttatttattccttcacatacactcttaatatttacagaaattttaatcttgtcaaatctttctcaagactttctattaagtgctacagagactagagagtgtgcaaaagtgtaataactatcaaggaattcatggcctagtgatgtgtctaaatagcttgcattagatatcctcaaattagcagtacagcagtgaaaaaaggaatttccagttgtcgttttaggcttgggtaatttggatgcagatagtactagagaaacaaaagacagaaaaagggtcagttttggagaaaaggtgatgaattctgtaagttctgtaaattctatagttgcttctatagcacatgtttaatggaggtacactgatttttagagagaaaaggaggaatgcgtactttttaggaggcagcagcttaggactgatgaaacagatgtcatgaaaactgagctgtagctttaaggaagagtagtggttcatatgaaatgctgcggagtcccttaggagaatgtccagaaggatttgcaaaggaggtactaatgtgggctgaagcagtgagatggaacaggtgcagggaaactttgtttagtgggagcaaatgaggaaaaatgtcctttttgaattaaaaaataacaaaactgataaaagcatgtacaaaggaagtgaggaaaaaggaaaacatggaagttgcctctaattctactactttttttttttttttgagacgaagtctcgctcttgccccctaggctggagtgcgatggcgcgatctcagcttactgcaacctccgctgtctgggttcaagtgattctgctgcttcagccccctgagtaactgggactacaggcacctgccaccatgcctggctaagttttgtatttttagtagagatggggtttcaccatgttggccaggctggtctcaaactcctaacctagtgatctgcccgcctaggcctcccaaagtgctgggattacaggtgtgagccactgtgcctggcctaattctactactttaacacagttcttgaagtttttatgtattccttccaggatcttattttgaaaatttttttcattgtgaaatatcacacacagacagaagtaatgcatgaacatacatgtacagcttaataaattattataaggcaaacagccacgtgaccaaggtcaataaacacaatactgctaggttccttgagagccttctgtgtgctcatcctaaccctccaataaagctaatcatctctttgcttttatggtaaagtagcttccttggttttctttattgttccatcagctctttgcatttgtgttcactatagttgaggttcatgtgtttgttaactttatatagaaagatttataatgtatttattgatttgcttctcaaaattatttttaaaatgtttttggctgtgcatggtggctcatgcctataattccaatactttgggaggctgagttgggagaatcacttgaggccaggagttgaagacaagcctgggcaacatagagagaccctgtctccacaaaaaaattttaaaagctagctaggcatggtggcatgtgcccatagtcctagctacttgagaggttgaggtaagagaaccacttgagcctaggagtttcaggctgcagtgaactatgattgtgccactgcactccagcctgggcaatacagcaagaccctatttttttaaaagttaaaagaatttttaacgtaattgctctaatagtttttttcattgtacgataagtataccacaatttattcgttctactattgagggcttcttaagttttttgcacatttagagatactgcaagcaatgctgttactgtgcatgtatcctgatacatattggcacaagtttctctgtggtttatatctaggactggaattgccaagttggaggataatgcacctctttatgttattagataatgccaaaatgttttccaaagacccttgactgacttatactcccgcaaacccaataagtgaatgcctgttgggcatcgtaattttcatctatcagaagggtgtgcagtggtagcttgtggtttaaacttgcatttgtcaggccattaataaagttgagcaccttttcgtatgtttattgaacatctaggtatccccatctgcgaagtgaatcttgaagatttttctcttgtatctattggattcttttattgatttgtagaagttatatattttagatagaaatcctttgctaattgtatgtacttcaaaatctttcacatgtggcttttttttaaccttcatagcttcttttgatgaacagaaattcttaattttagtgtagtcagatgtatcaatcttttcttttatgtttagtatttttttagcctgtttaagaaatctttccctcctaagagattatgatgaagacatcttcctatattttcttttaaaaaagcctacttattttgccattcacatttcgatccatcgttcactttattttgtcatgtgagttagtagtcaactttgctatcttctgtatggagatccagttatcatagtaccatttattgatagatcaaccattttcctcactgttttgaaattagttaaatgtcaatttttgtgtttgtatgtttctaggttctcaattctctttcatttttctctttgctcaaatctatacagccttagttacagatttaatgattaacattttattgtatttgtcttacccctgcccctttttttctctgaattattttaagtaaacagggctaccatttaagagttgttgctgcaacctagtgtagatctaatcattacctgaactatgtaggcatccagggagctaagggaggtagacagattggaaataaagtgaagaagtagactcaaaaggacctggcgattggctagatgacagacatgaagaagactgagaagtcgtggttgacattagtctttttggtggtatgattgtttccttagttaaaaaaaaaaggatcagcaagtttgtaggggagggaagattatattgagacttgttgagtttgggtctctgtgggatacgaatatataaatccagtaggcaattgagtatcatagtcaagaggcttcaaatgcatattcctaggccccaccctggaaattctaaattggtaggtttggggtggaaccaaataatttgcatttctttctttttttggctagtcaaaaaaaaaaaagcgggagtggaggagaaacaaagaaatctataactagttgttatcaatgacttataaactccactgcattcagaccagccagaatttgcatttctaacaaatgaccagatgatgctgatgctgaactaaagtagacatttaggagttacctgcacagcttcttaaaattttgaattttctttgtagaattgttgcatacctgttatttcttcttaagcaactttccccagtttcttttctatattgcttctctataggaatgctagtcaatttgtatatttatatctctttatctttattatacaaataatacggctgagtgtggtggctcacacctgtaatcccagcactttgggaggccgaggtgggcagatcacctgaggtcaggagttcaagaccagcttggccaacatggtgaaacccgtctctactaaaaatacaaaaattagccgggtgtggtggtgtgcgcctgtaatcccagctactcgggaggctgaggtggaagaatcgctggagcccaggaggcagagggtgcagtaagttgagatcatgccattgcactccggcctgggcgacagcaagactctgtctaaaaaaaaaaaagaaagaaaaaggaaggaagaaagaagggaggaaggaaggaaggctctaaatctttctagattttttcctgcaaataccattgttgtttatagaataatttcactgcactaaaaattctctgtgttctgcctaatcacccattcccaacccttggcatccgctgatttttgttactgtctccatagttttgcctgttccagaatgtcagagagttggaattaaccttttcaaaatggcttctttcacatactaatacatagtaatatgcattttagttacatgtcttttcatggcttgatagctctttctttttagcactgaataatattccattgtctgcatgtactgcagtttacttatatgttcacctacttaaggacattgtggttgcttccaaagttttgacaattttgaataaagcacatctgtgtgcaggtttttgtatgggcataagttttcatttcatttgggtaaataccaaggagtgtgactgctgggtcatatggtaagaatatatttagttttgtaagtaactgccaaaatgtcttccaaagtgattgtaccattttgcattcccgtcagcaatgaatgattgatattatcatgtgattttatttttttatcacgattggttgttggattttgctaatgcttttattgcttctattgatattatgtgattttacttctttagcctgttgatgtgatggattatattttacattaattgattttcaaatgttgaaccagccctgtatacctgggataaattccacttgggcatggagtataattccctttatacattgttggattaaatttactagtattttgttgagaatttttacatttatgttcatgagagatactggcctgtcattttcttttcttataattcctttggttttgatactaggtcagtgctggcctcatagaatgagtggggaagttttccctccgtttctgtcgtctggaagagattgaggggattggtataatttcttccttaaatgtttggtagaatttaccagtgaatcctgatgctttcatttttgaaagttattaattattcatttgatttttttttttttcgaggcagggtctcactctgttgtcaaggctggagtgcagtggtgcaatcatggctcactgcagcctcaacttcccccggcccaggtgatcctcccgtctcagcctcccaagtagctgggactacaggtgcgctccaccatgcccagctcatttttgtattttttgcagagacgaggtttcaccatgttgcccaggctagtcttgaattcctaggttcaagcaatctgcccaccttggcctcccaaagtgctaggattgtaagtgtgagccaccacacgcagcctcatttgatttctttgctagatacaggcctattcagatagtttcctccttattgtgtgagctttagcaatgtatgtctttcaaggaattggaccattttagctatgttatcaaatttgtgggcagagttattcatggtattcctttattatcctttttatgcccatgaaatttgtactgaggccccctttcattgctgatattaataatgtatgacatctttttttcttaattagcctggctagaggcttattgattttaattatcttttcagagaactaggttgatttggttgcttttctctattaatagcctattgtaaatttcatcaatatttgtgcttttttttttttttgagacagagtttctatccttttgcccaggctggagtgcaatggcactatctcacttactgcagcctctgcctcccgggttcaagcgattcttctgcctcagcctcctgagtagctgggattacaggtgcacgccaccacgcccagctaattttgtatttttagtagagatggggtctcatcatgttggccaggctggtcttgaactcctgacctccagtaatccacgcacttcagcctcccaaagtgccgggattatagatgtgagccaccacacccagcctatttttttgagacaggatcttgctctgtcacctaggctggaatgcagtgccacaatcgtagctcactgcaacgtaaatttcctgggctcaagccttcctcctgccttagcttccaagtagctataagtaccgacacatgccaacactcctgactaaatattttattttttatttgtaaagacagagtcttgctatgttgtccagtctggtcttgaactcctgtcctcaaatgatctacccaccttggcctcccaaagtgctgggattacaggtgtgagccactgcacctgggtcctttgctctgatttttatttcttttcttcttcctttgaatttaatttgctctttttaaaatttcctgacatagaacgtagatgattgatttatgaaggggtggcctgcccctccacacctgtgggtatttctagtcgggtgggacaagagactgagaaaagaaagaagacacagagacaaagtatagagaaacaacagtgggcccaggggaccggcatcagcataccaaggacctgcaccagcaccggcctctgagttccctcagtttttattattattttcattatttcagcaaaaaggaatgtagtaggagagcagggtgataataaggagaaggtcagcaaaaaacatgtgagcaaaagaatctatatcataattaggtttaagggaaggtactatgcctggatgtgcacgtaatccagatttatgtttctctccacccaaacatctcagcggagtaaagaataacaaggcagcattactgcaaacatatctcgcctcccaccatagggcggttttgctactatctcagaattgaacaaatgtacaatcgggttttataccgagacattcagttcccaggggcaggcaggagacagtggccttcctctatctcaactgcaagaggctttcctcttttactcatccatctcagcacagaccttttacaggtgtcgggctgggggacggtcaggtctttctcatcccacgaggccatatttcagactctcacatggggagaaaccttggacaataccctgctttcaagggcagaggtctctgcggctttctgcagtgcactgtgccctggtttattgagactagagaatggcgatgacttttaccaagtatactgcttgtaaacattttgttaacaaggcacgtcctgcacagccctagatcccttaaacattgattttatacaacacatgtttttgtgagctccaggttgggtcaaagtggctggggaaagctacaaattaacaacatctcagcaaagcaattgtttaaagtacaggtctttttcaaaatggagtctcttatgtcttccctttctacataggcacagtgacagtctgatctctctttcttttccctacatttcccccttttctttttgacaaaaccgccatcgtcatcatgacccgttctcgctggtcgctgtctctccggagctgttgtatacacctgtagactaataatagaaaggacagacatacaaggattaatacaaaatttgtaatagtggaatttccagtggttttaacccaagtgacagggttaagatttgtgaggctatcaacagcttttaccattgtctcagtttctggcaccagatttaactgggttttgatgtttcaaaaataatgttctttcaatttggaaatatctaaagtaagattgtcttctcttccttgtagacggcgtttaaccatgtcccagtgatgttcagattcattataggctcgaggtgtaatacaaaaatctgacgtagtccagtcacactaactgaaaaagatattccaggctcatgagcctatctcccatccaaatgacagtttgtctaagatcattaatttgatttgctaatttttgatctatttgagtctgagaattccacagtcttgaggaattcttttgccaattattcacatattttgtagtttgaacagagcagtgtaaagcaattccagcagccacagcagtagctgtgactgcaataagacccataatcactgcaatcaaagtaaaaatgaatcttttagatttagttagaactccttttaatacttctgttaagatatgtacggatggagaagcctcccacggtcggtccatggacacagggatcctcgcaccctctcttgccctcactaacagaatacgatgctgccaatcaaaagttgaatcaatgcaagtaaacaatctacaattttcacaggttatagtttggacatctggtttaataactatgtttcctacaactagcatataagggggttttacacaactttgcaaaggaattgtcagattggaatttaggttaatagtgtaatatggcttgtgatttcttgtttccataacttgatttccataccaaattttaatgtggtaggagaccacagtgagcttccataattttgggtgttcaggaccaacaacaggactaactaactttggtcggggtgatgaaattcccttttcaccccatttccatggatagggtgattctagccttctgtaaacctggtctagccttttagttaaatcaccatcataggccggattagtgggccagagagatggagcctgtgaacatgagtgggcctggcccgtacaatcataatataattggcctcgaggggcccagtctataatagttccaaatttattgttttgtagtaccactgcagtatcagccgcacattgttcccaaactaagacttctgggtcttttgattcttttggaatttccttggggcatggttttcccttaggcctaaattttaatgatctttgataggaagaatcctgtaaattattcatttgtgacccgattgacattccacttaccatgtgataagtaaatttactggtggcattgacagtaggtacttataccaaccaattttggattgtaggcattaagcatcctggtgctttttccaggcaaataggaggataatgatacccaatggaaatgtttatcatcattccttcttcaggttgggcagggccacggtcatccatggggcctggtacccatgcactgttattaacgtatacttcaataggattatctatccaagtaattgtctgaattaagggtgggaaaggcacataggcccagtaagtatagttagttgtagcggctcctgcagacatagggagacttaccaccgttgatacaatcattaaagctgcaagcagcatattctctggagtttgtgttactcttgtgttttccaggctttttttcagctaactgtgtcagcttctttagctgggcccatgtcgacggctccgctttcttggtagatggaaacttcttttgtaagttgtaagtatccaaactggaagctgatttattttctggttaaacacaagcaaaatctctcccccatgttatcaccttccctatttcccatgttttatttttgttgtctttccaccaaattagttttccctcatgtgggctgttctttttaccagtaaaatgttgttctgcagaagtagtggtctgatttctatatatgtttagaaaattcaaagtatagagtgctagattaagttgtatctggggagtgttatattccttactttttgtctcccttctcttacagtctctctcttcctctctctctctctcacacactttatctccagtttcactttctgtgtctctctctaatctctgtctcttccttttacacgatctctctcgccagtctcactttctgtgtctttctctgatctctgtcttttccagtctctctgtctgttatcccctgtgtcctctctccttcacacttagtctctttttctttctctttttctccccagttttacttttctctctgttggtctttcccaaataatgaaaaggagtggaggtctgaattttatcagatgatattgtcaggcctgcgtttgcaacctctgtctgcagaaatgtgtaacagtcaattaatttgtctctggtttctggagcacacaaaatattatcaacataatgaataatacaacagtctgaaaacttgtctctcattggttgaagaacttgagctacaaaagtctgacaaatagttggactattaagcattccctgaggcaacactttccactgaaatctggtggctggttctttattatttacggctggtatagtaaaagcaaatttttcaaaatcctgttttgccacaggaatggtaaaaaagcaatcctttgaatcaattataattaaaagccaatctttgggggtcatggccggagagggcagcccaggttggagaggccccatgggttgaattgctgcattaatggctctcaaatcagttagcatgcaccatctgcctgattttttctgaattacaaacacaggagaattctaaagagagaaagtgggtggaacacatcctatttaaaatagttttttaactattttatgtaacacccccaacttttccttagagagcggccactctttgacccatacaggaagctgcagggcaagtctgaattgctccttcaccgtagtgaactgcaggttgggcaataatgagtgccacgagccaagtcgcagcaagcgtagtttcaggctccctcccccagcactcactcggctgaggaggaggtggccatcgtgcttttaaccccaacagccctgatggttctggactttttccttttaattttaatgtttcaggatatattacctcctgtaattgattgtagtcaacattttgcgttgaccgagccattactggctctgctacatttttaccatgtgaactttctgttcctttcttgaactctgtttctgcctcttcacaatctattacacagctttcaggggcatcagaaactgaaactctaacttcttctgtttgaaatggttctaaagttgctttaataatagcccaatcattccatactgcacgtgggatgattttaccttccctagttgcttgttttaattctttgccaattttttcccaatcttttaaatctaaagttccctgttctggaaaccatgggcagaattgttctattgtttgaaatagcgtaattagattttctgtagaagctttaactccccctcttcttaagagaattttaatgaagctgagataagaggcatatttacttgcagtttgccccattgttaccctggattcctccgagcgcacaagcttaccgcaaggctgactgtggatgtactcgggaatctctcgtcggctgtcctcaatgctcacgttcttagcataccttcaccctagagaaaggcccccacatcgggcgccagatgaaggggtggcctgcccctccacacctgtgggtatttctagtcgggtgggatgagagactgagaaaagaaagaagacacagagacaaagtatagagaaacaacagtgggcccaggggaccggcatcagcataccaaggacctgcaccagcaccggcctctgagttccctcagtttttattattattttcattatttcagcaaaaaggaatgtagtaggagagcagggtgataataaggagaaggtcagcaaaaaacatgtgagcaaaagaatctatgtcataattaggtttaagggaaggtactatgcctggatgtgcacgtaatccagatttatgtttctctccacccaaacatctcagcggagtaaagaataacaaggcagcattactgcaaacatatctcgcctcccaccatagggcggttttgctactatctcagaattgaacaaatgtacaatcgggttttataccgagacattcagttcccaggggcaggcaggagacagtggccttcctctatctcaactgcaagaggctttcctcttttaccaatccacctcagcacagaccctttatgggtgtcgggctgggggatggtcaggtctttctcatcccacgaggccatatttcagactatcacatggggagaaaccttggacaataccccgcttccaagggcagaggtccctgtggctttctgcagtgcatgtgcccctggtttattgagactagagaatggcgatgacttttaccaagtatactgcttgtaaacattttgttaacaaggcacgtcctgcacagccctagatcccttaaacattgattttatacaacacgtttttgtgagctccaggttgggtcaaagtggctggggaaagctacaaattaacaacatctcagcaaagcaattgtttaaagtacaggtctttttcaaaatggagtctcttatgtcttccctttctacataggtacagtgacagtctgatctccctctcttttccgtacaatttacattttttctaatatattaattcaatgctataaattttcctttaagcactgctttcactgcatcccactgattatcccactgaaataagttgtattttcattttcatttagttcaacatatttttaagtttcagatttcttgtttgtgttacttagaagtgtgttgttcaatatccatgtgttttgagattttccttttaatctttctgttactgatttctggtttcattccattgtggtctgacagcacatattatatgatttctattctttgaaatttgttaagatgtgtgttatgactaagaattgcgtctatcttcgtgaatgtcttgggaattggagatgaatgtgtaatctgttgaatgaagtagtctactgatatcagttgattgatggtgctgttaagttcagctgtgttcttaacgattttctgcctgctggatctgtccagttctgaaagaggggtgttgaagtccccaagtgtaatagtgcattcatctgtttctccttgctgttttatcaggctctgcctaatgtattttgatggtttgttgttaggcacatgcacactaaggatttttatgatttctttcttggagtattgactcctttatcattatgcaatgctcttctttaaccttgctctgaagtctgctgtgtctgaaattaatttagctacgtctctttcttttgataagtgttagtatggtatacctttctgtactcacttattctaaatctatatgcatcttcatatttaaactaggtttcttgtacacaacatatagttgggtcttgttttgtgatgcactctgacaatgtcttaagttagtgtatttagactgttgaccttcatttttaaaatttatttaatttttggctgggtgtggtggctcacgcctgtaatcctggcactatgggaggccaaggtgggcagatcatgagttcaggagattgagaccatcctggctaacatgatgaaacctcgtctctactaaaagtacaaaatattagccaggtgtggtggtgggcacctatagtcccagctactcgggaggctgaggcacgagaatggcgtgaacccgggaggcggaggttgcagtgagccgagatcacaccactgcactccagcctgggcaacagagcgagactctgtctcaaaaaaaaaaaaaaaattacttatttctttagagacaggatctccccatttcccaggatagagtgcaatgatacaatcatagctcactgctgtctcaaattcttgggctcaagagatccttttgcctcagtctcccaatgtgctgggattatatgcatgtaggagccgaacgcgaagcgaagttccgttaagaaccgctaaatagggtaggtggtgtgatgctgataggtagcgtannnnnnnnnnnnnnnnnnnnccagcctgggcaacagagcgagactctgtctcaaaaaaaaaaaaaaaattacttatttctttagagacaggatctccccatttcccaggatagagtgcaatgatacaatcatagctcactgctgtctcaaattcttgggctcaagagatccttttgcctcagtctcccaatgtgctgggattatatgcatgaggcaccacatctaaccgtgtgtgtgtgtgtgtgtgtgtgtgtgtgtgtgtgtgtgtgtgtgtgtgtgtttttgagatgaagtcttactctgtagcccagactggagtgcagtggcgcaatcttggctcactgcgacctccccctcctgggttcaagcaattctgcctcagcctcctatgtagctgagattacaggtgcccaccaccacacctggctaatttttgtatttttagtagagacgggatttcaccatgttggccaggctggtctctaactcctgacctcaggtgatctgcccacctcgacctcccaaagtgctgggattacaggcgtgagcctacgcacccagcccccttttgtgttttttattgagcattttatatgatttcattttctcttctttcttagcatattgattatacttctttttctcatggttgtcctaaagtttgcaatatacattcttttttttgagatggagtcttgttctgtcacccaggctggaatgcagtggcatgatctctcctcactgcagcctccacctcccgagttcaacagatcctcctgcctcaacctccatagtagctgggattacaggcatgcgtgctaccatgcctggctaatggtctgcatttttagtagagatagggttttgccatgttggccaggctggtctcaaactcctgaccttaagtaatccacctgccttggcctcccaaagtgctaggattacaggcatgagccactatgcccagcctacatttataaataatccaaccctactttcaaataatactgtgccacttcatgtgtagtgcaagtaccttataataaaatatttctcattttttcctccagtccttagtatcactgttgtcattcatttcacttatatgtaagctataatcataaaatacattgttattatcattatttttttgagacagagtctcgctctgttgcccaggctggagtgcagtggcacgatcttggctcactgcaacctctgcctcccgggtccaagcgattctcctatcagcctcctgagtagctgggactataggtgtgtgccaccatgcctggctaattttttgtattttattttatttatttatttttgagacagagtcttgctctgtcacccaggctggagtgcagtggcactatcttggctcatccgcctcctgggtttaagcgattcttctgcctcagcctcctaagtagctgggactacaggcgcgagccaccacgctcagctaatttttgtatatttagtagagacggggtgtcaccatattggccaggctggtctccaactcctagaccttgtgatctgcccgcctcggcctcccaaagtgctgggattacaggcgtgagccaacgtgcccagccttgtattttattttttgagatggagtcttgctctgtcacccaggctggagtgccatggcatgatcttggctcactgcagcctctgcctcccgggttccagacattgtcctgcctcagcttccttcctgggtaactgggattacaggtgcacaccaccacgtccggctaatttttgtatttttagtagagacggggtttcaccgtgttggccaggctggtctcaaactcctgacctcaggtgatctgccggccttagccttccaaagtgctgggattacaggcatgagccactgtgcccggccaatacattgttattattttgaacaagctgttatctgtgaggttaattaagaataagaaaactaaggctgggtgcagtggctcacacttggaatctcagtactttgggaggcttgggtgggaggtgcttgagcccaggaatttgaggctctagtgaaatataatcccaacactcttctgtaacctgggcaataaagcaagaccctgtcttttaaaaaaataaaatatttattttacttttacttatttcttcttaaatgctattcctttcttcatgtaggtctgagtttctgacctgtatcattttccacctctctgaagaacttctttcaacatttcttgcagggcaggtgtactggcaacaaattccttaaaaaaacttttatttttctaagagagtaatttctccttcacttttgaaggataatctcacaggctacagaattgtgggcttgagagttttttttttttctctcagcacttcaaatatttcactccactctccttgttctttttcttggtttctgagaagatctgatgtacggtaatcctcccctatcttcaggggatattttccacaacctccgatggatgcctgaaaatgcagatagtattgaacctcattgccattggttagagtatgtttctgttcatgtcttccatccaaaaatttaatgccttttccgtttttttttttttttttttttttttttggcagggtcttactttgtcacccaggctggagtgcagtggtgttatcatagctcactgcagcctcgagctcctgggcttaagcgatcctttcacctcaacctcctgagtagctgggaccacaggtgcataccaccacacttggctaatttaaaaaaatttttttagagatgggtgctccatatcttgcccagctggttgcaaacttctggcctcaagcacttaggcaatccccttgtcttggcctcccaaaattctgggatgacaggcatgagccaccttgcctggcccttttacaccttaactaagcacttatgcacttgtggttgcaactttagcagtttgaggtgcaacagcgaaactagctgagttgctttttttcttcttcatatgaatagaagactcattctgctgtaatcttagcaacctcagcatatgagagagtttttccttattgagtggagaagaaatttcacattttcccattaaggaagcactttgtagcttctttttggcatatctgaattgtcagcatcactattcttgtgctttggggccatgattaagtaaaataagggtcagttgaacacaagcactacgatactgcatcaggtgatctgacagctcctaagtgactaacaggtgggtagcattcgcagcatagatatgccaggacaattcacattcggggtggggtggagcaggatggtgcgagacgtcacactactcagaatggtgtacagtttaaacatgaattatttctggaattttctatttaatacttttaaatattgaacaaaggtaactgaagtggtgaaaaactacagaggagaggactactgtaattcccagccttgttcctttataggtaaggtttttttcctttgacttcttttttctttgtatttgattttctgaaattggaatataatatacctaattgtaggggtttttgtgaggggcgagagggcacttaccttgcttggtgttctctgtgtttcctccatctgtggtttggtttatgacattaatttggggaaattctccgtcattatttcctcaaagactgcttctgttcttccttcttttttagtatttctgttatgcgtatattacatcatttgtagttgtcctacagttcttggataatctgttccttttttttccctcaatattttatctgtttttcagttttggacgtttctattgagatatctacacagaatacttatgagcccattgaaggcattctttattttcattacaggaattcttttgagatggagtctcgctctgtcacccaggctggagtgcagtggcgcgatctcagcttactgcaagctccacctcccgggttcacgccattctcctgcctcagcctcccgagtagctgggactacaggcagtcgctaccacgcccggctaattttttgtatttttagtagagacgggtttcactgtgttagccaggatggtcttgatctcctgaccttgtgatctgccagcctccacctcccaaagtgctgggattacaggcgtgagccactgcacctggcccattacaggaatttttatttctagtatttccttttgattctttcttaaaattttcatttatctccttacattatccatctcatcttgcatcttgtatactttttcccagtaaaactgttagcatattaatcatagtttcttaagttcctggactgataattccaacattcctaccgtatctgtctcagattctgatgcttgttcagtctgttcaaacttttttttttttgccatttagtatacctcataattttacattgaagggtggacatgatgtactgagtaaaaggaactgccttttgtaatgtagtggtaaggtgttgagggaagagaagcattttgtaatcttaaaatcatggtaagcctgtgcttctggactaagaacttaattagttcttaattttttttccaccttatgtgggataggatggctagaaggggctggagtttagtttgttcaacttttcacttgtttttaggacagagtagtgacttctaagatccttgtaagtcagactggaaactgcaagtctccctgtcataattttccataatttccttcttcctgtattgatcttaaataacattggtgatagaaggtattaggctgttttcccaagaaaagagtgaatacatctaaaaaatttccttggagtatattagttgctggtttatcaaaggaatcctttattacatcaagaatgaaaccttggtggctcatgtctgtaatcctagcactttgggaggccgaggtgggcagattgcctgagctcaggagtttgagaccatcctgggcaacacagtgaaaccccatctctactaagatacataagtaaataaataaataaaataaaccattagccaggcgtggcagcgtgtgcctgtagtcccagctactcgggaggctgaggcaggagaattgctcaaacctgggaggcggcggttgcagtgagccaagatcgtgccactggaccccagcctgggtgacagagcgagactccgtttcttaaaaaaaaaaaaaagaaaaaagaaaccttctatctataggcttttaataagtactgagtttcctcaaatccatttggcatctactaaaaagagtatggaggtatagtaggagatgggaagaggtgaggtgattgaggaagggaagtgtgtgaagggctatgtaattagcattctatttttatatctcgaacattgttttgattgtgttttttactctcattgttgtgagaaatatggcaaatacactaaatctgtgcaattaaccccattttttcttctttttaattgacacaatgactgtacgtttatgaagtacaatgtgatgtttcaatacatgtatacattgtataatgatcatataaaattaattagcaaatccattatctcaaatgtgtatcatttcaaatgtgtatcatttctatgtgataagagcattcaaaacttctctcttctattttgaaagatacattattattagctataatcaccttaccatgcaagagaacacctgagcttattcttcatatctaacaataacatcttacctgtccaacaccccctttgttttaagacagggtgacattctgttgcctgaattcctgggttcaagcagtccttccaggtcactctgtcaagtagctagaagtacagatgcacagtaccgtgcctaagttttaatttttttttttttttttgggtaaagacaggggtctcactttgtcactatgttgtttaggctggtctcaaactctaggactcaagtgatcctccagcctcagcctcccaaagttggattacaggcatgagccaccacacccggccccaacagctttctatttttttttaatgtccaggttcacttggtatatttcagttcccagtaagtttccttgaagcatttctagatgaagcctttatttattggagtggatttttaaatcttatctctggtcttttatacaatttttaccctaagtataatgaacttgctcttgtgtcttatatcaatattttcttctgtgttctctttccctatttatattctcagttcctgaaaagaattactcagttcacatctacagagttcttatttaggtactcagtagatacagaattggtttaaagaagaggcaagaaaggaatttaatgttttatctgcattgacacaattattttaaaagctgtttcactgcctccccatcttgatctttcatgtattttgtatacctaccatataggtacagatcttgatccattattgagatatgaattaaatatttcatcaaagaaacagtctatttacctttccttaaaagcttactgtgagagcaataacagataacatttttcccaaagtgccaacgtatgtttgactgaaatgacaaatgcgtttttagatgttattgggaattttaagcttatgtaaaagttataagaatagtacaaagaatgttcacattcacctttgcttgtacacatttgccttatcatttggcatatgatttttcttctgaaacatttgagaataagttctatatattatggccttttacctctatacacttaagtgtagatttcctaataagaatttcctaaagatacaatttttttttttttttgagacagactctcgctctgtcacccaggttggagtgcagtggcgcaatctcggttcaccgcaacctctgcctcccaggttcaaatgattctcctgcctcagcctcctgagtacctgggactacaggtgcatgccaccacgcctggctaattttttgtattcttagtagagacggggtttcactgtgttagccaggctggtctcgatctcctgacctcatgatctgcccgccttggcctcccaaagtgctgagattacaggcgtgagccactgcgcccggccaagagtatgaatgtatttttaaggagacacttcatattatttcaaaattctgttccaatttaaaaatgatgaagtccctcgttaaaattcagcatggagaaaattagggcttatatttgtcaaacacatttgatattaagacactttatttttctgtccaactttcattttaggttaaaggttactcatgttacatgagcaaattgtgtgtcatgggggtttggtgtgcagataattttgtcacccaggtaatcagcataatgcccaatagtcaggtttttaatccttaccctcctcccacattccaccctcaaataggtcccagaaaagacataattataccaaatatgagcttcatactagttcagaaggtagagttggaggatcataggcaagttttcagagaaaccgctttttttttcatttagattattataagatgttccagaggcactaagtgaacagaatctaatgtctttgtgcaatctgacgaacacttagtgtttagtagcagcattatgaaattgccatttttagataattctggcagtaaataccgtttaaatggtggtgaagaagactagcaacctatccttcacaaatatttcctgatagctctattttccctgctctttcaattacttacgtttacactttctctttatttacctatatgtctatctctgtttgatcttttctgaagttctgggcatactactcagatttcagtcacagctgtgaaagctgctattgataagattttttgaaacttcattctgttgctaaagaagggagaaatggccttattttattcaatacaggaaaaagaaacattcactttttttttggtatctttcagtttcagagtcaagtggtgagatcaaagacttttcaccaaaaaatgtcatttatgatgactcatcccagtatttgatcatggaaagaattctaagtcaaggccctgtgtattccagttttaaaggaggctggaaatgcaaggatcatactgagatgctgcaagaaaatcagggatgtattaggaaagtaacagtctctcatcaagaagccctggctcaacatatgaatatcagtactgtggagaggccctatggatgccatgaatgtggaaaaacttttggtcgacgcttttccctggtgttacaccagaggactcatactggagagaaaccatatgcatgtaaggaatgtggcaaaacctttagccagatttcaaaccttgtgaaacaccaaatgatacatactggaaagaaaccccatgagtgtaaggactgtaataaaacattcagttacctttcatttcttattgaacaccagagaacgcacactggggagaaaccttatgaatgtactgagtgtggaaaggcctttagccgtgcctccaacctcactcgacatcaaagaattcacataggaaagaaacaatatatatgtaggaaatgtggtaaagcatttagcagtggctcagaactcattcgccaccagattacacatactggagagaaaccttatgaatgcattgaatgtgggaaggcatttcgccgtttctcacaccttactcgacatcagagcatccatacaaccaaaaccccgtatgaatgtaatgaatgtaggaaagctttccgttgtcactcattccttattaaacatcagagaattcatgctggagaaaagctctatgaatgtgatgaatgtggtaaagttttcacttggcatgcatcccttattcaacatacgaagagtcacactggagagaaaccctatgcgtgtgctgaatgtgataaagccttcagccggagcttttccctcattctacatcagagaactcatactggagagaaaccctatgtatgtaaggtatgcaacaaatccttcagctggagctcaaaccttgctaaacatcagaggacacacactcttgacaacccctatgaatatgaaaattcatttaattaccactcattccttactgaacaccagtgaatttacactgcaaagaaaaactatgaatgtatggaattttttaaaaagaagtataatgccttacttcagagaactcttggaaagaagccttatgtgaaagtgatgactgtgaagtaatatggcccacactttattcaccaccctggagaaaaaaaaacccaggaatatgtggaaaagccattaataaccactcttttatttttttgcaataacaaggtgaaatcaatattgttgagaagattcttccatctggtaatgttgagaagacttcatttggtaggagtcccttactttacgtgtgtaaattcctaccaggaaagaatacatatccaatagattggagaaagccagagattagccctcattccgcatctgtcaaccaggacagaaagcatggacaagggatgagctttacaaagatgatgcactttggagatcagaaaattcatatttaagcaaagtgatacaaacacagtgatttgggaatgccttcatttacaatgcaatacttacattttaatactcttgtaggagaaaaagcaactgtataaatgaatgtagagtgactttctgcaatatttcaaacctatatcagagaattacactgtgggaaaactaccattgtaataagtgtagcaaaatctccttagatatctgaaaagtcatactggatggaatctgtaggaaacggttctattttgagggaagggggattcctttttgttttttaagtgaattcagaaaatgttataaataaatcttttggtttattataaaccttctgcttgctgattttttcccacagcatgtgattctgaaaatgtaactacaatattgacataaaaaataaacagtagtttttcttgttgaaacatacaaacataacaaagtgtttttaggtgttttatgattttaactttcagacagagtttggatttaaggtaatgctgacagttatccttgaatctgactatagacatttgttattcagtgtgaaacaaatataagatacatcacagaaaattaccaaggtattcttcctgttttgttccatgtacggtgaaaaccgttcttttgtaagcaggtatttaaaactgttctggcattaccacctgcccagctgacaaaggtcacaccatcagggttagtttgccttaatcaggaaggtaagcaattttattttgtagaaagagaggtagagaatatgaataggaatgaatttagtgagcattaatgtaatggctgcattgagggcacatttgtaggaggtgttattagataaatataagtaattttgtaagaggtgaaatttataaaagttttagcccaaaaacaccttatttacatgtactagagttctaaatacattatcagaagtgtatttcctcaaacctgccattggcatgccatattggtacatacatttagaagcttctcaagtttccataagagttgtttcagagaggctgatttatcttacaatagtgtacagtctgactcgaatacaagcagcatgccttactacgtatgggtatctaatatctgatttgattttctcaagcagcatgccttattacatatgggtatttaatatctgatttggtgtcctcaagcagcatgccttattacatatgggtatctagtatctgatttggttttctcaggcaggaatggtttgtatcagggtaaaaatcaagttaccctgtcagcaaaattaggatatgaaaaattcattatttatttatttaagagtatactcaatttctcccattatctgctccacatccactttccttcctactgtttactctgtggggatgcacctcatgaactatatcagaggtcatcaagctacagcccatgggccaggtattcatttacatagtctatggctccttacctctataactgaagagtttaatatacagccataaaggttaaacatttactatctagccctttacagaaaaacttggccaacccctgactacatcaaatctttgccctctagtttttgttgagtgcagccaacattgagaacgtttactttggagcaatctccaattaaccaaagtgatacaaacacagtgatttgggaatgccttcaattacaatgcaatacttaaattttaatactcttgtaggagaaaaagcaactgtataaatgaatgtagagtgaatttctgcaatatttcaaacctatatcagagaattacactgtgggaaaactaccattgtaataagtgtagcaaaatcttcttagatatctgaaaagtcatactggatggaatccagtgtccaatcttttggcatccctgggccacattggaagaattgtcttgggccacatataaaatacgtgaacactaatgatagctatcagttattgtggctcaagaaaattcttcttctggtgtagcccagggaagccaaaagattggacacctctgctttagagggagatgtaactatcaatgaattattatgttcattttttcccttagccagagaaaggccaaaagacattcccgtcagggtattaagaaatacattggtgaggagtttaccaccatccttggacaactctgtggtacccaccctctctagactgtagatgatgcagaacttctataatgaaagtaagatcccaatttcagtagagatcataggatcttggcatgggaggggttgggtaaaatctgcacaagagtccaagggatgcactgttaatgagaattttaaccatataggtggca

SEQ ID NO: 12232 - DNA, 58593 bp, Human
  misc_feature (1)...(58593): n = A,T,C or G
cggcctcccaaagtgctaggattacaggcgtgagccaccgcacccagcttggttttgcctattcttgaacattacataaatggaaccacagtatgaactcttttgtgtctgggtttttctacttaacgttttggatatttattcacattgttggcatgtaataacagttcattcttttttattgctgagcagtgttctattgtaagaatataccacaacttgttgatatattctccccttggtgaacatttgaaatgcttccagtttttgactattatgaataagatggcagtaaaaatatgtttgtagacatatactctcatttgtcttggataaatacctatttgtggaattgctgggtcatagaatagaggcatatttacctttctatgatagtaccaaacaattctccaaagtggctgggctgtcatacactcccactagcaatgtctaagagttccatttgttcagtgctgcttcttgtggttaaaacgtttttaaaaaataggctgggcgcagtggctcacacctgtaatcccagcactttgggaggccaaggtcggaggattgcttgagcccaggattttaaaaccaacctgggcaatgtagcaagacactgtttccaccaatttttttttttttttttttttttttttttgagacggaatctccctctgtcgcccagactgcagtgcagtggcccaatctcggctcactgcaacttccgccttccgggttcaagtgattctcctgcctcggcctccttagtagcaggattacaggcacccaccagcatgcccagctaatttttgtatttttagtagagagggggtttcaccatgttggtcaggctggtctccaactcctgacctcaggtgatccacccgcctcggcttcccaaagtgctgagccactgtgcctgtccaatttttttttttttttttttttttaattagcaaagcatggcagcatatgcctgtagtcccagctactcttgaagctgaagtgggaggatcacttagcccaggaggttgaggctttggtgagccatgttcattgtactacagcctggatgacagagcaaaaccctgtcttctaaaaaaaataaaaaagaggccaggcacagtggctcatgcctgtaatcccaggaatttgggaggctgaggcaggtggatcacaaggtcaggagttcgagaccagcctggccagcatggtgaaaccctggctctactaaaaatacaaaaaattagcatggtgtggtgtgcacctttagtcccagctactcaggaggctgaggcaggagaattgcttgaacccggtaggtggaggttgcagtgagctgagattgcaccattgcactccagcctgagtgacagcgagactccgtctcaaaaaaataaaaaataaaaaagaattctgtttgtttcatattatcaccaacatttggagttgttttaaagttttagccattctactggatgttaagtggtctatcattgtggttttaatttacatataaaaaagctaatatatcacttggttatgatgtatttttgtattttgctggattcaattagctaatattttttaaagatgattttttagagctgttataggtcaccacaaaattgagaggtaggtacagagacttcccttacactccctgcccccacacatacatagcctcctgcataatgaacacccccaccagaggaacacgtttgttactgttgaaacctacacgtacacatcacaatcacccagagtccatcatttacatcaggattcactgttagtgttgtacattctatgggtttggacaaacgtatgatgacatacatctatcaatagaggatcatactctattagagtatttttactgcccttaaaatcctctgtgacaatttgctaatatcttgttaaggattttggtgtcaatgtttatgaaccatattgatctataatttattatgaaattataagaaaaagtttcatctcctgtttcaatatcagggttaggcttgcctcataaaacaagttgggaagtgttctcttctgtactattttctgatagttgtgtaagattggtattatttctccataaaagcttgatagagttaattaggacaccaccatctatgcccagagttttctttttgcggaggtttttttttgttttttttttgttgttgttgttgttgttttttactatggattcaagtttttaagtggatctatactattcaagttatctatgtttttttgtatccattttgctaagttttgtttttgtaagtttgtctgtttcatctaagttttcatatttattgatataaagatgttcatactatttccttattatctctttaatatacataggatctgggggccgggtgcggtggctcatgcctgtaatcccagcactttgggaggctgaggcaggtggatcacctgaggtcaggagttcaagaccaacccagggcaacatggtgaaaccccatctctactaaaaatacaaaattagccaggtgtggtggcgcatgccagtagtcccagctactcaggaggctgaggtgggaggatcatttgagcccaggaggcagaggttgcagtgaactgaggtagcacagctacactacagcctgggcgacagagggagaccctgtctcaaaaaaaaaaaaaaaaaaaagtcagtggaaggtaaagcaattcttagaggaaaatttcttttaaatgcttgtattggaaaaaaaaggtttaaattgaatgatcttagtttctaccttaagaaaaattaaacaaaaaaagtaaatggaaggaaataaggactgggcgcagtggctcacacctgtaatctcagcactttgggaggctgaggcaagtgttcccgagtagctgggacccaggctggcctcaaactcctgggcttcagggatccctcagcctcagcctcccaagaagctaggactgcaggtacaagccactgcttctggggaaaaaaaaaaaaatttaaattgtctactgcccttctggaactctagttacatgtatattaactaggtgttgtcttacaagttgctgggaatctatttggcttttttgttttttgtttttttgagacagttttcgcttttgttgcccaggccggagtgcaatggcacgctctcggctcactgcaacctccgcctcccgggttcaagcgattctcctgcctcagcctcccaagtagctgggattacaagcaccggccaccacacctggctaatttttgtaattttagtagagacggggtctcaccatgttggtcaggctggtctcgaactgctgacctcaggtgatccacccgccttggcctcccagagtgttgggattacaggtgtgagccaccacacctggcctatttggggtttttaacaatctttctcaaggttcttcagatggagaatgtatattaatttgtctttgacctggttctcctccctcagcctcccgagtagctgggactacaggcacccgccaccatgcccagctaattttttgtatttttttttttagtagaggtggggtttcaccatgttggccaggctgatctcgaactcctgacctcaggtgatccacccacctcggcctcccaaagtgctaggattacaagcgtgagccatcatgcctggctaagcaattgtaattttaaaattgcattctggaccttgtggatgacacattatagagattctgaattttgttatctttctctggagaatattgattttttttttctattagctagttaaattacgtgttgtggctgggttttgtactttgttaaggcaggtctgtttcagtgttgctataaggtcttagggtgaatatttagtcctgggacgtaatcttacctcctaacttggtaagattgaaacttcaaattccgtctctctttggtgagttgcactgaaagctctccttagtttctcagccttctagatgctgctttgccagtcttgttggaatgttgttggaaaccggaaatatttgtgttgaggggtcttaaggatttgaggccgggcgcggtggctcacgcctgtaatcccagcactttgggaggctgaggcgggcggatcacgaggtcaggagatcgagaccatcctggctaacacggtgaaaccccgtctctactaaaaaatacaaaaaattagctgggcgtgatggcgggcgcctgtagtcccagctactcgggaggctgaggcaggagaatggcgtgaacccgggaggcggagcttgcagtgagccaagacggcgccactgcactccagcctgggcgacaaagtgagactccgtctcaaaaaatatataataataataattattattctggctgggcgcgggggctcacgtctgtaatcccagcgctttgggaggccgaggcgggtggatcgcctgaggtcaggagttcgagaccagcctgaccaacttggagaaaccctgtttctactaaaaatacaaaaattagccgagtgaggtgccgcatgcctgtaatcccagctactcgggaggctgaggcagaagaatcgcttgaacctgggaggcagagtttgcagtgagctgagatcaagccattgcattccagcttgggcgacagagcgagactacctcaaaaaaaaaaaaaaaaaaaaggatttgaggacagtttatacaaagatttgggggcttcccactcaaattctttgctttctgggctattcttctctgtactgctattctggcagccctggactccattatctttaaccttaagttgccccaggctgctcaaactgggtagtgccctcagtgtgaaatctatttaaacacagatataacacagtgtgactcccttcttttgagaatcccctctagtttcttcctgcttttcattgctcctcaaagccttcatatagttgctttttcatatttttgtcaagggtttataattgttatctgcaggaaggttagcccaatataagctacttagacattgctggaatgaaatctgtttttcttatagaattagggaacattattgggattgatccaagctaaatatctattagcttaaaatgtagcatttttagtggatgaatagccaagtaaaacagcagttttcatttttaatctattctttctctgaatttggctgagtaaaattttagaatatcatctaacagaaatagttaattgccattttccatgttatctgcatttttttaaaaagttgtacttgtggtataagagccacaaaagcccttttaatcctcctggctagatgctgcaagaggagtatgggaagattccatggagtctaaaatgggaaatgagtatgagatgagatgctgtttgtcagtagtaccactggtcctttcagttttcctagttaaatggaaatctaattttaaatacgacaagtaaagaggaaaaaaatcatttattttctcctatgagccaatctcaggaaaaaaaaatggacatttgaggtgcaaattagtccacatacataacttcccaagcagtcacttaggggtaatagaatctaggtacagccacatctccctggctaatggggcctggcatagcagatccatttctccagtgttctctaccctattttgccattggctcacttcataaccttagataatgagcctcaacttcctcaaataaacctcctttcaatataggctttgacaagtctatggtcagaggagtttttccttttcaatttgaagaaatccattgtattaagtggactttaacctatttaaatcgcaggtttaattctttatgtgtatggtttgttttgttttgcttaaggttgcaattgtagctcaagacttggcagcattccatactgcctcatcagaaatggggcaccagcagcatagccatcacttagtaaccacagaaaccagacctctgaccttagtagcaacatccaatggcacccagattgcagttcaggtgagtaccaaggcatactgtcctcagtcgacagcagtgctgctcatagctttcaactttgtacactgtgcttcgtgtataacctttacaggaggcaaggtgtagaataatctctatcacctagcctactttaaggaaatcggtgtatttgaggtggactcaaaaagaccagcactttgttctctacccatctttgcatattctaggggaatttatagcaagaaaaaaaaccttcaggtatatatccctgtgtgcacccacccaggcatctttactctcaaaataaaagtctaattaggcaggggtctgtaaagcacttaagagctactccttagagaaaaacctagtggaaacacaaatcctaaataagtcctctgagaatccttgcacagcccccattttaaagtggggaatgtcagaagacttagaaggaatcattctctgggaagcagagaatttagaatcttaggtgcagccgggcatggtggctcatccctataatcctagcactttgggaggctgagacaggtaggtagcttgagcttaggaattagagaccagcctgggcaacatggtgaaaaccatcactacaaaaaacacaaaaattagctgggtgtggtgacggctgcctgtagtgcccagctacttggggggtgctgaggcaggaggattacttgtacccaggagatttgaggctgcagtgagccaagattgtgccactgcactcccgcctgggtaacaaatgagaccccatctcaaaaaataagagaccagcccaggcaacatgacgaaaccccatctctacaaaaatacaaaaattagccaggtgtggtggtgtgcacctgtagtcccagctactcaggtggctgaggtggaaggatcacttgagcaagggaggttgaggctgcagtgagccaagatcgcaccactgtactccagcctgggcaacagagcgagaccctgtctcaaaaaaaaaattagaatgtaaagtaaaatagaatcctaggggctaggtgcagattacctgtccttagggagattttttttccgcccacgtgtttacttgataaagagttagaacacactccaggaaatgtcagctgttggctttatgtagtttatgggtatagaagctaaaggctcaagaagctctcttttgttggctgaggtaagcatcttttgtctcttgcatgtatgaattttttttttttttagtttttatttatgtaaaaataaatagagatggggtctcactatgttgctcaggctggtcttgaactcctgggctcaagtgatcctcctgcctcagcctcccaaagtgctacgattatagtcatgagccaccatggccagactgtatgaagattttatcaaaatcccaagtaaattgcaggccaggcacggcaggctgggagtacaggtgcacgctgccatgcgcagctaatttttgttttttgagacggagtctcgctctgtcacccaggctggagtgcagtggcaccatcttggctcactgcaagctccgcctcctgggttcatgccattctcctccctcagcctccccagtagctgggactacaggcacccatcaccacgcccagcaattttttttttgtattttttagtagaaatgaaatggggtttcactgtgttagccaggatggtctcaatctcctgacctcgtgatctgcccgcctcggcctcccgaagtgctgagattacaggcgtgagccaccgcgcccagccaatttttgtatttttttagtagagatggggcgttttgccatgttgctcaggctggtctcgaactcctgggctcaagcaatctgcctgcctccacctcccaaagtgttgggattacaggcatgggccaccatgccccgctgagacctcatcatatcaccaggcctggctgcacataggatttgaaattcaaaaaagaaaaagaaattgcattgcattattctcccctgcaggaaattgttttgttctcttaatgtttgagttagcagtagtattttaacaatcccaagtgtcagaattacagagagaagtttcacttctggcatataacatttctttggcattttcttgactgtggcttttgaattgttagcgtttgatgtgtgtgttcctgtttcagcttggagaacagccatctctggaagaagccatcagaatagcgtctagaatccaacaaggagaaacgccagggttggatgattaatcctcagaacaatggagcaataaagcagaaggagtctttcatcttctggcagcagaaatccatgaagcccgggcccaggaaaattagaagttttccattcctgatacactgtacacatttttatgcgagagtggagaacattttattcttgacacttttgtgtatataacccttggaatagattctcagagtgattcattgtgtacaaggaagtatgaaattagggcaatacagtaaattttcatgttactcttttatcagatcacaaactcctagagtctacatgcaagactagtaaagtcttatggagtcttatgatggatttttaacttcccgtggaaaaaaaaataaaggctgtatctaaaatatcaaaggttctatatgtcacacaatcgtaattccaaaagccattatggataataaagggtgtaaagccttcagatatttccccagttagtagagtgtctgcggtttttgttctactatatgcttgtccatttttatttgtatctcatggtttgcagactgtttgaataatttatagtttcccatccctgttaaaaaccagctcttcaagctgaaatgctaattatattggcattacattgaattatgtacaaaattataaaatttggttatttaaaattaaaaagttaaatccagtggttttgttaaagattttgcttagtattcaatttttattactgttttttaaaaataatgaatcatcaaagtttaaccacaggctggtgcccgggataacagtactgtaattggaaatggctttactctgaaaattaggttagtgggttggtgtaaattatttatttttgcttatgtacttttgttttaaagcttatttaccccaaagtttattattaattttgaatacagcaatttttaaaatgttacttttatatttatttatttatcatattggtggggggttggggggaaatggtgcagaaaatatcgcaaatgtaatggaatgtaacctaatacacatattgaaaggatgttgtttatcaagtacagagtaagtgcttttccatatatttttatatattcacaacaattttgtgagacatatgggatttactacctccgttttttacatgaggaaaccaagagtccaggagggaggctgactgtcgtaccagccctcacagctatggagaggcaggaccaagacgagaacccagactttctggctccaagtctagtgtgttttcactgcaccacagttacctcctcaaatgctcatttgtggcagagattatcaagatgaactttggtgatttctgattgcctaatgaattgagcagtataaaaaccattttctaatgctggaaaatcagcgttcaccaaggtcaaaaaaaaaaaaaaaaagatggtgtgttccgcagcagcccctcctgcactgtagttcagcgagctttatttgcagagagctgaaatgtggctttttcatttcaagctttacagtagaaaggggaaaacgttgtgctgttttattttacataaatgttatctttgatcaggttctatgatcttgctaaaaaggatggtgacttacttgaaatcggaagcccttcagggttgggcagaacttttcctgcagaaccctttacagatgcataacattagcaaaagccctagtcaaccaccgatcgagtcttcattcttgacagagacacagacccacacagaactccccccggaagcccactgaggctcagaaaggggctgttgggcggggtagaagaccagaatctgcaaaatcgcaggcagggtggcgcccagcctcccagtgctggtcctggctgctggccaggagctcctccccactgggcccagccaggctgctgtacttcccaggaccaaaaaccaagctgtcagcctcccatggccccttagatctgactttgctcaaattccagggtgtttctctttactcccagcacctttgccagttggattgggcagggcttaacctggactgttttggttagcctgattatccctcagctcaaaagaaaatgacctctggcacccagagaaaagggcctagggtcgctgctagtttaacctgacctgccttcttgggaatggggcctcaggagcctggcaaggtggcctgtttcctccaggggaagggtgcagttggtgtgctgacaattgctaggaaagctgctatagggtctcttcacagtgcaggacatggaaacgtccaaggttgaaaaatcccaaaaagacacttgaaataagagtaaacgctagcaaacagaaccaggtggggcataaccctctggaatttgatccagacagtgctcaaggaaaacctctccgtccaaaaaaaccaccctgctttgccccagacaaagcttgaggccactacaaagaaaatgtgccctagtctgaactcaaaagaacttagagttaagggagggacgaggctttcttaattctctagaggtgacagctgcccagagagccagatctctccttcccctcctacccacccccaggccttcagggcaaactaactttgtacagtgtctcttgcttgctgcttgccttcccgtgtgacagccctggggctaggtaagcaacttgggaaactgtggtctcagtgctgaaactgactggactccatttatcaacccaaggagtttaccgtccagtatttcctggctcagataagattatagactagtcaactattggtagacctcagcagcgagcgaggagtgggatgtgaaaaagaagggggcagagctgaagtctagtgtcgaagaggaaaagggagcgtgttggaaggggagaaaagctgcctcagcctcctgcatgataagcactttctgtacctaggtttccttcagggatgacgctttcaaggaatactccagccaaatactccccttctgcctgagggacaggacacgcctgcatgggcatgtgatcagtacagtttgaacaagaaagtgcactcagaagggccctggatttggggtttaatggactgtggttgcagtcttgaaattctttttgtttatttatttttgagacagggtctcgctctgtcacctaggcttgagtgcagtggcgtggtcagggctcactgcaacctcctcctgggccccagctatcctctcacttcagcctcccaagtagctgggaccacaggtgctcaccaccatgcccagctaatttttgtatttttggtagagatagggtttcaccatgttgaccaagctgttctcaaactcttgagctcaagtgatccacctcccaaagtaccggaattacaggcatgaaccactgcgcccgcccggctgcggtcttgatgtctatctttgtgtgtgttttgtaaatgaagtctcatgcatcaacaaagcatgtgctgggggcttagcgcctgagcttacacacagctccaccggctgctgcctccctggaagtgctctcaccaccactgccccacctggcctctccctccttgccctcaccctgcaactgctgccaccctctaaccttggcaggagtctgatcccagttcagggagggttggggcgtggtggtggccatccccactccaggctggcagcaccacagtgctcctggtggacaatcagccttagttgagccttgaaaggggcaagacttttgcccagccctttactgacagtgtcccagttctgagttttaaagacactggtagcccatttgctgtaggctgaggtggcaggcctgtgggaaggggagacacctggaggaaagggaacctggaacctgtcagacccaacagagcacctgcccacaggcatctgtgaggtcccctgccctggaggctttctcagcaggctctgtgcctggaggaatcctctcttcctccttccaactttcctgagcctggcttgtgtttgttgtgcctttgaaccagcaggagataacccttctgggatgaaccacaaaattcaaattgtataatttcagtgattccaaatatgagataaatattctgatattcacatttaaaattggcattgtatgatataaaagtggagggtaaaatgcatgccaaaatttttaatttgtcgtttttcttttctttttttgagacagagtcttgctctgttgctcaggctggagtgcaatggcgcgatctcggctcactgtaacctccgcctcctggattcaagtgattctcccgcttcagcctcccgagtaagtgggattacaggtacccgccatcatgcccggctaatttttggtatttttgtagagacagggtttcactatttgaccaggctggtctcgaactcctgacctcaggtgatccacctgcctcggcctcccaaagtgctgggattacatgtgtgagccactgagcccgtcctgtagtttttcttagaatgacattaagtagcaaataagcaccatgacaagtcaagagaaagactataaaagaaggaaaaagcttatgtctaccattttgtgtatgtaataaaatatacataaaatataccattttaactatttttgagtgtgcagtggtacttagtcaaccctctgtatccatcagttccacatccctgggttccacatccatggagtcaaccaaccatggatcgaaaatattcaggaaaaaggctggtgtggtggctgacacctgtaatcccagcactttgggagacctaggcaggaggatcacttgaggccagaagttcaaggccagcctgggcaacatagtgagaccctgtctctacaaaaaaaagaaaaaatatattcagggaaaaaaagactaagttccaaaaagcaagccttgaatttgcaaggtaccaagtactatgttgaattcataagaatgatgtgtaggcattgtattgggtattataagtaatctagagatgaattaaagtatgcaggaggatgtgtgtaggttatatgcaaatactataccatttattatcagggacttgagaatccatggattttggtgtccttgatgaatcctagaacgaatccccctccaatactgcaggacaactgtacattcacattgttgtgcaaccatcaccaccatccatctccagaactttttcatctccccaaactgaaattgtacccattaaacaataattccacatccttcctcattccagttcctgacaaccaccattttattttattttattttatttttatttttttcagacagggtcttgctctgtcacccaggctagagtacagtggcatgatctcggctagagtacagtggcatgatctcggctcactgcaacctccccctcctgggttcatgcgattctcctgtctcagcctcccaagtagctgggactacaggcacgtgccaccatgcccggctaacttttgtatttttaatagagacggggttttgccatgttggccaggctagtcttgaactcctgacctcaagtgatctgcttgccttggcctcacaaagtgctaggattacaggcgtgagccaccgtgcccagccaccattctattttctgtctctataaatttgactgttgtaggcgcctcatattatatttgtctttttgtgtctggctttatgtgtacctttaaaagcaagtttttcctgtcttttgaccaagaggttgcgtattttcatttttgcacggagccgcacagattatgtagcctgtcctgctgaggcgtgcgcttctattagcccttctgtttttgctgcagatgtgtgacctgtgttttgggaatatattatctcttgttagattatgggctcctttaagacagctggggatttaaatttcccggtaactcctggaggtcttgcagagtagcagggcacctctagctgttccctccagttccaaactcacgtggcttgagatgtacagagagattcctcaattctccatgcaggagtttcgttttgcttctagagcacggctaaactgcaaggacagaaaatcttgctgagaatgaagaatgctcaaaattcaggataattgcatgaatagttaaaattgcctggcaaaagctttttctgctcacttttctgcattcagactgtgaaacaaaaatagaatcttgggacctcaaattcactaggccaaagcttgggaactgagtcatgcaaacaaaaaagcaaaaataaaacaaaaatacggcctttcttttgttcccaaagagctgtaatttcacatgctcaccttatcttataaaaaatgtagattgactgagcatgagactaatgcataattgacttttcctctacccctttctttttacatgtaaaacatagactcactgaactctaaccggagcctcacaagaatgtaaccacttgcctcattgcctacccaccctccttttttttttttcccttcccctcctgcttgccctttcctctgtgaaaggaaaataaaaacttgggaccctaatttcactatgccaaaagaaaaatattaagctgaaagctgaattatccaagaagttacttttccttttgttcctaagcaagtagctacagataaaaagttaagtatctccacagagctactctatgttcaccttagctgctacaaagatgaatatataattgactattcccctacctgctccttttctcttgcaacatgtggattcagtcatgtgaccataccctccgtctttcccctccagcctgcttttcccacttttaaatattgaagccctcaaaaccatatttggagaaaggcacagacctgtctcccaagtgcacgtccttaacgctggcaacataaatttctaaattaattgttacctatctcagatactttttggtttacacctcttgaaatattgaagttccccaaatcctctttggaaaaacacgggtcacagatcgtattgtgacttgggtttctttttcccaggcacgtcctcagccttggcaaaataaactttgaatcagttgagatctgccatggtcatgttttggtttacaagatgaaagaaaatgagattccagctctaatgtcaattccagatttcttcccactttgcctcactgctgcaggggttccctggcacgcacaggtcacagcacacagaagccccccacaagcctaatcactaatctgccccaaagccccccagcctaggaaagggatgtggaaaacagctctaatctgggtgcagactcagtgccagtgcccttcacacaaattctgcaaattctaaagaaaacccaaagtggtaaaaaaaaaaaaaaaaaaaatctctgctgccccaaggggtttggcttatctttttaaataggaaatctttactccaagccagtgacagggcttttgtgctgatgagggccctaggagcacagtaggtcccgcttgagggcagctcccacactcacctgatgttttattcagctaaaactcattaggcatgtttccccactgccttagggcttttctaatatcctgaaattgcttcatgttcttttaaccgaaaaagcaggggcaacagaaaaatgggagcgcttctttttttttttacaaaggtgggcttcactgttggaaagctggtggaacctttgggtatttcaaagccaaaaagaaaagcagctggttaatgaattaaaggcaggatggtgggccttggggtccaccaccagcaggaggcgctgtggaggtccagggagcaatccatctgcttgcttcaccatttccttctgggacaaatgagccagctgtgccttgatgggggcagtcaaaacaaggcaagtgatgagaagaaccctgacagcctcaggccattgggacatcactaaagaggaaatgccctcaccagactagttttgtctccttgcacaatctggcagcctcttttggttttatagccagtgttgaccaagatgatacttccaggagtagctcagatttggcttcctgagacgccagttgcaatcctgtgacaagaaggtgctgagaactaatcattctcacacaggcacttccagggcaaatctctgccaggcctaaggagtctccggccccagccactcattcctagcaacattccacactctttgttttgtttttgagatggagtctcgctgtgttgcccaggctggaagtgcagtggcacgatctcggctcactgtaacctctgcctcccaggttccagcaattctcctgcctcagcctcctgagtagctgggaatacaggcatgtgccaccacgcccagctaatttttgtattattcgtagagatggggcttcaccgtgttggccaggctggtcttgaactcctgacctcaggtgatccacctgcctcagcctcccaaagtgctgggattacaggcatgagccaccagtcccggtctttttttttttttctgtttgtttttgagatggagtttcgctcctgttgcccaggctggagtacagtggcacgatctcggctcactgcaacctccgcctcctgggttcaagcgattctcctgcctcagcctcctgagtagctaggactataggcgcctgccaccatgaccccctaattttttgtatttttagtagagacagggtttcaccatgttggctaggctgtctcgaactcctgacctcaggtgatccacctgcctcggcctcccaaagtgctgggattacaggcatgagccactgcacccggcccattccacactcttaaacccagtcttaaggtgaggccaggctgctgccgtatttgccgttctgcatgccttctacagtcttaggagaaggtctacatggtcaccttccttcatccccacagggaaagtcacttgctcatccacaggcagagccctgtccagggctccagtgtcaaccatgactggagacaataggctgtcaatagattctatcccaagttcttggacaagaaattttggaataaatgccaaacttataggataaatgccaaattcttgtccaagaacttgggatagaagccccattgctgccctgcccttggacccaagtctaataagtgggctctgacattgttcttgaggattgactctgccttgatcacctctcctggcccccagacttgctaaactgtggctatgtttatcccagcaaaactccacaggactcagagttactgaaatccagcctggtagcaaggggtcttattcaaggggtcttattcctaccatgactcctctctcctcctgcccctgaattctctacccttcagaggagcttttttttgtttgttttattttattttattttaatcctatgacactacttttttgcctgattgccactgttaatttttatttttatttgagacaggctggggtgcagtggtgcaatctctgctcactgcaacctttgcctcctgggttcaagtgattcttatgcctcaacctcccgagtagctggaactacaggcgtgcgccaccatgcccggctaatttttgtatttttagtagagacgaggttttgccgtgttggccagactggtctcaaactcctggcctcaagtgatcttcccaccttggcctctcaaagtgttgggattacaggcgtgagccaccgtgcctggcctgccgctgttgactatgtcttcagatacacagtgttgcatgagggaccaataaatcacaggaaagatatagaaatggcagtttaaacatatcaaaaaatgcataacctcacttataataagataaattaatattaaaactataccaaaattatttcaaaaagttttttaaagtttaaaaaacctattctgggctggctgcagtggctcacgcctgtaatcccagcactttgggaggccaaggtgggcagatcacgaggtcaggagatcgagaccatcctggctaacacggtgaaaccctgtctctactaaaaatacaaaaaaattagtcgggcgtggtggcaggtgcctgtagtcccagctactcgggaggctgaggcaggagaatggcatgaacctgggaggtggagcttgcagtgagccgagatggtgccactgcactccagcctgggtgacaaagcgagactccatctcaaaaaaaaaaaaaaaagaaaaaagaaaaaacttatatgaaatcccatttttcacccatagaatcggtaaatatcaaaaaagttgataatgttgttggcaaagatgcaggaaaataggtttttgttttgttttgtttttttgagacagtttattgcccaggttggagtgcagtggtgcgatcacggctccctgcagcctcaacctcccaagttcaagtgatttccccacctcatcctcctgagtggctgggactataggtacaaacaaccacacccaactgatttttaaattttctttttttttttttttttttagacggaatctcgctctgttgcccaggctggagtgcagtggtgcaatctccactcactgcaacctccacttcccaggttcaagtgattctcctgcctcagcctcccaagtagatgggattacaggcatttgccatcacaccgagctaatttttgtatttggtctcgaaatcctgggctcaagccatcctcctgcctcagcttcccaaaatgctgggatcacaggtttgagccaccatgcctgaccaggaaaatgattgttttgtctgagacagggtcaggctctgtctcccaggctgcagcataatggcgtgatctgggctcactgcaacctctgcctcctgcgctcaaaccatcctaccatctcagcctcctgagtagctgggactactggcacgtgccaccaagctctgctaaattttttttgttgttgttgtatatttggtagagatggcgtttcaccatgttggcaagctggtctcaaaacctgctgggctcaattgatcctcccagctcggtctcccaaagtgctgggattatagatgtgagccactgcacccggccaaaaatagatttaaattgcatatatcctttaatttggcaattcttcttctaatactgtattctaaggatatatgagcagcattgctcataatagcaaaagtttgaaaacagcctaatggagagctgtttagataaatcatgggaaaagtcgtgctgccccaggctcttctggagctcagcactgtgtgggaagctgctgggtaagttgctcttgggtgcaaggtgtagtaggctgaataatgcccccaccaaatatgtccatattctaatccccagaagctgtgaatcttattttatttttatttttgattagagacagtgtcttcttgctctataacccaggctggagtgcagtggcttgatcatagatcactgcagccttgacctcccgggctcaagcaatcctctggctcagccacctaagtagctgggactataggtgcacactaacatgcccagcttattttttgtttgtttgtttgtttttgagacagagtctttctctgttgcccaggctgtagtgcagtggcgtgatctcagctcactgcaacctccacctcccaggttcaagcggttctcctgcctcagcctctggagtagctgggactacaggcacatgccaccacatctgactaatttttgtatttttcatagagatgggttttttgacacaggatctcactccgtcacccaggctgaagtgcagtggcacaaacccggctcactgcagcctccacctcctgggctcaagtgatcttcccccagcctcctgaatagctgggaccacaggttcatgccaccatgccaggctaatttttaaaatttttttagagacaaggtctcaccatcttgctcaggctggtctcaaactcctgggcccaaatgatcctcccaccttagccttccaaagtgttaggattacaggcgtaagccactgcgcccggcctgatctgtttttgagtaaataaaattattatttgttttaaagaaataaaatgacaagccctccacctcaagcaaataacagtttgaaaaagattttctatctttggtcatcaaatttgaactacagttcttaaatataaggctcatataagttgattataataaagtagtttgaatttaggctccaatgttaggtttgaagtggaaaagtaggattggttttcagcaacttttttttttttttttttttttgagacggagtctcactctgtagcaatgttttctttcaggatgggtggacttcttgtttgggttacttatctttatcctctgaatatccaactattctcattgtcaggactccactcagaggtacccataaacagaaaggacccactggccacttctccaggacagcaaggtagtggacatgcacaaggaccttgcccctgttcagatccatgaaagaagtgctgtgcctcccttgacttgataaagaaggagccaatttcttcccagtttcctcgagaactcacaggtgacaaaacaacttcagcccctatgtccacagtgtgtgctattatactttgcctggagaggaaaaacctgttatccttaactaccctcactggctcttctcttcctcactgagtatcagaagaccaagaggagaaaataaagcttgctagtttcttacccatactgttattctatgagtaaagacccactcattcaaagaaaaccaatctgtttctagctccactcctgaaactaggaagttggtccttagcctgatgaagtcaacctcttggagaaatttttaagttcttttttatttatttattttttattattatactttaagttttagggtacatgtgcacaatgtgcaggttagttacatatgtatacatgtgccatgctgatgcgctgcacccactaactcatcatctagcattaggtatatctcccaatgctatccctcccgcctccccccaccccacaacagtccccagagtgtgatgttccccttcctgtgtccaggtgttctcattgttcaattcccacctatgagtgagaatatgtggtgtttggttttttgttcttgcgatagtttactgagaatgatgatttccaatttcatccatgtccctacaaaggacgtgaactcatcattttttatggctgcatagtattccatggtgtatatgtgccacattttcttaatccagtctatcattgttggacatttgggttggttccaagtctttgctattgtgaataatgccgcaataaacctacgtgtgcatgtgtctttatagcagcatgatttatagtcctttggttatatacccagtaatggaatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatggtgagcattttttcatgtgttttttggctgcataaatgtcttcttttgagaagtgtctgttcatgtcctttgcccactttttgatggggttgttggtttttttcttgtaaatttgttggagttcattgtagattctggatattagccctttgtcagatgagtaggttgcaaaaattttctcccattttgtaggttgcctgttcactctgatggtagtttcttttgctgtgcagaagctctttagtttaattagatcccatttgtcaattttcgcttttgttgccattgcttttggtgttttagacatgaagtccttgcccatgcctatgtcttgaatggtaatgcctaggttttcttctagggtttttatggttttaggtctaacatttaagtctttaatccatcttgaattgatttttgtataagatgtaaggaagggatccagtttcagctttctacatatggctagctagttttcccagcaccatttattaaatagggaatcctttccccatttcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggctcaggattgacttggcgatgcgggatcttttttggttccatatgaactttaaagtagttttttccaattctatgaagaaagtcattggtagcttaatggggatggcattgaatctgtaaattaccttgggcagtatggccattttcacgatattgattcttcctacccatgagcatggaatgttcttccatttgtttgtatcctcttttatttcattgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgttccagttttcaaagggaatgcttccagtttttgcctattcagtatgatattggctgtgggtttgtcatagatagctcttattattttgagatacatcccatcaatacctaatttattgagagtttttagcatgaagtgttgttaaattttgtcaaaggccttttctgcatctattgagataatcatgtggtttttgtctttggttctgtttatatgctggattacatttattgatttgcgtatattgaaccagccttgcatcccagggatgaagcccacttgatcatggtggataagctttttcatgtgctgctggattcggtttgccagtattttattgaggatttttgcatcaatgttcatcaaggatattggtctaaaattctcttttttggttgtgtctctgcccagctttggtatcaggatgatgctggcctcataaaatgagttagggaggattccctctttttctattgattggaatagttccagaaggaatggtaccagttcctccttgtacctctggtagaattcggctgtgaatccatctggtcctggactctttttggttggtaagctattgattattgccacaatttcagctcctgttattggtctattcagagattcaacttcttcctggtttagtcttgggagggtgtatgtgtcgaggaatttatccatttcttctagattttctagtttatttgcgtagacatgtttgtagcattctctgatggtagtttgtatttctgtgggatcggtggtgatatcccctttatcattttttattgcgtctatttgattcttctctctttttttctttattagtcttgctagtggtctatcaattttgttgatcctttcaaaaaaccagctcttggattcgttaattttttgaagggttttttgtgtctctatttccttcagttctgctctgattttagttatttcttgccttctgctagcttttgaatgtgtttgctcttgcttttctagttcttttaattgtgatgttagggtgtcagttttggatctttcctgctttctcttgtgggcatttagtgctataaatttccctctacacactgctttgaatgtgtcccagagattctggtatgttgtgtctttgttctcattggtttcaaagaacatctttatttctgccttcatttcgttatgtacccagtagtcattcaggagcaggttgtttagtttccatgtagttgagcggttttgagtgagattcttaatcctgagttctagtttgattgcactgtggtctgagagatagtttgttataatttctgttcttttacgtttgctgaggggagctttacttccaactatgtggtcaattttggaataggtgtggtgtggtgctgaaaaaaatgtatattctgttgatttggggtggagagttctgtagaagtctattaggtctgcttggtgcagagctgagttcaattcctgggtatccttgttgactttctgtctggttgatctgtctaatgttgacagtggggtgttaaagtctcccattattaatgtgtgggagtctaagtctctttgtaggtcactcaggacttgctttatgaatctgggtgctcctgtattgggtgcatatatattgaggatagttagctcttcttgttgaattgatccctttaccattaagtaatggccttctttgtctcttttgatctttgttggtttaaagtctgttttatcagagactaggattgcaacccctgcctttttttgttttccatttgcttggtagatcttcctccatcctttattttgagcctatgtgtgtctctgcacgtgagatgggtttcctgaatacagcacactgatgggtcttgactgtttatccaatttgccagtctgtgtcttttaattggagcatttagtccatttacatttaaagttaatattgttatgtgtgaatttgatcctgtcattatgatgttagctggtgattttgctcgttagttgatgcagtttcttcctagtctcgatggtctttacattttggcatgattttgcagtggctggtaccggttgttcctttccatgtttagcgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattggccctcactctcttctggcttgtagagtttctgctgagagatcagctgttagtctgatgggcttcgttttgtgggtaacccgacctttctctctggctgcccttaacattttttccttcatttcaactttggtgaatctgacaattacgtgtcttggtgttgctcttctcaaggagtatctttgtggcattctctgtatttcctgaatctgaatggtggcctgccttgctagactggggaagttctcctggataatatcctacagagtgttttccaacttggttccattctccccatcactttcaggtacaccaatcagacatagatttggtcttttcacatagtcccatatttcttggaggctttgctcgtttctttttattcttttttctctaaacttcccttctcacttcatttcatacatttcatcttccatcgctgataccctttcttccagttgatcacatcggctcctgagtcttctgcattcttcacttagttctcaagccttggttttcagctccatcagctcctttaagcacttctctgtattgattattctagttatacattctcctaaatttttttcaaagttttcaacttctttgcctttggtttgaatgtcctcccgtagctcagagtaatttgatcgtctgaagccttcttctctcagctcgtcaaagtcattctccgtccagctttgttccattgctggtgaggaactgcattcctttggaggaggagaggcgctctgctttttagagcttccagtttttctgttctgttttttccccatctttgtggttttatctacttttggtctttgatgatggtgatgtacagatgggttgttggtgtggatgtcctttctgtttgttagttttccttctaacagacaggaccctcagctgcaggtctgttggagtgcccggccgtgtgaggtgtcagtctgcccctgctagggggtgcctcccagttaggctgctggggggtcaggggtcagggacccacttgaggaggcagtctgcccgttctcagatctccagctgcatgctgggagaaccactgctctcttcaaagctgtcagacagagacatttaagtctgcagaggttactgctgtctttttgtttgtctgtgccctgcccccagaggtggagcctacagaggcaggcaggcctccttgagctgtggtgggctccaccccaattcgagcttcccggctgctttgtttacctaagcaagcctgggcaatggcgggtgcccctcccccagcctcgctgccaccttgcagtttgatctcagagtgctgtgctagcaatcagcgagactccgtgggcctaggaccctccgagccaggtgcgggatataatctcctggtgtgccgttttttaagcccgtcggaaaagcgcagtattcgggtgggagtgacccgattttccaggtgccatctgtcaccactttgtttgactaggaaagggaactccctgaccccttgcgcttcccgagtgaggcaatgcctcgccctgcttcggctcgcacacggtgcgcgcactcactgacctgcacccactgtctggcactctctagtgagatgaacccggtacctcagatggaaatgcagaaatcacccgtcttctgcgtggctcacactgggagctgtagactggagctgttcctattcggccatcttggctcctcccgccgaaatttttaagttctaaacaactctttaatcagtgacaaaccaaaactgaattacagacttttattttttttttgagatggagtcttgccctgtcgcccagggtggcatgcaatggtgtgatctcagctcactgcactgtccgcctcccgggctcaagcaattcttgtgtctcagcctcccaactagctgagactatatgtgtgtgccaccatgccaggctaagttttgtatttttagtagagatggggtttcatcatgttggccaggctgctctcaaactcctgaccttaagcagtctgcctgcctcagcctcccaaagtgctgggattacaggggtgagccactgtaactggccggactattttaaactatacaacgatgagaatgtatgctcttcaattacacatagaagtatgaatgatcctcacaaacataatgctaagcaaaagaaactagacacaagggtacagactaacaattctctgccatctgaagtcaggtagtggttacacttggtagggaggccaagttagggagtagaaggaagtccaaggatgagttgccagggccaaccagcttcatgagcatgcgcacaaggccctgcacttaggctcagcgtttggctaacactctgctgtcaccatttcaaaattattattattattattatttgagatggagtctcactctattgcccaggctggagtgcaatggcgcgatcttggctcactgcaacctccacctcccgggttcaagcgattctcttgcctcagcctcccgagtagctgggattacaggcatgtgccaccatgcctggctaatttttgtatttttagtagagatggggtttcaccatgttggccaggctggtcttgaactcctgacctcaggtgatccacccgcctcggcctcccaaagttctgggattacaggcgtgagccactgcacccagccaaagtcgttaatgatatttgaccaaagggctgagcattttcattttgcactaggtcctgcaaattatgtcattggtactggcaatgttctgtttctcagtctgggtgttgaatttgtgaatattcaccaaactgaacatattttgatatgtttgcttttctgtatgtgtatcatacttcaatacaaagcttaaaaacagaactataggctattttaaaaataactcatgaaacactacttatgaaatgcagccaaagtagtattcacaagaaaatgcatggctgtaaacactgttattgcttagtgagaataaaagttcattaacaaagtagacaatgcaggaaattaaaaggggaaaatgtcacagtaaggtaaaatctaaagaaagcaaaaggaaaaaattaaggataaaagcaaactgaattatttcaaaaccagaaaaacaatataattggcccggtgtggtggctcatgcctgtaatcccagtgctttgggaggccaagggaggaggatcatttgaggccaggagttcaagactggcccaggtaacacagcaagaccttgtctctacaacaacaacaaaattagcccggcatggtggtgcatgcctgtagttctagctgctcagaggctgaggcaggagggttacttgagcccaggaactggagattatagtcagctatgatcacaccactgcgctccagcctggatgacagggaaagactctgtctctaaaaaaaaattttgggggccgggcacggtggctcacgcctgtaatcccagcactttgggaggccgaggtgggcggatcacgaggtcaggagtttgagaccagtctggccaacatggtaaaaccctgtctctactaaaaatacaaaaattagccaggcatggtggcaggcacctgtaatcccagctacttgggaggctgaggcaggagaatcacttgaacccgggaggcggaggttgcagtgagccgagattgcgccactgcactccagcctaggtgacgagggaaattccgtctcaaaaaaaaaaaaaaaaattaagacaatatagttgatgaataactctaagatctggttatttggcaagaagcaagcaacaaatttgataaaccactagctaacaaaacaaactaaaaaagaaatgacataaatatacacatcaggaatgaaaaagggtttatagccatcagtacagaggaaatgagaattacaagggaataccttgcccaacccaatactaatacaatataaaatctgaatgaaatagataatatttgaggaaatataaaattaccaattgggactcaaaaatctaaacagataaataatgatggataaaagctgtcaaaagatatacttaaggacctaagctaaaactagataggttaatgagcaacttctttcaaatattcaggtaatcaatcatactcatattccaaaggatagataaacatctcagtgttccataaagccaaaattttacatcatacagcaggaaaactatggaccagtctcatttataaatgtagatttagaacaccttaaaaaacacaggcacatcttgggactagattatgaaatagaaaagtataattaaaaattaaggctgggcacagtggctcatgcctgtaatcctagcactttgggaggctgaggcaggcggatcacctgaggtcaggagcttgagatcagcctggccaacatggtgaaaccccgtctctactaaaaatacaaaaattagccaggtctggtggcgcatgcctgtaatcccagctactggggagactgaggcaggagaatcgcttgagcctgggaggtgaaggttgcagtgagctaagatggtgccctgcactccaacctgggcaacagagcaagactctgtctcaaaaaacatttttttaaattaaaacaatcaaaaaattaaaattaaaaacattaaaaaggaaaaacaaaatgtaaaactcaggcacatctcattttattgctctgcttcattaggctttgcagatacttcgtttaaaaaaatattttatttttcagaccgcaggtaactgaaactgcagaaactgaaaccacagataagcagggactgattttgttataaaatggggcgccctgtgcttggacgtcttctttattttatttttttattttttgagacagagtctcgctctgttgctcaggctggagtgcagtggagtgatcttggctcactgcagcctccacttcccaggttcaagtgattcttctgcctcagcctcctgagtagctgagattacaggtgtgtaccaccacatcccactcattttttgtatttttagtagatacggttttttgccatgttgcccaggctgatctcgaactcttggcctcaagtgatccacctgcctcagcttcccaaaatgctgggattacaggcatgagccattgtgcctagccaaatactgcatttttacaaattgaaggtttgtggcaaccctatatttagcaagtctgtcaggccattttcccaacagcatatgctcatttcgtgtttctttgtcatattttagtaatttttgcaatatttcaaacttttttattattattatgtctattatgttgatctctgatctttgatgttacaactgtaactgtttcagggtgccacaaaccgtgcccatacaagatggtgaatttaatctataaatgttgtgtgtgttctgactactgcatggactgggtgttcctctgtctctctccctctactgcaacctcctcatttcctgagacacaaaaatactaaaattaggccagctggaaccctacagtggcttctaagtgttcaaatgaaagaaagagtcacacatctctcattctcaaaagctagaaataattaagcttagttaggaagtcatgtcgaaagctgggacaggctgaaagttagttagctaagttgtaaatgcaagggaaaagcttttgaaggagattaaaagtgctactccagtgaatacacaaatgagataagaaagcagaacagccttattgctgatatggaggatgtttgaatggtctggatagatcaaaccggccacaacattcccttaggccaacgcaaggccctaattccctccctttttttttttgagaggaagtctctgtcgcccaggctggagtacaatggtgtgatgtcagctcactgcaacctccgcctcccgggttcaagtgattctccccactcagcctccccagtagctggaattacaggtgcccgccaccacgcctggctaatttttgtatttttatagagatgggggtttcaccatgttggccaggttgttctcgaacttctgacctcaggtgatccacccgcctcagcctcccaaagtgctgggattacaggtgtgagccactgcgcccggcccaatcaatattattattaatatccccattaaagtcaggagctagacaaggattctcaccacctctgttatttaatgttgttctggaagtgctagttaatgcaattagacaatggaataaaagtcaaaatactaaagtggatgagagcattattatcaattacctgattgtcggcctagaaatccaaaatgatcaaatgaatagttgttagaactaatacaagagaggccgagcgtggtggctcacgcctgtaatcccagcactttgggaggccgaggcgggcggatcacgaggtcaggagatcgagaccatcctggctaacacggtgaaaccctgtctctactaaaaaatataaaaaattagccgggcatggtggcgggtgcctgtagtccctgccactcgggaggctgaggcaggagaatggcgtgaacccgggaggcagaggttgcagtgagccgagatcacgccactgcactccagcctgggcgacagagggagactctgtctcaaaataaataaataaataaataaataaataaataaataaataaatacaagagcacagaatattctttctatatttcttttatttgcacttattttataatggttatttttctgtgctgtgttgtttctaacaattggctgacaagcatactgacagagccaattgtttctaacaattggtttcaagcacacaggaccctgaaagtcagcagagcttggtagtggaggctgagagtggggatgggatgggcagaaacagttacagcttggatccctcaaaaaccttaaatggggctgggtgcagtggctcacgcctgtaatcccagcactttgggaggccgaggtgggcagatcacttgaggccaggagttcgaggccagcctggccaacatggtgaaaccccatctctactaaaaatacaaaaattagctgggcgtggtggctgtgcctgtaatcccagctacgtgggaggccgaggcatgagaatcacttgaacctgggaggtggaggctgcagtgagccaagatcgtgccactgcactccagcctaggggacagagcaaaaccttgtctcagaaaaacaaaacaaaacaaaaaccttaaatggaaggcaggcgatggcagtcaacatcagccagagtgtgtgtgagcaatcctaatgttctgaggctagaatggggttggtggaggagacacaacagagcctttaacgctgctcttgacattgcactgcaccacattgaagtgaggctacaatgaaccagagggatccaggaagccctcttccttatcagcacctctccacggactgcaggcagagcagaaagctgtttgtctgacggtggcgggaaggtcattccagatgaagaaaccagattaaaaaacagaagcacaggctcctttcccaagagcaaagctagaggagggacaaagccacgtgaggaaatgaggaagggtcaggcatatgtggcttgaaagagaggagagctctaagtatatcagaaaaggcaaggggatggctcttcaggactcatgtcgtaattctgtctgccctatcctgtttcagagatgacaaggccttcctcctgcctctctctttagtaggcacctaagcactttgacttattgttctctcattcaatccatgcaacaactcttagaagtcagattttttgacagtttttaaaatttacttataaaaatttatttttaattttcgagggtatgtagtaggtatatatgtttatggggcatatgggatattttgatacagccatacaatgtgtaataatcacatcaggggaaatgaggcatccatcccctcaagcatttatcctttgtgttataaataatccaattatactcttttagtttttttttttttagagatggagtcttgctctgtcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctacacaaaaagttagctgggcatggtggtgcatgcttgtaatcccaggtacttgggaagctgaggcaggagaattgattgaacccaggagggggaggttgcagtgagccgagattgcaccactgcacttcagcctgggctacagagcaagacttcatctcaaaataaataataataaataaatgaggccgggcacggtggctcacacctgtaatcccagcactttgggaggccgaggcaggcagatcacgaggtcaggagatcaagaccattctggctaacacggtgaaaccctgtctctactaaaaatacaaaaaaattagccgggcatggtggcgggcgcctgtagtcccagctactcaagaggctgaggcaggagaatggcatgaacccgggaggcagagcttgcagtgagctgagatggcaccactgcactccagcctgggcgacatcgagactccatctcaataaataaataaataaataaataaaattagattattagattttttcctatagagttgtttgagctccttatatattctggttattaatttccttgtcagaaggatagtttgcaaatattttctcctatgctgtgggttgtctcttcactttgctgtttcctttgctgtgcagaagcttttaaacttgatgtgatctcatttgtccatttttgctttggttgcctgtgcttgtggggcattattcaagaaacctttgcccagtctaatgtcctggagcgtttcctcaatatattctttagtagtttcatagtttgaggtctgagatttaagtcgttaatccattttgatttgagttttgtatatagtgaaagacaggggtctagtttcattcttctgcatatggatatccagttttctcagcaccatttgttgaagacgctgtcttttctccattgtatgctcttggcccctttgttgagaaatgagttcaccttagatgtatggatttgtttctgggttctctattctgttccattagtccatgtgtctgcttttatgcctgtactatgctgttttggttaccacagttctgtagtataatttgaagtcaggtaatgtgattcctccagtttttttgtttttgtttttgttttttttctcaggatagctttggctattttggatcttttgcagttccatataaattttaggattgtgttttctctttctgtggagaatgtctttagtattttgataggtattgtattgaatacatagattactttggatagtatggacattttaacaatatggattcttccaatccatgaacatggactatttttccttttttaatgtcctcttcaatttctttcaataatgttttatagttttcattgtagaaatcttccacttctttggttaaattaattcctaggtatgttattttatttgtagctattgtaaatgggattacttttatgatttttcacattgtttactgttggcatatagaaacattttttattattttttaatttttaattttaatttttagttagttattttttgagacggagtctagctctgtcaccaggctggagtgcagtggcgtgatctcagctcactgtaacctccgcctcccgggttcaagcaattttcctgcctcagcctcccaagtagctgggattacaggcacacaccgccatccccagctaatttttgtacttttagtagagatgggggtttcaccacattggccaggatggtcttgatctcctgacctcgtgatctgcccacctcagcctctgaaagtgctgggattacaggccgattttaaaatttattttaatttattttttattttttattttttttggggaggatgaagtcttactctgttgcctaggctggagtgcagtggtgcgatctcagctgaccgcaatctctgcctcccaggttcaagtgattctcttgcctcggcctcctgagtagctgggactataggtgcgcaccaccatgcttggacaatttttgtatatttagtagacacagggtttcaccatgttggccaggctggtcttgaacgcctgaccttgtgatccacccgcctctgcctcccaaagtgctgggattacaggcttgagccaccatgcctggcctagaaatgatttttatatgttatgttctctttttttttaacccaataatagctgtgtgtactgatatatgttgattttgcatgttgacttttgtatattgttttatttcctgcaagtttactgaatttgtatatctgttctaataattttttagtggtgtctttaggtttttctaaatataagatcatatcatctgcaaacaaggataatttgatttcttcctttccaatttggatgccctttctttctctttcttgtctgattgctctagctgggacttccagtaccatgttgcataacagtgatgaaagtgggcatccttgtcatgctctagatcttagaagaaagactttcagtttttcaccattgagtatgacactagctgtgggtctgtcatgtagggctatgttgaagtatgttcttatttttttttttttccagacagagtttcactcttgtcaccgaggctggagtgcaatggtgcaatctcggctcactgcaacctccgcctcctgggttcaagtgattctcctgcctcagcctcctgagtagctgggatcacaggtgtgcgccaccatgcttggctaatttttttgtatttttagtagagatggggtttcaccatgttggtcaggccggtctcgaattcctgacctcaagtgatccacctaccttggcctcccaaagtgctgggatttcaggtgtgagccaccgcgcccggccaaaacatgttccttctacacccaggtttttttagggtttttataatgaagggatgttgaattttatcaaatgctttttcagtgtgaattgaaatgatagtatagttttgtccctcattctgtagatatgatgtattgcattgattgatttgcatatgacatccttgcatccttgcgtccttgcatccctgggataaatctcacttggtcatgatgaatcatctttttaatgtgttgttgaattcagtttgctattaaggtgagtgcaaaactattgcagtttttgcattgttggaatttgccgtttgatgttggaatacattcttcaataaatgtggttaggtcatacatcattttaatggacatttctcgctttatgttttcttgctaatgacttattatttgttgtttattttatgtttattttagactacggaaattatgttagacaaaaagcaaattagagcaattttcttatttgggttcaaaatgggtcataaagcagcaagaaaactcataacatcaataaggcatttggcccaggaactgctaatgaatgtacagtacagtggtggttcaagaagttttgcaaaggagacaagagccttgaagatgaggagtgtatggccagccatcagaagttgacaatgaccaattgacagcaatcatcaaagctgatcctcttacaactacatgagaaattgccaaagaactccacctcgaccattctatggtcatgtggcatttgaagcaaattgaaaaggtgaaaaaggtgggaaaaaaaggtgaaaaaaaggtgtcttgataagtgggtgcttcatgagctgagcaaaaattttaaaaaatgttgtcttgaagtgttgttttctcttattctatgcaataacagtgaaccatttcttgatcggattgtgacatgtgacaaaaagtggattttatacaacaactggtgacgaccagcttagtggttggactgagaagaagctccgaagcacttcccaaagccaaacttgcaccaaaaaaggtcatggccactgtttggtggtctgctgctggtctgatccagtatagctttctgaatcctggcaaaaccattacatctgagaactatgctcagcaaacggacgagatgcaccaaaaactgcaacaactgcagccagcattggtcaacagaaagggcccaattcttctccaggacaacacccaaacacacgtcacacaaccaacacttcaaaagttgagcaaattgggctatgaagttttgcctcatctgccatactcacctgacctctcaccaactgactaccacttctacaagcatctcaacaactttttgtacggaaaacgcttccacaaccagcaggatgcagaaaatgatttccaagagtttgttgaatcctgaagcatggatttttacaccataggaataaagatttctcactggcaaaaatgtgttgattgtaatgtttcctgttttgattaataaagatgtgtttgagcctagttataatgatttaaaatttacagtctgaaaccgcaattacttttgcagcaacctaatagtatttggttgaggatttttgcatcaatgttcatcagggatattggcctgttgttttctttcttttttcttttctttctttctttctttttttttttttttttgatgtgtctttgtctggttttgctatcagggtaataatggcctcatggaatgagtttgaaagtattccctcctcctcaatttttttgaatagtttgagtaggattggtattagttatttaaatgtttggtaaaattcatcagtgaaactattgagccccaggctattctttgccagcagactttttattttggctttgaaattgttacttactattggtctgttaaagttttgaatttcttcatggttcaactcagtaggtttcatgtatctagaaatttatctatttttttctaggttttccaatttgttggcatatacttactcatagtagtacctaagatcctttgaatttcttggtatcagttgtaacgtctcccttttcaaaacctctcattttatttatttcggtcttctctctttttttcttagtctggctaaaggtttgtcattttgtttatcttttctttctttctttttttttttgagacggagtctcgctctgtcacccaggctggagtgcagtggcacgatcttggctcactgcaagccccgcctcccaggttcacgccattctcctgcctcagcctcccgagtagctgggactacaggcgcccaccaccaggcccagctaattttttgtattttttagtagagacggggtttcaccgtggtttcgatctcctgaccttgtgatcccccccacctcagcctcccaaagtgctgggattacaggtgtgagccatcacgcccggccttatttgtcttttcaaaaaatgatttttttgttttcatcctttgtattatttgtttcaatttcatttatttctgctctggtctttattatttcttttcttctactgactttgggtttggtttgtgcttgcttttctagttctttaagagacaccattaggttgtttacctgaagtttgtatgtttgttcatttgtttgtttgagacagagtctcactcagtcacccaggccggagcgcagtggccaatcttggctcactgcaacctccgcctcccaggtccaagcaattcgcatgcctcagccgcccaagtagctgggactatagacatgtgccaccgtgcctggctaatttttttggtatttttagtagagatggggttttgccatgttgcccaggctggtctcaaactcctgagctcaaacaatctgctcagcttggcctcccaaagtgctggagttacaggcatgagcgactacacccagactttttatcttttttgatgtaggcacttatagccataaacttccctcttagtactgctttcactgtatcccacaggttttgatatgttgtgtttccattattgtttcaagaaatttttaaattttcttattaatttcttagttcacccactggttattcaggagcatattgtttaattttcatgtgtttgtatagtttctaaaattcctcgttattgatttctagttttatttcattgtggtcagagaagatccttgatattattttttttttttatgctttaagacttgttttgtggcctcacatatgatctgtccttgggaatgatccatgtgctgaggagaagaatgtctattctgtgaccattgtgtgaaatgtcctataaatatctattaggtccatttgatccatagtgcagattaagtctgatgtttctttgttgattttctgtctggatgatctgtccaatgctgaaagtggggtgttgaaatcttgtgctattattgtagtggagtctgtctctctctttatctctaataatatttgctttatatatctgggtgcttcagtgttgggtgcatatatatttacaattgttatattctcttgctgaattgacccctttatcattatgtaatgaccttctttgtctctttttatagtttttgtctttttttcttgagacggagtctcactctgtcacccaggttggagtgcagtggtgcaatctcagctcactgcaacctccacctcctgggttcaagcagttttcctgcctcagcctcctgagtagctgggattacaggtgtgtgccaccatgccaggctaatttttgtatttttagtagagatggggtttcactatgttggccaggctggtctcgaactcctgacctcaggtgatctgcccgcctcggcctcccaaagtgctgggattacaggtgtgagccaccacacccagccttgattttgtcttgaaatctgttttgtctgttataagcacagctacttctgctctttttttagtttccatctgcataaagcatctttttccatccctttattttcagtttatgtgtgtctttataggtgaagtgtgtttcttgtaggcaacagatcattgagtcttttttaaaaaaaatccattcagccactctgcatcttttgattagagagcttagtccatttacattcaatgttattattgataagtaaggacttactcctgccattttgttatttgtcttctggttgtttttggtcttctcttccttctttccttccttcctgtcttccttttagtgaaggtgattttctctggtggtatgttttaatttcttgttttttattttttgtgtatccattgtatgtttttagatttgaggttaccatgaggcttgcaaataatatcttataacccattattttaaactgatgacaatgtaacactaattgtgtaaactaataaacaaaaaggaaactaataaaaactaatacaaactttaactttgtctccccacattttaattttttgttgtttctatcttattgtactatgtcttgaaaagttgttgtaattattattattattattattattattattattattattattattttgagatggagtcttgctctgttgcccaggctgaagtgcagtggcacgatctcagctcgctgcaaactctgcctcccgggttcaagtgattctcctgcctcaggctcccgagtagctgggattataggcatgtgccaccacgcccagctaatttttgtatttttagtagagatggggtttcaccgtgttaaccaggttagtctccatctcctgacctcgtgatccgcccacctcggactcccaaagtgctaggattacaagtgtgagccactgcacccagcctgtaattattatttttgattggttcatctttttgtttttctacttaaaatatgagtagtttacataccacaatgacagtgttagaatagtctgtgtttttctgtgtagtacttattattaccagtaagttttgtaccttcagatgattttttttttttttaattttttttgacaaggtctcactttgtcacccaggctacagtccagttgcttgattatagctcactgtagcctcccaggctcaagcgatcctcctgcctcagcctcccaaagtgctgggatcacaggcatgagcctctatgcccagccaattaaaacaatttttttttttgtagaggtggagtctcactgcattgcccaggctgacctcaaactcttgggttcaagcaattctcccaccttggcccagatgatttcttgttgctcattaacatcattttctttcagattgaagaactctttttagcatttcttgtaggatagatcttgtgttgatgaaatccttcagcttttgcttgtccaggaaagtctttacttctccttcacgtttgaaggatattttcatcagatatagtaatactattctagggtaaaagtttttttttccttcagcattttaaatattgtcatgccactctctcctgacctgtaaggtttccatcgagaagtctgctgccagacctattggagctccattgtatgttatttgtttcttttctcttgctggttttagaatcctttctttatccttgacctttgggagtctgaatattaaatgccttgaagtagtcttctttgggttaaacctgcttggtgttccataaccttcttatccttgaatattgatatctttctctaggtttggaaagttatctattattattcctttgaatgaaccccacctctctctgtacctcctctttaaagccaataactcttagatttgcccttttgaggctgttttctagatcttgtaggcatgcttcattcttttttttcttttttcttttgtctcctctgactttgtattttcaaacagcccaagttcactaactcttctgcttgaccaattctgctattaaaagactctgatgagttcttcagtatgtcaattgcatttttcaactctaggatttctgcttaattctttttaattatttctatttctttgttaaatttatctaatggattctgaattccttctctgtgttatcttgaatttctttgagtttcttcaagacagctattttgaattctgtgtctgaaaggtcaaatttctctctctctctctgggattaatccctggtgtctatttccctggatggtcttgatgcttgcggatgtttatcagtgtctgggcattgaagagctaggtatttattgcatccttcacaatctgggcttgtttgtacctgtcctttttggaaggctttccaggtatttgaagagacttgagtgttgtgatttaagcttttggtcattagtgggccattggtgggtaacccacaatgtaacccagtaacgccatggttcttgcagactcatagaggtaccaccttggttaccttggataaggcctggaagaagtctctggagtatcaggcagagactcttattcttttctcatacaatatattccttcttttcttttcttttttttcttccttccttccttccttctttccttccttccttctctctctctctctctttctttctatctttctttctttctcagggtctcattctgtcacccagggtggagtgcagtggtgcaatcttggctcactgccacctccacctcctggggtcaagcaattctcatgcctcaggcacctgagtagctgggattataggcacgtgccaccatgcctagctaatttttgtatttttagtagagacaggtttttgctatgttgcccaggctggtcttgaactcctggccttaagtgatccacctgcctcagcctcccaaaatgctgagattacaggaatgagccactgcacctggccccatactttctcccaaacaaagagcatctctctctctctctgtgctgagctgcctggagatgggggagaggttaaacaagcacccctgtggccaccacccctgctcctgtgctgagtcagatctgaagccagcacagcactggctgtgaatgtgatgggtcacacctgaagctggcacatctcagtctcactgaaggctcacagcatgtactacttggttaccactgctgcttatatagggttctttaattagcaggtgataaatcttgccaggactgggtccttcccttcaaggcagcaggttcccttctggcccaggttgtgtctagaaatgtcatctaggactaggttctagaatgggggcctcacaactctacccggcgccctttcctaatgtggctgagctggtatccaagttgcaagacaaagttttctttactcttctctctcctcaagtggaaggaaggggtctcttttggatttgcaaactgcactgcctgaacttgaaggaggggtggcacaagtactcccttgattgccccagctagtgtctcactaggttgtgtggctcccaagtccactggctctgggcccaacacaggactaagccttgcctaggagttgcagtccttgtggcctagatagccttccaagtttatttaggaccctagaggacattagcctgtggtggcaaggcttgccaaaactcaagtcctgaccactgggatgagtgattcccctctgggtaaggctggtccaatgctgcccttatgggcaccggttgagttctgcccagtgttggcagcactgtgttccaatgcaaaatcccacaatagctgcacttgccctccctgaagcacacagattctctctctgtgccatgcagcagctgctggggagtgggggaagggtctgtcaagactgtacaattcaagactgtatttcctaccctcttcagtggctctttcagtgataggaagttaaaaccaggcactatgatcgctcacctgatttttggttcttatgatggtgcttttttgtgtagaaaatcattcagtttggtgttcctgcagggatgacgattgatggaggcttccattcagccatcttgcttccaaccatccaattttcaatttttgttttgtttttagacagtctagctctttcgcccaggctggagtgcagtggcatgatcttggctcacttcaacctctacctcccggattcaagcgattcttgtgcctcagcctctcgactagctagctggaattacaggcgtgcaccaccacacccagctaatttttgtatttttgttacagacagggtttcaccatgttagccaggctggtctggaactcctgacctcaagtgatccacctgccttggcctcccaaagtgctggcattacagatgtgagccaccgtgcccagcccaattttcaattttttgtatttcttcagatgttttccctgtgataaatatgtttgctttaggttaattttctcgtttgtttgtttttaattgaatcattatacagttctccattatatgtttttgtttgttttttgagacacagtcttgctctgtcacccaagctggagtgcagtggtaaaatctcagctcattgcaacctccgcctccagggttcaggtgattctctcacctcagccccccaagtagctgggattacaggcatgcaccaccacacctggctaatttttgtatttttagtacggtctgggtttcaccgtgttgatcaggctggtctagaactcctgacctaaagtgatccacctgccttggcctcccaaagtgctgggattacaggtgtgagccactgtacctggcccttttctccattatcttatagacatcttttcattttgtacatatagttccagctcattattttgcaagctatagttttttagcatttaacggaaatttgggtggtttccaatatggagtataataaacaatgccaatatttggttttgtaaactttcccccagatctctctgtggctgattttctcactccattcaggttcctgctcaaatgccacttcctcagaaaagcattccttgatttcactattttaaactagcactttcctccaaccctctaccacttcttcatcccttactttactttctgatatcaatctttgtaatttttcctcttgattttagagtttaaaatacatttggattttatgatgaaacaaaaaaataaggtacaagtctgactccccctggatcccattgtccacattcacaccatcaagttgtgtgccggcatacctggaaggatgactctagacatcacactgctcaactagcctggcctcccagctgggtccagtgtgaccctgccttcatcaaatctccctgtttcacccttcaccttatgcccttcttactggggtaggaagaaccaggctttaagtcagcagcaataaagtctcagaaggctgggcatggtggcttacacctgtaatccccacattttgagaggctgaggtgggaggatcccttggagtttgagactggtctgggcaacatagtgaggccacgtctctacaaaaaaaaattgtttttaaattagccaggtatggtggcatgtgcctgtagtcccagctactcaggaggctgaggtgggaagattgcttggtcccaggaggttgaggctgcagtgagccatgattgtgccactgcactccagcctgggtgatgaagaccctgtctcaaaaaaataatactaaaataaaaaatattgataggtcattggatgggtaaatgtaaaattttttttaaattttaaaattaaaaataaagtttcagaaatacagtctcagtaatactagttctatgattgtatgatgaaggcattttttaacctgtgtttcattttcatctgtgaaatgtgaataaaaataactctcttacagagttcccgtaaagattaaataagtatgtaaagcatctgggtcagtgcctatcatatagttggcaccaaaatattctcccctctcccagctcctgcaaaggcaccccagctctttgcagcacttagggcctttctcatattctgacctgtattaagcaaatgtgcagctggtaggataagatgcttgaacgtagtagacactcaatagaggactgccaagcagagttgatttctgtagttagaaactagttcatccttaccagtatttttttttttcttgtatacactcccaatcggcttatcggcttatcatgtcacacacaactggttactctctacccaactagatactggatgaggtcatctctcaatcctgtctgagctgaacaaggccttttatggaactttaaagttgactcaccactgagtcatcaaaacacagcaatacctaaacacgctcctgttgctaacaaaagaccagcatgggatgtctgtcttacctcctttccctcccctaatgagacacggccccttgactcactggagaagagtcatcacgtcttttgtgctgcagtaatctgaacgaagccagtttaaataatcacaatgtggccagcaaacaactggcagtccctgtggtcattcaggtcatttcctgtgtatgtcactaacccaaaaggagaggcaattaatcaatcacctgaatatttaataagtgcctgcattctgttgggcactcacagttccctctgtttatgacatttctgtgaagtgaacttttcagttattgaaactcattaaaaatatagagaacagtgttgcgggaagtcagggaccccaaacggagggaccacattagaacagcaacctttgtgcctctgtaaaggaaataaaaaaaggaatattggagaaaatgggactattcagttccattccaatagaaaagaattataaaatagcaaataggaaggggttatttgctaatgttttggctaaatgcttcagagagctataattttaaaatatcttggttgagaactactctcttatctaggaatgaaatggtcagtggtattttctcttgggaaaagtcttgcgttagtaccactgcctgacctattgcagtggactatgaagtgtttcaagattagggggcctgtgtaaggctgagaactgctgagataactaggagtaggcctaagggctcctttcataaataaggctggttacagctgtttcatacatgaacagatacaacctttaagtaccctagcatggtctttcctagctgaagaccccaaggaaaacctgaatgaaaatcttagatcttcagacattttatatagaatccatacaattgatatacccatatccaaaggatataatgatctacccttgatctatcttaaataaatatcagaacgatgcatggaaattgcatgttagtagtccttaaagattaatttggcacgacaagaaatgtttattttattaaaataaatacaagctcttaactggttgtttttcctgggttatgcttctcaagttcttattacatagatactgtgttctgatttgatcttcctagctggttgtgcataaactcgagcccatccatattaagtaaattaattttggggacatcaggagtcacatattgcaattactgactataaagccattaacaactatgaatttttctcaaacaacattgctataattgaaagcatacttataacttttttttttttccccagacagggtgttgctctgttgcctaggctggaatgcagtgatgtgctcacggctcactgcagcctctacctcccaggcccaagcaatcctcccacctcagcctccagagcagctgggaccacaggcgcaccatgcccggctaattttttaaattttttgtagagagggagtctccctatgttgcccaggctggtctcaaactcctgcgcccaaggaatcctcctacctcggcctcccaaagtgctgagattacaggcatgagccaccatgccaagccagaaagcacacttatatttattgaacactattcacaagagataatgctagtctcacatttaataaactgaacaattggccaggcgcggaggctcacgcctgtaatcccagcactttgggaggccgaggcgggcggatcacgaggtcaggagattgagaccatcctggctaacacggtgaaaccctgtctctactaaaaatacaaaaaattagccagggatggtggcgggcccctgtagtcccagctactcgggaggctgaggcaggagaatggcgtgaacctgggaggcggagcttgcagtgagctgagctcgtgccactgcactccagcctgggcgacagagcgagactccgtctcaaaacaaaaacaaaaacaaaaacactgaacaattagagaagaattgagtttgacggtactgtactctcagggtatgctgatgaacatgcggtgaaatggtcaaataatcacatccatcagaggttattaaggcacgtgatgaagtagagaaatctaatttatagctgggaagtcaaacaggagcaatctaggagctaccacgttctagcctgagatttgtattcctgaggccaataggcagctggtaacagagctgggttgaaataaattgagacttgctgtgagaacaagcataaggagaaaggtaaagataacaaggaaggtgaagaaagttgaactctttaagcatattatttgtcttttaagtgaaaaactgacatttgactaatgtgtcttttttttaaagttagaaatctatcagagtagggtccttagagaaactgattatttctccagaataaagagcatattaatagaaaagattcagctttcgctaacggctgactagtcttaacgaaacattcctaaaggctttgcatcactgagaaaagttagttcctagttctgaaggatttcattcaaagtgcaaggctcatgttaataggaatatgcatgcatattcatgtgctatatgtattaaaaatacttgagaaggtgatttagaaatctcagttttaaatcttcatgggaagaatcttgcttgttttgttgctaaggaaggtgaatgggttgaaaatagttttaaagccctttacgtgcgaagtcatgaatctaaagaggataaacaggttaggtttgttatcccagaagctagaggcaagatttttactcagttctttcaacattaccacaagcatgtggattctgcaaaagttgcctagcaacattagttagaaacaacattgggtggagaaaggaactggaaatttgaattagatacggcctggggcaggcgggtgtaacccatctctccagtacagtgtgtgctttactcagaggagcgtgaaattttaaaaatcagaacagtcacttaaaatttcagttaggatgttgctacagttaaaccataatattgtgccatgttctcagcttgaagaggcagggcctgggtttctcacttttgttttgttttgttattttggcacttttgttttaaagatcactggattttcattaaattattctagaaacatttattaagcactttctcaggggccaaggcacagtgctggttgctggagctctgaagacaaacacagtttggaccctgccctgggcagtgtgaaaaccagacaagtaaacaaagtaagagtgttacatagtccgtgctgggtgcggtggaaagtctggagtagggaatggagagtcaggaaaggcttcacagaggaaatggctctagcactgagtcttggtttcaacttaaaaaaaaaattccttcagccaggtgcagtggctcacacctgtaatcccaaccctttgagaggctgaggtaggcagatcacttgagctcaggagttcaagaccagcctgggcaacatggtgagacccggtctctacaaaaaatacaaaaattcaccaggtgtagtggcacttgcctgtagtcctggctactcaagaggctgaggtgggagaattgcttgagcccagaaggggaggttgcagtgagccgtgaacgcaccactgcactccagcctgggcaatagagcaaacccttgtctcaaggaaaaaaaaaaaaaaaaattatttcccccaatcattctacacatttattgtgaacttacctcttcgattctgtgtgaggacttcaaagtcctgggtctgtggaccaagaactcttcccttcccatccacaacccaagcccttctgcctgccttagcctacttcaaagacctcccatttagggacgcagacaggtggcaaagtaggagttgacaaaacaaaacaaaacattgttaagagtgtttaccttcaggaaggggaactgggctgggatttgaagggataggtgggagaattttgtaccatttaagtttttgttactggagtggggaaaaaccatggggaaaaataggaagtgtgatggctgctacctctacaatcttgcattaaatagagtactagagtggtgatctctgttcaatttttttttttttttcctgagatagttctcggtctgctgcctaggctggagtgcagtggcacaatcacagctcactgcagccttcatctctcaggctcaagggatcctcccacttcagcctcctgagtagctgggaccacaggcatgtgacaccatgcccagctaatttttaaatttttagtagaggtgaggtctcactatgttgtccaggctggtcttgaactcctggcctcaagtgatcctcctgtcttgacctcccaaagtgttgggattgcaggtgtgaacaactaccacacccgattcaaaatcttaaataggcaaacttatctgcaaatgtgccaatttaggaagcgaataaaccaacaattatttaaataagggctcttttatcactcacaagggagtgaacgcctaatccacgttagaatactgcaataaacaagggtcccctaccctcggggaccttatttttctagaaggagatagtaataaactaacaacgtactttgagatagaaataagcctgctaaggaaataaagccaggtgttgtgaaagagcaaagagtgagggaggggacgtgagaacagagatacggaattcttacataggaggagtttaggagcatcagtctagttgtggagaggcaactaaagggctttaaagtcccatttacttagaaagcacactattttcacatgcagtttatgttacagatcgataaaagtagggttctctatttttatttatgcttcataataaattgagaaaatgtcaattatatcaaataattatatttgtcatcaggagtggcaggagggggcccacagcctgggcaatatggtggctcatgcctgtaattccagcactttgggagacggagacgggcagattgcttgagcccaggagttctagaccagcctgggcaacatggtgaaacagagtctctactaaaaatgcaaatattagctgggcgtggtagcacacatcattagtcccagctatttgggagggtgaggtgggaggatctcttgagcctggggagatcgaggctacagagccgtgattgcaccactgtactccactttgagacagggtggacagagtgagaccctgtctcgaaaaataaaaatttaaaaaaaaggagtggcaggaggggaagtgttggagcaagggttctgaaaatcactccttggctttggccactgtggatcattgactaactctccttatacaagtctagaattcttgtcctccaagagcttaaaattaagtttgcatgaccatataaaaaacacatttatacaccagttagcaaatgttaggagaaaagacagctgttgatccttcactgtgtcttcagttgtgtgatctcaggaaattcccgatttgatgtgttaagtactaccgtgtgtttcaagaaaaattcagcttgagtttatttagcctttgaaaagcattagaacaacatatatgacaaagtgttaatatgcataaagtgctaacaataagaaaaataggcaatagagataaatgtaaattatcattaaacccatgacaactgttcaacaatatgaatcaaaacaacaaaaccacatcaacgaacatccactgatgtcctgaattcacagagtgtgctctaatccactgctagtgagaatgtattgtgtttctggagggggagtttgccagtttatatcctttgactgaggaattctaactccagggaggtatccaaaagagtattttaaaaaggccaggcgcggtggctcacgcctgtaatcctagcactttgggaggccgaggcgggcagatcacctgaggtcaggagtttgagaccagcctgccaacatggtgaaactccgtattttgcattttgtaaaaatacaaaaattggccaggcctggtatgtgcttgtaataccagctacccgggagacaggagaatcgctggaacccgagaacccgggaggtgggggctgcagtgagccgagatcgcgccactgcactccagcctggggcgacagagcgagactccgtgtcgaaaaaaaccaaaccaaacaaaaaacatggagaaggaagcatatacaccacggggttgtttacaacagaaaactggaagaggccgggagcggtggttcacgtctgtaattccagcactttgagaggccgaggcgggcggatcacttgagatcaggagttggagaccagcctggccaacattgggaagttcgtctctactaaaaatacaaaaattagccaggtgtggtggcagccgcctgtaatcccagctactcgggtggctgaggcatgagaatcgcttgaactctaaaggcggaggttgcaggttgtagtgagccgagatcgtgccactgcactccagcctgggtgacagagcaagaccccgtctcagaaaaaaaaaaaaaataaataaacaaagaaagaaaaaagaaaactggaagaaacgtgtaagtgcattaagggacagattaaatcagtttaacgaagcactagggaaattttttaaaattgcgtttgagtttgccgcgagccgggccaatcggttttgccaacgcatgcccacgtgctggcgaacaaatgtaaacacggagatcgtgtgccgggcacttggtttcgtggtgggcaactgtgctgctgtttcttttggccgcggacaaggtcggcagaggtggacccctgcttgggagagctcttctcgctgtgctgacacccgcccctaacagtcacccaccccggggaaataatggggctcggaggcctcctcccagccagtgtccagcctaagcacatcggctcccgcagttcagaaaggtcccgaggcccgagtcaccatttccggctcagacctcgacccggaacgtggctgcccactgccacgcccactacgccccagtggctcgccccaggggacgaggggcaagaagcggcctccgagggcagcggccgaaggccattcggtccctggctcttcccagctcgcagagacccggaagcgctgcccggccgcctgcccctcttcagatcccccagcaccggaggagcagcgagggggctgcgtccaggccggctttcgggtcggcttaggcgaatccagctctcttttgcccctcccagaaggcccagccccgtccgggcggtgttcgggcggcgccgggccgggccccccgccgccccaggctcgctcataggcccggaacaccacagcccgcccagacttggctggcgccgagccgggggtggagccagcgggttcccgccaaaatcgcgtagctggtccttcccccgcgggctacgtcgcgccctcctttttttttcaaacccggagctgcactgggattggtggactgggcactcacgtggttaacggtcgcgggaagccgcggagcccgaacctgagactggacctgaggagacctcagcctcggtgctcgggccgccccgcctctgccggaaagtccgcgccgccgctgccgccaccgtccgcagcccgagcgccccggagccgcaggccgccgccgcgcagagacgccgcggctgcgactaggcgcgcccagccgcacgtggcggacccgcccccaggcccgcagtgtcctggaccccgcaggcctccgctctcctgtcctcggccccgtccccagggccgcgatgagcttcctgagccgacagcagccgccgccaccccgccgcgccggggcggcctgcaccttgcggcagaagctgatcttctcgccctgcagcgactgtgaggaggaggaagaagaggaggaggaggagggcagcggccacagcaccggggaggactcggcctttcaagagcccgactcgccgctgccgcccgcgcggagccccacggagcccgggcccgagcgccgccgctcgcccgggccggcccccgggagccccggcgagctggaggaggacctgttgctgcccggcgcctgcccgggcgcggacgaggcgggcggtggggcggagggcgactcgtgggaggaggagggcttcggctcctcgtcgccggtcaagtcgccggcggccccctacttcctgggtagctctttctcgccggtgcgctgcggcggcccaggagatgcgtcgccgcggggttgcggggcgcgccgggcgggcgaaggccgccgctcgccgcggccggaccacccgggcaccccgccacacaagaccttccgcaagctgcgactcttcgacaccccgcacacgcccaaggtgagagcggcgggcgcgggcacccggcggccggggccgcggcgccggaggggccagcgccgctgcctgggttcggttacagaagcggccggccgctcccccctcgctttcctgcgccgccccccaaagttggcagcccttgtgtttggccctgccccgaggttgtccgttgagattatgtaactgaacaatgggcctcgtctggaacttcatcttacaaaggggccgatcggcccgtccgggtggccaaggatttgccgcccgttgagtccgggccgccccgagcgtgtcagccccgagtgcggcaccgataacgcggttcgcgaggatgctggagggtgccggcccggccacctgacactcccgagccataggatgccttttaaacgcggcgatcgggcctgtaatttgggcggcgcgggcagaaggagtttaaagaaaaataattgtcccgccctgatcgtgtcgtgtcgtgtggcgtggatgggggaaaggtctggggcatgcagggagactacgcttggacttgggagtaaaggctggccttccaagcatttacagtcctacagactcatcctaagtccaggcagtactgaggcctgtttctggacaaggtcttggcccagcatttgtttttatcgtgggtttgcggtgcccagagtttggccggcctccgtgtgattaggaacatcctaccgtagataaggtatcttaaagaaggaggtgttcagcacctgtgttttgaaaggccttcgagtactgcgcagatgaccacttttaaaactgcagattttaaagctgatacttccagagattaagacaagcctcgcatttgtaaggttaacagggaagatgcaccttttaaagtgagtttgttttgttttcaatgtactgtttgtcatcagcctaggcaatctgtgtgctttcgagctgtactgtttattggccgacttgctcaaggcaaaatccctctggaagtgaggggaggagtccagcggaggtggctatggaagccctatctagatgggggaggggagattttatggggctctcggactgctttctatttttggatgggttgaaagaatttgttaacttttagccactagaatgaacttagttttaggcagcatttatattctttttagggttagaggcagattttacttggctatttttttcaagaaaagatagttaatatccagcttcagtcttcctaaattagccacaatttattttgcttgaactctaacaaaggcttgtgtgttgctttcacctacgcattcagccctatgaaaggctcgttgaaggttaggttgagaaggctgactataggacttggatcctaaaaattgtatttgtatttttctttccctagagtttgctctccaaagctcggggaattgattccagctctgttaaactccggggtagttctctcttcatggatacagaaaaatcaggaaaaagggaatttgatgtgcgacagactcctcaagtgaatattaatccttttactccggattctttgttgcttcattcctcaggacagtgtcgtcgtagaaagagaacgtattggaatgagtaagtcgtttatttaacagtttggttctccaaataacctaagattggtttggtatacttatcaaaatttagttcctatttaatggcatggatgtatctgtcagatatattgatagaaaaataacattttttttagttcctgtggtgaagacatggaagccagtgattatgagcttgaagatgaaacaagacctgctaaggtaaatagctttttatttttatttttttgaaatttacttttctgccacttaaagcatgctatgaatatgttaataagcattaacacataaggtagaatggtttttaaatttcacacatagccctatcaccatagcaagaaataactgttttcgtatatttgtattacatatatggaaacactttttattacagagaattacaattactgaaagcaatatgaagtcccggtatacaacagaatttcatgagctagagaaaatcggctctggagaatttggttctgtatttaagtgtgtgaagaggctggatggatgcatttatgccattaagcgatcaaaaaagccattggcgggctctgttgatgagtatgtattaaacattttgtcttttgctcttttgtcccctatggtgttactaacattaaggtttcagctggtcaaacactgaattccatctctaacttttgagaagctgtaatgatttaatcaggtccttttcacttaataccatcagttcttattggacttgttgaataatatgagtctgattttggaacctaacttaaatttcttatttctagtcagcatccatgaattcacagtaaaatggagtttattcttacctgagtcctagggcaagcaacatttcttctttctgataaatctttaatggaatctgcctttggaaaaatctcttacaagtctaaaccccttctctcttaagcaagttgctttttagcataacaatagataccaaaaatttattgtatgaagtttcagataaattaattcagtttaagcttgagtgaaaattatttaccattctattaatctcaaatttcttctaggcagaacgctttgagagaagtatatgctcatgcagtgcttggacagcattctcatgtagttcgatatttctctgcgtgggcagaagatgatcatatgcttatacagaatgaatattgtaatggtgagtgatgtaatggttttcttgtgagcttgagaaaatgaacatcgaggaaatatttatggttatctaaaatcttgctctatttctgtcacttttatcttttataaatttaaagatcagagacctaacataaatttcaagtacaaggttaaaaaccttgtcctttctgaagcaccttgtacatatctcagtagtagaacttcgcatactatttatgtgcttgtcgctccaactgagctttttgacaagactatggcctcgacacatatattttggtgtccgtagtacctagcgtagtgtgtgaagcatatagtattatgaagtgttaagttgaatagattcttcctgtgtctggtctttgatttccatttcatgtgaggtgctgctaaaactgatgtttgttagtcactgagtctctgttgatctaaattcagctgtttctttaagcattctgtagtccggccctactcccacgtatccaacctagtctaccctagaatccactaacgctttattatgttacattcttttagttctctagcttgtcgtctctccctcctctcccctaaggatgaaacaaaacaggcatgtatagattcaagtttggatgtcttgtatagctttcagtttcggtaagtccttcaagggccgacttatgtctctccttttctattaaaaacctttaccaaagtcttggtcagaattctggttcttatggacgtctgtcattattatataccaaatcttttatggattatttctcaacacttttgtagtttataagtgtgatgattgggttttcatactcaagtgtga

SEQ ID NO: 12233 - DNA, 12583 bp, Human
atttaaatagaggcaggagtcactcaggctagaatgcagtggtgcaatcacagctcactattgcagccaccacctcctgggctcaggcgatcctcccacctcagcctcccgagtagctgggagtacaagtgcattccacaacccccgactaattttttttttttttaatttttgtagagacgaggtcccaactatgttgcccaggctggtctcgaactcctgagttcaattaatcctcctgcctttgcctcccaaagcggggaattagaaaagtgagccaacacgcccggcccactagtgttaaaaaataaaaacaaaagcaataatctgacagatagagccagggagggctatgaagagacacttctcaggcttgtatgcctcataagaaaactatcacatatgactgcaaaacccatcttacaccaaaaatacctctgcaaggacatccgcccagcaactgtttgtctaacctcagactggtgtcatcctcgttaccgatctttgtagtcaagaataatgatttcaaaacaattaaataatcctccccattcttcctttaaaaacctttgtcttcctttacctccctgaatagaaacatagtttactctggcacgtctattcttattgcaatttcctattcccgaataaacttttttttttttttttgagatggatccttgctctgtcgcccaggctggagtgcagtggcgtgatctcagctcactgcaaccttcacctcctgggttcaagcgattcttctgtcttagcctcccaagtagctgggactacaggcgcccaccaccacacccagctaatttttatatttttagtacagacggggtttcaccatgttggccaggctggccttgaactccttgttaaatacagtgagttctaaatttctcttcaaagaatcagtatgtcagtatgttcaattctttgttctccattttaaactttaacttcctcattttcctcgtctccttgcctctagtttcagtaaacaaccttttccaccagttctaatcagtagttcacatctgttcccctggtgacctgctccgtcctgagtcacccctggtcacctgctctgacctgagtcacctttagtcacctgttccgtaaccgtccttcccactgaaactgctcaccctaccactccggctcatacccctgctctctttaaaatagccaatcggaattaacttagactgtgcggtccaaccctagccagtaggggaacgacacagcactagggactacctgcgtcagggataagaaccccttcccctcccttgttcaggtgtgctctcgccattgctccatccgtgagacgcacccttctatagaagtaaattgctttgctgagaaaatgtgtgctcgagtgtgtatctttttcttcttcttctttttctgagactgagtctcactctgtcacccaagctggagtgcagtggcgcggtctcggctcactgcaagctccgcctcccgggttcaagcgattctcctgcctcagcctcccgagcacctggaactacaggcgcgtgccaccacgcccggcaatttttttttttttttttttttttgtatttttagtagacacagggtgtcaccgcgtaaaccaggatagtctcgatctcctgacctcgtgatccgcccgtctcggcctcccaaagtgctgggactgcaggcgtgagccaccgcgcccggccaacgtcattttcttttcaggagtcccttctgttatttagcaagacacactactacaatggagaaaaaagatgccccctccttcaagccctgagatcttcaggactttggcgaaaagtctgcgcccgaagagacccaggaaggattcttggaattgtagtccaaaggcatcccgccttctgcgcagactcacaagtccctgtggacggaattcttgaagtgtagcgccgctcagtccttccaccggaagtgtccgatcggaatcagccctgtccgagaggtgagtccgggtttggggatccagatgtccagccccgtgtccccctccaaacatccagtccctctcatattgcctttgaaattagcagcctctgggtgaccagaccttggccctcagaggaatcccggagaaaggtagaaccagcttcggcgttgggaacgcaggcgcgcttacgcatttagtgagggtttggcggtctccatagttaccgccgccgcgcgtgacgtcatagtggagcgctgagggcgtggtggcgtggggtgggggctgtcctactgatcctgaatttggggtcactggtaagaggagttgcccattccagccaggtggaacggggaggggtgccacatgtctcagatctgccattgtctgcgaaaagaaactgctgcgaggaccatccccaatcccctgcttcccttgggaagagtaaccgccgttttgtaggacacttggggacaaccccgcttgtcctgaaatttattgacacggtaaatagtatttcctgtgtgccgaggatgcagttaaaccaacactgaccccctgcccttgagaaacacaaggtactatgggagcctttaccagcatgccccttgaagtctctgttctgctttgtggtctctaccggatttcccctgactgtctccctctccaccaacaaaactctcacccgtcttcccctcccgcaacatgcccaccaagacatgttcatccatcaggagccctgctctttaacctccaactttctcatcataattaattactcgttcctctctgttctcctagcgtttcttcacacatctgcttacccatttttgtaagtcctcctaacacaatattataaggcactagatgctcaatcaatatttattagtttaaagctaccagctttagggggactcggttttaaatagatgagaagtgataaaacacctggagatagtactgtcagctgagataacatgtcatagaaccagctgctcagcataattgaaatttcattcggattatatgggcctactttacacccatcttactatggtaaatgagatcatgctcattaagcattaggacactacttggttagcgcatctaggaaacataaccagaaatatcaaagaaatggcccagtaaaatataagggattgagactctctggttaatataccatggaactaaccccccttttttttctttatcattgataaattttgttcttacttatactcaaattgtttgttttccaaggttcagtctgaacctagtgatatttatttcatactcttggagaattaatactgttacatatcttcaactacccttttcatgaatcttgtctgccaagacaagctcggtcatggagaccctaacccagtggcgctagaggaattaaagacacacacagaaatatagagtgtggagtgggaaatgaggggtctcacagccttcagagctgagagccttgaacagagatttacccacttatttattgacagcaagccagtgataagatttactgaaagtattccttacgggaaataaagggatgggccgaaataaagggatgggctctggctagttatctgcagcatgaacatgtccttaaggcacagatcgctcatgctattgttttctgccctgggtgggccaggtgttccttgccctcattccagtaaactgacaaccttccagcgtgggcgtcaaggccatcatgagcatgtcacagtgctgcagagattttgttcatggccagttttggggccagtttatggccagatttgggggcctgttcccaacacttgtcaaaatctgtcttcccattccaaattcttttccattattgaaatatcattgtttctgttggaaatatttttccaagtagatgtcttattatcatcttaaatacagatcatccaaaacagaagtcatctgaaactttcctaatttttcctttcaatcataaatatgaagccttaagaacaattaataatgcatgatccttaacctcatggaacatcaatcagttgataaaaaaacagccaaacaactaaaaataatacaaggacttatatattcatatgtgtatgtgttaggaattgtaagaactcagactagagttgagcaatttcttaacagaggcagtagaattcttagtcactccagccatcacaccctgcaagttgatctcaccatcagtctgctgctcattcctacttcctctactctgttcctttcctttctgaatctttctcatcctttattgtccaatttaagccccatgttaaatacagtgagttctaaatttctcttcaaagaatcagtatgtcagtatgttcagttctttgttctccactttaaagtttaacctcatctccttgcccctagtttcagtaaacaaccttttccaccagttccaatcagtagttcacatctattcccctggtcacctgctctgtcctgagtcacccctggtcatctgctctgacctgcatcacctttaatcgcctgttctgtaaccgtccttcccactgaaactgctcaccccgccactgtggttcatacccctgctttctttaaaacagccagttggaattagcttagactgtgcagtccaaccctagccaataggggaacgacatagcagtagggactacctgcgtcagagataagaaccccttcctctcccttgatcaggtatgctctcaccattgctccatctgcgagacacacctttctatagaagcaaaattgccttgatgagaaaattcatgttcgagtgctatttcttttgctgcaccgaaaatttatttctaatacccaccacctctaggaaataccttctaccattcacagtctcttcccacctcaggaccgttagaacattcagtatctccaccataaactcattttatacttcaacattcaacatttaacaaacatgtacaatgtatatgtcatgtgaaacgttttctcatttaaatcttttgtatccatgttttataatttcttcccaactagttcttcccactgaatttatttctttctctcccgcatccttgtcaaatcttttctattcttcaaactcaaagactttttgtttaatccattaagctgtatattagaatacagattttccaggcatatactatactgaccaagttaccatctctaggagcaggcccctagtctgcatctccagaggtagggcccaagaacctgtttctaccaaagatcccatatgatgattaggcagcaagcccagtgtcatattcagactttcttgtaaaccattgctgtacaacttctagcccaatgctttgcttgtgataagattcttaataaaatgtgtgttattgcatcagtcagtagtcaacttagtgaaatgtttagtaaaagaacctcaggccgggcacggtggctcacacctgtaatcccagcaatttgggaggctgagatgggcagtgggcagatcacaaggtcaggagtttgagaccagcttggccaacatggtgaaaccacatctctactaaaaatacaaaaaattagccaggtgtggcggtgtgcatctgaaatcctagctactcaggaggctgaggaaggagaatcacttgaacctgggaggcggaggttgcagtgagccgagatcgcgccattgcactccagcctgggtgatagagtaagactccctctcaaaaaacaaaaaaaagaacctcatacttgcatgaatacagtggcctctatcttttcatattgccacccaccctagaaatgaagaacatattcatctccacagtgtttagcaggtcattctgctcagaagaattgactcctcttcagtgactccccagtgcctaaaagataaactccaaattcatgaacttcacagttgatgttttctacaataacatctccaagctttgcctctataattttcttatacaaacctactaaacgttttgctttccctcttctgtattcctactcttacccaattgttcagactgtttctctgttcgtaatttcctatttctttccctcccacatcctagtcaaatcttttctattcttcagaatttcatgtttgcattaagcttcccttgaccattgcaaccatctgtatttttctcatctcctattttatgaagcacttctatcatttttcttttttatccttattttctctgtgacttttaaaatttaataacatgtacattgttaatatttagcattacatttaagtttattgtttctaatttatcttatttttaaatttaaaaattaagctatcttgaagtagaaatcattaacagttgtattctagaaaccaagtatgtcagtgcttttgcatatagtaaatgcccagtaaatttttgtgtaatggagaatgacgatttttattatgtggtctttcatcttcttagacagtaatagtaacttttgatccctcaggaggactcttgaaactaaagaagaccctttccaaagcagttctgataatatattctatccacagatggctacagaaccaaagaaagctgcagcccagaactctccagaggatgaaggacttctgatagtgaagatagaagaggaagaatttatccatgggcaggacacttgcttacagagaagtgaactccttaagcaggagctctgcaggcagctttttaggcagttctgctaccaggattctcctggacctcgcgaggcactgagccgcctccgggagctctgctgtcagtggctgaagccagagatccataccaaggaacagattctggaactgctggtgctagagcagttcctgaccatcctgccaggagatttgcaggcctgggtacatgaacattacccagagagtggagaggaggcagtgaccatactagaagatttggagagaggcactgatgaagcagtactccaggtgcacaggggatgggagatctaagacctccataatggataaagttccacggtgggaggagaggcccgagattgcatatctagcttgcaggagctgttggttcagtgtgcatttatgtctcctttcctgtctgtttgattccacactacattttacaattaaatcagactcgattcttccttccccagttttgcatttctatgggagtttctctttgttgttagaagacgtttaacacagggattcttttataagcccaaatgtactttatttttctcaggttcaagcccatgaacatggacaagaaatattccagaaaaaagtgtcacctcctggaccagcacttaatgtcaagttacagccagtggagaccaaggcccattttgattcatcagaaccccagctcctatgggactgtggtgaggggcagaatgccatatagtgcacatcactaaagaaacaggggaatgaatctccctccacaaactagtcttggtaactgtagatggtcctttcctttattacccaatgaaaagagagaacttgtggccaggtgcggtggctcactcctgtaatcccagcactttgggaggccaaggcaggtggatcacgaggtcaggagatcaagaccatcctggctaacatggtgaaaccccatctctactaaaaatacaaaaaattagccgtagcacctgtagtcccagctactcggaaggctgaggcaggagaatggcgtgaacctgggaggcggagcttgcagtgagctgagactgcgccactgcactccagcctgggcgacagagcaagactccatctcataaaggaaaaaaaaaagagagagagaacttgttttcctgtgagtctttggccaatggtaggggaaaagataattttgttccttatccagaatatttccaaaacacagaacatttttatgatatgaccaaattaaaggaaataaaagtgaatgagttgagaaaatatcatgaaaagagaaaagaaggaaaagaaaaagaaatacatggacagaagcaaaatatgttcatagagaagtacatataatgatcaagagaaacagatacatgatgatatactgagaaatagtatataattcacaagtaacatagaccgtgatccatatttttcctgttatgctcttggtcttataaagctcttttacacttttatagaaagttagctatagttctagagactacttccacagaatactcatctctgttctaaaactcatctatttaaaagattcatagatgcagtatcacttaaggtgtgaattgtccctatagtaaacccaagaataacttaccgttaattttttggtttgtttgttttgttttgttttgtttttcctgacacagagtcttgctctgtcacctaggctggagtgcagtggcgtgatctcagctcactgcaacctccacctcctgggttcaagcaattatcctgcctcagcctcccgagtagctgagattacatgtgcctgccaccatgcccggctaatttttgtatttttagtagagacggggtttcaccatgttggccaggctggtctcaaactcctgacttcgtgatccgcccgccttggcctcccagagtgctgggattacagacatgagccacggagcctggccacaattaatttttaataaatttctacatattctgccttcagttttgttctggaaacatctccatctgtcgtatataaaattgtaaatttccctcaccccatgaacagcactccctaaccctctttcctgccctagcgtattgtagacaaaggacagcttataataaagaagggcggttcaattccagcacagtatagagtgggatttgtgaagactggatcataaatggatcttggaaaccaggcttgggaatttagacttgaacaaaaaaagagagagagagattcaaggtttttgagtagggtatgaaaggatggcagtgtttaatgaccattagtctagtaaggatctttaggataactaggaagaagaaaagtgcagagtcaaaacagcaaggaggcagttaaagtctagataggaaatggtaaggttcgagactatggcgatggtagcagaaatataaaggaagggatttatacaagggacacttagtggacagtgatgacagaatttagaagactgattaaccatggaatatgaggaagaaatagacaataggtggatggaagttttctcacacatacttcacagtcacttatagctttacttttctctcttgtgttctcatctgctttctttgaggtagtgcctccattttccctctagaaatgtatcatagacccaaggttcccaagatctgctgcagtcaacattgtagagttccttctccgtactctatctccccctatctcttgagttcttgctgatgacaatcctcccaatcttttctaatatatatgcttcacgtctgattcctctctctgccaaccactgcaggcattacttgctcttaccaatgtttctttcattcctatcatcctctttcattctatcattcctctcatgtgaaaggtcatatattaaagtgggcatatcaatatgtaactatcttgagcatgctataaaattttcttttcgtgcagcaaacaggtaatatttccctttcttttttattttagataatgagagtgaaaacagtagatccatgccaaagctggaaatttttgaaaaaattgaatcacagagaattatatctggaagaatctcaggatacatatcagaagcatctggtgagtctcaagacatctgtaagtctgcaggcagggtaaagagacaatgggaaaaagaatcaggggagtctcagagactctcgtctgcccaggatgaaggttttggtaaaatcctcacccacaaaaatacagtcagaggtgaaataataagccacgatggatgtgagaggagattaaatctgaactcaaatgaattcacacaccagaaatcttgtaaacatggtacctgtgaccagagcttcaaatggaactcagattttattaaccatcaaataatttatgctggagaaaaaaatcaccaatatggaaaatctttcaagagcccaaaacttgctaaacatgcagcagttttcagtggagataaaactcatcagtgtaatgaatgtgggaaagctttcaggcacagctcaaaacttgctaggcatcagagaatccacactggagagagatgctatgaatgtaatgaatgtgggaaaagctttgcagagagctcagatcttactagacatcggcgaattcacactggggaaagaccctttggttgcaaagaatgtgggagagcattcaacctgaactcacatcttatcaggcatcagagaattcacaccagagagaaaccctacgagtgtagtgaatgtgggaaaaccttccgagtgagctcacatcttattcgacactttagaattcacactggagaaaaaccctatgaatgcagtgagtgtggaagagccttcagtcagagctcaaaccttagtcaacaccagagaattcacatgagggaaaacctattaatgtaaggaacttaaatttgtaagtaaatgctgaggaaatggcacaatatgaaaaatattaaataaaaaataaatattgggcaagatggaagactgaaagaccagtttctggtgttcaatctgtgtgtatgtgctttctgtgagactggggatgtaccccttctttcattgactactaaagtcaaaccaaaagagctacatttaggggggctaatagggtagtctatggcagtgcaatgtagagaaatagagactgtctggggaaataatcatgattacagtgtgggaagaaaaggaagatttaggtaaagagactgataatcagtcctagtttattttcctagttagtttagcacaagaagaggtcagctaaacccaggagtgaaataggttgcacagtgcactgcagaacagtgttttcagagcatccctttaaaaactgaagaccacaaaactaagatgctcatgttaagttagagagtaatgtcaaatgaggacatatgtaatggtggcattcctatatgaggccaaaatctgtgtccagaggtcataccaggaagtaaaaaaccagaagaacaccccagggaagaggccagaatccagacatttaagtaagacagtaagagaatagaattgaattaaggaaaaattgggttaggagtgagaaaaggtgttcaaattgaactaaacctcagaagttggaggatagacacaggataaccaggcttttactggtttttggcacctttctggggtaagttgatagggactataaggagttctcctaacagaaactgacagtaacagaaactgacaggattctccggcccgtggcaattgtggaagattactgaggaagttagtactggaaataatggtcctgaaatgttatttcgttgttgctggctgctctctacaaaaaagactgagaagagagtatagagcgatagtatatgaaagagggtagggaggaatgatttaagtcttaaacattccacagtatgtaaggcttttacattataaaatgtaaacaggaccttgatgttagatgtatgataatctaatgtgaaatgtacaaaatctcccactaagaggctttataagaaatagcttagcatttattttcaatgactttaaaaatgtcctgacgggatctaagtaacacaatatttggattgttttttaaggtaatgttgagcccacagttttttacaggtagtgtgctagtatgtcctatctcattttgtaactattatttttcacattttatagatgagaaaattgagctgtagtgaagttaactatcttgctaaagatcacatagtaagtggtagaaccaggattttaacgcacattttattccagggccctagttcttaatgcttaaacttgattatgtcactgaaaatattcctatgggatataacatcagaaaagatagcgcttgtacaccacaactctaaagttggtggcgggggaaacggggagacctagcacccttctagaagattaatccaccaacatttcaaaatcttgtaaggagctgcgacccgctaggacgggagcctactgcgccctcaaaccccgcggcggctccctccccggagggggcgcgtgaggccaccacccagagcctcttcctagaggagccggaagcatcgggagccgcggtacccgcccatcttccggccaggatgtgtggtcctggtgagcgattgtcctgtggcgtccgggaccgagtttgtggcccagggttatgtgtgcacttcacacctctgacttttttcagggttcctattgatggttaggagcaggatttcggggatgaaggcggcagcagcaagaggaggctgcgactgcggaccccagattcgtccccctccaccacacacaacgccaagacgggccccaggagggcgtgaagagaagacttcctttcctctcctctcgcctcctggcgctggccgtatgaaggtgtctcccagaagcattagcagaggagccctgtgggagaaatgaggtgtatagtcacacttaaatctgtttatgctgtcattgaacctctaaacacaattggatcattttctaatgatcag

SEQ ID NO: 12234 - DNA, 91665 bp, Human
ataaaagcattaaatacacatttggaggtacttggagagacaaaggaaagcttaaagcaatgcttttcaagctttgttatgtgtaagaatatcttgcttgaaatgtagagtcccaggctgcaacgcaagagtgtgcatcaggaagagtggagtgttgcccagaaatctggaaggtaagagaaaaggctagccactaatagtagtttaaatgagtcgagagtctggtctacattttgcatgtctaatagacatctcaaaattagcatatccaaaatcagatccaaatcctctcccctggtctgtccctgcccacgcccctaccctctatcaagtctttcccatctcagcatccttccagttgcttaagccaaacacctgggcataatccttgtctctattgttcctatcacaccatacctaattgtgttaattctatcttcaaatgtattctgaacttgactatttcccacaacccccatcatcacttgcctagtttatttcaatggccttctgacagatgttgctacctccattcttgcttccttggttctattttcaacagaggagccagagaaattaaaacatgagttaaagcctatagtcagagcctatcagtcctttgtccttttagtgccatccatctcactcaaagtagaatcaaagtccttagaatgggccacatggtcctacccagcctggacccgctcacttctgttgagctaatgtcctgcacttcacctgatgacctcatgtcctgcacttcacccctccttcactctggtccagacacactggcatccctactgctccttatacttgctaggcatgcttctgcctcaaggcctttgtgcagactcttcccgttgcctagaacacatttctctcagatattctcaaagctggctctctaacctctttcaggcatttgctgaaatatcactttctctgtaaggacttctctaacctccctatttaaaattgtaatattttctccccactccctgttccccttcttggtttgtgttaattcatagtacctaccaccatctaatattacaaatttttttttttgagactgaatcttgctctgtcgcccaggctggagtgcagtggcaggatcttggctcactgcaacctctgcctcccaggttcaagcgattctcctgcctcagcctcccaagtacctgggactacaagtgtgtgccaccacgctcagccaattttttgtatttttagtagagacagggtttcaccatgttagccaggatggtcttgatctcctgacctcgtgatccacccgcctcggcctcccaaagtgctgggattacaagtgtgagccactgcatccggagtattacaaattttttattactttgttcgtggtttgccttcctccaacagaacacaagctccactgggatttttgtctgttttgtcactgctttattcccaggacccagaagagcacttagcataaagtagatgctcaatgagtattggtgaaggcatggatggatatataacatatgacagagcttgcagtgtaaaacagtggggaaaattagaggctgtgcattagatgacactgagataattagttaaccatatggaaaaaaggggaaacaaatatatattttgctctaaacacaaaaattaattccagatatataaagatttacatatgaaaggcaaatgtctcagttgttcaggcctctatgacaaaaataccatagactgggtggcttaaataacaaccacttatttctcatagttctagaggtaggggaagtctgagctcagggtgcacagtcagtttcagatgaatgttctcttctgggttgcagactgctaacttctcattgtgtcttcacatggtggaagagacaagggagctctttggggtctctgtcataagggcacaaatcccattcagtagtgctctgatctcatgacctaatcacctcccaaaggccccacctccaaataccatcacactgaggattaggttttaacatgtgaattttaggagggacacaagcattcagtctatagcagctaaactgaaaaatatttagtcaataatatagattatctttgtaatctcaagacaaggtaggacttattaaactagaccaagagtccaaaacataaagattgatacgtttagctactttagaatgaaaaaacaaatgcttctctcttctcaaaagatgacataaagagagagaaacaacaagccagaaactccaagaagatgtttgtaacacatataaccaacaaggaattagtgtccagaatatacaaaaaacaaatatttcccataaatctgaaaccaacccatttgtcccataggactgattatgtttttttttcttttaataaacatagaaatttaccctacaagtcttaaaacttgagaaacttacatttgtcttatctgagttcctttctcaggaaattgacgatcagggctccctggtagtatcaggaaactgaaacttacctttcactgcatctgctaagacaccagacccctcacccttcatgactgcctaactgaccccaggctgcctgttgaccaactcctcttcctttcccctccctaattcctgttttcccatatgtagttacctttcttccctgctctataaacccttaattttaatctgttgaaaagaggagacagagttaagactgatctccaatctcctcggttgcaacacctgaataaagccttcttccctcacaatacttgttgtctcagtgattggcttactgtgcagtgagcaacctagaccaaacccttggcattttggtaacaaatccaaaagaaaactaaaaatagccaatagaagaaagtataaaaaacataaaagacactatacagaaagagaaatacaactggccaaaaaaaaaaaaaaggaaaaaagaaagaaaagaaaaatgctcagcttcattaataattaggaaaatgcacattaaaaccaaatgcgataacatttcacacacatcaaaatggcaaaaagtcaaaagtctgacaattccaagtgaagttgcagatgtggtttaatgggaatttcatctgccactaaagggaatgtagattatacaacccctgggaaatagtctcccctcacaaagtaacactatatatactgcaaccacattctaagactcagaaatttcattactagttacatattctaaaaagtcttgcaggtatgtgccagggtacatgtatgagaatgttcatagcatcattggtcataacagcaaaactatgaagacaaaccaagttctaagaatagtaaaatggagaagaaaaaaacatgggactttcaaatttggaataccacacagcagtgaaaatgaacaagccaaagctatatgcatcaagatggtgaatctcaaaaataaagacaagtcacagaagaacacatacattacaattccacgtatacaaagtttaaaaataggcaaaactagacaatatcctgtttagggatacatacatgtatcaaggaagtataaagaaaagctaggccttggcctctccctctccctctccccctttcccttggatctccctctgttgcagaggctggactgtactgccgtgatctcagcttgctgcaacctccctgccttgggctcccgtgattctcctgccttgacctgccgagtgcctgggattgcaggcatgcgctgcaatgcctgactggtttttgtatttttggtggagacggagtttcgccgtgttgaccgggctggtctccagctcttgacctcgagtgatctgcccgccttggcctcccgaggtgctgggattgcagacggagtctcgctcactcagtgctcaatgttgcccaggctggagtgcagtggcatgatctcagctcgctacaacctccacctcccagccgcctgccttggcctccgaaagtgctaagattacagcctctgcctggctgccaccccatctaggaagtggggagctcctctgcccggccaccccgtctgggatgtgaggagcgcctctgcccggccgccactccgtctgggaactgaggagcgcctctgcccagccgccccatctgagaagtgaggagcgcctctgcctggcagctgccccgtctgggaagtgaggagcatctctgcctggccgcccatcgtctgggatgtgaggagcgcctctgcccacccgccccgtctgggaagtgaggagcgcctctgcccggctgccccgtctgggaggtgtacccaacagctccgaagagacagcgaccatcgagaatgggccatgatgacaatggcagttttgtggaaaagaaaagggggaaatgtggggaaaagaaagagagatcagattgttactatgtctgtgtagaaagaagtagacacaggagactccattttgttctgtactgagaaaaattcttctgccttgggatgctgttaatctataaccttacccccggccccgcgctctctgaaacatgtgctgtgtccactcagggttaaatggattaaggtcggtgcaagatgtgctgttaaacagatgcttgaaggcagcatgctcgttaagagtcatcaccactccctaatctcaagtacccagggacacaaacactgtggaaggctgcagggacctctgcctaggaaagccagagacctttgttcacgtgtttatctgctgaccttctctccactattatcctatgaccctgccacatccccctttccgagaaacacccaagaatgatcaataaacactaaaaaataaaaaataaataaataaataaataaaaagaaaagctaggatggccggtgtggtggcttgtctttaatcctagaactatgggaggttgaggcagtaggattgcttgaggccaggagtttgagacaagcctgggcgacatagctagacaccatctctacaaaaataataataagaagaaaagttcactgggaccgggcgcggtggctcacacctgtaataccagcactttgggaggctgaggtaagtggatcacctgaggtcaggagttcaagactagcctggccaacatggtgaaaccccgtctcaactaaaaatacaaaaatattagctgggcgtggtggcgggcacctgtaatcccagctaccttgggaggctgaggcaggagaattgtttgaacctggaagacggaggctacagtgagcagagatcacgccattgcactccagcctgggtgacaagagcggaattctgtctcaaaaaaaaaaaaaaaagaaaaaaggaaagaaaaagaagtgaaaccaaacgaaaagaaaagctcactaggtgtggtggtatgagcctgtagctgaggtgggaagatcccttgggctcgggagttcacatgctgcagtgagctataattgtgccactgcactccagcctggatgactgactgaaacctaatctcttaaaaataaaaataaaagctgggtgcggtggctcacgcctgtaatcccagcactttgggaggctgatggggcggatcacgaagtcaggagattgagaccatcctggctaacacggtgaaaccctgtctctactaaaaatacaaaaaaatttgctgggagtggtggcacgtgcctgtagtcccagctactcaggaggctgaggcaggagaatcgcttgaacccaggaggcggaggttgcagtgagccgagattgcgccactgcactccagcctgggtgacagagcgagattctgtctcaaaaaataaaaataaaaataaaagctagggaatgattatcacaaaaaaatgcagctctagcaaagagagagggagagtgatctattggttaggagcacataataaaagatattggaaatattcgattgcttagagtgacagatgattacataacatcctttattatctcatcaatactttaaaatgtgtatatggattatatgtacacttttgaatatatatttcacagtttttgattaaagaaggagagaaaaggaaacagagggcaggtacagacaatattttctaattttgctgtaaatgtggagcaggaaaataggagagtacctgaagcaaaaaccttttaaaaacttatgttactggccaggcgcagtggctcacgcctgtaatcccagcactttgggaggccgaggtggggcggggaggggggtggtggatcacctgaggacaggagttcaagaccagcctggccaacatggtgaaaccccgtctctactaaaaatacaaaattagccgggagtggtggtggggggcgcctgcaatcccagctactggggaggctgaagcaggagaatcacttgaaacccagaggcggaggttgcagtgagctgagatcgtgccattgctttccagcctgggtaacaagagcaaaactctacaaaacaaaaacaaaaacaaaaaaacttatggtatcaaggagtttgtcttgttttggtttttaaagcgatatattataacatgtttgtatgctcatgagaataattcagtgaaacggtaaaaaaaatttgctgaagcaggagagtagatatttatagatggttagtccatttttgagaaaacaagagaggatgggatctagccttgtcagggagagtagagacatcaaggtggttctgctatggcagaacttgctggaaacccactctctagggtgcaggcaaaagctgttcataccagagacactccagtataaaaccccttcaggaggggtgcctaaggaagctgctcactgctgggtgttgctgactgtgactgaagtaactggacactaggtaagttttgggtgctgcaggagcaggtgctgctaaaccatgcactcactgcaggaacctggcaaacagcacaccagaacctggaagcaaaatcgtttttccctgcaatgactctccagtgccctctactgacaaagcttcagggccagatggcaaagaaaacataattaaaagattcaggatcatttttggagctgagaggcagtaaatccataactcacaaactggggaatggagggatcaggctgacaatacctgaatcttccatcaaatctaccatcactaatagtgggatgagatcatatacctctaaatgtgataccataggtacacagcactgcttttgaagtattctccttaaaaaattgaacccagccgggagcggtggcttacgcctgcaatcccagcactttgggaggccgaaacgggcgagtcacctgaggtcaggagtttgagaccagcctggtccaacattgtgaaaccccgtttctactaaaaatacaaaaattagcctggcatagcggcgggcacctgtaatcttagctactcaggagactgaggcaggagaatcacttgaacccaggaggcagaggttgcagtgacccgagatcgtgccactgcactccagcctggatgacagcgagactccatctcaaaaacaaacaaacaaaaaccccaaatctgataaagccttttaagtaaataaaaataaaagctaaggaatgattatcacagaaatgcagagtgatgcttacctctatagcagagagagacggactagtagtatctgggttagggacatatggtgaaagatattgaaaatgtttgattgcttagaatgagagatgactacatagcatcctttattatcttatgaatcttatctaagatacacaggaaatagaggaacaagttaattgataccatgaggaagcaatcaaccaaatccagtactgggaacattctatgggataaatgaactggcttctccagcaaattaatggaatgaaaataagggaagggtagattgttataataagattaagagacataataataaaatgcaatgtattgccaaaatataatttttaaaagtcaatgacagtatcctatacaaagtgagcatgtatcaaagatgtactaacaagagactagtaaaaaaagaactagttcaaagagaatttggaagattgaatatacatacactggacatacatcttctatacctccactgaacaaaattcattgacattgctattgaccaagaatcatttccattgatatcacttttctacaagttaatgtctacccctaaggagtactctaaataccctaaaatactaaatcaaagttaaactaccctagagaattagataatttttacgtaggcctattagaaaatgctacagtgtcggccgggcgcgttgtatcaagcctgtaatcccagcactttgggaggccaaggcaggaggattgcttgggtccagaagtttgagaccagcctgggcaacatggccagaccttgtctgtacaaaaaatacaaaaattagccgggcatggtggcacacatctgtcccagctactcaggaggctgaggtgggagaattgcattagctcaggaggtcgaggctgtagtgagccatgattgcaccattgcactctagcctgggtgacagagtgagaccctgtttcaaaaaaaaaaaaaaaatttttttttaagttgaatttgtcattatatattatacaatatattttcactaacttttgagctaatagacatttaaaagtcaccaaatttggaatacaaagtattttaaatgacatcccaagtcatataagagattggttcagcctacgctttctgttcaaaacccagtagttaatgctattagcattcaaaatgcctttttttccttttaaaaaggacagttaaacctgttattttttatcctgcagccagttcttagcacaaaagcaggcagattttagtagcacaaaattatttattagcttatgcctctaccagaaaacagaaatgttggcttaaaattgtttcattgatgtaacttttaccttttcctttacagatattcatttattcattctggccctaataccaaggtatccttcacacaaaagattcaaacagattctttgcatctttaccaatgggagtttcatgttttcaagtttttgtttgtttgtttgtttgttttttgtttggaggcctctttccaagcactctagtattcttaaaatcctgagattctgaatggtatgatttagctcaatatgtttatactaaacttaggggaaaaaaactaatatattttccttacccatcacaaggtttatgctgagacttcaataacaaaaaacagactaacaagagaaaagcatgcacatttattttatccaagttttacatgacatgggaactttcagaaacgaaaacccaaagaaatggggacatttgtgtagttgtatagacagtcaggcagatgtatgattgcaaggacaaaagtgtatgagctaacggtgataaactgagaagttggaaaggcctgtctattcagtttcttcttggcatacctgtgtggcagtccctccctcagggcataggagaggatgcctgttatataaggggcctcagatgaaggagggagaaggagggagcaggtcagagagtgaccttcctagattttgtggcctgcttcagggaagaaggggcgaggggaactctagtttctatggcctgcttcagggcagaaaggagcaagaggtcagagaaaccttcctgtttctgctattttctcaatttccaaggtgccatattttggggtggcatttcctgtaccctgtcatatacaaactcatttttagacagcggcctttagttcctcctgaggttaaaccagagctgctcaaggaatatacctactaaatcttcttgctccatttaagatatttatttcaaatgcaaataattataccataccctttggcctagtcagcactgattcactatttcaaagctttacatttaagcctcataataaccgtacgaagcagatctagctacttccatgttacagaagaagaacctgtggcacacagaggttgagcagctgccccaaagcctcacagaatgtggcagactggagaattcaacgcagaactcttacccagccccatatgctgccttggcctccatctggtatgaccacagaaatggagagctggaggaaggaatttcaactctgcttcagaaccttaaatgaagcaggaagctgtagaggggcacaaagctacaaagctgctccaaagctgtctcctccaacacaaagcagaaattgtgttcccagcatccatttctgttacccttacttggacttgagaagctgtatcaatcaagatgtagtgtggtgggagagggactcagtgcatgactgatacccagccaagcagggccaggcagctttagaaatgcccacactggggaattgaacaatgagaacacatggacacaagaaggggaacatcacacaccaggggctgttgtggggtggggggaggggggagggatagctttaggagagatatacctaatgctaaatgataacaaacctgcacgttgtgaacatgtaccctaaaacttaaagtgtaataataataaaatttttttacaaaaagaaaaagaaatgcccacactgagctcatttcatttaacaaacatttatttacatggaagccatgtgcatggaagacaggtgttgtctcaactctcttggggcgtacactgagggggaggaagatcgaaaataaacacattgacaaagaaatgaacaaggtgctttcaaatggcaacaaatgcatgaagaaagggaaacagaataatgcatgatggggaactggtttcaactgggtgagggaggaagacctttctgagatgtagacatgactgacaagaagcgggcagccatgcaaggggctggggcagggagtttcaagaccaggtgtaaggtgaaagcacagggaccgagggagaagtggcatgagggaggtcagagagttaagcagagctgtcatgtcaggagccccagcccctgcaagagtcttccatgcccctctaagtgtgctgagaggatagagaattttaagtggggtggtggatttgtggctggagtctgcccagaatggtctgtgaataggccaaagacctcaggacagggagaaaacgcttagtggcacagcattattttttattttattattattttttgagacggagtctcgctccgtccccaggctggagtgcagtggggcgatctcggctcactgcaacctccgcctcccgggttcaagcgattctcttgcctcagcctcctgagtagctgggactacaggtgcgcgctaccacgcccggctaatttttgtatttttagtagagacggggtttcaccatgttggccaggatggtctcgatctcttgacctcgtgatccgcccacctcggcctcccaaagtgctgagattacaggcgtgagccaccgcgctcggcggcagagcattatttaaggagcatgttaaacacactttcttcccacaccaccaactaaaaaagcaggtatcaagagggtctaggtaggtgctgagaccacctccagagcacaggcccgccagagttgtgctcagcaggtgaggtctacactcctctcagcccggaggggcagcgtgagttatactgctggacaaaggggaaaaagacaaaatgctgggctggggtagaagggaaggacgcgggtgttaaatgtgggcgtggtttcttctgaatgtcccacccactccactatacattgcttaaatgcagtgcaaatttccctacccccagcggaggaggggtgaagattcagcaggttttagggtctaggaccctgagctcctccattcatgaatacccaaacaactgtagcccaccctctcaccactgcctaggcggacgaccagtgtccccagctagatctctacccttaggagcagggcactggctgacccggagaacctgcgccgcctcttctcagcctgctgccagcccagtgcacgagctgaatgccgctgccgcctggctggccgggaaagacggggatcttgacgcggcggcgcctgggacacggcaaccgcagcacagggcatggccctgcggctggaccggacgcggcggctgcaggcagagcaggaagagagcgcaggctgggcagcggcgtacgcttcggcgacgtcagcttccggggccgtggacgggggcgcgcccgagcctcctggaaacctccccaccaaggacctggggaacccaagtctcggcccgctttgtagcctctggtttctaaattcagcgtcgaggagcgaaaacaacccccctgaactgggcccagacccttaagctcctggaacctcagtttttccttccgtcgaatggcgacaatggctgtctggttgaacgttattttacctaggaagtaataattttcgtaaataggtctctgagagtatttgcttgctaaaatcctgctttgtcctggaagcaaatttaggccacgttaggggcggggacttcgtatttaatgttgagcacctggcgagcgccaccttcgcctcaaagcgccctcggaccctggatccagcataaggccagagttgggcagtgaggggtctcgagaggtggaaaggggattattgccctctcaagagtcctacgtaggtgactcctaagccttagcatttactcccttagaccgtgtaacaggccaccccaattacgcgccaaactcaggctgcggctcttggcgcagcctcggtcccgcctgatttcagtttccatttcgctgcccctggtgccccaccgcccgcggctgtctggggatttgcccggtgatcagtgacgtaaaagagactaaggttcccattggacggcgaagttcggcaggagccaatcccggggctggtccgggagaaatctcggcgaagggccccgaatagccgggagattacggggcggggacgagctgtcgcgctggttgctcgtgcaggagcgggacccggaacagaccgccgtgagagaggaggggcgccggccgggattcgcggcccggagctcgggaccggtgagtagggggtgcacatgagacatacagcgaagcaacagtctcgtacgctcaccgggtttggggcgacccaacgcagccgccgggcccgggttcaaaacggggccaggcccccgggcgggctcaggagggggtcaagttcgctgcgtcctccctgccagccagatccctcctgtttgcttgtccttacattctccccctcctcttgggtctttctcgctttctggtatcctactcagactcccatccattctagtctgcggaaccagaagtaagcggggcctggatgaccgtccggttgcttggagcctggtagataggcgactaatccagctccctgaccaaagtgtcatgctttctttctctttctttctttttttttttttgttcggagtaaaccggtttagccacaaatacttggagctgtgctttcactccttccagctcattagcatttttcttactgattttctccctatttggccttagaaaaaaagtgtaaatttaactctgtggagtaaatgggagggacacacttccaaatctccagtagatttcaaattttgacccacgatttgtgtgtacttcaaaagaggggagaatgacattcgtttatgcatgccttaacctcctgtttttaactcttagctgaaatcataatccctaacatgtttttccccaagttcaaaaaaatcacctttaaaaaaaataggctttttatgtttcaaaaattgcaattttattgtttaagtagactttatttcttacaacacttttagatttacagaagaattgagaagatagtacaaacttcccacatgctccaaaccgggtcccctgttattaacatcttacctcagtgtggtacatttgttgcagttaaccaatatcaatacattattattgaccaaagtccatagtgtgttcagatttccttagtttttacctcagtactttttctgtttcatgatcccatggaggttaccacattacatttagttgtcatgtctccttatgctcctcttggctgtgggagtttctcagacttgttttgatgaccttgacagcattgaagaatactggtcgtgtatgttgtaggatgcccctctattggaatttgatgtttttctcctaagactgggcttatgggtaactgggaggaagaccacagaggtagattgccattatcatcccatcgtatcaagggcatgtactaacatgatttatgacttaatattgatttgggtgagatagtgtttttcaggtttctccactgtacagttagtctcttttccactctttgcgtgtattgtcctctttagaaggaagtcactaagtgcagcccatacctagggagccaagagttatattcccccttcttgagggcaagtatctacatattattgtttgcagttattctgcatggaagatttgtttctctcttctccccaatttattaatttattcaatcattaatttcagtgtagactcagggacatttattttatactttggtttataatccaatactacttaattttgttgctcaaattactgtggctttggctgttgggagctcttttcacattggctcctgtgctctttcatagtatttttatagagctttttgctaatgagacactcgtacttatgtgactttgcctcaacctcaaatagcctggtaaacttggcaaaatattttccccttgttaagaggtaaggagactgaaggcctaaggcagtgggtgacttcttagatatcacttcctgcaggggagtaacaggttggactcagattgtgtgtgaccaccacagaagacactgcaaacccccgaagagagtccatggtctgtattgaggcttcttggaatgacttcagacttggacccccccaggatcagaatagaaaagacacggagaatgggaagttggtttgagaagacaaaaacataaattggctggcatcaggatgaattagattttgccagctttatagaaatggaattttgttcttccccccaaaattgtgtgtgtgtggagggaggccaagagagatctaggtaatgtgtgtgggcaagaatgtctaatctaaagagagccctggaagcctgctgctgaagcagaattttaatgtgggaaaggggggtgtgtagtgaaagggggaagaatggagatggcagggctctggaattagaggaggtcattcatttcacaaacatttgcagaccccctactttgtgccagatattggagataaaaaggtcagtgaggcatgacctttgggttcacattctggtgggagagaagacagataaaaatatcaattacagccacttatccatagcttagttttccgtggtttccgttacccatggtcaacctcagcccaaagacagtaaacagaaaattccagaagtaaacaattcataagttttagatgtgcattgttctgagtagcatgatgaaatctcttgccctcccactgttccttcatcacaagaagggtaagtacagtacaagatagtttgagagagagagagaccacatgcatataacttttattacggtatattgttatagttattctgttgtgttattattgttaatctatttctgtgcctactttataaactttattacaagtgtgtatgtgtaggagaaacaggtttcagacatccactgggggttttggaatgcatctcctgaggattgaggggactcctgtatgaatgtatctttagcggatggggggtgctactgtatgaagcactgtgatagtgctattgtagaaatacagtatatgcaaagctgcaggaggagggatacattcaactcagaggtgggatgggtacaggaaacacctcacagataaggggacaaattgtattcaagccttcaaggatgcgctggactggagagaagagcatgtacaagggaatgggtggagagtggggagtgaagaaggggctgtcttcctggttcagtgtatctaatggccagagaattaggtaggacgaggagggatttggggctggatgggtaagttggggctagccggatgcagggcaggggaggatgtctgtgcagtttttttttttgttttgagtcagagtctcgctctgtcacccaggctggagtgcagtggcgtgatctcagctcactgcaacgtccgcctcctgggttcaagcgattctcctgcctcagcctcccgagtagctaggactgcaggcgcgtgccaccatgcccggctaatttttgtatttttagtagaggctgggtttcaccatgttggccaggatggtctcgatctcttgacctcatgatctgcccacctcggcctcccaaagtgctgggattacaggcgtgaggcaccgtgcccggccacctgtgcagttttgacctcagctagtaggagtttttttggtgtgtttgtttttatttttatttttatttttatttatttattttattttagagacagtctctccctatgttggccaggctagtcttgaacccctggattcaagggatcctcctgcctcagcctcccacagtgctaggattataggcatgaggcaccaaacccagcctcagctaggagatttgaagcaggagaataacaaggatgagatcctgtgtgctagaaggatgatcctggcagcactttttaggaaatatgccacatctcaccaaatctaagatgctatttgtcttaatccattttctgttgctgtaacagaataccacagactgggtaaattgtaaacaacagatgtttattcagctcacggttctggccaatggactcttgcaagaaaggcattaatccattcatgagagttacaccctcatgacccagtcacgtcttaaagaccccacctcttaataccgttacattggcaattacgtttccaacacgtgaacttttgggggacatgttcaaaccacagcaccaccaaatcttttatgtgcccttattttatgctccacatcaaaaaaatattttgccagttaaattatgacatgcaattgatcacatttcagagatgctaaaatgtgatgtcacaggtgtctcaaatttgatgaaaagcactaactcccttgctgatggcttagattcctccctttccctggattaatggttaggatgtctccatctcactaactcatagatggtaagttaccaagggaaagaagaacagaagctgggtgggcccttccccttctctccccaaagataaacatttacaacatttactggttgggtcgaggagcacaatatctggtctgctgctataggattccttggcctgttattgggcctgtctcatgctgtttccttttggggagttaaatacacacacacacacacacacacacacacacacacacacacacacacagatattctatatcccatcctccagagtggcaaaaattaaagctgatattatcaggtgttggtgaggctgtggggcatcatgagtgctcatagcctgctgagcagactacatagcactatagtcactttggaaacagtttggcctgcttagtcaaattgagggtacatcttgcctgtgtgtgctagaacatgtatgcagaaatattcactgaagcagtgtttgtaattgtcccaaactggaaacaactcatatggctatcagtagactgcattaaaaattgtatagttagagagcagcaattaagtaaaatcagctcataatcacatggatgagcctcacaaacatgttgacagccccccacccaaatacatgcaaaaaaaaaaaaaaaaaggaaaaaaattccattcatttgaggctcaaaacctgagaaaataaactctgtttatggggtgtatacctaggtctaaaactaaagaaaagggaaggagtgattctcactattacaatttactccacaacaaccattttctcagacacagctttttcttctcctggtttctgtaagttgctggagcgaaaccttggatacgatgatttgctggtgacgtgcagcccactgttcttgctgctacagggaatatgaagaaattgcttctctctctaccaatttactaccatcttgctggagagaaagggcaggtggctaagattgttcgcattccttcagcagatgtgtaggaagcatcttctttgtgtcagatactctgtgcttgtgctttgttttctcagtcagtttttattgtctactctgtgccaagtaatatgtagattctggggataagacagacacaatctctctccttgtttcatggaaaaagctggtgttaagcgagtaattacactaataagtcaggacttaaaactgcagagaagtacagggtgcagcatggggtgttttggggctgtataactagactacatgtggacccaatctgacaggtcaggaaagaattgccagaggaggtggctttcagctgagacttcaagctagaaaaggcatttgctaagtgggaaagggatggtgttctaggcagaaggaattacattgtcgaagggcttagccaggaaagagcatagcactttgaggcatggagagcggtttggtttggctgtgagtttgaggtggggagtggcaggaaatgagcctggagacacaggctgggccatgattatctgggaatccagctaggatctcctgggacagcctcctcacagaagaaaggaaggacaggagttttgactttattcctggagcaccagaaagccattgaggggtttaacctggttggtcacccgggcagattggcagtttaacacgtgaccgagtgtgtttgaggatcaaaaggccagagtggctgcagcactggggcagcaaaggggagaggaggtttatgtaaatcaggaaacccttgagggtttgatgatcccacagttggatctgatttcagcttctaaaggattcctcaggtcactggatgtaagttctggtaggacagggagtttgccacttttgttctctgctgtaacctcggtgcctgacacatagtcggcacctaataaacatctgctagctgttgaataactttcaacatcctgctgcttaaaccctcaatggcttcccagggctgttaggataaagtccaaaattcttaacctgggtcacagtcttgcataatctgttccctcctgtttctccacccttcctctgctcgcctcactgcactccacctgtggccaattgtcagctcctcaaattcaccgctaccctttctccggcggatgatttcctctgcctgtgaggctaaccctccacagcactccatatgggcagggaagagttcattttccaggcaccaaagtgcagtgtatggtggaatggaaggagcccagagctgggaggtgcacctcaccccacctcgtgctagtgctggccttgctgccagccagctctgctgctgggcaaatgagtccgaggctctggcactcactgtcctcctctgtaaataaggggttctagtgattcacagtcctggatagactttagaatctcctgggaagtttgttttttaataccagagcctgggccacctctggagatcctaagtcagttggtctaggtatgttttgaagactcaccagtttgaagactacaaatctgatgtgtagtcaaggtttgaaccattccacaagatgataaaggattccttcctatatttggtgcaaagcaccaagtgacacttaggaatattttagacaagagagcttggttcatgattcaacattagacagatattctggcacaaatatgaagaaccctcaattttcccctgtgggtcagccacaagaccagggcaatttaacgccttgtctcatccacctcccagctggctgctacctcctgcccctctttgagccctgtggggatttctagcgttcagagccctggtagtttttgtggcctgcactgtgcttcagagcaccactgatgctcggctccgtggggaaagtaagccaagtgtgaccacaagaacgcatcatccacagtcactgggatctcctgggacagcctgggatccaggcctttggcctggccagtaggggtgcagtcactcctagtatgcacatccagatcacttgctttttgccccgaattctggcctctccaggtttgttagaggtgtctcacggaagtttaccccatggagagtttgcttatctcagattaaaatatggggattaatctgggacccaggagcccttaaatggagtacccacagggaatggagctctaggctaagtgctttgggattacaggtgctttgctcttgtttggaggtccagacatatgcttgagaagcagcttgggatactcaagagaggcctgaactggtaccctggaggccaggatgaaaacccaggcctctccatttactttcttgggccccagagtccacatttgggattcactgtctaccagggcacctctctgggtggcatctaggagccggaggcaggccagagtttcacccaggctggagtgcagtggcgcagtcatggctgtctgcagcctcaacttcccgggctcgggagatcctcctgcctcaacttcctaagtagctggaactataggcatgtgccatcgcacccagctaattcagctaatttctttttttggagacaatgtctcactatattacccaggctggtctcaaactcctgggctcaggcagtcctcctgccttagcctcccacagtgctggaattacaggcacaagcccccgtgcccggctttcagctagtttttgtagctcatagtgattattcttggagccaataatcgtgcatgcatccacatcttgaaattacatggtgtcaccttgaccagtctgttgacatatgcagattaggtatttatgagatccagagacttataggggaggggtggatttcagggaaaagggaacctcttagagaaaggtagggagtgtctgcagttctgcctgtgaggagggtaccaggacattgcagggcttgtttgttgcatcttcctggttctatagaattgcagctagcttctggtttattttttcatttttattttttgagatggagttttgctcttgttgcccaggctggagtgcaattggcgtgatctcagctcactgcaacctccgcctcctgggttcaagcgattctcctgcctcagcctgcccagtagctgggattataggcatgcgccaccacacctggctaattttgtattgttagtagagatggggtttctccttgttggtcaggctggtctcaaactcccgatctcaggtgatccacccgcctctgcctcccagagtgctaggattacaggcagaagccaccgcgcccggccgcttctggtttattgaagagacagaaaaataccccctcacccccagcagggatgtgtgacctctggtgcaagggagttcatgaagtgacttcttcaggttcagaattctcatctgagtaaagggagtgggggtggagtgggtcatctctgaggttttttttttttggctctgattttggtttctgtctgcccaggagtcaggaatggagagaagggtaatggttttacctcttattgtggaaacctgttgagatcacagagaatatactgacggcataaaagggcagaaccatagcagggtgcggtaagttggggaagagtttttggagagggtgaattttgcattggacctgacagaattgtgtatggggaaggggagcggttattctggtctgctcacatctctcatactcaacctcatttctcctaattctgaaatcttgagatcctctatcactaagaaggaaaactactgtccaacagggacactttattgctcaccccatatgtgaaagtttgtcatagctaaggctagggtgcttttggtcagtatcagcagaatatatgccccctttcttttgtcagcattactccgcttacaaagcccttccatgtagatgacctcatctgagcttcctaacaaaggagctggtattagaccccattttacagtgtgcctgggtagggaagagagtgtagtggattgagcagaggccttggcaccagacactgcttcctagccatgtgctcttgggcaagttgcttaaccctgctgagcctcagtttcctcagaaggagtctgtataagcaagggaagggattggtcatagaagtggtactgtgtttcatttatctagttatggcagactctcaaaaacaaatggttctatacaactaacattgtctgcaattcccctgaatccattcacttgttcagtaaatgtgtattgagcttctacaaggtgtcaagcaccatgatctctgtatcagtgatttaaccatttttgatggttactacagacctctttaagaatgtgatagaaaactgtagctccctccccagaaaacttttctagctttttattttgctttgcagtgagccaagatagttccactgcactcgggggacagagtaagaccctgtctcaaaaaaaaaaaaaagaaaggaaccatttcaaattaggtgggagacatggagctctaaatactacagcatccattgcctagaaatacaggtattctcagccgggcgcggtggctcacacctgtaatcccagcactttgggaagccaaggcaggtggatcacctgaggtcaggaatttgagaccagcctggccaacctggtgaaaccccgtctctactaaaaatacaaaaaattagccggatgtggtggtgggcacctgtaatcccagctactagggaggctgaggcaggagaatcgcttgaacctggcaagcgaaggttgtagtgagccagattgcgccattgcactccagcctgggcaacaagagaaaaactccatctcaaaaataaataaatatattaataaataaataagaagtataggcattctcatacataacctcagtaaataccattaagaaaataattttagacatggtgcagttgctcatgcctataatcccagcactttgggaggctgaggtgggaggatggcttgagcctaggagtttgagaccagcctgggcaatatagtggcaactcttctctacaaaaacctttaaaaattagccaagtgtggtagtatgcacctgttgttgcagcaactcgggagcctgagatgagaagattgcttgagccagggaggccgaggttgcagtgagcccagatagttccactgcactctgggggacagagtaagaccctgtctcaaaaaaaaaaaaaaaaaaagaaagagaggaaataattttttaatatgatctaacacccagcctacttacaaatttcccacaatagttccaagactatttttataaccttttttttctttttacaggatccaatcaaggttcacgtattgcatttggttattatttctctttagtctgtaaaaatcaaaagcagttctttcgaaggtttttttttatgacattgactttttaaaagactaggccagttgccatgtgcaatgtccagcattctggatttatctggttctttccttatggtgtggtttaattcctccatcggtactttttcagttataacatacttcagagtattcctttcctttatattttttataaactggaagttagatctaaagtcttgactagattcattcaagtcaaacatttttggcacaaacacttcataggtaatgttgtgtgattcatatagtgccatgccagaaagcacatgccactttgccccgtctgctgatgacgctggatttggtcacttagttaagataaccactggatctcttccttacgaaggtatgtcaggaagtaatccattcattggtgctttggcaccatgggtactatctcatcccccaaaacttttcacctaatagttttagcatctattgatgatccttgtgctattataatggcagtcgcaaaatgattttctaattctgttatccctcttctacttatttgctgattaatcttacagaaggttattcttctgtaatccccagacaattttaggtatctagtacatatgcaataatttttagacagtttcaggaggtttagagaccatcaaaccccagcatggagcctgggtgatgaggtgtcctgttttgcatggaagaagagctgtagctgagctcttcatagtccttttattgttcttattttgcaagtaaattgcaaaataagttcccaacccaaagataacacaggctatccttcaacaaagaaaaacctcagcttttaaacttctaggccatttggcaaagaggcatgataaagggcttgaaagcccacagacacgcccagtaccactcctttttcctctttccaaacacttgcagtatgttacaactgaaaaactgctgagccaggcttatttcctcaacagtaaagccaaggagttggaccaggcaattcctagcatttctttctttttttttttttgagatggagtctcactctgtcacccaggctggagtgcaatggcacgatctcggctcactgcaacctctgcctcccgggttgaggtgattgattctcctgcctcagcctcctgagtagctgggactacaggtgcatgctaccacacctggataatttttgtatttttagtagagatggggtttcaccgtgttagccaggatggtctcaatctcctgacattgtgattcacctgcctcggcctcccaaagtgttgggattacaggtgtgagccaccgtgcccggccaattcctagcatttctaccagcattactaacatgtaggaacttgatattactttcacttgacagttaaattccttgaatccttcatttgagctttgaaggtgcttgattttcccctcattatgtctcttaaagtcacacatacctagatccattagtgcttccagttggaatttattatcagcactataagaatctcttatatttatgtagtccttttacgttataaaacactttttatgtattattgtactagaccctcaatgagtggacgttatatccctgttttgtttactcttgggtcttatagactgggggttttatttctgtcccattaatgtcactactgacagaggccactgaactctgttgtgatggactttcaccatacataatcattaatagtattgatttgcctgtaattcaggttgcttcattccagcctcgcagtcacctctgtgccctgctggttgtcttcccagcgctgctgtagttgccttccatggatctataggagagcaagtcctccaggtactgccctgtgacgatgttgttgaactctgtagcacgtgtgtcactgtggctggttctgctcacttcctcttttgctgccacttttgaatttaactctttgtttgtggtttggacactcactggatttggaaaccaggggttgtgggttctctcctagatttccgtctgtgtaccaggcttgtgcttagcacttttcccataattctttcacatgacctgcttagaaacccttaaaggtaagtatcactcttcccattttacagatggatacactgaggctcagtacttaagtgacttctgtattgtcacacagagtcaggggcaggaggctgctcttgggttagatgtgctgaggctcataacctcagcctggaactgggtcaggactacaaaggtaaacagaagcagagtcctttctgtgtgtccccgctccctgtacaagccaaggcctcacagcacatagcagccacagccacctgaggattcctgccatctagacgaggcagttacagccaagaacaagtccactgaggctaagctgtgctcctctggagggctgtgtttagagtccagccttctaggggaagcaaattaaacccaaactatagaacagcccagggaaatactcacaaagggaaatgctgacagtcagactcctgaagcttcctgatgcttctcgagttttggtaaagaacctcagtgctgtttgtttgtttgttttttaatgttttctggttttttgtttgttttgagacagtctcttattctgttgcccagtctggagtgtagtagtacaatcatggctcactgtagcctccacctcccagattcaagtaatccttctgccacagcctcctcagtagctgagactacagatgcatgctactacactggggtattttaaaaaatttttaaatttttttagttgagacagggtctcactatgttgctgaggctggtttcaaactcctcggttcaagtgatcctcctgcctcagccacccaaagtgttggatttacagggtgagccatgtcacattgccctctcttagttcttgaaacctgaaaccttgaggagcaaacaaaaggggtctcttggccaggtgcagtggctcacgcctgtaatcccagcactttgggaggccgaggcaggtggatcacgaggtcgggagatcaagaccatcctggctaacacggtgaaaccccgtctctactaaaaatacaaaaaattagccaggtgtggtggtgggtgcctgtagtcccagctactcgggaggctgaggcaggagaatggtgtgaacctgggaggcggaggttgcagtgagctgagatcacgccactgcactccagcctgggcgacagagtaagactccatctcaaaaaaaaaaaaaccaaaaaaaaaaaacgggcggtctcttgactctgtcaggacccccatgactgctcgtgtgtcttgtgctttgcacagttgagtgaaggagcactgtgtccacagtagacattgtagatttatatatgtatcattatgagtttcccagcaggtagtgagagattttttattacagttggtgcattacagcgattttccaacagatagaaggaaagggtgttgaggctctcccaacagcaaggtataggctagtggctgtcctgctcttcactctaccaagctaatctttctgggtttccatatccttatctgtacaatgaggaagttggactagatctataaggtcctcttctcgttgacattgtgtgaaccttgtaggagctggtggtgtctgtcgattgactgagtgctggagctggcagccctgtgcaggctgccacctttgcccctttactgtgcttgctcctgactctatgtcgcgtctccaaggagaagaagtcctcaccagtgaacggagacctctctgaactaagaataccatggccacgtcagccccactacggagcctggaagaggaggtgacctgctccatctgtcttgattacctgcgggaccctgtgaccattgactgtggccacgtcttctgccgcagctgcaccacagacgtccgccccatctcagggagccgccccgtctgcccactctgcaagaagccttttaagaaggagaacatccgacccgtgtggcaactggccagcctggtggagaacattgagcggctgaaggtggacaagggcaggcagccgggagaggtgacccgggagcagcaggatgcaaagttgtgcgagcgacaccgagagaagctgcactactactgtgaggacgacgggaagctgctgtgcgtgatgtgccgggagtcccgggagcacaggccccacacggccgtcctcatggagaaggccgcccagccccacagggtaagccctcttcacccccgagggtgccttgccaccttctctggatgctccaccttgcagtcctcagaggactcagcctgagtctcccttcctgccccagcccagagcatccacctgttgccactgcttgtttttccacaggaaaaaatcctgaaccacctgagtaccctaaggagggacagagacaaaattcagggcttccaggcaaagggagaagctgatatcctggccgcgctggtaagtgaggctgtttcaggaagccctgaggcggtgcgcccgtgtagggcagggtgagcctgggcaagtaggcggcagctgggaggtgtttctaggcgctgctcacagggaggatgggtgtcagcctggcagtagcagacctgggttttagcccaagtgctgtctttctgagccgtgtagtcttgggcctgtttcttgtctgagagacaagtgggctgcctggatgtcagctagagtcccttccgttttctgtgactgtcaccttgaaggcagggcccatgtccagctgctggttctcttctgccaggggactgaagaaggtgtggcttcattcttcctttcaaagagagagagagagacaaggttgcctgagagtggagagggtttagaaggagggagctggctccagggtaagaactgagagggaagggctagaaaacagctaaggcaggtctgccaattctgatggcactgtatgtagtgaggtccaggcccaggatcatggttgccagtacagtgggacctcctccatatctgtgggttccgtagcggcgaatttacccaaccatggatcagaaatattcagaaaaaagaaaaagcgtctctactgaacatgtacagattttttttcttgtcattattctctaaacaattcagtgtaacagctatttatatagcatttacattatattaggcattataagtaatctagtgataatttaaagtatatagtagattttatgtaactattattccattttacataagaacttgagcatccttggattttggtatccttggggagggagatcctggaacccatcacccactgataccaagggacaactgtagttagaaaacaggcagcacattatgtacttgattagagatggggttggggggaactgatcaaatggttctgattttctggggaactgtgtatgttgaggaagtgggcagtggaggagtagtggggtcagggccagtggtgagtcattaggcctagggagagggaaacagtaagctagagacagccaagtccaaggacccctccaggccctcagtgtgcatggctgcccccagctcagcaccagtcaacagggccactgaggactcccccaaccccagctggggaggagatttggaggcaggaaaggacatagtccctaagcacagacgtcacacaattttgctgaggaaacaggatgcagtcttacatggcaggggtggggtacatatagatattttagactgaacagtggggtgctgaagagagggctggtcaggcttagatgacattaatcaagcaaaacttcctggaagaggtgacagattttgtccaggagggaaaagtgcgtcggctcatgagtgagacccacagagtttctctaggggccccagagcgtactggtttagctagaacagattgtggctgaccagtcaggtggagacagggttttgaccatatagtggtggggtgaactgaactaattcattactggagtcttctttgagaagcggagtgtggaccaggaaccctctgtagctcctcccactccagatcctgtagaattcctgaacgggggtagcgaggtgaacgagccagccttgcacacctccagcactgggccctccaccctgagcagaggtgtcagcccttctccccttcctgccccctgcagaagaagctccaggaccagaggcagtacattgtggctgagtttgagcagggtcatcagttcctgagggagcgggaggaacacctgctggaacagctggcgaagctggagcaggagctcacggagggcagggagaagttcaagagccggggcgtcggggagcttgcccggctggccctggtcatctccgaactggagggcaaggcgcagcagccagctgcagagctcatgcaggtgagaggccgtccctgggcagggcgccagggaccaggacggtgggtcccagccctgccattcacttgcaggaccttagaagacttgggggctcagttttgtcatctgaaacatggagatgataatccttactgctgccaattagtctgtagattgcatgagcataaaatgaaataactggcatgctgtcacttcaaaaaataaactttttacacaaaactgttcaaaaaactaaatggtatagtagaaaatggaagggaagattattaatatcatttaccatcctccatcctcatcactgccatcacaagccctcttaacaagtcattggcagacacttagcagctggtggaagctttttatggtgttgtggttgggggtggctgagggagggctgaccagcagctcctctcaaagacccagaggatctggaagagatagggtaactggggaagggagacagagatggccaggttttctttggcccatgggattaccacacagagaacaagatggaaagcagacaagggggcctcggggcacctcctagaggagggggctttgatagtgagaaagggagggtttggggctgaagaactggctgtgaagctgaaatggcaccacatctcctcccccccgggagcctctggggatcacacttaccctgaagagggcccagtcccctttggaggggtagagggctcaaccttcctgctctcataggctgggaggggaggggctctctgatggtattcccccacttgcactgtttagggtggctgggtctgtctgtcagcagcagagccacccaggatctctaggaaggtggagtcccaggctaatggcagggcaatagctaggagggagagatagcaaggcagactctgcagtatgtgcactgggacagactgcagaaggaggcggccacctgctcctcattgttgtgaattcagatgtacagaatgaggactggcagggattttagaccttccagttcagcccctactgatgaagtcactgaggtccagagagtgggaggagtttgtcccaggccatggggtgggtgtcaggtcacagcttgagcccagatgtcctgactcctgggctctgagctcttgttcttattttgtccagaatgtctctctggccccctcttttcctccagatgtcattctgttctctcagatttctctcgtcatactctttgactgggtcattttctgcatctccttttgcccgtttctcttctccttcctctcctcacgcccctgccatgtgtgaatgcctactgtgtggaacagaggcacacagctgaggatgtggtggggctgaaatccattgtgtttgcccggaggggtgccttttcctaatgcacccagagaagtggccctcagagcagaagcctggccctcaatgactcagagcactcagattgcagctctccctggggtgggataaggtcaagggaagggagagaaaatggtgtcagcttgaaactagtataggaaatgttattggtactggtaggtttctttttttgttttgtgttttctcttttaattttagtgctatataatgtatatatttatgggatgtagaggtttttgtttgtttatttttgagacagagtctcgctctgtctcccaggctggagtgcagtggcgtgatctcagctcactgtaatctccgcctcctgggttgaagcaattctcctgcctctgcaacctctgtctcctgggttcaagcgattctcctgcctcagcctcccaaatagctgggattacaggcgcacatcaccacacctggctattttctgtatttttggtagagtcagggtttcaccatgttggccaggctggtcttgaactcctgacctcaggtgatcgcctgcctcagcctcccacagtgctgggattacaggcgtgagccactgtgcctggcctagagtgatactttgatacaagtatataatatataataatcaactcagagtaattagtatatctgtcacctcaaacacttatcatttctttgtgttggaacattcaaaatcctctcttctagctttttgaaaatgtatagtaaattatagttaattatattctccctgcaatgctgcacaacactagaatttattcttcccatgtagctataactttgtatctgttaaccaacttctccccaccctcctctccccagcccccttcccaacctctaatcattactattctactgtcttacttccatgaactcaaatttattatggatgaatagtactccattgtgtatatatgctacattttctttatctatctgttgatggatgcttagattgagtccacatctcaactattgtgaatagtgccacaataaacatgagtgtgcaggtatccctttgatatactgattttcttttctttggataaatacctagtaatgagattgctggatcatatggtagttctatttttagttttttgagaaactctcatactgttttccgtaacggctatacttatatgtagaaaaacctaaaggccccaccaaaaaacccttagaactaataaacaaattcagtaaagttgcaggatacaaaatcaacataaaaagtctactgcatttttaatacaccaataacaaactagctaaaaaagacatcaagaaagcaaccccatttacaatagctacaaaagtaaaataaaatacctgggaatgaagttaaccaaggaggtgaaagacctctttaatgaaaactataaaacactgatgaaagaaattgaagaagacacaaacaaatggaaaaatattccatgcttgtggattagaattaatattgttaaaatgactgtcctacccaaagcagtctacagatttaatacaatccctgttatcaaaatacgaatgacattcttcagaaaaatagaaaaaaaactaaaattcatatggagtcacaaaaaaccccaaatggccaaagcaatcctaagcaaaaagaacaaaactggaggcctcacactatcttacttcaaaatatactacagccagttgtggtggctcacacctgtaatcccagcactttgtgaggccgaggcaggcggatcacgaggtcaggagtttgagaccagcctgaccaacatggtgaaaccccatctctactaaaaatacaaaaattagctgggcgtgatggtgcgcacctataatcccagctactcgggaggctgaggcaggagaatcacttgaatccaggaggcagaggttgcagtgagccgagattgtgccactgcattccagcctgggcaatagagtgagactccattaaaaaaaagaaaaaaaaaaaatatatatatatatatatacacacacacacacacacacatatatatatatacacacatatatatgtatatatatacatatatatgtatatatacatatatatatatactacaaagctgtagtaaccaaaacagcatgtattgatataaaagcagacacatagaccaatggaacagagtagagaactcagaaataaattcacatatttacagccaactgattttcaacaaaggaaccaagaacatacaatggggaagggacagtctctttaataaatggtgctaggaaaactgggtaaccaaccatacgcagaaaaatggtattggtagattttgtctgtgtgcttatttgagtttgattgtactgcgtgggaactggacagctacctccctaattagcattaatattttcccagagattatttggctgtcaaagtatagtaagaaaaagacctaaaatagggtccagaagtctgatagagaaatacaggtgaggctggtgtggtgattcacacctataattccagcactttgggaggctgaggcaggcagattgcttgaacccaggagtttgagaccagcctgggcaacatagtgagatcctgtctcaaaaaaattaaaataaaatagaaatacaggtgagagggagaagcagcaggacaaaatgtgtaaaatagaagagaccttttgatagaggtgataggaaaggaaagacaaacctatgggctgggagcatcaagaagacattaaagggattggggtgacaggagaggcccagagagacactgcatcctgccctggtaacccgggcaggccctgcaggatcaggtggcatgcttgtaccctgcttctcctgctgtacacccccgtgaagaactttcttgatgctctctgttagtaaccgggcacatcccctccgggagcttgccatgactcattgccgcagccccactgctcggctctgcctgtttcatgacagcttcagatgtcttgggtgagaagagtcctccaggagacttgggcggatcacttccctccagaggccctgtatgtggctgtggatgggggctcctgagtctttcagcctcttctccgcagggccagccctgccctggctctcgggacccaccctctctgggctgctcacaacctttaacctttagaggactcttctttctcctgtatgattctctccctttctactgttctaggaacttccatgtcaggaaatatgcccaaatgggcctctggcccacactccagctactgctccattcatttgctcttttatgccacctttgtcagcagagctgtcaggacacactgtctgttttgttgcctgtcctctgaagccgccttggacttacatgttttgaggggcatgttagaggacttggccagaaatgtgctaccagtctctgggcacttgcttcatagcggggggttgggatgtgcctctgacttcttgtcttattcctctggagtaaagctcacaactcttcccaaacttttggaagcagtcatcagcagccacaatttgttaattccatttgtttcccaaatctcaccctctccaggaagccagcctgcaccccaccggcccctgctcccatcccccttcactctgctctcttttcccgtggtgcgtatcactcacgtagtatgatgtatttgctacattgattattgtctgcttccccctgctagaatgtcagctctacagaagtagggatttgtctctctctctcttttttttttttttttttaactgttctgaggcttctagatgagtgcctggtacctaggaagcacttaataaatatttgtggaatgagtgaaaggaaggcaaaaatcaattaatacagggtattaaggaggcttttgactcacaaaagggaatctgagcatctcagaatagccctcttcccactcaccctgccctaccacctgtctgtcacagagatagcaccaccattctcccccctgtacaaaccatgctctgttcttgtttatccttgaccagtatgtccagttgaatctgtctctaaaatacctggaatgtattgcttctctctttttctccctactgccaccaccttagttcaggccatctttagctctcccctggtccacggcaaaagcctccggaccaacctccccatgttcctcttgcctccttagtcccttctctgtggggcagccaagtgagtggtcacttagggttttggctcactgctgtacagtgacgcaaacagaatagaagtttatttctgcctcagttaacagttcagaggtgcagggtctagagctatcacagtagctgtacataagcttatccaagggactgggttacttccatgtggttcttccaccagcttctagggatgttgtcctctgctgcgtggtcaaagttgggctcaccaccaccatgtccaaaattcagttggggtaaaaaggaagtagaaagcaattttctttttttaaaggacaatgcccagaattatggtcattgctttctatcacattccattggctggaacttagtctcatgaccagaccttgtcgtaggggatctggaaaatgtagtcttcccaggtggccgcctgaccagcaataactccgggggttctattattaaaaggaggaaggggagagtggactctggaggttacacagcagtctcagccacatgtagagcggatcacacatatcatgcccctacttgaaacccttggtgggtttccactgtacgtggagcaaaagtgaaactccttaccatgcatatccagccctgcgcagtctggcctctgccgttctcaccaagccctttcctgttttaccttacctctcttcatccggccagtacttcttatccgtcaattctctgcgcaggtatctcccagagaggttgcccatgtcatctcccagccattgtggcttctgtcattgtgccgattttgtttgttttcttgttgttttatgcagtgaccccactggaatgtcagctccataaaaaagggaccacatttgttttgttcactgatatgtcccatctctgctacagtgttgggtgcagatgcattgaagtcttatttgattcatattgatacttgtgcttttttctttcccttctaggacacgagagacttcctaaacaggtaaaagagtctcctctccatggcgtacctcatcccccttgtttatgttcccccgcttctgaccaggtgcatttgaattcatggggagtggtatggtgccagaggtactcacatcccatggttcatcctgatgcctttctgaggagcaggacacatcattgagaactggagacttgctctcctccttatgagttctctgtgtagccccagctccttggcccactggccttatttgaggtgggacagagcagagaggttagaaacatggcttagtagacagagcgccctggatgtggagtctactgatgttctgaagccctggttcagctggtgtctttgggccactgtttttctgtcacttgtttggggataatcatacctttcctctccccttcataattgccatgaggattgagagataagtatgaaggaaagtaagaagagctgagtaacagcttgttatgtatgtcatcttcttaggtatccacggaagaagttctgggttgggaaacccattgctcgagtggttaaaaaaaagaccggagaattctcagataaactcctctctctgcaacgaggcctgagggaattccagggtaagggttggggagcgcacaaagggtgggagtcagagcagggctacctcgtagaaagagcgcacccagctcctttccatcaccttgtcgatcctcactcttctgagggcctcttgtcttagacatggatccctatcaggaaattgatactgcccgagcaagaaatgggctcataaattttcgggacttgagtcattgctgtccttttttctccccagggaagctgctgagagacttggaatataagacaggtgagtgtctagagggtgtttcccagatgtacatcaaatatagaaaactccgcctgcagagattctgactgctcacttttcccccaggtagccccttttgcaacaggaagaatttcccagctgcacaatagaagcccccctccctctttgcactttctaatcagcctactctttagtctgcagtagaggcctctgcttgctagtctgatccttctctgccctgtgtttgcttttctttttcctatcctcacaggtcctaccaccagtccttttcctgtggccgagctttctctcatcttcctggctgcatggctcctatattcagagcaaacagcaggggcaacctaagaccagaggccatatccaccacaggccccactattgtgccccctctcagccctgcagttaggttgtacactgcataccaaccaccaaggagcgccatccacatagaccaagatgtgaatggtgccccttggattgtgaagactggtggtctcctcctggctcactttcacacttgctttcgtgagaaccattgaggaggtcggcctgtctgggagcaaacgaggccctgagagcttcatctagttcacaggataaaatcccatagcagaactgagttagcagtggttaaaccttaggtggttgtagcttctttattaatgtctgagctgtctgtgaataccgtcaaattttacctatcaggttattctaattatagagaatcctatgaggatgatggtgaggattatcccactctgtcagtacctgttcagggtttcttgaaccatcttacagagcaggctggtagttttgaaactgaaattgaacagtttacagagaccctgaatgcttgtgttacaacagatgatgctttgcaagaacttgtggaactcagaggccacatctgtcccaaatttcttttctttttttttttttgatacggagtctcgctgtcgcccaggctggagtgcagtggcgcaatctcggctcactgcaggctccgcctcctggggttcacgccattctcctgcctcagcctcccgagtagctaggactacaggcgcccgccacctcgcccggctaattttttgtatttttagtagagacggggtttcaccgtgttagccaggatggtctcgatctcctgacctcgtgatccacccgcctcggcctcccaaagtgctgggattacaggcgtgagccaccgcgcccggccttttttttttttttttttttgagatggagtcttgctttgtcttccaggctggagtgtagtggtgtgatctcagctcactgcgagccccgcctcccaggttcacgccattctcctgcctcagcctcctaagtagctgggactacaggtgcccaccaccatgcccggctaatttttgtatttttagtagagatggggtttcaccatgttagccaggatggtctcgatctcctgaccttgtgatccacccgcctcggccttccaaagtgctgggattataggcgtgagccaccgtgcccagccccaaatttctcttacatgggagctcacctgtgtaattacctgacatcatctgacagttagcacagagagtagcaccttccgccaatttctacttcaaagatatcggactgaatatgacattaaagatcaagctgcaaaaggggatgaagttactccaaaacaatttcatgcatttgtaccctttctgggagagctttatcataacctggagatcagaggaacaaatggacaggttacaagggcagatattcttcaggttggtcttcaggagttgccgaatgcccgaatgccctcttttctaatcccatggatgacagcttaatttgtgcaataaaattgctgaagttgacagggtcagttttggaagatgcttggaaggaaaaggaaggactgatatggaagaaattattcaggaaattgaaaatgttgttatagatgcaagctgtggcagagacatgaaacagatgctcttgaagcttgtagaactccagtgcagtaattggggtagagtccatgcaacttcatcatacagaaatacaacagccaaaaaagatcccaattactatgtgaatgaaccaacattttatagtggtcattcacatagttattgtgtttcatagtgttcctttcactgcagctgatccggattaccaagaagcatatcaagagttacttgaaaaagaggactttttttctggattatgaagaaaatggaacagatttttcagggactggtgatccacacttggatgatattaatgatgagttggacccagagatccagagatagaggaagcttatgaaaagttttgtttggaatcagagcgtaagcgaaaacagtcaagttaaatttcagtatatcatgtttataaagcagtttagttatggtgatttagcagaatacaaagccagaaaatgtgtcacacttataccaaattaaggatgttgagttatattactaatgtatgcaactttaattttgtttaacgctatctgccaaaataaattttattccctctgacttaaaaaacaaaacaaaacagtgatgctgtttttttttttttttcccttgtccccacagtgagcgtcaccctggacccacagtcggccagtgggtacctgcagctgtcagaggactggaagtgcgtgacctacaccagcctgtacaagagtgcctacctgcacccccagcagtttgactgtgagcctggggtgctgggcagcaagggcttcacctggggcaaggtctactgggaagtggaagtggagagggagggctggtctgaggatgaagaagagggggatgaggaggaagagggagaagaggaggaggaggaagaggaggccggctatggggatggatatgacgactgggaaacggacgaagatgaggaatcgttgggcgatgaagaggaagaagaggaggaggaagaggaggaagttctggaaagctgcatggtgggggtggctagagactctgtgaagaggaagggagacctctccctgcggccagaggatggcgtgtgggcgctgcgcctctcctcctccggcatctgggccaacaccagccccgaggctgagcttttcccagcactgcggccccggagagtgggcatcgccctggattatgaagggggcaccgtgactttcaccaacgcagagtcacaggaactcatctacaccttcactgccaccttcacccggcgcctggtccccttcctgtggctcaagtggccaggaacacgcctcctgctaagaccctgagccctgacatctgcccccagccccaaccctcagatgcttcacttctttggaattccaggactctcaatggggggacgggatgcctggcctaagcacctggagcaggggaccccatatccactggtagccacctccccattgctgtggccccctgaaatctcactcagtgctgttgctccatctactgccctaatggggctcttttcccacctcctgctggtttcccgagggaacttctgaccctggagtccatgagggctcctttcctttttgaccacgaccttggccccagctctgcactctctggaataagggcccgatgcagcattttcttgcccagtgtggcaagacctcagaaaaaccagtcaattacgcctaagatcattttgctgtccttaaaccccccaggttccttcttgcacaaatccactctgctgcccaccttccctggcattttaaacagacctaccccaccccaactcagagttaagcatacatggcaatgctgaaaataaacaaaatccactgaggcttcccaggccatttaaagcctggagtaccagcgcatatcatctcatggggtccagagtggagtccaggcttctctgaaaccagggctgagcatatttccatagccaaggaggtgggactccctggagctatctgtggtcttagggaaggatccagacatacacggctttggggtacaagctgtgatcactgatcaataaattatctctagattggtccttgtgaggggagttttaagaatccagaacatcttgctcttgatcagcacatccaaaaacaccaagacaaacatccagtggagcagaacctctcctgcctcgggagttctgaccgggttccccagcagggtgttaagcctctgtctctggccctaccagcatccaggttccactttcctaggagagagtggagatgggaagacagggaaaggaaggcagcaggaggccacaagcccaccaggtcttcatgtcaagagagggagtaacatgtcttctcattgcccacggacccaacctctgtccaggtgcccctcatcatcacagtttaacacaagctcccctgctccagccaaattgatctcccagtcttgtccttacccattccaagtgctctgccagcccctgttcatccaagttttaagtcctccaccctgttctaagagactgttccaacggctctgggcctcagtggtcacttgaccaccattgtctcagagctgcccactttgtgtgtgtcacatgctgcctgagtcacatgtacatcttatttctgcctctagttttgtaagctcctggagggcggataacatcttatactactcttgtattctcatggcacctagtgcagtgctgggcacagagtaggtgctcaataaagacttgttgaatgaacagcctggagatctgtatttgtaggtctatatctatattatatctcaaatgccaccagacctcagtctggctacagagaaattccactgatagcagtagccgaaggttttccttctgtgccttctgtaacagtgtaactttgctttctgttctctgcacacatgctgtcatttctggaagtccctcaaaaagagcctactgcggaacacagacgagttgttgcgtggctccacctttttattcctcctgcagtggtgcccttgagctgaggtccagcgttttggagcaagtgatgactctccctgagaagggagacctccagtatagcacacccaaaaattcttccttggaaaataagcactgcctcagaggaaatagaatgtgcagagattcagccttgcatcctaacacagtcaactgtttttcttgtcctttctgatttttttttttttttttttttttttttttgagatggagtctcactctgtctcccagtttggagtgcagtggcgccatctcggctcactgcaagctctgcctcccgggttcacgccattctcctgcctcagcctcccgagtagctggaactacaggcgcccgccatcacgcccggctaatttttttgtatttttagtagagacggggtttcaccatgttagccaggttggtcttgatctcctgacctcatgatccacccacctcggcctcccaaagtgctgggattacaggcgtgagccatcgcgcccagcagtcctttctgattttttaaattgccatcttaaagatggaaaagggaggattatacgaaactacctgtaaaattacgctagtggcaaagagcatatttcctctctgttctctaagttgtgggctcatgtaaattttccctttttattttttatattcatagtttttcattttgtataactctacttgcacatatggtaaactttctacagtgcttcttacaaataggaacatttccctgccccatacctccctccaaagacccagttcatacctttcagcaaactattttgtgtttgccttgctgggattacaggtgtgagtcaccacaactggctgaatttttattattttagagacatggtcttactctgtcacctaggctctagtgatggtgcactcgtagcttactgtggccttgagctctggggctcaagtgatcctcccacctcagcctcccaaagtactggaattacaggcgtgagccactgtgccctgcctgaattatttcttgttgacttttcctcctattttctgtattctctcaaatctgttatctccaggcttcatatgtctcctgaattcatttattaagtacccgtgatgtgccaggatgtttctaggttacaacagtgataaggttaacaaagttctgcactcttggaggttatattccagcaaatggtgacaggcagtatgttaaaattgaaaaaaaaaaagtaattagcactatgcaaggaagtgaaataagtctgtgatagatagtgacctagtatctattttataatgtgtgatcagaagggagttccctgaaaagatggcatgagagctgaaatcagaatggtgagagggaaggtctaagatcacatcagctagagggaacagcaaagtcctaaagcagggacaaactgggtacagaaagagtgcatttagagtatggttatgggagaacagaaagagccatagattttctcttttttttttaatagagacggagtctcgctctgttgcccaggctggagtgcggtggcatgatcttggcttactggcaacctccgctgcccaggttcaagcgattctcttgcctcagcctcccaagtacctgggactacaggcgcacaccaccatgtctggctaatttttttgtgtttttagaagagacggggttttgccatattgaccaggctgttcatgaactcctgacctcaggtgatccacctattttggcctctcaaagtgctgggattacaggcatgagctttaaaaagaaactttttaaaaactgatgcatcccaagtacccagaataatgcctatcacataagtcttgacctgaggccggactgatgtggcgctgctgttgctgctgctactgctgccacctggcaaaaaagagatgggagactgagcactcccatgcacccccctggacaaatcccatcgccactgctacaggctgctgtgagaccagggcttgagaagactgcactccctgtggctacttgtccttgctcttccacctgagaggggtcctgccctcccggtggcaaacctgtagtcattattctgagagctcaaccacccgggtctgcattctgcccctgggcctggctggggctgctgccgccaagccaaggctaagttgaggagggagagtagagacggggcacttccgcacgttcctaggacaaatcccaccactgctgctatgggctggtgtggacaaaggtgtgagcagatgacacttcccacagctacttgctcatgatgcgccagctgagagtggccctgccttccctggttgcaggactacagtgcagccaccacagccagcccacacctgagcattctgccagtggtctggggacctctccatctcttgtctatcacagctagcacctgaatgcattgcagggggccctgaggacaggtctgctggcctgatcccatccccccagtacacaagcacatcatccaggggcccggaaattgcccagcccaatctaccaccactggcatctgaatcattcctgtcaggatctgaggtcagtccaactcaatctaccaataccaccacaactgacacccacccacacatgctaccagtgggtcagggtactagcctgcccaacttgtcacagccaccaccaacaccagcacagactgcttgggtcctagcaggttgttccaccactgctactgccattacccatttcacaccagctgcccaggagcctgagaagttgcccacatgtctggcccactgctgccactgctagcatctgagcaagtcacctgaaggcccaataattggccctccaagacccactaacgctgttgtcagtttaagccactctgtgggccctagcacaggctcattcaacccaccgctgccatcactagggcctgaagactggcccacctagcatcttagttcccagccaaacttcaccacagccttcactaataagtgcaccttaagtcaatgaggaagtcacagataccactgatgttgtatactgccaaataaatcatacagggatcacactactataggcactcaaaatcaaagccaaagcaccctactcaacaaacaacacgtaaaatcttcaggaaaaaaatcctcccctatgaaagcaatttcaaaaatggaagaagtgactgttgcaactaaatgtgcagatatcaatgtaaggacacagaaaactaaagaacaaagaaatatgacaccaacaaaggaacacaatacctctccagctacagttatcaatcagaaagaaattcatgaaattctagataaagaattcaaagtactgattttaaagaaactcagtaggctgggcacggtggctcatgcctgtaatcccagcactttggaaggccgaggtgggtggatcacgacgtcaggagattgagaccatcctggctaacacggtgaaaccccgtctctactaaaaatagaaaaaattagctgggtgtggtggtgggtgcctgtagtcccagctagtcgggaggctgaggcaggagaatggcgtgaacccgggaggcggagcttgcagtgagctgagatcgtgccactgcactgcagcctgggtgacagagtgagactccatctcaaaaaaaaaaaaaaaaagaaactcagtgatatataagagaattctgaaaaacaatagaaagaaaaaagataataatgtaggatatgaatgagaaatttaataaagcaatagattgttttttaaaagaaaaatagaaaatctggatatgaagaatttattaaaggaaatacaaaatacctttgaaagcttcaacaatagaactagattggggagaagaaagagtctcagagcttgaaggcagctcttttgaaataacctagtcagacaaaaataaagaaaaaataattttaaaaaattcaatttactttgcctagataaaaaaattagcaaagccttcatgatatttgggacagcataaagcaactgaatatatgaattgttagtatccccgaggatgatgaagaaatgaaaggattagaaaatctatataatgaaataatagatgaaaactttccaagcctagcaagggatttggacatgcaggtataggaggctcaatgtttcccaggcagatgcaatgcaaagggtcttctccatagcacattataattagactgtctaaagtcaaaataaagagcaaattctaaaaatagcaacagaatagtgcctagtcacctaaaaggaaaactcatcagactaacaaacagtggatttctctgcagaaaccctacaggccaaaagataatgggatggtatatacaaaatgatgaaagaaaataactgtcagccaagaatattagatccagccaaattaaagtataaaggaaaaagaaataaagtctttcccagacaggcaaatactgagggaatttgttaccactagatcagtcctacgagaaatgctcaagggagtcctaaacctggaagtgataggatgatatttaccatcataaaaacacacaaaagtataaaactcgctagtaaagcaatcacacaaaggaagaagagaaaggactcaaatggtgcctctaaagaaatccaccaaaccacaatgacaaacaagaagaaaggaacaaagaatatataaaacaatcagaaaacaacaatatgacaggaacaaagtctcatatatcaataataatcttgaatgtaaatggaataaattctttacttgaaagatgtagaatggctggatttatttaaaaagataatacacctgtaagctgtttcaagaaactcagtaaagtttcttaccagtaaagacaaatatagacaaagtaaagggatggaaaaagatattccatacaaatggagacaaaaagtgagaaggagtagctatacttatatcagatacaacagactttaagtcaagaattgtgaaaaaaaaaagccaaaaatgtcattatataatgataaagggatcaatccagcaagaagattcaacagttctaaatatatatacaccaaacaccagagcacccacattcataaagcaaatattactagctctaaagagagagacagattggaatacaataatagtgggggactttagcacctcatgctcagcattagacagattatctagacagaaaatcaacagagaaacattggatttaaactggactttagaccaaatgaacctaacatttacggaacattctattcaacaactgcagaatatatattcttttcatcagaacatggaaccttctccaacatagaccatatattaggcgacaaaacaagtctcaataaatttttaaaaattaaaatcatatcaaatattttctcagactgcaatagaataaaatgagaaatcaataccaagaggaactttggaaactatacaaatacatagatattaaaccacatggtcctgaatgaccattgggtcaatgaacaaattaagatagaaggccaggcatggtggctcacacctgtaatcccagcactttgggtggctgaggcggatggatcacctgaggtcagaagttcgagaccagcctggccagcatggtgaaaccctgtctctgtgaaaaatacaaaaaaattagctgggcgtggtggcaggcgcctgtaatctcagctacttgggaggctgaggcaggagaaccgcttgaacccgggaggtggaggttgcagttagccgagtttacaccattgaactccagcctgggagacaagagcaaaactccatctggaaaaaaaaaaaaaaaagaaattaagatgaaaattaaaaaaaaaatctaaaaacaaatgaaaatggaaacataaaacctgtgggattcagcaaaggcagtgctaagaggaaagtttacagcaataaatgcttacattaaaaaagtagaaagattacaaattaacaatccaacaatgtacctgaaggagctagaaaagcaagaacaaaccaaaccccaaattagcagaagaaaagaaataataaagatcagagcagaaagtagagacttaaagaaatacaaaggatcaatgagatgaaaaattggttctttgaaaagatatacagaattgataagctactagctagactaaccaagaagacagaagacccatatgaacaaaatcagaattgaaaaaggagacattacaactgacatcacagaaatattaaagatcatcagagactgttataaacaactagataaaattggaaaatctagaggaagtggataaattcctggaaacacacaacctaccaagactgaatcagaaaaaaatagaaaacctgagcagaccaataattaatagcaagattgaatcagtaattaaaagtctctcaaagaagaaaagcctaggactggagggattaacagctgaattctactaaacatacaaagaactaataccgatcctcctgaaactgttcaaacaagtcaaagaggaaggaattttccctaactaattatatgaggtcagcatcaccctaatactaaaaccagacagatacaccacaacaccaacaaaaagaaaattataggtcaatatccctaatgaacatagatacaaaatcatagatagatacaaaaatcctcaacaaaatactagcaaaccaaacccaacagcacatcgaaaaatactacatcaaaatcaagtgggatttatagtagagatgcaaagatgtttcaatatgaataaataagcatgatacatattatcaatagaatgtagaacaaaaaccatatgatcatcttaatagatgcagaaaaagcatttgataaaatttaacattcttttaagataaaaacatacaacacactaggcatagacggaacaaacctcaaattcaaatgagctgtatgtaacaaacccatagctaacatgctgaatgaggaaaagtggaaagcttttcctctaagcactggaacaaggcaaggatgtctactctcaatactcttattcaacatagtactaaaatcctagctataaggatcaggcaaaagaaagaaacacaatgtgtgatttcaccaaaaaactcttagatatgataaatgagttcagtacagtttcaggctacaaaattaatatgcaaaagtcagtagcatttctttacatcagtaatgatttagccaacaaagaaatcaagaaggcaatctcatttagaaatttttgctaccaaaaacaatttaggattgaatttaaccaaggaggcaaaagatctttacaaggaaaactacaaaatactgttgagagaaattcaaaacaacacaaatggaaaaacaccttatgctcatggattagaaggaatatcaacatcattaaaatgaccatattgttcaaagtaatctgcagattaaatgcaatccctaacaaaatatcaacatcattcttcacagaatttgaaaaaaaaatcctaaaattcatatggaccaacccccccctcccaaaaaaagcccaaatagccaaagaaatcctgagcacaaagaacaaatactcttggattaaagggagtttagtaattaatagattagtaatacttgctactagagacatttttgtcaggtttgtcaaatatcagatggttataggtgaaaatcaaatcaaaactacaatgagatactatctcgcaccagtcaaaatggctattactaaaaagtcaaaaagcaacagatgctggcaaggttgtgaagaaaaacgaatgcttttaacactgttggtgtgagtgtaaattagttcaaccattgtggaagactgtgtggcaattcctcaaaaacctagaggcagaaataccattcaacccagcaatctcatttactgggtatatacccaaaggaatagaaatcgttctctataaagatacatgcatgtgtatgttcattgcagtagtattcacaatagcaaagatatgaaatcaaactaaatgcccatcaatgatagactggataaagaaaatgtggtacacatataccatggaatattttacagccataaaaaggaatgagatcatgtcctttgcagggacatgaatggaactggaggttgttatccttagcaaactaaagtaggaacagaaaaccaaatacagcatgttttcacttataagtaggatctaaataatgagaacatatggacacatggcaggaggcggggggaacaacacacactgggccctgttggagggcgggggtgggaggagggagaggatcaggaagaatagctaatgggtgctgggcttaattcctgggtgataggatgatctgtgtagctgactactatggcacacatttacctatgtaacaaacctgcacatcttgcacatgtacccctgaacttaaaagttgaaaaattttttaaaaaagaaaaacattagggagtagctgcctttgggagtgaggagaatgggaataaaaattggggagagaggagaaaatacaaataaaaccagaagaccttgcatggactgatgatgatagtgttccaagaactgagaggtatgactgagtcaacactctacactggaagtctgaaagaaggaaagaactgaaaatgaaaaagaaaataaaggccatgagtagagctaggaagcttccttatagacaggagaatgggccccacatccagagcaaagtaagccgaccagagagacaatgcatctgcctaggctctagttcccattacaaccagctcactgtcatcacggttcctgggctccagagagattcccttataggtcccaccttggtccttacaataacccctctggttctccgaggcacatcagtgtgactgctcctcacatagtccagcagcccagcaattattttgtgggatctctttgcctcctgcccagtagtggacagaactcagcacttggaattcaggaacacctacaaaaagcattaggggcaaggcaggttgtgcagaggatcctgtaggggagatagaggacagttttacatcacaaacacaggaacacagccatcctgtggctccagctggaccaccaaatgaataattttcctctgcttttccttcaggcagctctcagtcctcaccctgaggtcttagccactcccaaatttcttttggcttctaaatttctctttcctttcttatgcagaacaatttattaatataggcacaaagcctccaaatgtgcatatccacacttttaaattatctggaccactctaaaattagaagtaccagagacttggaaatacagtgtgcttatggttcatcggttctttttttttttttctgtttcatatgaaaccaaaaatgccctgtctaaaacatgaattcaatgggtagcaaatgaaacatagccccattgggatgtgtctgttttagaagtctgagtgtggtggaaatgtgactgcactgagctccaggacaggtagattctacttcagcaggtcacaaggaccagctgtgaaaattgttagacaagttcatttaactgtgtgtcagttttctcaaccaccacatgagaaaaacaaaataggtcttatgtatttcacaggcttgttgtaaggttcaaatgaagatataattaaaacaaatttgaccaatggtacaattagcatgtgttgcacatagtttttcttttggaggggttgcaaagaatacttatggcataatctaatttatgtaaaaaaaaagagaaagcaatatatatttgtattcaaaacttgcaggatatacaaaaaattgatatcaatgtttaactatggggagtggcaaggggaagtgttgagtgggtggggaaagaggtttttatttatacactttgaaaatgtttgaattttcttaaccatgagcatatacaacttttataataagcattgggcaatactactactactaccactactactactactaggttggactaccaagccacttgggtcagataaggatggctctgctcaccacactggggggcagaagaaaccccacattgtctggcttcttttatatcaagaacctctatttccccaacagtcaagttagggttaattattcacatcacattgattcatgttacaatttttaaataaaattcacatatggtccaaactctttgagtgcttttaaaacatctgacccatgctttaggagcagggcttacgcaataatgaagatgttctttgttttatttgtttgtttgtttcttggagacagagtctcactctgtcacccaggctggagtgcagtggtacaatctcagctcactgcaacctctgcctcctgggttcaagtgattcccctgcttcagcctcccaagtagctggtctgccaccacacccagctaatttttgtatatttagtggagatggggtttcaccatgttggccaggctcaaactcctgacctcaggtgacccacctgcctcggcctaccaccgtgagccaccgcgcctagcctgttttttgttttttgtttttttgagatggagtctcactccgtcactcgggctggaatgcagtggcttgatcttagctcactgcaacctccgcctccctggtttaagtgattctcctgcctcagcctcctgagcagctgggattacaggcgcctgccatctcgcccagctaatttttatatttttaatagagacagggtttcaccatgctgtccaggctggtcttaaactcctgaccttaagtgatctacctgcctcagcctcccaaagtgttgggattactggcgcaagccaccgtgccgaccctaaagtgttcttgtacacagggtattgtcttacactacagggaacctggattggagttgaaggcagatttttttcagaggttggggtggaagggtgagaatgtgagtgttcaacttgagaggagaaagggtaggggtggaaggaaacatcacttgtatagggattaatactttgctttttaaagttattttaacctgtggtctgtttctgtgtccaaataataactgcagtaataacaaatatttgagaggttagttagacctgagcaaaagcctcgttttattaaacaatggggcctggtgattgtcccactgtctgtcatcagggatatcctgactaaaagaagggacaggattgtgtcttggtcacagagggatcatcacccttcctctctgcatctactccctcgagccatctcggccctaaattgccaacacaggcagatcccattggatttaagcctttctccagtcccatcagcgctaattggacacatggaatccagaggtctgtgagtcacactttcttaggacattctctacaagtccagagaaatgaccagaagggaagggaaaggaaggggccctggggtccacccagggctgataaaaaggccctaagccctacaaaggtggaggcatcttcaggtgtgtgtcaaagtacgaagttaactgtacaaattagtgcaagtccagcaaaaccctgatttttcccaagataattattttgaaacagtttaaacattttattttagatgtctttttcttttttttccccgaaagcccgctggctcctaggttggctgttgccctaggcacagccgaagccgtctgtggttctgcactctgaggtgcagagaaggccagagcgtcacagggaggctcaggacgtcagggagctgagggcctaagataaataaagtaaaaacaaccgctgttcgagactcaagtcccctgttctctcgcctcacgcgggcacagggagcccccgggccgcacactggccaggggcggagctggatcccggagagccgccgtctccgcttcgccgcccttcgcgcgccccacttcagcctttcagcgtaaggcaggaaccttttttccagacggcaaagaaagggaagactttgccggagaaagaggcagtgaaggtgaagatgggctcctgggtctgggcgttgtggagggtcacctgccccgcctcgtagtccagggcgactctcacgccgcgcgggatctcgctcagcggcaggtcggtgcccggggaggtgctggcccagcactgctggtgcgagatgatcacggcccagacgccgtcctcggcgctgagtcccatctctcccttcctcctcaccccctccccggccacccccaccgtgcagccgccgccgtcgcccagctgcaggtcaacctgccagcggtggcgcccggaggagaagcccgggaagcccagaaccgccgggaggccgtcgaagcgcagggggctgtctggcaggctcttcttctgccgggtgtacctcactgacttcctgtcttccgagagaaccaggctccggctggcggtctgagggtccagagtgatgacccctagagggaggagcgcgcagacatcaacagcgggcggcaaccacagatgttcctagagcaggcaacgcacgtgggaggcagaaggagtactggacttgggcagcctgccattgggccacttctctgaaccgcccttctacctaatcagcaagtggtgctgttaaggatttgcttctcaaagtgcagcgggagggaccagcagcatccccaccacctgggtgtttgttagaaatgcagaatattgggccccatcccaccctactaaatcagaatctgcattttaacaggatccctaggagacgtttctgcatattaagtttgaaaagcacttacctataccagagtgagtgaggtgatgcttatggaaacaacttctaaattaagcaccaatttaaaaataaatgtgatttttaaaaaattgcacattttttgttcaaatcagtagagagcccagcacaatgctctcaaaaaactagggcttgataagtatttttcaacgagtaatatctacacaagtagatgacattaattgagcacttactatgagtcaggtaatatactaagctctttgcatgtattaatttattttgtcctcacagctacttatgggacaggtacagtacttttattttcattttactgatgaagaaaatattgtgggacagaggcttaataacttgcccagtgtctcagagctagcaagaactggaatcgagaactcaagcaatcaagctccagaattcatgcattttattgctctgtttgctgccatggattgaatggatgaatggaagaatgactccccaaatcccaagctgtttacctgaatctatttccagatgatgcgccaagttttctgagggaagcagaaatagaaagagagatctgtgacttattacttcttataggcacccccaggggcaaggtgacttgagtacaatgtgaagatgaggacagaagactcggcttctgctgtggtctagtggaggagaagggtcctcaccctcctggactctcagtcctgcacctgtccttagggagtggaggagatgctctgggaatagtgcccctgaataaattgagatcactaagggaaggctctggggagggaagatgtctcgagccaggtttcaagggcagagaaggatggagatgggtggaagacaggagggcagctaatgggactggggaaaactgtggcgccttcccctttacctgagaacatcctcatcatctctgggagggtgagtattttcctgtggaaatcacggatcttcttgacaaggtcaggagaaatggcctcaggactcacaaaagtcttcatctcacacctgcagacaggtttggtaaccagttaggtccaaattccaaaaacaaatgttcgggtgagaccacgtgaggctaaaatcagactaaagaatgatcttggcgtctgtggtgaataatgaaattgagtatcatttctttacttttgctggaaatgtgtagttactaaaatagtaggcatttcagttaaacctaagaggaactaaggataatcacttctcaagaattggaggtaagcccctttaggagaatgtttggttctgtaggggctgagggacagagatcattaccccttttggtctctagagggcaacagggtaccatttgaaaacagccttaaactacccttgtgtatgctgctatttgtaaaggaaaagaggctagaagggaagaaaaaaaaaggatcaacgaaaatatatattgcaatgaaaaaaactcctgattctggtcccagctcagtcctcattagacacttgctgcattaccttgaagactcttcaccccctgggtctcagtttcttcctcagactggaagacctccaagcccttctagatctaaacctctaatgctctttgaaaagcatgtttggagacacttcctgattcatggaccctgggtttatcctccctgcacgggaataggcacaaagcacgtgacaattgttccctagtcactacacctctcttcatctcagtgcagactgctaatgcttatagcagacagggaaggaaagggccatgcatttacaatgccactggctcctggtggctgtccttttacagtagcattagaaaattctgaaggaaaccagagatgtgtgtaaaaaatgaatgaatgaaagaacaggctggtattcctggtttccatgcttatcatagtctacagaaagtattccccctttaaattacattttaaatggtgttagatactgactcaagtactaataatttcatagattaaataaatgttcctggatcaacctaaaaacatgattattatttataacttcacttctaggggaaaaaatgtgtccccaataccaaccaatcaatttaaaaatgaacctttagaacgcaaatctttagtgagtttggactgtttgtgcacagttgaatgagacagtgtgtctgccagagtgcctttgctttcctggcaaagtgggtggcagtaagtgcccctgccccttcccattcagtcttgatgttgagtaaaaggaggcaggaccggggagtgggccctacctgctctggttgactctgacatcctgcaaaagaaagacaagaacatacatttagtttccataagtccttcctgtcagggattctgtacatcacttttcccttaaaatatgaactcaaaactctccttctgcagagagttgtcctgtttaattacctactcattagattgttcttttacatcatgttttcttactaatttgggtttctgtagtcagttcatttgtgctggtttccctgtttcagccttatcgtgggggtgggttgtgtctgcaatgattaggaggtggtagagagcaggggcctgccttcagttatcagctggacctgatgtgagccaggatcacatattcataaccatagcagacaccagttattgagttctttctgtatatcaggaatcatgccaagcattttttatggattgtttcttataattttgcaataactttatgagggaggtgctattgctgtccccatgtttagagaggctaagagactcactcaagtcacacaattggaagagccaacattcaaatccaagactgtctgaccctaaaccccttaacatgaccacagtgtatgacttgggcaagtctccagcccctctggatctgcaccccgttaacctctctccacttccctttcctgcctctctccagcccaaagcatggtgcccacccccttccccgtggagtccctctcttatcctacaaagtggtgaagtgtctctcacttgtagaagctcacttgctggctgctgacacttctcctccagctccttgacctgggctccaagccgggtgacttcctcagagacctttgtgatatattcatccctctccttccaaatctgctgctccagctccctcagcctggccagcaggagacatcgctgctgctccagctcctgctgcagcctctcaaaagctgtttccacctgatgcttcttgctttcgatctgagtcttcaagggataaaaggcagacatggttaggaaggggctcagagatagcttccaggatgatcatctatatacttattattgattaacagggatagggagcaactggtccaagactcattccatttactaatatgcctagaagtagttaggtctcaggatgaacttaccaatgatgagggctgtgctactgtcttagctagatactctaataataatgctacattatgctctcagaatgatgttgaacttttcaaaaatatttccacaactacaataccatcataaccctactatgccttcttagagttaggtggggaagactgtaataatttcttagaggcaaaaggaagttgtgattggagtcaacacaacttagtgggagagtgtgtaattttggttttagccgtggaaatcaccaactacagggcatacgttgatgagagctgagggatggtggataggttgctttgtccccacactctctccttggtcaaggtaccagaaatcctcacactgtgattcctccataactttatagcatgaaaagagaggcgtgagggatccagatgtagccacaccatcagcctactctcctcaaggtcagcctgtagtcaggactagaatcccgacactaacatatgtttttgaccccaagcttcccatctgaaggtggtgtgttcaggcaaacagactaggatggaaagaacaatgaattaagggtcaagaaatccaggttcctcatgaacttcagctttgctatgtggccttgggagcattgcttttctggtcctaagttttctgctctgtaaaatgtgatatacaagatggatcttggattgcaagacatcagaaccacttctagtgctcatggtctgagatcccaaatgcctttgtgcagccacaggaaggtgaacgagaacagtttgtcagttcttttcagccaggaaacagataccagccaacgggtttccccagagtctcttaagaaaaccttcaaaggaaaaggtagccagtgacgtggcctgtaccagcagcacttgaagcttctggtcttcttgacactttacatcctcaatctcatctctctccgtgctcagagcttccagtcgactcctgagacgatcctgtggggagaagaatgggtggatagaggtgactgaattaataattcaactcacaattattaactatcacatcctgggcacactgttgagtgctgaggggttcaaaggtggaaaaggcccagtccttgccctaaagagaccaccatctcaggaagaagtcaatgtcaagtgattaaaatacagatagataaatgcaatagtccaggggtacacacagtgagatgggaacacagaggtcagctctgcctgtaggcctaagggaaggtttggaaagcagaaaacatttacaatgtgccttgaaagataaatttccagttgaatagagagggagagaaaaggacttagtgcccacagatgtgaaggacctcttcaaggagaactacaaaccactgctcaaggaaatcagagagaacacagacaaatggaaaaacattccatgctcatggataggaagaatcaatattgtgaaaatggccatactgcccaaagtaatttatagattcagtgttatccctatcaagctaccattgactttcttcacagaattagaaaaaactactttatatttcatatggaaccaataaagagcccacatagccaatacaatcttaagcaaaaagaacgaagctggaggcatcatgctacctgacttcaaactatactacaaggctgtagtatatgatatcaaatatgtctggtatcaaaacagacatatagacaaatggaacagaagaagggcctcagaaataacaccacacatctacaaccatctgatctttgacaaacctgacaaaaacaagcaatggggaaaggattccctatttaataaatggtgttgggaaaactggctagccatatgcagaaaactgaaactggaccccttccttacacctgaaataaaaattaactcaagatggattaaagacttaaacgtaagacctaaaaccataaaaaccctagaagaaaacctaggcaataccattcaggacataggcatgggcaaagacttcatgactagaacaccaaaagcaatggcaacaaaagcctaaattgacaaatggtatctaattaaatgaaagagcttctgcacagcaaaagaaactatcatcagagtgaacaggcaacctacagaatgggagaaacattttgcaatctatccatctgacaaagggctaatatccaaaatctacaaagaacttaaacaaatttacaagaaaaaaacaaacagccccatcaaaaagtaggtgaaggatatgaacagacacttctcaaaagaagacatttatgtggccaacaaacctatgaaaagaagctcatcatcactggtcattagagaaatgcaaatcaaaaccacaatgagataccatctcacaccagttagaatggtgatcattaaaaagtcaggaaataacagatgctggagatgatgtggagaaataagaatgcttttacaatgttggtgggagtgtaaattagttcaaccgttgtggaagacagtgtggcaactcctcaagaatctagaatgagaaataccatttgacctggcaatcccattactgggtatatacccagaggattataaattatcctactgtaaagacacatgcacacatatgtttattgcagcactgttcacaatagcaaagacttggaaccaacccaaatgtccatcaatgatagactggataaagaaaatatggcacatatatgccatggaatactatgcaggcataaaaaagatgtgttcatgtcctttgcagggatatggatgaagctggaaaccatcattctcagcaaactaacacaggaacagaaaaccaaacaccacatgttcttactcataagtgggaggtgaacaatgagaacacatggacacagggaggggaacatcacacatcggggcctgtcagggcttgggggactaggggagggatagcattaggagaaatacctaatgtagatgatggattgatgggtgcagcaaaccaccatggcacgtatatacctatgtaacaaacctgcacgttctgcatatgtatcccagaacatgtataataaaaaaaaaaagaaaaggacttagtgcccctgaattgtatacttaaaaacagagagagaggtgggaggaagggagaagagtattctaggaggaagagactatgtgcaaaaagtattggaagcaggaatgaataagacaactcaggaaaaaacagcaagtgcagctcagtctggccagacacgtggtgccttgaggagggaggctgagcgatgaggccggacagggaggaaggatcccgactgcaaagggccttgaatgtcttgctaaagaccttggactttctttgggcactaggtatacatgggaggattttgtgcagatgagtgactttgtgttttaggaggatctgtctcccagcagattggaaggtgactggaaagggtgagaatggagacaggaaatgccatggagactgcaaagtctgcgcaagagatagggagaacctggctgtgaggataaggcagaattaaagatttgggagatgtttctaaggtaaccacttccagacctggtgactggatgacaagagagagatctgagaggctgacaggaaagtgccccaaggccagatggggaattctcacaattctggactactgccaccctccctttctcaagaagaagagcagtgctagcaggttccccttcccagctcctccctcccctctgcgccctggcagtcagggccctataaaccccatttccagtctggatcctgggagaacaagtttaccctgcccataatctgcagaagatcccactcggcattggagctttctttccatagtgagtgaagccaaggctacagttctttgcactccacctctgtggggtcctctgagagctggagctgaagttccccccagaccaggaactaccacacatccaagtggagccctatctgccttcagtctgggaatgcctcgaaagtccctgtaaccttagggttccctgatgtggaagcctttcatccagatccccgcccgatttcctcccctcataacaggacatcatcctgccccaaacaggccctaggtaaagctacacttcttacccggtagggctgaatggcctcgtccaggaaccccacggtgtgcgcctggtgcgtgggaccctccctgcagaacacacagaggaactcggcatcgttctcgcagaagaagtagatcttctcgccgtgctcctcgcagtaagtttctcccagcgggcccaggggcacaggggccatgggagtctctgcctgctcctcctcttggcagagcgggcagagcaggatcttgcccgaggattgggcccccatctgggagagcgcggggaggcagagccggcagaaggtgtgtccacagggaatggtcaccgcatcctccagcggccccgcacagagggtacaggcaggcagctcatggaccaccttcagggacggggttgcgggcatcacggtgccttccccagcccgtccactccggtctcctcagcccacgcgagttccctttccctgaaatcgagtcacacttacatgaatcgcagagggaaacggctgcaaggctgagagacagagagagagaaagagagagagaggcaagaatgccagcacagggaagccacctggctccgcctcttgtgttccctagaaccctggccaccacctatcagcggagtgggtccaaattccagggcgtctcgaattacccagaatttcccagtggcggccaagtaagccagttctttactcctggctccttctggtccctagggtggagaacagagcacaccatgaggtcacagggggatgggtttcctggaatctgtagaccacagtggctggggagaactggggagcagaagcttcctgtcagattgagcaggtgggagccataaacttctggctctgaggcgtgcccacagcatcaaagtccaggctggagtgagaggtgtggacttcgggagattctgccggaagtgtgtgggcgggacgctgtttcgacactgcaggtagggtgtaaggattgctcatcgggtcccctcttctgctctcctttcctccctcaccacatctgcccatggtggcccctcctacggtcccaaatcccccaccacctggcacaacagtcccctttggggttcgggtaacactggactattttatttatttatttatttatttatttatttatttatttttactgtagcggggagaaggcaagaaaccataatgcaaatgatttatgttgatacacattagaaaacgattagtcagataatcagtttcaaccacatttatctagggtttagtatttttatattactacattcaattttaataaccctctaggcaaacattattaccttcattttacagagaaagaaatgtaaactgactttccaaatgtaaagtgactttccaaaggtcacaaagctagaaagtatcacgttaaggacgatcccagtctcctggcttaaagccctacgctcctcccacacctcatgccaagaccaagatctgcagccacggtccttcacccatgcacacatctgtggataaaaccaggccttcccccattctcccactgggtgatcagcctagccccttgtggttgctccctttttactctaatcactttattacctccccttcccatccaatctctgctcttcctgccacgagtgcagcccaggaactagtttgtccaatacaggagccaccagccacatgtgtctactgagcactgaaatgtggccggtctgaatggcggcatgctgtatatgtaaaatacataccggatttcttttttttctttttctttttctcttttttcttttctttttttttttttttgaaatggagtctcgctctatctcccgggatggagtgcagtagcgcgatcttggctcactgcaagctcctcctcccgggttcacaccattctcctgcctcagcctcccgagtagctgggactacaggcgccggccagcacgccaggctaatttttttgtatttttagtagagacggggtttcaccgtgttaaccaggatggtctagatttcctgacctcgtgatccgcccgcctaggcctcccaaagtgctgggattacaggcgtgagccaccgcgcccggccaacacaccggatttcaaaggcttttcacaaatttaaaaatgtaaaatatcttattaatgactttttatatggatcacatattgaaatgataatattttggaaatataggactaaataaaataacatcattaaaattactttcacctgtttagactatttttatatggccactaggaaattttaaattgcatatgtggctcactttgcgtttatgttgaatagcattgctcggaagacagatctgacagcaaattatttatggtcactcaccttcttacttgtgtgcctagggcaagctgaataacctggctgggcctcagctttctcatttatgaaatggagatcctaatagcactgatgttgcagagcagacacagaaataagatcatacttttaaattgcttgtatcaatgtaagttgtaccgtcattgtaaataaattctggccaaattgcttgtatcaatgtaagttgtaccgtcattgtaaataaattctggccgttagtagttttctttctcctccccatcatagggaatattccagcctcttttgaggcctgcagcaggccagttgaggcatcaccattgaagttgctggtgcagtgtacaccctggcacaaggaccttatctgagcccccacactctcctgcttgctgatgggcaagccctgggctggctgatacctccaatctctttggagacagctggccatatggcagaaaggctggaatggcatctccactctgtgacccagtctcccacttgcccccaaaagaatatttcttctgacagtggacagctgacatatcaccactttccttctactgtgagtgtctctggatgggcagaaaggaatggccagcccctggttatggtcatctaaggtcacctctgaaatgctgtgagcccctcttccttcctctcctctgctatttcccatctctgctgttggcaggagaatagaaccctggctgccagagatgcaagtgtgtgacgatatgggtgctggtgcatatttagtatgtgcctgtgtccagccatgtgcatgtgtgggtgtgtgagtgtgtgacccagcccttcccccgtggccaagcagagagagtggccttgaggaagccatagcagcaggaccagcatggcctctgctgcctctgtgaccagcctggcagatgaagtcaactgccccatctgtcagggtaccctgagggagccggtcactatcgactgcggccacaacttctgccgggcctgccttacccgctactgtgagataccaggcccagacctggaggagtcccctacttgcccactctgcaaagaacccttccgtcctgggagcttccggcccaactggcagctggctaacgtggtggagaacattgagcgcctccagctggtgtccacactgggtttgggagaggaggatgtctgccaagagcacggagagaagatctacttcttctgtgaggatgatgagatgcagttgtgcgtggtgtgccgggaggctggggagcacgctacccacaccatgcgcttcctggaggatgcagcggctccctatagggtaggaaaggggaactgggggatcccagggtggactggactggactaagagaaacagcagagttgtggattatttaggccacccggaggccaaattctttctccttacttacatgatcacccaggcaatagacccaggcatggaaaattgtgtttatgttttatgtttttttgagtgtgttctgtgttcacttgtggccaacagataacgggagttcaacaagtacttgttgaatgaatgagtgaccaaacatgagtgtgtgtgtctgtgccatggatcaggtgtgtctgaagtttgcatttgagggaatgattgtacaaacagtgtgtatatgtgttaatgtttgcatgtttagaagtgtgtctggtgtgtttggatgggagtctgagtatgtatatattcgagtgtgtaagtgtaactgagagctcctgtttgtgaataaattcgtgtttacatatattcaggctgggtaaatgtatgtggcatgccattttatctgtcattaaatgaatgtgtgctggttttagttgtttatgcattgtgcttatgaattatgttttagtacaagtctgtgtgtggatgtcttaattagttaattagcagttgatagtgagaattctaatatatctttgaacacacatatttatcgtgtgtgtacctgttcctaactctattctggagcaaataattttgaaaacaatttatcaattatttttacattacccaagtttcttctcccctctggagtcatacacagataattgatttcagtaacaagggagggttgttatttacacatgttcctttgggatgagtcggaaactcagaatgatttcagtgcggggcatatcaaactcagtacagaccccagataccacttacccgaagcaaaacacaatagaatgttaaacctgaagaaagactcaagtgggaaaaccaagtcacagcctctaatggcacaggataaagggggaaagtcctgatccaaagtcttagagacaaatcaagaggaagaagacccaaagggagtaagctgtcagggtggtgaaggctcggggattgtcagctaaggaagggactcctctcctggggccatttcattcctggaggcagagggtcagatgaccagacaaacctgaacaaatcattttccatcttgagtattttatgttccttctccccaggaacaaatccataagtgtcttaaatgtctaagaaaagagagagaggagattcaagaaatccagtcaagagaaaataaaaggatgcaagtcctcctggtaagtcatcaccccttccccaggttcctccccttcctcagggtccagtgtcttcctgaaactgaggcaacatagattatagggctttgaagttattatgagtttaaatcctgactctgacactaactctatgacctcaagcaactctccaacttcagtttacttatctgtaaaatggagagtaaaaatcatcatgacctcattgaattactgtaagcattaaatgagattgtgactgtaaagtagctcagggctgtgcacataatgtgcttttcatacaagacaggaggtagggtgtccccaccacctcctcctacacctcctgtaagccctaccccttttagaagctgcagcagatggtgctgagacaacactgtgagtcttgcttctcgaaatgggatgacaagtgaaaaggaaaccatgacacagttccagatctacctggggacaggggaggaagaggagcagagggagaaggaggaagcaaactttctcttgggcttgcctcctgccccctcagactcaggtgtccaccaagagacaacaggtgatttctgagttcgcacacctgaggaagtttctagaggaacagcagagcatcctcttagcacaattggagagccaggatggggacatcttgaggcaacgggatgaatttgatttgctggttgctggggagatctgccggtttagtgctcttattgaagaactggaggagaagaatgagaggccagcaagggagctcctgacggtgaggcctgaaccggaaccctgccccacctgtgctgtcctgtgactcttgcatctttgtcttgcctaagccatgtctccctgactcacacatctctgtatcccagatgggaggtgggtcagaggaccagaaagtctcaattctagttcatgcttttccaagagttccctggtcactttttgctctctggtctccacctctccgtcccaccatctgccaaatagggaagatactttccttaaatatttcacagggcttttgtgaggatccaacagtaagatggaagtgaaagtagcactttgaaaaagtattaagtaagttgcaaaccattctctataacctaaatgtcaccaaccaccagtcaggaagtttgtcctggtctatttcacttcctcacactggaggagaggtattggggtccccacaaagtattggaaaggcagcatgacttagaatgatgctcttaggactgagaaacaggagaccttggtatgagacttactttgcctccagtgagcaggggaaggtcacttcaccatctttatctaaaaaataaaggctttgggctctgatccacagagatgggtgagtcctaatgctctgtgactctatgcatctggtatccttttcctgtccagggctagaaatatattttgtcttttccagtcataagaaaagtgggaggagcctgggcaacataacaaaaccccatctctacaaaaaaaaaaaaaaaaaaaaagaaaattagccaggcatggtgacaaacacctgtagtcccagctactcaagatgctgaggtaggaggatcccttgagcccaggaggttgagtatgcagtgagccatgatcacgccactgtattccagcctgggcaccagagtgagaccctttctcaaacaaacaaacaagcaaataaaaaataaataaaataaaagtagaaaaagaaaggaaagaaaaatggaaaggagaagctggaaactgaatttctggtatctctttctcctaggacatcagaagcactctaataaggtaagcaatatagtttctctcttttctttttccatataaatatacatacatgtactgcatgcctagttattgccacacaggtatataacattctcacttaaggatacaaatttacatataaacctctatatacccaaatgccttctcaggtatatccatagatgcccaaaaatgggcagtgggattcatcctagaggaagtacgtctgcctgcaggaactagcgccatcatgccctattagaagatgaccagctgagtctggagacattattaaggatgataattcccagacccagccatttctgtgcccctagatgtgaaaccagaaagtgccggaaaccggtggctgtgtcgccagagctgggccagaggattcgggactttccccagcaggccctcccgctgcagagggagatgaagatgtttctgggtaagagaaccccaggcctccacagagcgcaggtggccatgaagcctgggtttaggagtggcctccacgctccactgctgaaaggtgtgactttggcaagccttattccttcctgtgccttgatttccttatttgcagatttttataaaatctgcctattaggatattgtgacaatgaagaaagagaataaaggtgaatatttctggtgaaaaagttaaactgattttaaaataattcaacaaatctgattagtggtcattaagcaatatgaaagataatgattaacaatatatcattcttaataagttaaaaaatcccacagcaacatttgtaatatgtgataagtttttgatgatgaacattgttaattaatagccaacaacagtatttatcttgaccctgtggtatctggctcgtccctccttccttctcactttctttctgttagtctggctcagagttagacggtcctacggggactgtgctccacttccttttccggaacagggagtggtggtagggtgtgggggagggtttggatgagagtcaggaatgggacatggctctctgccaaccacctcctcactaaccatgacagaatgaatgatgacaccaattttgaaatgacccacccacagttatgtcaccctagaaggacttttcccataattccatttcctgcaaatactccagtgacctgtcagtgaaggaaatttcactctaatcaaaggctgacctttgactctccccaaaattatttccaagtggaataataaataaatgaacccatttctctattcactaagcagatatttcttgagcatttactatgtcctgggctctgcgggtacagaggtgagcaaggcagtcatggtccctgtttgatcagggctagggcagtggggctcccaccagcagcagcagctgcattgcccaggaaattgttagaaatacagatgttcagctccaccccagagcacctgaatctgaaacagatgtgttttaacaagagctccagatgattctgatgcaagcttggaaccactggtctagaggattccagcttacattcttcttcttgtcccttccctcttcttggcctcagttttctcatcattaagtgtctgatggttttgtaagactaataaaatctcatcctggtttattttctttacagaaaaactatgctttgagttggactatgagccaggtaaggagcctatgtcaggatgggagagaatgagaagtcctcggaaaggagagaaaattttgcaggatttgcactatgactatgttatgactatgacaatagtcataacaaacacccatggatacatatacacatcatatatattatatatacacatatgtgtgtgtatataatacatgtgtgtatatataggttgtgtgtgtgtgtgtgtcacattgtttgtaaggctctcaggagaaacatgaagaaaggacaagcacatacacatactacattcgtggtatgaagctcacatcctgatctgcgcatgtcgagtagatagaaagattaatgcagaatgggataaagtccatctgggaatgctttctggataaaggggactttgatctgggtttataatcacctctttagaacgtaaggaacccctgcttcctctcagatgtcatttcacagatgacagaaggagggcggcctgtgggtgggaaaaaaatgaacagaatggaccccttcaaggctgtcatttctcaatcaaccagcctaagaccctgggagtcacggagttgttggagggggttctctaacccacagatggacctaaatttatggaagcttctcaatttatgaatactaaaagtaacaaaacgcaaggctctgcagcagtttttggtggtaaaaagtggtcctcagactctgacagtttcagaattactgaggcagagtgaataacccaggggtgagccagagagcctgccaggagggaagactgtaaatgagtcaccagtgccctgggaggaaaacagggaggaatcatgaagtttggactgaagggagaaatgtcgctgcactgtgggatagagatgggaggaggggagaatgtggtatatcagccccaggagatccaagctggcacgcacagctttggaaaccaaccaacttgcggtgagcagaagagctttcccgaggaccacactgaactaaacgagagctttcacatcctctgaggcaggcttttcaggctttacctgtgtgcaaatcacctgggcatcttgttaggatgcagattctgagagcgtatatctaacaagttcccaggtggttccacactgttggcccacgtaggcactatacatgtttttggtaataataacactaacaggaggggcccagggggagtttctatgccttccttggaggtaatagcatgtctgctgacatctgtcccttttggttatccccacagctcacatttctctagaccctcagacttcccaccccaagctcctcttgtccgaggaccaccagcgagctcagttctcctacaaatggcagaactcaccagacaacccccagcgttttgaccgggccacctgtgttctggcccacactggcatcacaggggggagacacacgtgggtggtgagtatagacctggcccatgggggcagctgcaccgtgggcgtggtgagcgaggatgtgcagcggaagggggagcttcggctgcggccagaggagggggtgtgggctgtgaggctggcttggggcttcgtctcggctctgggctccttccccacacggctgaccctgaaggagcagccccggcaggtgagggtgtctcttgactatgaggtgggctgggtgaccttcaccaacgctgtcacccgagagcccatctacaccttcactgcctccttcactaggaaggtcattcccttctttgggctctggggccgagggtccagtttctccctgagctcctgagaaggagcagttacctactctcctctaagtacaggactcatatcaacccaagtaccatgtggacttgatccctggctgaatcacctggatgacttggaatagaaatgactgctttagaagatgggatggggccgggtggtaagggatagaagagaggactctcaatctactgatcaagtcctttccccaatgcccagtggatggccagggtacctggggactcaggctgctgccagttctgctcaccaccatccgtgcttggcacagaagtagctgcatagaaagggcactggatttgaagtcagaagacctgggttcttgaaccagcctgtcaaccagttgtatgactttaaacaaggcatctcacctcttttcatcttgttttcttccaataatgttagagttcatgtaatcacattctctagaaccatttagtttgtgttaactatgaaccaagcagtgtggtggccactggtgacttgaaaatatagagaaaaaaaaaacctgctctatatctgaaagagctcttgggaagacagagaaacataaagaggaaattacagcacagtgtggtgggtgttacgggaagtccaaccccagcattatgggagttcaggggaaggggcatagcccagcctggaaggagagggtgagtgggggatggctttctgaaaagggtggtctaaaggatgcctatggtcaatagggaaaagaggggaagaagcatcttaagaagaggaaacagcagagaactggctggatgacctgtgactctggagcactgggttgtctccattgtcattatgggcagatgtgtgccatccccagccgacgccactcactgcctccttcctcctggtgttgccacttctgggtgagattaaggtgcagggcctgggggcaggaggacataaggtatagccataaatcataacccagggaccacactcaaccctagggaaattgtcttcctgatcagttgattaccatctgaggtcaagaaatgagatagtgggagcaaatgggtcacaaatagctcagctgtgggctcagaaactgctaggtaaaagaattccagaaggaggccagggcataagttggatgacctatgaactttagtctaaagaattgagactaccgtaattgagactactgtagtgacatctgagaaatgggatggaagagtgaccatgttttattttcttgttcttgtcactattgtattttattttgcataatcatgcccttcactgacagtctccttaacatcatctgtttactctgctcagtgtaaactacaatgctctgtcatctccctactgggtctcctgggaggaggggagccatccagggtgcaaactcaaaggcagagggcacagcgtgcttaggcccaagcttagaattcaattgagaagttctgttgttcatccttacctcagcaggtagaaaagaggtggagatcagaagccagggattagagattgaattgctttccctgggagtgtgcagtatctcattaaaatgttgtatattcaaaaaaatacagacacacacaagtgcctatataatgataaaacatatccaaagcacccaaacctgtgattccagaaaagtagatcctatttttgtttatttttattggctttagctgtgtcttttgaaaggactattatcctctaaaatgtatgtgtatgaagatcctggcttgcagctcgggagctttacacaccttgtgtcactttatcttggtaacgagccaagatcatgcaaccagttcatccatgtctgacccaagagctcttaactgctatgctgcactgcctcattcagagatagatgcctgcatgggtcctggcgattattttaatgctggctacacccccacaggtgacttggattcagaaatacaatttatatttcttctttttaaattgttttattttatttttcttttaatagttatatgtcagtgagaacaatttatatgtcttacactgagaaataaaactgctcataagtgaaaacactcatgttggtctgtcagtacctgcttctcccctagggtaattttacttgaagtttacttgctttcggagtatggagtcagcacaggggaagtggatagatcctaaaacctggtaacttcaagataaggcagcttaatgaacctccttgctctgctggccggaagtgggactctgggttccctccccaggaagtgctcaagtctagaggccccagagtcccagctaccctttccgactctgaaggactgttgcacatttgtaacatccacagtttacacctcatttttcaaagcttacatggtagcaaccctttctattgcaaagaactgagacccactcaagttagttcaaatgataggtaagtttattataaaagcagaaataaggaaaatgcgattttccaccatgagccaggccccgtgagaagctatgtcaggcgtgagcgagttggtggggtcaccactcgttcctgtaggaagaactagagattccaaaaatgctgataacaatcacacacatagaacttattttggccaaacaccataataaatatttgtatatattaactcatttaatcctcacaacaacctcaggaggtaggtgcccatcttgtacataagagaactgagacatgtggaggccgagcagctggtctcaaatcagctgatagtaagtcgcagagccagcatttgaagtcttgtggtttggctcccgagtctgtgctcatgaccattatgcagtggtatgttgtatgcccaggacctaccggtaagaagtgggctcgaagtccaaagaagcgtgaagactggatattcctgcggcctctcagcagcatgggtcatggacacctgttccaatacatcgtggctgcacatgcatctctgattctctctgtgtctgctcttcttgccaactaatgacacattcatcatggatcccttctgaatctccgagaggacctgatggtttcagttaattactattgtccctctttgataaggtcttccttgacaggtgacctcatagacttgtttggccaattatctgctgttcagactcccacccctggcctgatcatctgtggtgacgtcagaagggaccaaggggggcctggaaggcatcttcagtataactgaattctctcctgaggagagaccctgggggctgtcagtctcctcctactcctagtacaagttctcttggtgacattaactccatctgggatgcagaaattgctagctgtcactttcaggggtgttctttccttggctaatgtcttgctcttagatttgggatcttatgtttctctgagatctgcagcttcttgccaaataactataccttttttctgaacatctgcactaggctctttctcctcccctctccttccagcccccaactctctgtcccagtccttcttgtgcaaacgatccagactggctttcattaaacaccacttctcccttcattcctgactcagaaacctcactatgtcttggtgtcatccatttagcctgttgacttctcgtcttccccattcctgaacattccagcctaaccaggttggtttcctcacactcctacaaaggtaccgtggctttttcctacctctatgctttcattcatgtggttattgtgacctagaatgttctcaccttcctctcccacttgtccaatccccacctcccccacaaaacctaccctgactttcccaggctcgctgtttctttcctctgaattcccagggcacttagcctctgtgatacctaattcagtgcagttacacgctctcttcttattctgtagctgtttagtcatagttccacagctaaattataaacttctggatggtgaagtggaatttatttaaaatttttttatcattccatatttcatttcaaaaggggaagtggtttttttaaaaaaagatgaaatgaaaaaggatgagttcatgtcctttttagggacatggttgaagctggaaaccatcattctcagcaaactatcgcaaggacagaaaaccaaacaccgcatgttctcactcattggtgggaattgaacaatgagatcacttggacacagggtggggaacatcacacaccagggcctgttttggggtggggggaggggggagggatagcattaggagaaatacccaatgtaaatgacaagttaatgggtgcagcacaccaacatggcacatgtatacatatgtaacaaacctgcacattgtgcacatgtaccctagaacttaaagtataatttaaaaaaaataacaataaagccagaatacaccaaaaaaaaaaaaaagataaaatgaacatatttgaatgtttacgttttagacactttagcagacactcagcatgtatttaattttgacaacaatcccaggccacaggtaccataacccttattttagaggggggagtacagaggttcagagaggctaagtaatttgcccaaggttacagaggcattaggtgtcaggaccgagacctaaactcaagtctgaccctgtagttttcactctttgcaccaccacgtggcttgttttataattgtggccatgttttattccttatacctctcagtatggtattgactactttggcaaaggctcaataaatactgattataaggtaattgatggctctttttaatcagaggattgagaagagcccttccttatgctttcttattagttcacttatacatacatttaaaattttactggacaccagctatgagccagacactgttctagacatgaggacacagacagaatatgatccctgctcacccaaagaagtgaggcttatacaaaaatgactaatatacaattgtattcattatccattactccacaaaaattaccacaaatttactgccttataacaacacatggccaggcgcggtggctcacacctgtaatcccagcattttgggaggccaaggtgggctgatcacctgaggtcagaagttcaaggccagcctggccaacatggttaaaccctgtctctactaaaaacacaaaaaattagccgggtgtggtggcgggcgcctataatccctagctattagggaggctgaggcaggagaattgcttgaacctaggagacagaggttacagtgagccgacatcacaccaccgcactccagcctgggcaacagagtgagactccatctcaaaaacgaaaacagaaaacaaaaaaacacacacacatttattgtcacactgtttctgtgggtgggaaattttggcacagcttcactgggtcctcagcttaggtactcacaagactataatcaaggtgttggctggactaggttcttatccggctcagttggggaagaatctgcttccaagctcactcgggttgttggcagaattcaggttcttgcagccacaagactgagggcctctgcttgttgttggctggaagctgctcttggctcctaggaggggctctaaaagggtgggccagcaaggaggagttctatacaatgcaacacagttgccagagtgacaccctatcacctttgccttattccattcattagaagcaagtcacagatcccacttacactcaaggggaggggaccaaacaagggcatgaattccaagaggtgaggatcacgaagggaggctgtctttgagtctgtcttccacaacaataataaataagtgccaggtgagtggtacagacaacaagtactgcaggaactcagctgggctccacatgtgaggtggtgtcactgctgatgagctcgggccattcagaggcctggaggatcctatttgaatgagattgtgagagatgggcactaccatcagtttacaggcaaaatggagatttcacaaatgctcctggagaccatgggccccgacctccacagtggcagccccaagcatgagcctgtcctggaaggaggctggctatcgtccaagagtcagagggtcaggcatcaggtgatgactgtggacatgaagaaatggtgacatgttcaggagctggcaggcccgaagatgcactgggtagacccagtgggggcctggacaggttggaggaaggagagagaggaggctgaggtgagcctgaagtgaggtgtcccagggatgaacaggtcagagcttctgagggggctgaagaagcaattcactgactcctttctccaactggggataaataacctctaatttctgtggagcactcctagaaacaaagaaatctttcatagattaatatgtattcatatattccattggctcttccattggccatgtagcatcaagatacaaaagctaacggagcagtgggtctccttgacctctgtgcatgtctgtgttgtgtgggtttatatgcacatgtgggaaagaagaagggacagctcgtacctgttcagtaagtcaccagcattctaggagagagaaaaagtgagaatcataattggttctcaggttcctatcacctccaaattcctttcccaattcactcttggaggccactctggggtgccaccttgagaactgggggaacatagcaacacccctcttctgtgcccattctgctgcagcagcactctgtagcctggaacaagccacatctaccacaagtcaccacatatcacacaggcccctccctcttacacctcccagaagggtgatgcagatgggctgcctcctatcggggagaatcccagcccttggggaaggcctcagggtatgcaccttcagtgtgttggtgtctaattccttggccgtcctttccagatcaatgaccaggcttctgagctgtgttactgccctggagatgtcaaggattctggccgcttctgctggcatgtgctccagctggcccagccactgctgagggagggcacccagctgttccctggtttggtgctggctctccggcccagcctccagcctgtggttcccgtggtctacctgaaactacaggaaaggggctccctaagactcagtgtcaggtggctccctcctggcccttcacagtctctgaatgtctgagcaggaatgctgattcctcagtcctcttgccctcatggtgttgcctctgtgtgtcacaggtatagcagaagcagctttgattctcataaaggcagggacacctcacctttccacctcactctctgaatatctacagatgccatgtgaccaagaggaatagaaaggtagactgtcagagacagaaatggaggcctatggcggccgggcacggtggctcacacctgtaatcccagcactttgggaggccaaggcgggcggatcacgaggtcaggagatcgagaccaacctggctaacatggtgaaaccccatctctactaaaatatagaaaaaattagctgggcgtggtggcaagtgcctgtagtcccagtactcgggaggctgaggcaggagaatggcgtgaacccgggaggcggagcttgcagtgagcggagttcgtgccactgcactccagcctgggcgacagagcaaggctccatctcaaaaaaaaaataaaataaaataaaaagaaacagaggcctatggcttgtgtagtaattttcagttgacgagacactggtctcctttgatccctactgtgatccaggcagagcaggactggttctcatttaacatgtaagtcacataaagatcagagggcttaacttgcgtaggtcactcaaccagcaaactttgacgccaaggccaacacccgggttttcagcctccacgaccatctgcccacatcaggctgttccagggacagacagatgtccagaatagttaagtaagggctcctgagaacactccagggagtccttcccaggaacccgaaaaacccacctgcagagcctgcagtttcttctcctgctgagccttgagccgctgaagttctgcaatgtcctttctgagcttcctgctccggcgattgagtcgttcctaaagagacagacacacctgcttgtcagactgggagtgaggggggcacccactgggaggagtcaatggaacacggtagggggcctgatcccagaatgcaactaatgtaaaattctgcctaaaaagaaatgcttttagagcatcatggttggagtaagggacttgagagtttatttattggataatgatggggggaaatagtaatgggtaatttttttacagtcttagaagtacagaaaaaataatagatagcaacagaaccatttctacttgacttcagggtgctttctctcaacatacaaaagttatatgacagtcttctagcacttcttactattttacagtaacacatggagccagtctggagggaattgccttaaagaggaaatggcaaccctctgctacctctgctgcctggtcctcactgggatgagtgacaagatagagccctttactaggtgcaaactcatagcccaggtaggcagtgccttctctctcaatcttaaatcagcatctggatgtgtcgctgtgtccttgaagctatggagttaaagaatgatttgagtttctaaaaaaattttgctttcaggtttttgatgacctataagagaagcaaaaataacaacaaatgctttaaatggctgcccatggttcggggggcagttggagggtgaatgataaaatagaaaacaaaacgagaagagatttgtgaactaaagatcaggatgtgctattagctgaaaagtgtgtgtttcactaaatctttcccacttcagatttttttttttttaatcttttttgaggagattttggagatgtacaggtagaagtcaggggatggtgaagacaactgaaagttctttccagcctgagaatttcctggtgaaatcaaggtcaaaggactgtgtgtgtgaggggtcagcaagggcatttggtgaacagaaagctgcagtaagcagagaagacagtgatgtcatcacaaagttactaaaaacgtgtcacgtcactgggtgtttcctgcaggcatttcccagcagagacgaaataaaaaagtcataggagtgggaagtaataaatgggcatcatggatgtcgctcatgagtctcgctgaagaaggtggcaggctggtgtggaactgtttgtgcgagcacaagagttcatgtcctgaaaagcacaaacagccttcaccgcttgcatctactcacttgctgccctcacagtcaagttgtttggtgttgctgtcttcacctcctcactgtcgtcattcctcagccagccgccttgtttctcatcactcctttaaagcctctctctccaaagtcacctgagatctccagccatgaaatccgcaggtgcctttctgtacctcctctccaccccatccttcctagacctgtgccttctgccactgcttctttgcctcttcatttttttctgtaaaaaggagccttgaagttggctcctcaacccttttctatctcagactatgtccttagctttcctttctggagccttcagatcttagaattccaaaaccaaatcttttttcctagcaatccatctcatgcttccaagtgagagctaagtgctgcctactgccctgttggcagctcaaaatcaatatggtagaatcaaacatgctgcccagttccccaagctcttctgcagtccactcctcttgaccttcatgtttctgacattgggactgccattctgcctgccattcagcttgaaatctgtcacatttcacctttgttgatgttagtcctcccttcaaaatggcttctcagcaacaaagataagcccaaactccttcacccagcatccaaggtgccccaggacccagccccaactgacattgtccgggattctctctctgctcactgaactctcttcaccagcacacaacattgctctctgcttcccaaacacacccgtgcagccacacctcctcatggccttttacttctctctgtcaggagtgctttatttttctgcctgtcaaagtcaggcctattaaggtccagttcaaaaagccacagtcctatcatctggcagtttaaaatttaataaagccaactacagacactgtgtaaatgaaaaaaagaaggcaaagataacagtaataaagataaaggcatagaatgactgaagataatactgtcatattgtttacaatattcaaaatgagtaaggtaaagtcctctgtttctaaaaagtactttttcaccaatttttgcataaaggtatttaatgggtgcatataatataaataagacactcattagaattgaaaagctaaattctatacactttcacctaccaaaatattcctcagagaaaaaaagacaagttgaaatctagaaaatagtcgaagacctgtcttgtctaaatgaatattttaaaattctgtcattcaggttaaatcatattaaatttttaaaatctgacaaaaaagggcattaaatttgttcttaaacaacttgctaacacaatgtacaaaagaaaagtggttaacagacaaaaagtacctatccctgacactgaaaaaaaaaaaaaaaaagaaaaattaacagctttcaaaatgcatgctccttacagaactgtgtccaaaaatatgaattaaaaacaacatcactcacacaattatgatctagaaaatgtcagaaaatttttaaaaatgtatggtaaatacatgagctcagcaaagaatctcatttgaatctacaagtaaaaattgtcaaaaaaaatagtgttgtaaaatacatagctaccctcaatagagtcagggcacatgaggtttaagtaaagacaatttaatatctgattcagatacatagtggaaagccgttagtgatgtatcttggtactggttgagaagactaactaaacccccaaaagtcatgattcttagtaatcaacaaatttaatgcaataaccattaaaatcttatggaatgatctatgaaatttagaaacattgtaaaaaagcactcatcttaaaagacagcaaaaatatcaggtaataaaattattaaatggcaaaaatgctgctagatttaaaaataaaccataaagtaacatgttgtcaaaactatataacagaaagaataatcaatggactagagtaaaaaaaaaacagcccatcatgagaacttaattgatgtcaagcgagaaacaacacgtaaatgtggaaaggactcactgttatataaatattttgggaacaactggataccagaataaagaaaaattaacgtggagtcatccttcacacaacatactatatgaaattccaagtaagccaggaattaataaacctttaaaaataaaacagagcagcacactcatattaaacaaatttctgtgtatttaagacatggagattatattataaaaaagaatagagccaatttaaatgcaaatttctaaaaagttgcccaaaaatataattaagaagaaataacagaataaaaaaatgtaggttaaacaaacacaactaatggagctcattatccaaaagataaactattttgatgcaatcatgtagaatttatgccctgattctaggggaaaatgcagacagcgagtcttcatggataaaagcctcaccactactagcattcataatcaagcaaagtaaaacaacgtacatcactgtcacacacttactaaaccagcaaaatacattaaagtgattgacactgacattgactggtcagtgaggaaacaggtatacaaataagaatttgtagattttataaatttttcggtctttttagagtacagtcagggattatatgattcttttaaaagaacaaaatttacaatacttaactacaaagtttaattcaaataaatagagatatggtgaaaaaatcagtaaaaaaaaaccctccttaatttcaaaattacgctgtcaatatccatgagtacacataaggtccaccattataatcacttcttcagaaatatactcaactcccttaccctccctctctgtgttacttttcagacaactccttatccatggtaaaatgtaccatcaccttcttgtttgctgtctgtcctcaggcagcctcctgaaacatgttaaacatttcagacctcaaattggtgctacatactgtctgccaaccctacatagtttctcttgtaagcgctctcccacactgcatcacaccatcttgtttcttttcaaacctttcacatccatcctgatcccacccatactgctgatgttccttcctcaaatattatgagaaaataaaaaccagaacaaaacctggatttccaaaactgcaaaactatgtaggcttgcagacaccttctcttgttccctgttattactatggaagaagtgtgcctcctcccaactcagctctcatgcctctgccaccatcttactgaagtgttagcattgttcaatgcaatctattataatctcttaaaatacccttctctcttagcagctggggcaccattccccttgtttttctcctgcctttctggcaactcatcctgtctcctttgctgggtcctcctctgcctacatctaaatgacggcctttcccagaaccttaccccaaaacttctttttctgtctagcctcttttgaggcaattacatcagtttccttggtttcttggttgtttgtttctttgtttgagacagggtcttgctctgtcttcctggctgcagtgcagtggcacaatcacagctcactccagcctcactctcttgggctcaagcaatcctcccacctcaaccttccaagtagctgggaccacaggcgtgagccactgcacccagccccaaattgtcacgttcttttttttaaatcctgttaatttcactttgttgttgctgttgttgttctagagatagtatctcactgtgttgcctaagctggtcttgaactcctgggctcaagcgatcctcccactttggcctcccaaagtgctgggactacaggtgtgagccaccgtgcccgcttttcttggatttaaatattgtctttgcctggatggatctttgttctaggttctaggaataagactctggagatctaaatttgtgatccagctgcgtatgtaagatcctattttgatgtgtctcaacttggactcaacttgtcttaaatgaaactcttggtgttgcattcaaacctgttctaccaagttattatctttcacatcatctattcagtttctcaaaccagaaactcatgaagtcatctttgaccttcctccttccttcaacccactttttaaaatatatatactttaagttctggggcacatggacagaacatgcaggtttgttacataggtatacacgtgccatggtggtttgctgcacccatcaaaccgtcatccacgttaggtatttctcctaatgctatccctcccctaccccccatcccctcacaggccctggtgtgtgatattcccctccctgtgtccacgtgttctcattgttcaactctcacttacgagtgagaacatgtggtgtttggttttctgatcttgtgttagtttgctgagaatgatggtttccatcttcatccacgtccctgtaaaggacgtgaactcatctgtttttatggctgcatagtattccatggtgtatatgtgccatattttctttatccagtctatcgttgatgggcatttgggttggttccaagtctttgctattgtgaaccatgccacaataaacatacgtgtgcatgtgtctttatagtagaatgatttataatcctttgggtatatacccagtaatgggattgctgggtcaaatggtatttctggttttagatccttgaggaatcaccacactgtcttccacaatggttgaactaatttacactcccaccaacagtgtaaaagcgttcctatttctccacttcgtctccagaatctgttgtttactgactttttaatgattgccattctaactggcagagatggtatctcattgtggttttgatttgcatttctctaaagaccagtgatgatgagcattttttcatatgtctgttggttgcataaatgtcttcttttgagaagcgtctgttcatatcctttgcccactttttgatggggttgtttttttcttacaaagaacccacttctaatctctcagtaagtcctgtcgattcaaactctaatgataaattcttcaaatataacaagacttctcaggtgtgggcatctgtatgcactccctaccccctgtctttgcaggttgatttctcttctgccagccctcagcttcaaggtcacttcctctatgaggccctcactgaccaaatggacatgggccacccattactgttcatcccagacccttgtttattttcttcctaactaataaaaagttacagttcttttgggaggccagcgcagatggatcatgaggtcaggagttcaagaccagcctggccaagatggtgaaaccctgtttctactaaaaatacaaaaattagctaggcctggtggtgggtgcctgtaatcccagctactcgggaggctgaggcaaagaattgcttgaacctgggagacggaggttgcagtgagccgagatcatgccactgctctccagcttgggtgacagaatgagactccatctcaaaaaaaaaaaaaaaaaaaagaaaaaaaagttacagttctttgattacttatttgtgtctcccttactacactgcaaactcctggcagaaggaatggcatctgtcttcattgattcctagcacatgctgcagtttctcacacacagcaggaacttactaagtttttacttaatgaacaagtgtcatcgttatttatttgttttagctttcttgtcattatttaaagacagatttgaaacaagaattatgaatcatctttgtactttctacaatgcctagcatgacatctaacacaaaggacagacctgaaaaaatcatttagtgaggaaataaatttctccatcttatgctgcttcatcggcaggtgaggaatccctccccactctcctgtggacattgcacctggagggaatgatgttagaaccaaatagaactttgcctctggctttttcaattatttctctacctttctgtagtcacttttaatctggactccccactttctcattctgtatcataacatgttctccaaaagtcaagtatctcaaagctacctcagctttggaagttcagccttcactattggatagaaggatgccatgtgaaaatattgtcaattgtccagtcaaatactaactggattagggtcaggggaaaggttgataaaaataattccaaagctaattggcaaaataaagatatacaaatatctgcacgaattctgaaaaataagagtattgtgaggattctatcaaaatacctgacattaaaatatatggtaaggataaaatctctaaaataccttggcttataggcaagcatagacagaatagaacagcataaagaatcaaggcagtatgcaagaaaatatgcatatatggtatattatgacattggcattcaaatcaatggggaaactatatgaatcattcaacaaatggtgataggacaaattgattataacttggaaaaactaaagttagatttctaccttatgctctcaccaaaatatatcttggatattctaggtcctccaatatatatgttgaaggatattcattagaacgttctgtgtaatcttaaaacaaaacaatagcttggaaatgacccaatgtctgccaatttatggtacattcatagaatttaataccacacagttcttgaaaataattcagaagatctatacatgctgatgagaaaatgttcaagccacacttttagataacaaaaatgagttacagaaaaaaatatagagagaatcctttgagggtgtgtgtgtgtgtgtgtgtgtgtgtgtaagagtgcattcataagcacacacattttttggaaggatgtacaaaaatcaaacaatggttacctctgaggactatgaatggagggagaaaggaagacaagtttttagtcttgactttatacctttcagtgctttctgaatttattacctacagcatgtaacttttgtgatagaaaatttaacagaataagataaaataattgccatagcaaagaaaggaaaaggaaagataagacaaatgcagaaggaagaaaaagagagaaaaaattatgtagtaactttcaggttttaatatattttcaggataattactagtgtatataaaacctgattacatttctagccaagtttctagtactatcaaccaggagttcacacagttttagtcctgaaagggttttgcattagttagtccaattactctattctacagatgagcagactgggactctaacatcacactgacaatatcctcttttagacagactcacattaatgcatggaaacatcagcctcaaaatatacacagaaaagcaagacaagggtccaaaacaggatgaagcagaagaaacaaagagagatgtccattgttgagctactctgaggtgccaggcatgatgaacatgtaggatgcagcacctcagcgaggtggaggcagggcctggctgcggtgacccaggcttaccttgtagtggctgagggcattttcaatggtcagttcatgatgagacatgtgttcaggggacaccaggcattccacacatagaagaagtctgctctcctcacagaacctgcacaccctcttctggtggttggggcagatatagcctgtccctagcacctcctcagaacagggcttccggcagagggggcagcagaagaccccagaggctgaggccttctccacatgctgtgtcaggcacactcgacagaagagatgtccgcagttggtgctcacggcctccttcaggctctcctggcagatggggcagacaccctcctcctggttgtccttctgcaaagggatcatggcctcgttcctaccctgtcagcctcctgtttgcagggcctccttcttcactggtcttcggaaggcctgttgccctcaacagtcccagataagaaggcccagtcggaaggaggcagccctggagcagcctggggacaggacacagcctccaagttcaggcaattgcccactctccctcaagggtgccgtgacatagaccacacaaaccacaattctgcacgagtttcagaaatagctcatcagctttgacatggaccctgcggtttccttgtgtttgttaaacttgaaattatttttcatacacctagaggaagcaagtgattcaataaccaattctgttttcctcttgacagctttcagtgaatatttgcacgggccccaaattaaaagggcaaggtgtcattgtcatggccaaaagccagaccactataaacttacaatttgagtctcctctgatttgccatcagtagagagagtttggcaggagtttggactgttttctcctacactgtcacaccgggtggctcactgctgcccattattaccaccaataattacagcagcatctccatcagctggtcattcttccaaccaacatccctcccagggtcatatagattccacactgaaagaatgagaaagaaaacaggacacagaacagactagagacttgtataatgtttgaagccactttgttccttcctgtcaaatcaccaccaaagatgacccaaagaaagaagtcccccgccacctgccacctcccttagatactgaggattcactcttattccctcatgctgcacctcttgcctagccccactcctgaaaagctttcttagtatcctacctcaatttctcctgctacaatttcagatcatcttctctggctccagacctggagagatggccagcagatgagtggttcttatatcatgccaatcatatgtgttcatatgtcagtaaatctcagggcggggggtggaaagactcatgctttcctagaaacactgaattaccaggaaaattacctagggtagctggaaggtgagatggactttggtgcagggcgtggcttgtttgctcaaggggaggaggaaggtcttgggcctttgacgtcgatatgacaggaaatgagactcaactaagaatggacatcctagaaccccagcttatggaaccccaggatccaggtgtcacagaataatggcacccactcaagatgctggaacatcaaatgcccactccattgtctaagttccctccagtcaggctagtcttggcattgagtttgagggagcccctaaggggtgccactaataagggctgtcacttgaaacttctaagggtccaagacgcttgttgaaaacctcatttcagagcctcctccctcaatcccactttgccactgtttgctgtgggttgtgtgatcttgtgagatatatatataattagtcttggcacagagctcctaaaacccttgaacagatgatccttaacttatgatggggttacgtcccagtgaattcactgaagtcagaaatattgtaaggtgaaagtgtactcaataccccagtaaacccatcataaagtcaaaaattttaagttgaatcatcttaattcctgatgcacctcaacttaccacatggttatgttctgatgagtgtatcttttattattcataataagcccttttcaaccataccagggtttatgctaatgaggtgactcttggaggaagaatgggggctggttggcagaagaaccatgtgattagagggtgggatctttctttctttctttcttttttttttttttttttttgagacagagtttcactcttgttgcccaagctggagtgcaacggcactatctcagctcactgcaacctctgcctcccaggttccagcgaatctcctgcctcagcctcccgagtagctgggattacaggtgcacaccaccatgcccagctaatattttgtatttttagtagagacggggtttcaccatgttggccaggctggtctcgaactcctgacctcaggttacctgcctgccttggcctcccaaaatgctgggattacaggcgtgaaccaccacgcctggctggttggaactttcagtctcacctctgacctctggggaggggagaggagcccagggactgagttaatcaccaacagccagtgatttgatcaatcatacctaaataatggaacctctgtaagatcctgaacaaagaggtttggagagattccaggttggtgagtgcatccacatgctgggagggtggcacatcccacactccaccggggacagaagctcctgtgctcaggatcctcccagaacttgcccttcatctggctgtgaaattaccatgatcctggtgatttcaaagactatgtacatgatcatttaacaccaaggcctttcagttcttgtcctgctcacatccaatgacctttgcttttgccacccaccctagtggccactctcttgaccttgtca

SEQ ID NO: 12235 - DNA, 23187 bp, Human
acgtaggcaaaggctatgtcattaattctcaaatgagattcgtccaagcgggaaatgcacatctagtgcagtagttttaggccagcctttttcagagcctcaggctctgcctgtcaccttgaagacatccatgtgggtcccctcagggcttctctttgccataaaaataaaatgattgctcccaccaatgtttgcgtccatgggagaggaggtaggagcagcagtacttgtcctgtgtgtgggagacacttgaagggctcagtgggaattgtcagcagcagggaacagaacaggtggtgagaagagtcattccactgagtttctgggcctttgactccctgaaacttccttctcctctatccaacctccctctccagaaaaaaaaaaaaataatttaaaaatggaatcagtgtaatcagtgaagtagctgtattccagtgaacaagcagcctgcccttgcatctgcatgcatgcagccttggcgttttctctagaaaaaagagaggttctacctcgtgcatgaatacaggtggaggccaagaccagcattaacaaaggctgtgtgtttgccatggagctcaggagggctaacagtcattttacttctgcctccgaccatcacactttgtccccagaacaaagccaagagtccttggtcaatgaaagtgtgtaaatatcctcacacttcccctagtagttcctttttaggctgtaatcatgtgctaaagaaaagaacctaacttcttaaaatctttccctttttggatgtagattgaaatttttgttttaaacacaatggccctaatgtctaaatctaatgttagtaattaatccctagtgctttaaggatcttctgtttataggcagttattttatggagctggtctctgtgagaggcacagactgccaggaggggttgagatttcctttaaccaggattcttagttctgaatggctctagtgaataacattaacaatgattctctggccgggcactcacgccggtaatcccagcactttgggaggcctagacgggtggatcacttgaggtcaggagttcaagaccagcctggccaacatggtgaaaccccgtctctactaaaaatacaaaaattagccgggcatggtggcagccgcctgtaatcccagctacttggtaggctgaggcaggagaattgcttgaacctgggaggcggaggttgcactgagcccacagtgcgccactgcactacagtctggatgacaagcaaagctcaatctcaaaacaataatttttaaagtaatgattatcttaaccattcttaaatccttctgtctagtaggaatcttattcatgggagtgtctggaaaagggacaaagagcggctattgagatttttttaaagcctggatttgggatgtctgaacagtgaataactccaaagccatttaaaaatcatctttttttctaccaccggactgagcttttcagttttaattccaaggttccaatcatatagatgtgagtcaaaccctgttgggccaaacaggatctcctttgttggcggataatttcaagtgctcacagagaccctccgtttttttttaaatacctggacttaattgtttaaactggagtccggaccaaaacatctctgacctcgggggtcttcctttggtcaggaagaggggagggagcaattggacccctttccctctgcggctgcagagtccaattttcctctggggacatttgctttttcccttggggaagacagtacggattctagttctgtggactcttttacttagctttgagacccaagcaagttaattggcttgtgcctcttattttactctaatgcaatgaataaagacagtcccagccttcgccctaagggagcaggagcacctgcgatgccccgttcccaagtcctcagggcgaatccgccaaatgtgcgagctgggcagcccacccctttcagctgctggccggaagcggaagtgggcgtccgtcgcctcgccatctcccatagctgtcgcctgcagctgagaaagggttgctgtcccagcaggccaggtccaggtgcgccccactagtgaggccggcggaatcgggagggaaggggtcaagggcacagtgcgcagccccggctgctccagaccttgcctgcagcttcccgccccagcctccggctatcgcggcgtttcttctcagaggccgccggctttggttcctcccggcactgctgggcttggggctgccattccgggcattggttcccgggaggaggcaagtgggttcatgtggtcagagtgcgtcggcggggccttttctccactttctgtacccttctctttaaacgtcgtccccagtaggagactattttttctcaagaaaatgctctcttggacctcactttccgttgttagaaggcatatcttgggatgcgcgttattggtttgtggagatcgtccctttttttcccctctgttatgtggatgcaccctagtgcctgatacacatttgagttcctatctgagtgggcttgtgcatgttttttcgtatttgtggacttaggtcttcaaggtttatttttgaaagtcaagttgttgggtcaaagcataaatgaatgtgtaattcctaggtatgaccagatccccctctatgggacttgtgcttttttgagccctcagggtgtgttttgtatgcagcaagcagcagaccttagttttcagtttacctgtagtttcttttggatgtttacatattgacatatcgtttatgaataagaactttattctccctttataatcctattacgacccactcctgccctacaaatttactgccctgcctacgacctccgaaacattagaaggagcaatccttgctgccttccaggtctcagaaagaaagctttcagcttgtcactacttacatgtttgctatgtgtttttgatagattaaagacattcccttctgtaacagctttattgacataaaatcatatatttcatctcatttaaagtgtataaatcagtggtttttagtatattgagttgtgcaaccatgactacaatctaactctagaacattttcattgccccaaaagagaatcccatactcatcagcagttactcccccatggttggcaagtttttgggctctattcttgagtttttttatgttgtcatacaccaggtcagattgatttaggtaaaaacaacactcttcatttaagaatatacagatgttctccttttccagcagtaagtcaaggcctcggcggttttggaggacaactgcagctagagtcaacttgggcctggaggactgatgaagtttgtgatatgactgtgatgctagcagagaattcattagagagactatggaaggtcctgacagaggttgaaatgcctgctattccagtaccgagagcaatagtggaggcagaaagtcttaaactgacaagggaattagtggaataactctttttgtcgtgtcggtgtcatgaggggaacagggagctcttcagtcctatttgcaaattgcattttgagagtaaggaaaactagtgtgcatgtgcctgtccaattagcaggtagacacatgtaggtagaggatccacagaggaaaaagagaccttgtgcgaggcaaaactggagatgcaaagtaaaaagatgaggagtgctgaaaggggtgtcttgtacttagaatcctagggatccagctagggcggcagtcgtcagaggttgtaatggggactgatgaggtaattgcgtcgagggggaggttcgattttcatggtgtatgagaaaacgtcgagtatctacaagcaacctttcactgttattttcagggctgggtataagtaagcaagaagagggcctgggagaagagtctgacgagcaaggggaaggtagccaaggatggagtgaaatacagggtaagtgtcttcctaagcaataattactgctaatgtttttaagtttgccactactgatagagggcttgtctgtaatatggagctggaaggctccaattgtttcagtgatgtgtgtagttgggctttggagatgaagagtaaaggaacatcgagaaggtgaaagtttacctaggggaattccagtgggtctttgctgagagatacataaaggagctgccacaggaatagtagtttgtgttgtgagaggtctaaatatggggggagtagagttgatataaggaggaaggttttaggtctttaagaacacaggctaagggagaagggggaatggagggcagaagcttgcccatagtgaaggaggcaagcccagaaaaaagagagagtagagacatggagagaaggggtgggggcttcttgtcctccagaaaagcagagaaggggtagagacacagagagaagggaccggggggttcttgcaccccagaaaagtggagaagggctagagatatggagagaagggttcaggggttcttgacccccagaaaagcggagaagggtagacacatggagagaagggggtcagggggttcttgcccccagaaaagcagtacttgccgctaagggtgaaggaccaaggcaggcatccccacgtggtcagacacctctgaaatgtgggtgaataatcaggcaggcgtccccgcatgattaaacaccaagggaagactgtcttcccgagtccatgaccggcgccggagttttgggtccatggataaaacacgtctcctgtctacgagaaaaggaaaggaactgaaattgagagaagggagagattgaagtgtggcgccaagattgaaatgagaaagaggttgagggatagtaagagaggttggagaagagagtaaaaagaggccacttacctgatttaaaattggattgatgttccttggctggtcggtctgaggacctgaggtcataggtggatctttctcacagagcaaagagcaggaggataggggattgatctcccaagggaggtccccagatctgagtcacagcaccaaatctacctctgtcgccaggctagagtgcagtggcgcaatctcggctcactgcaacctctgcctcccgggttcaagtgattctcctgcctcagcctcccaagtagctaggattacaggcatgctccaccacacccggctaatttttgtatttttagtagagacgttctttcaccatgttggccagagtggtctggatctcctgacctcgtgatgcgcccaccttggcttcccaaagtgctgggactacaggcgtgagccaccgtgcctagcctcattcctttttttaatgagacaaggtctttctctgtcacccaggctggagtgccgtggtgccctcgacctccctagctcggccttccaccttagcctcccgagtaggtaggaccacaggtgtgggccaccaagcctggctatttttttaaatttttggtagagatgagatctcactgtgttaccaggctggtctgaactcctgggttaatgtgatccacccactacagcctccctaagtgctgaggattacaggcatgagtcaccatgcctggccttcattttctattgtcaaatgatagtccattgtatggatataccacattttcatttatccgttcatcggtagatagacatttgggttgtttctcctttttggctaatatgaataatgctgctgtgaatatttctcttgggtatatacctaggagtggaatgccttgttcatgagacgaacttttatgtttaatcttctggtaaaatgctaggctgtttgccaacgtggcagcaccacttcccacttcactcccctccacaaaaaaacaagagaatttctccacatcctcatccacacttgtctttttaattacactcaccttaatgtgtgaagtggtatcttaatgtggttttgatttgcatttccctggtgtctaatgatgttcagcatcttttcatgtgcagttgacctttttatctttagaaaaatgtacattcagatcatttgcccatctttgaattgtgttttcaaaagtcagctgaggctgggcgtggtggctcacgcctgtaatcccagcactttgggaggcccaggcgggcggatcatgaggtcagcagatcaagaccatcctggctaacacggtgaaaccccgtctctactaaaaatacaaaaacatagctgggtgtggtggcacgcgtctgtagtcccagctacttgggaggctgaggcaggagaatcacctgaacctggcgaggttgcagtgagcagagatcgcaccactgcactccagcctgggaaacagaccaagagtgtctcaaaaaaaaaataaaaataaaaataaataagctggctgaattaaattcagcccgaaagttttcaggttgaaaaaatttatttttgaaatcattatgtgatactggtttttatcactttgagttgatcatacaatttttcttttgctctattaatgaagcaaattatattgattttctaatagcaagcatctcttgcattcctctggtaaacctaacttaattctgttgtactatatttcctatttattgacattttttgtttggacttattttccttagaatatctgaatctatgttgaaatttgcctataattttgtttacttaaagtggccttgtcatgtttgatatcagtatgccaatctcaaagaatattcttccttttatactcttaatcacggtaatccctttgataagttaaactgttttgtgaaattagtttaaaagtgaccatatttttttcccttgtaatattgtaaactgctgttaatagaataaccaaaggcaaacatgacattttgaaccatacacaattctggggtttgcataaaggctatattaaataaaaccttccagatacccagctcttgcctatagagtggataagttatctatacctgaaataatgcaaacattagtgacaaattacattgaagtgtagtttaagtaaccagtcttcataaatatgcctaatctctggaatattttcatccagactggaattctttcttctttgagtggcataactgactgataaagcctttgagcatggtgttttttggtgaaaacctaaataatctagttttgttttctgttttaaaagaatatctgggcagtgagttaagctgggaagacctagcaccttgctgacgggatcagtctagattcttcttttatattttttaaattgtggtaaaatacctaaagccaaatttgccattttaatcatttttaaatgtacaagtcagtggcattcattgcattcacagtgttactcaaccatcaccagctagttctttttattgtaatttctacacagttttggtaagttgtatttctgtaggaatcaatttatttcctgaaagttttgaatttgattaaagttattcatgtcttgttaatctctgcaacatttgtagttgtgtttttctccttttgtctttgaagaattttgcccgatttttttcctagtagttttcaaagaaccagtttgtagcttgagtgatactgttgttttctagttcatcatcgtattttctgctcttcccgttccagctgcttaagttaatttttaagttcacttcttttctaatataaacatataaagcttatttttttcctaaggaccagtttagctacattctacaagttgtggtacttagaactaatcaataaccatagtattatgtattttctaattcaattcttttataaaagcataagttatttggaagtgtgatgttttctgaattccaaatgtgttacttttttctgtttgcttgaaaaatatgaaaccactaatattcaaccatattttaaaactaccaaaacacccatttcatatagttcaatgtaatctcgttattaacttacaacttagttacattgtaattaagacatgtcagagaacatgtttgtataccaaatctttttctaagttttaatttttgtgggcacatagtaggtatatatatttaaggggcccatgagatgttttatataccaaatttggaaggtttaagactggctttacagtatattcaccatacagtatggtcagtttttataaacacttcatgtgtgcttcaagaatctatgtatactccatacattcagtagtgtccctcagtgtgctagattaagcatactcattgtgttgttcaaatcttcatatcctttttttcatatgatctttctattgctgagcagtgtttgaaagtcttatagtgatgatttgtgttatttatcctttaattgtgctagcttctgctttataagttttatgagactagaattttatatcttcctaattggtactttacatcctcatgtcattacctctaatagtgccttttgtctcaaaatctatgaaattaatttagcaaacaaactttattttggttaatattcacctggtatatctttcttatttttgagactcaatttttatgtgttgttgtggattttagtgcatctaatgaaataacatagagctagtttatcttaatctaccaggacagtctgtttttaaactgcagaatttagcccatctgtacacttactgttattgatacagtcagacattttttaccatcttacattttacattgtgcttttcatttgacctattttttttgtttcatttcccttatttttcttacctttggaattgagatttttttttaacctaattccattttctcttctagactgtgagttaaactcactatgtccatcctttgaattgttaccctagctattttatcatgcatacttacagtctaaacctaatcaatattgtgagtccccagtggaagaatacaaggaacatactactcaatcacctccttcccaatttatatattatttagtattaggattgagcttatttttccatgtcacgaatttggtattattaccattttatataataaaggtttgcttaattttatccattttacctttgttcattctacttaacattttgggtcttccagttcctatctcctgaagtacttttaagttacttctgtgatggtctttttggatgggtaagttgtctcaggtctttattttaaaatgcctttatttgactctccatttatttttcttaagcttttaatcatgaaaatttttaattctccacaaaagtagaatagtacagttgtctctcatatccatgggggactggttccaggacccccacatggcttccaaattccacagtcacaaattccttatataaaatagcattgtatttgcatagaacctacacacatcctcccatagatgctattttttccctcccatttactttaagtcatcactagattacttacagtacctagtacaataagtgttatgtaagtggttggtttgttttttttttgttttttttttaagagatggggtctcattctgttgctcaggctggagtacagtggtgtgatcatagctcactgcagcctgaaactcctggactcaagtaatcctcccacctcagcctccctagtagctgggaccacaggcatgcgccaccacgcctggataatttaaaatagatacatatttttgtagagacagggtgctgctttattgcccaggctagtctcaaactcctggcttcaaggcatcctcctgccccagctttccaaagtgctgggattactggtgtgagccactgtgccgggccataaatagttatgctgtattgtttaaggaataatgacaagggggaaggtctacatgttcagtacagacacaagcattcatcttttttccacatatttttgatctgtggtcgagtagccaacagatacagagggctgactgtataatgaattctcatgtccttaacacccagctttgacagttaccaatattttgcacatcttgcatcatctagcgctgagctgtccaatacagtagccactagcctcatgtggctattgaagtttaaatgctcatttcaagtattcagtagctatccgtacatgattagtggttactgtattagatactgcaaataaatattgaataatgctgggttttccccccagatttgtttttaaagcaaattccagacatcctgtcatttcatcagtatattactaactgtgcatctctagttggttcatcaccactactccattatcccacctaacaaagtctgacgttccctgattggctacagaatatctttttacatttggtttgttcaaatgagaatcttaacagggtcccaacattttttttttattttagaccccttaagtttctattgtgtctgttctcttcctcctcccttttcatttttttaatccactgatttattgaagaaataaagttatttgttcttaaaatgtcccacatcatatatggattttgctgactggtttgttttcattgcttaacctggttatctttgtatttcttataaagagtagttagatagtttgtctagcgttttaggttgataagttatttttttctcagcatactgaagacattgtcctgctttcttctgacgtccattgttgctgttgagatgtcagctatcagtctgtttttccttttataggtgacctgtgtttttcccctggctgctttggaaattatgggaaaaaatcaaataccaaggaagaaaaatctataatgaaattagatgtggatttctttttatgtattcagcttgggggcttatgatacttctagtacccaaaggttagtgtctttcactaattcaagaaaattgctaggttttcatctaatagtgcgatcaaagttctgatctggtagttaatactggcactgaatttctcatttcagtgagtttatttttcatttctaaaaattgttttttaaactaaccattttatagtatcttaatctatatccattcaaatttttattaagcttttatatattttaaaatatatctaaaagggtaatatccaaagtgttatgctttttaccacctgacacctgtgtgttagctatgtcttacacatggtacattgtgtatttgtgtttcacaatttcttaaactgtgccttcctcaatttacttagaactttgtatataagattttttctcaagacctgacttaaagttgattttccagagataggtcgatttgcttgcactagttgcttggggacaatgccacttaggaccctctttaagtgaaattattcccttgaggttgtttgaactacagaaatgaatttggactgaaatctaaaagagagcacttgtgtatacagatcctcaagagagatttgctttttattatacctgatgggtacagttccttgcttcacgctttcatatggaaattttactttctttttaaaaaactgttcactgtggattttcagtcatacctaggaatagagtgctataaagccactatgtacctaccacccagcttcaatgattgtcaccattttgccattcttattacatctgttctctcccttgcttcctttcatcattgagctttcttttccttttttttttttttttttttttttgagatggagtcttgctctgtctcccaggctgaggtgcagtggcatgacctcagctcactgcaacttctgcctcccaggttcaagcaattctcctgcctcccctcccgagtagctgggattacaggcacctgccaccacacctggctaatttttgtatttttaatagagaaagggtttcaccatgttgttcaggctggtcttgaacctcctgacctcaagcaatccacccaccttggcctcccaaagtgctgagatgacaggcgtgagccaccacaccctgccagttttgtttttctgaagcatggttttccagctttcttgaggtataattgacaaataataaaaattatatatgtttaaggtgtacaacataatgttttgatctacctgtccattctgaaatgatcatcacagtcaagctaattaacatatccatcccctcacttacttttgtaagatgcactctcttggaaaatttcaaatatacagtacatcattaactatagtcaccaagccatacatcaggtctccaaaactcagccatcttataacagcaaatacatacccattgaccaacatctccccatttcccttgccccttggtaatcacctttctaatgcttctaggagtttgacttttctagattccatgtaagtgaggtcatgcggtatttgtctatgtccgccttattttacttagcatgatgttctccaggtttccttcttttttaagactgaataacccactgtgtgtatatatatgacattttctttacgcattcagcaatcgacaaacacgttgtttccatatagcagctattataaataatgctgcaatgaatatgaggtcacagatacctctttaagatattgatttcacttcctttggttatatacccagtagcaggattgctagatcatatggtagttctatttttaatattttgaggcacctccactactgctttccataatggctgtaccaattttcacttctaacaacgatgtataagggttccctttctccacatccaacacttgttatcctttgactttttgataatatctattataacaagtgtgaggtagcagccaactatggttttgattggtacgtccctaataatgtgatgttgggcactttttcatatacctactggccatttttatttcttctttggaaaactgtctatttagatcctttacccattttttattccatttttttctatcgaactgtatgtatttcgtaaatattttaaatattgtgcagattctttctcccattccataaggttgctttttcattttgttcattatttcctttgctgtgcagaaactttttagtttgatgtagtttcacttatttttgcctttcttgcctgtgcttttggtgtcaactctttaaaaaaaaaatttgtcaaaattaatatcaaagagcttttcccctgttctagaagttttatgatctcaggtcttacatttaagtctttaatccattttgagttgatttttgtttgtagtttaaggatctaatttcactttttcacatgtggatatctagttttccttacaccatttgccgaagagactgtcctctccccattgcttattcttggcatctttgtccaagattagttgaccatacatgccagggtttatttctgggcttcctattctgttacatttgtctccgtttttatgccagtaccatactattttcattacagtacctttgtaatatatttgaaataaggaagtgtgatgcctccagtattgttcaagattgctttagctatttggagtttttgtgtttccatatgaattttaggattgttttttctatttctgtaaaaaatatcattggaatttcataggaattgcattaatttgtagatcacctttcatagtgtgacatttgacaatattgattcttccaatccatgaacactgggtggcttcccatttgtttgtgtcttctactttcaccagtgttttagaattttcagtgttgagatcatctccttggttaaatttattgtcagtattttactctttttgatattattataagtgaaattattttcatagttttttttagatagtttgttagaaatacatttaatttttgtatgttgatttttttttaccctgcattactgaatttacatgttagttttaacattttttcatggtgtctttagggttttctagatacaatatcatgtcatctacaaacataattttacttcttttccaacgtagacgccttttgttttcttgcgtaattgttctggctagaacttcagttgtatgttgaatagaagtggtgaggatgggcatctttgccttgttcccaatcttagaggaaaagctttcaattttttataattggctgtaagctgtggttttgtcacctatggcctttactggtgttgaagtactttccttctgtaactaattcgttgagggtttttatcacagaagaatgctgaattttaccaagtgctttttcttcatctattctaatgatgatatagtttttatccttcattctgttgatgtgatgtatcacattgattttgcgtatcttgaactatccttgaatttctgggataaatctcacttgatcatggtgtatggtccttttaaggtactgttgaatttggtttgctagtattttattgaggagttttgcatctattttcagtagggatattggcttgtagttttttgctcttacagtgtttgtctggctttggtatcagtgtaatgctgacctcataaaatgagtttaatgaggagtttggttgggctccttttccatttttttggaagagtttgagaaggattctttaaatgtttggtagaattcaacggtgaagccaccaagtcctgggcttttctttgatggaagatttttcctcactgatttaatctccttactcattattgatcttgtcaggttttctatttatgattcagtcttagcaggttatatatttctaggaatttattcatttcttctaggttatccaattttttggcatataatttttcattatggtctcatgatcctttatatttctgtggttatcagttgtaatgccttctctttcatttctagttttacttcagtcttgtctattttaatcttaagtagtctggctaaaggtttttgttggtttatcttttcatacaaccaacattcagtttcatcgatcttttctattgtcttcctagtctctcatttatttctgctgcgatctttattattatttccttccttgtactgactttgggcttagtttctttttccttctactgactttgggcttagctgctgctttttctagtaacttgaggtgtaacattaagctggtataagatctttcctactcacccttgctctctttggtttccatttacgtggaatgtcttttcccatctttttactttcgggctacatgcattcttaaagctatagtgagcttcttgtaggcagcatataccttaggtctttcttttttaatccagtcagccactatgtgttttgactagagaacttaatccatttacttttttgtttaaggagatagggtctctgtcacccaggctggagtgcagtggcatgatcatactcccactactctcagattcaagcaatcctcccaccctagcccaccaagtagctgggactactggcagatgccaccacacccaaataatttttttaaattgttttctgtagagatgcggtcttgctgtgttgcctaggctggtctcaaactcctgctctcaagtgatcctcctgcctcagcctcctgagtacatttatatttaaagtaattattgatgggtaagtacttactgttgcctttttgttcattcttctgtggctgttgtacagatgttttgttgctttcttcctcccttgtcttcctttgtgatttgatgactttctgtagtgatacgctttgatttctttctcttttctccataatataggttcttgctttgtggctactatgaagcttaaaacatcctgtagttttaatagtctgttttaagctgttaacagcttagctttgattgcatacaaacaatttatactcttccatttcccacattttatgtttttgatgtcacaatttacatctttctatattgtatattaacaaattattataactttttaatatttttatcttttaatcttttacactagagataagttatttagataccactgttacagtattagggtaatctggattgagtatataattacctttaccccagtgggttttataatttcatatggtttcatgttactaagtgtcctttcttttaagctgaagaatttactatttcctataaatcagctccattactgatgaagcccctcatcttttgtttgtccaaggaagtttttatctctccttcatttctgaaggccatttttggcaggtaaaacattcttggttggcagtacagtcatgcactgtgtaaagacattttggtcagtgatggtccacatatgtgacagtgctctcataacattttaatagtgctaaaaaattccaatcacctaatgacatagccagtgtaacattgtaaagcacattactcacatgtctgtcatttaaacctgctgcactgccagtcatgtaacagtagtaaatatggttatgtacagtagattatatacagtacataataatgaatagtaataagtgaccacattactggtttatatatttttatactatttattgttattttagaatgtattccttctacttactaaaaaagaaaagttaactcaaaaacaagcctcaagcagatgcttcagaagacattctagaagtcattgtcaccataggagatgtcagctccgtgcatgttattgcccctgaataccttaagtgggacacggtagaaggtgtcagacagtgatactcaagatcctaaccctatttaggcctagattaatgcgtatgtgtcttcgtttacaacaaaaaagtttaaaaagtaaaatcgggcaggcaaaaagggcctggaaggtaggctactgagttaagaagacagagtcctagctctgctataagatttgcagcactagattttgatacatatacagctaagtgtactaaatgttgttctggaatgtcacccttttattatgaaatgcaaatatgctcacctttatggtccttatgagttactccttattgttctaagtaatttcgggatattaactcagcccaaccctatgaaattggtcccattctaacaatgaggaacgtgagggtgtgatataagatattccaaactcatcttgaagatttcttagtctatactagactcagctatttctccagtgagtcctggtttctgtcacgggtaaatgatattcagagacagttttgcactttagaggctcattcctcctgagctgttagcagtcataagcctttttagtggttcaggctagaaaaaagtccaagaaaaaatgaaaaatgcatactatatttctaatttgaggatatactgtgttcttggataaggaggcaaattgtaactacactctatgtgtatgttgttaccctttagtaagaagaagcttcccagcctgctagtgttgaacatctagcaggcctagactctaatggcttctgtgttctcctctagctctgcctgcttaggactctgcccagccaggaaggaaacctacaggaggaagaatggctgcagggtggctgacaacctggtcacaggtacacaagaaatttctctatttccaaaagcacactgccattcctgaaaagaacacatctcttgcccctgacctgaagcttcacagcccaatctgagctggcttcatcttccgcagctcccaggctgcttcatgtggaagagggaatccctgggaaaggcttctgttcccacatttgttaactttctccagatattcttccatatttttgagtatgaattccatactgtagtgagtgctgtaaagaaagacttttactaggaaaattatttatcatttctcaagtatttcttgcattcctacagtatgccctgtctatactggatctgaataagacgaaaagagtcctcacaacctaactgtgcaaagatcaagccaaccatattttagaaaagctgttttgaccatgaccctgaatgagatggcccagggagtaggatttaaagagagttctgagaactcagctttaaggcaaattaagagaaggcctctgatgcatgtctgagcttccagtgccctgagtctcctctccagtcctgtcagcctcacccaccattctcctggtacattgtcaaaaatggtcattggctgagccagaatatgtatgtgatgttttagaactcagtaaccttccaggaagtggcagtggacttttcccaggaggagtgggcattgctggaccctgctcaaaaaaatctatacaaagatgtgatgctggagaactttaggaacctggcctcagtaggtaaggctggcctcatttcttcatttgtttatgtagcaaatagttcttaagcacatattatgttccagaatctgtggaaagaatagcaatacagtggttaaccccaaaatgaatggtccctgcccttgagggggcagtccagtggcttcccatgaaaatgcactgatttcattttctctatcactaatagcttaaggtaatttgcaatctgtgtctcatcttgtgtataggtttcaagggtcacttccatatagggcgtggaccatgctttttggttcttgtgaaagaaagagctcggctctgattgttttgttgttcctaaagctgcacttgactattttaataatcctttagttaaagccaaagtatggcaatcagttttgtggaatatttaattctcacacatttctcccacatccttgctttctgcgtgagcagggtatcagctctgcagacacagtctgatctccaaggtggatcaagaacagctgaagacagatgaaagaggaattttacaaggtgactgtgcaggtgagccttgggcagaacagggtgcagccttggccagtgagggttagtacatttgggaatgtcactcagtgaaggaaaagaaatctgaggccatgacatgagcttccttcctgtttcaccatctattcaatcgttcatacgttcatttggtctccgagaaagaagttttaattcctctttaaatgtaatgtctccatgaatgctttttgtttagttctccctattttccagataatactgtcttatttcccaacctccacaatcctttctaactaaaatacctcccatttctactgcttgttcctatcactggtgaatcactggttgtgtcttctttcttacatttctctacttagaagatattatttgaaaacaaatccatagggtctccctccctttttctttgatcccaaccttttctcccaataattataaaaattcctgtgctatttcagactgggaaactcaacttaaaccaaaagatacaattgctatgcagaacattcctgggggaaaaacatccaatggcataaacacggtaagacttactaggaagtattcctggtctttgtagtagaagtctgggaatctgaatgagttaaaacatcagcacccaaagcaggggtaagaattcaggcaccaggctttcaccagaaagctgtctcgggagagtttggagtttgattttcatgaaattggagaaatctgtaaacctaggttaacacttgctggctcacagagaataaccacaagtaaacatctatgtaaatatgattttagagttaagtatttagtacataattcattcattcttcactcagtattagaaaaactgtattaaagaagccctttgctgggaaggaatagagccttggacagaggagtgagcttattcaactcgaaaaagctaatagggcaaaagtcatacgcacctactgaaaatggtacacatgtcagtcatgatcatgtgcttcctatatatggcagaatcctcatggaagagaattcctgtgaataaggtgaaagtgaaaaagcctctagtcaccacttactcccttttcaacaggcagaaaatcaacctggtgagcactccctggagtgtaaccattgtgggaaattcagaaagaacactcgctttatttgtacaagatattgcaagggagagaaatgctataaatatataaagtatagcaaagtcttcaaccatccctcaactcttaggagtcatgtgagcattcacattggagagaaaactcttgaatttactgattgtagaaaagctttcaatcaagagtcatccctcaggaaacacttaagaactcccacaggacagaagtttcaggagtatgagcaatgtgatatgtccttcagcctacactcttcctgctcagtacgtgagcaaatacctactggagagaaaggtgatgaatgcagtgactatggcaaaatatctccccttagtgtccacacaaaaactggtagtgtggaggagggtttggaatgtaatgaacatgagaaaactttcactgaccctttgtcccttcagaactgtgtcagaactcactctggagagatgccctatgaatgcagtgactgtgggaaagccttcatttttcagtcttcccttaagaaacacatgagatctcatactggagagaagccttatgagtgtgatcactgtggaaaatcctttagccagagctctcatctgaatgtgcacaaaagaactcacactggagagaaaccctatgactgtaaggaatgtgggaaggctttcactgttccttcatcccttcagaaacatgtgagaacccacactggagagaaaccctatgaatgcagtgactgtggaaaagccttcatcgatcagtcatcccttaagaaacacacacgctctcacactggagagaagccttatgagtgtaaccagtgtggaaagtccttcagcacaggctcttaccttattgtgcacaagagaactcacactggtgagaaaacctatgagtgtaaagaatgtgggaaggcctttaggaattcctcttgcctgagggtacacgtgagaactcacactggagagaagccttataaatgtattcagtgtgaaaaagcctttagcacaagcactaaccttataatgcacaagcgaatccacaatggccagaaactccatgaatgaaatgactcagggaagtgtttgttgcccctcatgcctcctttctcactttagaacatatattggagagaagccctgttatggtcacctggaaacagccttctggcccaactctggatgcctgttatactgggacaaaccttataaatgttatagctatgattgtttttatcagtgagtatttcattcttatatgtgtcacaactgtagatcctatgaatattttagttatcttttcagtttaattgcattgtgaacagaacacatggtcttcaatatgtagattctgtgtgacatagatttgaacataattgctggacactgactgatgtactgtggcagacagaactagttgctgtctcaatatccattcctcccttctttcttaaagtaataaaatttaccatttagttcaagctggcaatgtggacagttttcacccagcttcccttacagctgtgagcggccaaatatgttcacatccctagcccatgcaaagtaggcagaagtcactggatacagctgctaaggaagctcatggaaatgggaatatctcatctggtgtttttttcttaactatttgccctttgtcttgtcccttatttcctagaaaatatatacaccaagaggaggacagagaaaggatactaaatgaaacaacaggggagatacaatattatctggttgcactaatcctgtgctgcttatctctggatttcatgttacatgagaaaaattaactgccatgtggtttaaaccactcttgtgggaagttcctctttcagctgatttcagtcccaactgttacatctaataaatggtcaagttttaggaatcgttcaagtatggttgaaaaattgtgttttctgaggcagaaggatcacttaagtctaggagcttgaaatcagctgaggcaacacagtgagaccccatctctaccaaaaaaggaataattaggtcttgctgtgttgcccaggctggagtgcagtggtgtgatctcagctcagtgcaacctccgccttctgagttcaagtgattctcgtgtctcatcctcccaagtagctgggattacaggcaaatgccaccacgcctagctacttttttgtatttttagtagaggtggggtttcgccatgttggccaggctggttttgaactcctgatctcaagtgatctgcctgtgttggcctcccagagtgctaggattacaagtgtgagtcaccgcccccagccaaattgttttctttaaaaatctctctctctaggccaggtgcagtggtgcatgtctgggagcccaaggcgggcagatcacttgagcttaccagttcaagaccaagcccagccaatgagccgaaactccatctctacaaaaaacaaaacaaaaaaaagttagccaggtatggtattgtgtacctgtaagtcccagctactcagtaggctgaggtgagaggatcacctgagcccaggaggcagaggtagcagtgagccgaggtcatgccactgcattcctgcccgggccacagcaagaccgtgtctcagggaaaaaaaaaaaaaaaaaactctccttttttggggggcactgtaattgggtacatttaagtttactcattttatgtttctggcaaattgtgctattagtgcccatacttttcccctaataactaatgttcattaatttactacaaatgtgagctactgacctagaaataccattttctcaacctgtaaggacaaccaggagcaacttactttttctcagcgttacatcagttatactgttgcttgcaataacatccagcaggtatggtcatctttacatcccacaacttgtcctctctattgatgcctttatgagttctttcgtaagacagacgtgaatgtttgttggggaatacacccaaacattcaggctaaccacctgaagtttctaggggttcagttgtctggcgcttgtcaagatattccctctaaggtgaaaggagaattgctgcaatttgtactactaatcacaaacagcacaatgcttggtcggtttttttggtttctggaggcaccatattgacgcaatatgacaacacttggagaatttagaaaaataacacgttctcggccagacgcggtggctcacgcctgtaattccagcactttgggaggccaaggcgggcggatcacctgaggttgggagttcgagaccagcctggccaacatggagaaaccccatctctaccaaaaatacaaaattagctgggcatggtggtacatgcctgtaaccccacctacttgggaggctgaggcaggagaatcgcttgaacccgggaggcagaggttgcagtgagccgagattggaccgttgcactccagcctgggcaacaagagcgaaactccatttcaaaaaaacaaaaaacaaaaacattc

SEQ ID NO: 12236 - DNA, 10972 bp, Human
gatggattcgaaagacattttttggaagttggaattaacaggatatggtgaataatcaagagatagtaaaagcataatggaggaaacaatggttcttcctgttaccataggaagaagctttggagtagagttttattcattttaaatgcatttattgtgcactttattataggtattggagattgatggaaaatagtctctgacctcaaagagtttcacaggaaagatgagcgatggctatgtaatatgaccaatactgggatagagaggtgcccaggtcactacgggaggacttaggtgatttctaactatgtctgagagtaggggaaatgggatcaaagaaaacatctcagaagacatgaagcttgagcttatgtcttgaaaaatttaaagtttaacctaaccaaggataaagaatcagaagaaacagcatattcaaaagctaaagaacacgggactcttgtgtgctttgcatgtacacacgtgtgtgcgtgtgtgtctgaaaggattggagaggagggcgaagagaataacaagatgaacgtcaacctaatgtagaatgtttgaagtttgtatttcacttaacaagacagcggggagtgatggaaggatcttagataggaaagggacatgagcacgtttgccaagagagctcgttctgatcatagtgggtacgtgaaggtgacaaatctggaggcagatagctcacatttggaggcagttgcagtcatccagatgagaagtgagagggacctaagctgtaaattgtgggaataaagacaagacccgttaaaaagaaagagaacacaccatgtagcgtggaaaggagaagggtggagagtagcctgtgcagaaggaacaaccttcaaaaagacatggaagactgaaaagacaccctgttgtagggagatcagcaatgcattttttataaccaggtgatacagggaaaaggtaggatctgaagcttgaaaaatagattgggggctgattgtaaagagcttcgtgtcattcccaggattttggaactgattttactaacatgaaaaaggttttgttttaaaatactgagtaatatagttggaactataatttagaaagataatagctggtgccatcactcttctaagcaaagatagtaatacatttaatgctcataggctttagtaatacatttaatccttacagtaagcctattagataaaaaccattattatctcccttctatagacagagaaactggcattaggagaatgagaacttgcctatggtcccactctggaaatacctagtaagcgacagagccaggattcaaacccaggcagcttgactccagaactttcgctcataaccttacacatctccctcatggttggtgtttctcaaccatggatacacattcgaactgcaagtagcatctctaaacatacagttacctgaattgactgaatcagagtgtctgaaaaatgatgtgtgatactatgttttgcaaaatctccacaggtaattctgttgtactttgcttatagttgagtactgcagggatcttaggaagttagagcagtagtccaggcaggagatgatgaaggctcaaactaaagcagtctgtaggaaggaagagaagggaaccggtttggagacttaagcgggggaattggcagtatttgtgaagtggaaatgcagtattttcttgcagagtatgaaccttgcctaggaaagggagtagaggaccatacctttagttgtaaattatcctctcccaactggatctgttgatttatggctatggtggttggggaaaagaggatttaaccatttgaagaagtttgtgtagaggattatgattgaactcaggctgttgtccttgtgtatagtttcatgcttatactcttgtttgtctttacttctctatccagggcccttggaagaaaatcctcgctgtgtccaggctgaggcggggggctaatgacagtgtgagctctagatggtgtgagaccaccccaaagccaagaaatggctacagccgtggaaccagaggaccaggatctttgggaagaagagggaattctgatggtgaaactggaagatgatttcacctgtcggccagagtctgtcttacagagggatgacccggtgctggaaacctcccaccagaacttccgacgcttccgctaccaggaggcagcaagccctagagaagctctcatcagactccgagaactttgtcaccagtggctgagaccagagaggcggacaaaggagcagatcctagagctgcttgtgctggaacaatttcttaccgtcctacctggagaactacagagctgggtgcggggccaacggccagaaagtggcgaggaggcagtgacgctggtggagggtttgcagaaacaacccaggagaccaaggcggtgggtgaggagggggagtcctgatctgtgtgatgtggagggggactatttgctggaaggctggatttgcggggagagcttgcaggatccccataaattattagtgggctctgcccttgggttgctcatataccatgagccccatggattagggggatgtgtgtgtatgaatgtgactttctggatattggaacacctgtatagggaccatctgaggggtctcagccaccaaagggtcatggctttggttttcccttctttgaatgttgagccgtgggttcctggagaggagaattttgtgacttcctcgaaggttctcatagatccccagtcacagatcccccttcctggctggtcagctagggaagcaggcagcaaggagagctgcaggtgggacaggtggagatgggaaggaaccttgggtgacaggggcccaggctgggggtggtgagagagcagtgcaggcctgcgcatcccctgccttgtcctggggaggataaccttcagctcctccttgcctgctccattgaaactggagtttcccctccttgtctgggtccctctgggagtgttttctctaggcatcttctcctaaaataagctcccgtgacaaccaagaacttcctcctgactccatggtgactggaagttggaattattcccaggtgactgtccatgttcacggccaggaagtcctgtcagaggagacggtgcatttaggagtggagcctgagtcacctaatgagctgcaggatcctgtgcaaagctcgacccccgagcagtctcctgaggaaaccacacagagcccagatctgggggcaccggcagagcagcgtccacaccaggaagaggagctccagaccctgcaggagagcggtgggaagcatcagcagaaaggggggattgtggcagaaggcaggcaaggagggggacatttctcggacatttctcctataccaaggaagctgggtagatagactgtatggaaagacatcacagaatccaggatgtcaagaggagacagtaccgccagctagagtcccccataaacagggccaagcttagacagcagattgttgcttgttctcttggcattctgatagtctcataggtgatgggattgggatatgggagctacccttaggccagtttcttggttcccataatagaaaggatagggccaccttcctaccaaagatggtgggggatgcccagatttttgcccattattggggcatgctgcatattactgatctttgccttcttttcttcatagaggtcccagtgcccgaggacccagaccttcctgcagagaggagctctggagactcagagatggttgctcttcttactgctctgtcacaggtgtgccctagttacctctgtaccacagagaatttgtttgaagaaccactgggcataagccatactaaacaggtgaagcaggatgcacatttacactcttgccagttttaagctcacagttctgcaggtacctggaaggggaggagataatgagataaattatcataccttatattggatccacaggcaccaacaccagtttatttgccattgactagaagaactaacaaaatgggattattttgtaacactccagtacaactgcgaagttgtcaaatgagggttttttagttttttttttttttaaaggaataaatttgatagtcatttgtaagtatgacagactgtactgctgagacatttaggaagtattcaccatgatcaaagctctgaaactaagccatgtggctggagaaaaagaaatagaattcatgtatggttttagattgtaatctaactgaggaaaaaagtcttgttttggctatagagtatagaaactattgaaagtgattagagtctttagggaaagtgtactagaaaagatgaattttgcagaaatgtatatagcgttaaagtgtcaagtagggagctgaatgatgatttttaagacctttcctaaattttaaacaataccttaaagaagaagaacataagctggtcctcaggaaaagtggtggagttggagggggcagggccagtgccacaggggacacatggctcccccgagaatgagtttaagcagcccgccactcaagctcctttcatctcctagaggagtccacctattgtatgaccttcaacagggacaaaatacgaggctacccgtagcatcacgttttgatgaaatccttatgtggtttcagggactggtaacgttcaaggatgtggccgtatgcttttcccaggaccagtggagtgatctggacccaacacagaaagagttctatggagaatatgtcttggaagaagactgtggaattgttgtctctctgtgtaaggaatttcaagtattctagagtgttctaagcccagagatctttttcctgctggaaattttgggggatcttagaccttagattgtatgcagtgaacttctcttatgccttccccaccaataaaattgagggattaggtgaaaaatatggtgtcctttcaagtaaaagataaatggatggaaatggaaacctctaataggaaaacaaacttgtaatatgacagctttagtgcagaaatatttgaagtaagcacatgagttttaaaacagtaagagttggagataatctttcttgaatatgggaaaagaggataaggtgtacaatggtataattattaagttgcaggtgaaaaccacaagaaaggcaagagatacgcagtccttggttaaaagtacacaaactaaagagatgaaagatttcatcacctgagctagctatgtatttgccccacaacctaccaaatagaaaaggaccgctcttaacacagggaattgttgagccaatcgtgatatcctattttccctctcttgagcagcatttccaatccccagacctgatgagatctcccaggttagagaggaagagccttgggtcccagatatccaagagcctcaggagactcaagagccagaaatcctgagttttacctacacaggtgaggaatgacaaaaacggtgttacccaccctgagccagcagttcctctaggcagtgcttctctctctctgtagggccccgctctcatcagttcttctaacatgtcagccagtactgctttctccctctgacagccatttcttctgtcattgccctcctcttttctcctcccatcatttgtctgatagcaatgtaatacaaaagggtgaaagaaaaatgttaacttttggaattgcagctataccatttactgtacaattcccttaaaccctcgattctcaatctctgcatttgtaaaatgaagattatatttgtgcataccaaggtttgttgatagcataacaatatgagaaagtgcttggcacaggacaggcattctatttagtcttgccatctcaaaaccctttgtaaaaatctccccattgtgtagaaggcattgttgccgctacagtgaccccctttttcctctcaccctttctacaggagataggagtaaagatgaggaagagtgtctggagcaggaagatctgagtttggaggatatacacaggcctgttttgggagaaccagaaattcaccagactccagattgggaaatagtctttgaggacaatccaggtagacttaatgaaagaagatttggtactaatatttctcaagtgaatagttttgtgaaccttcgggaaactacacccgtccaccccctgttagggaggcatcatgactgttctgtgtgtggaaagagcttcacttgtaactcccaccttgttagacacctgaggactcacacaggagagaaaccctataaatgtatggaatgtggaaaaagttacacacgaagctcacatcttgccaggcaccaaaaggttcacaagatgaacgcgccttacaaatatcccctaaaccggaagaatttggaagagacctcccctgtgacacaggctgagagaactccatcagtggagaaaccctatagatgtgatgattgcggaaagcacttccgctggacttcagaccttgtcagacatcagaggacacatactggagaaaaacccttcttttgtactatttgtggcaaaagcttcagccagaaatctgtgttaacaacacaccaaagaatccacctgggaggcaaaccctacttgtgtggagagtgtggtgaggacttcagtgaacacaggcggtacctggcgcaccggaagacgcacgctgctgaggaactctacctctgcagcgagtgcgggcgctgcttcacccacagcgcagcgttcgccaagcacttgagaggacacgcctcagtgaggccctgccgatgcaacgaatgtgggaagagcttcagtcgcagggaccacctcgtcaggcatcagagaacacacactggggagaaaccattcacgtgccctacctgtggaaaaagcttcagcagaggatatcacttaattaggcatcagaggacccactcagaaaagacctcctagctaggtccccatgtgaggagatctgctttcagccctcacctaagggaggtgaggaagaggaaaagccctcttgtcagcctgggaagaccttttcgagggagtctccctgacctgctcagatctgacattacctcttcctgcaactaaacacgagcctgggcagaacctctcagccttcctctacgccttgaggggatgtttcatccaaagtacaacctgaattgaggcttctccttcactggagtgcacctgcctctacctcatgggtataaagtaggagaactaagagacttaagaggtcgtggttcctatatcgtccaaaaaataggctgttacatatcctaaagactgctcaacagcttcaagttgaaagtggccaaggacagccccttaggtttgggaagggacgagcctgaaggattctgtctttactggggtcaaatcttaaagcacacagctctggactcaagacaggaggtttgcgtcctgatggctttgccacacattcacaggataactgcatagatccctcgctgtctgattcacttcttaccatgcactttcctttgatgctgaggagaaatggaagtgggcgaaaaatctcaaggctgcttcatgtggaccttgtcaagctgctccctcccccagcgtcaaattgttatcaggtgccaaacactgctagaaaggagggcctagtcagaagcctctttccatacgagttttggttttgtttttaatatttttttctattaaaatactcatgcatttaaccttcccgttattcaaccagtctcttggttgcatccctagcacttctactacaagtgagatggtagtgtttgagtgcttattgagtaaagcataattcggtcataatgaaatcgttcacattccctcatatgcacaagcccaccaaccccttcacaccccccttcacaggggtcgtatgagtaaggggatttggaaactgtcaacttacaaaggcactataacaattacagaatcatgattgccatgggccactttatttacatgaagacaactggagaacgactaagaccaaattatggaaaataagaaaaagctgttgctggcaagaccatcaagactgttctgacaccctgtccccatcatccctgactgagtactctgacatcacggaaagtgttgaacctgggaccctgaggaattcaccaggagtaaatggctttcatgtatttgtgttgtttgctttttcttacgtgattttatgttcatagagctagaaagtagcatctcatgatggcccaacaatctctgttgccagttaaaggttccttggagatgaggctgaataattatgaacctcaccttctctgattgtgggagtggcaagaactggggagacgtcctccataagtggagcacagggtatggggttaaagcatgacagggagagtcttctgtgcctggtttcttctcctctatctcataatgcattatgggcccgaggaataggggagggttaataagactccaaccctaatggcccaacagggaaattctcattttggtcgatgatattctgatggactggtttggtcttaataccagtcaaccgttgtccttctggaaatatacatatatgaaataaataaaggtaacacttgcagccaagttccctggtttctgggacttcccatcttacccattccttttccagggcttcagtgtcctgatacttctgagggtggttcatactcaaatagatctgggagtacagagtatttttccttgaggaaaggaagggttgggatgattagcagagtccggtgaaacatatgcactctgagataagatccaagcctggagtttgcagaagatactgtcctaataagcaggcatttctaaaccaagtatctaagcctaagcacagcttgtcctgggtgaaatgtctgccacaaaagatagtttctcctagctcagacttaaccatttataaaggttggtaaaatactggcagtgacaacaaattgactttttaattttcttatttgcattattccaataaatgaaaatctgtcagagttctacatgagggaaagcttgtgaggctgggccggtttgttggaacatcaaatagtccttaattactgatctccctgcagagtttcatatgctgacactaaatctctggtcccttttgtaaattactgaattttctgaggttctgggagggacatgttgtctcccaaatctgaacaaacacaaccacagtgtgcagcggcaggaaagaagtagtgcagctgagcgtgagcagggaggttggagcacagggtgtgtattcggaggggtcccctctagtatcttgtgagcagtagaattctagcatccttgaataccatactaagtttctgagggagaaaacggtgggattttaaagatattatttggaggaagttaatacgctacttaattaacagaattggcaggtggttggaaatgtgctaaagaggtatgacacattaaaaatgataatataaggatgtttgaccagataatttaggaataaccaaggaatatttaacctcttcaccacaaagtccgaggagaaataaatgcccaagagatcaagccaaaatacatttttattatctgggacttaggcctcatattccggagcagaatccggtaaactcagatgaactccatggagaatttcataaatcagattaacatcaaggtactaaaatcaaaacccactaagaaacctgttgcccccttcaaagcacaactgaagtaatggatctaatagaagatacattgtttgcactgagcagtagagtagtagaggagaaaagcccagagatggcacagacaagttgttccagtccccttcagtcaaggcctctggaccaccaccctgccacaggcgaaaaatgggatatttaataaataaaaaattttgattcaccagactggctgaaaggacagtaatccaaatgagagttaacggctccatagtagttttctagaatgaaagctgaactgagaaatagtaactgatgacatgttgagcaggttaataatttggtacccttccacaccagtatttgtttgtttgtttgttttgagatggagtctcgctctgtcgcccaggctggagtgcagtggcgtgatctcggctcactgcaagctccgcctcccgggttcacgccattctcctgcctcagcctccccaggaagctgggactacaggcacccaccaccacgcccggctgattttctgtaattttggtagagacggggtttcaccatgttagccaggatggtctcgatctcctgaccttgtgatccgcctgccttggcctcccaaagtgctgggattgcaagcgtgagccaccgcacctggccccacaccagtatttttaaaaatagtttgttttacctctagcgtcttccctcagctgacctaaatagtccagccacaatagctgagagaaatatacctacaattatttccatctccttatatttctagtgatgttggctgactaacccactaatctagtttatgggagagggaaagactgaaagagccacaaagtggatggccaacccacgtgattactaacctttattgtggcaaagtaactgatacaatgtttcaaatgtaagcacatctccttggaataagtggaataacttaattcatccttgcggaagtcctgaggatcaagcaaggaggagcccagctttctttagacaccaccttttttatctttaataacaaaaaggaacaaagtgattgtcagaccagcacaaagatacctcttaatgtgcaatttctattctctttagtgtgtgtgagtgcacgcatgcacgtgtgtacaccgaggtttcaggtagaaggaggaatgcaattcaaattctaaaaaaggaatcagtcagcacaaactagtttatttggcaattcataaagatagggactcttcagaggaggttgagagcattgtagggttatgtaaagacttccagaagctgtaaagacttccagaagcaagaagattcaaccatctaaaacgccatgc

SEQ ID NO: 12237 - DNA, 12226 bp, Human
  misc_feature (1)...(12226): n = A,T,C or G
tgaagtttgaagtttaatcactgagaaatggcacagaaataaagctggtttctttgggttccatcaggcaatgtgaaatatcgtgaagcgaggtggtatcacggagttccatccggggcaaatgtagaatggcagcagcttcactacatttttctgagaaaaacagaggcatagacagtgcatctcataaaaaagagcaaaacctggagtgcttacgacatccttaaacaggattacaggaaaaaatgatggatgtgaatgtgtttagcacaatgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctgccttagcctcccaagtagctgggattacaggcgcctgccaccacacccggctaattttttttgtatttttagtagagacggggtttcaccatgttggccagggtggtctcgaactcctgacctcaggtgatccacccgcctcacctcccaaacttctggaattacaggcttgagtcaccgtgcttggccttgtgattttttaaaatacatttttttcttacttttgttcccattatctgatggaggaaaaaaatgaacaaatctatcaaccaacttacctgggagcctggtgctcatttcctattggttccacattcactccctagtcctcctgcaaccactctgaaatcccttcctcgttttacccagctggaaatgccaccactttagccatactgaagttcttctacattcttcatttctgcatgtgcaggcaagtaaaatgatagggatttctgtgggcgttgtcaggagctgaaagattgggaatgcttttgaaaactccttctccattgagtttaagaggaaacgggtgagttttcccattatttcggtaggatagcagatgcctcttcatttacccctttattttaccctcccatgcccagttctgtcctaccactaagagtgagtacgtcggttgccgcattctggccttgtcctaagaagtgtttcacaatctaacaccaccaatactcccctcacccccggtgccttaagtaaggaaggactgggctgctgagtggcaggtgggggctgtctgaggatgggagggggaaataagatggaacggggtggacagaaaaaaaatcaggagaaaaattattatttgagaaatggaaatcttggattaggattttttttgcaagatgattaagccattttagaaacatgactcatattgtcttctgccctttcttcctctaagtaattatgaagaacacatacttggaagattttaataaaattatgagtaatattagatcactttaattcctgtttacggaggacagcagtcaagtacctaactgtgagaggaaaatgaatctttgcttctaggaggcaccatcatttacgaaaaccaaagagggccaatttgactgtttttacttgtacccctctccttcttgacttgtctcattttttcttaagattttgtcaaagtgatatatgcatctagaccaaagagccaggtatttctgcttaaagggacatttctttgtttgtttttttaaaaatagaggctttcgtttccatcctcttccaattcctgtttcccaaggcaactactttcaactcttttacctggtgtgtgtgtgtgtgtgtgtgtgtatgtgtgtgtgcatgtgcacgtgtatgtgcatgtgtgtgtgtgtgctttccgctatggaatatgaacctttagttcttcctcaccctcattcccctggcaaacaccttctgtctcccacttttcaatatagttttattgtaatggtaaaatcaatatttagtgtttaaaatattatgccaatgcaaatgctattcatggtgaaaccatgtattaaactgcaattaatttttctttcctgtacacatttttgtttccattgatttaacaattaccttgttttgtttgctttttgttctcaattccatcatcaagtatcctcaaattttatttgcctgagaaaatttctcctggggcttcatatcctgctccagtctggacttatgctcaggcctgatgtacctccctccatcctgggtctgcctttacagtcctcctggtggcctcctccgcctgtctctcacctttcacctcatgttgcctggactcatgtcttcctttatcatgcctactctcccactttggagggacacattttccagtatcctccagaaaaagagaacataaaaaattaactttatttggagactttgcttgcctgaaaagcctttattttgtccttgtacttgagtatccagatagagaattccaaggtagagataattttccttctgtatattgaagacattgctctgttgccttctagcttccaaaattactatggaaaagtctaaaataaaattcctaatattatattttgaatttagtatttttcctctccttttcctctctaaaagcttgtaggaacttctctttgtgctcagttttctaaaagtgtatgaaatgagacagatacttggtgagtctttctaatatgaagagtcgcgtcctttagctttgggaactttgcatctattttgttgatttttttcccaccatttatgacatctctctgtttagaactcctatttcttggttattagacatcccagattggcattctgttttgtttttaacctatgggtttatttgctctcttttctgagatatttaataaattttagctttcagctcttctattgacatttaatctcagatattgtcattttaattccaagaactttcttttaaaaaattttgagtattttaaacagtaacctgttgttttgtatgttattattatattctcataactctgagaatactgatatcattttggcaaagctttcttctccttgcattgttttcttcctccaaatacctgttttgttttggtcttattttccatgctaggtgccattctcagatgtcccaagctcctcgttgtctgctcctgtgcaaaagagatggaaaggctgattggaaactctgaactcatgaatgggacttgttaattatgggcttcactgtaaagtgattggctggactaattatttgaggaatatctgatattgtctttatgtcttccttttagaatgtttgagttcttggaaaagacgatactcatctgcctgtagggtaaaagcctgggttccggagttctaaaaaccatgtgagaggagagcatttgctcacctaatgtccctgtctcagtatagtacccttgtctcaactgtgctatagatacatccagctcagtgatcccattttatcctttccagacaatactagggtgagagagtggtggttgcccaggtatacaaagtgatttgggaatctgaatcttaaactgacttttaactagtttttctctagaggaacctggtatggcaaatcttgggtaaaagtcggttcattcttgacttttccttctgcttggatagaattctgttttcttagggctgttgtatctttgatcactcttctatctattttatttggatttatgccttaatttcaatttttttttttttttttttttttttgagatggagtctctctgtaggccaggctggaatgcagtggcgtgatctcggctcactgcaacctccacctcccgggttccggttcaagcaattctcctgcctcagcctcccgagtagctaggattacaggcacatgccatcatgcccagctgatttttttttgtatttttagtagagacgggatttcactatgttggccaggctggtcttgaacacctgaccttgtgatctgcccgccttgccctcccaaagtgttgggattacaggggtgagccactgcacttggcctcaaaaatctttcacagttaatttagaagagttttggggagcaaaggaaagaaggtgggttgatgcaatctgtccttacccctcttgttgactttggatctatctatggtagcggtttaaaatttgtttcttgcaatggagttctttctttgaaatagtatgtagaagctcagtatataaaatacatataagcaggactgctgtgtttgaaaaggaaatgagggtttatggttctactttctcagttctcctcttaccctttccctaccatgagaactccctggaaagcataatttgtaaaccactgatttagaaattatcgaacataacttatccctccagtagatgttagacattgagtgaagttcatggcattatgggaagaacgtttgatttattcctttagagattaattttattgcttctaaatgctcgaatggagcaaggcaaagagaaagattcattctaaagatcttttagttgaaatagaattggactcaacttccttgcaggctaactttataattacaaaaataactatcaaatgctattttttatttgagaggaaagtctgtagatttacctgaatattaaacgatattcaactgtacattcacattttgataatggaagatgttagaaattcccaaatttactttcagaaagctaaaattctctattatgccggattgctattacagccaatgtttattctaaattacttacttaaatataagagtcagaggaagtcttcagggtgagaaaaaatatttagggcttatcttgcagggaaatcattattaaatttgtgcatagtttagcttaacatttatgtgcagtctagccattaaaaacattgttatttcctttttcctccacctttccctggagtgggccatcagttacccgataaagccatggaaatacgtggaagtatttatgcaatgcacgtcactcaaaggttcagttgggaatgggcaccaagattgagaaacctgtcaaatgaaatgtatttttgtatgtctctaagatgaaccaagaattcattatctaagaattcaagaatgtattcttgaatgtgataagaaaaagaaaataaaaacaaaaaacaaacgaatcaacagaaaccaaaaagcactttactggtgtagaggactaacgtgagggaagtgccagtagctctttgcagaatcttccattttaatccagtcttctgctgttacctgtttaccattactaccatttcacagaagactcagacttcatcctaaaaaactatctccagtcatgctgcagaaaataattcgttagcttcagctgcaggaatgagacacctttaaaaaagagaaatgtgacccaaacttttgtgagaaacaccttgtattttgattgctatttcacattcgaaggactcttgaaaaacagaaaaaacctaaaacatcatcttgcttatggtatcttttggtggcagactatgaatgggacatgggacccccataagatatatctagtgaagcactgagagatggataaacaggtgcctgcgggaaaggtactctttcagccttcttatagaagagtattgaaacaggagaaaatgtttactttctagagctatcaactgtagaaaggaaaagtcctggggaggacttgttctggcaaagtgcacgctttggcacctctgcagagaacatgaagtttgcccgcaaacattagatgtctacttggttacacgtgaccgcaacagggcgtgtgtaccatggcctcagctcgcttcttgatgacatcatgaatctgggctccggccaaaggattttgagacgagccaaaatgctgtggagcatgcagaagccactcattgctgttgtcttcaagaagccagaggaagacatgcaaagaattaaagaaagacgctgaagctgtgttacaaaacagttgatcaggttgaattatccgctctctaacaatcttttgagagttcaataaaaactagcagctcttcaattagccgggcgtggtggcgggcgcctgtagtcccagctactccggaggctgaggcaggagaatggcgtgaacccgggaggtggagcttgcagtgagccaagatcaaaccactgcactccagcctgggcgacagagcgagactccgtctcaaaacaaacaaacaaacaaacaaacaagcagctcttcaagcaattgctatattcgagagctgaacctctttttcttgaagtcgccaccacaagtgtttgtccttgtttttatttctctttaatctttcacacacaggcctctctcacctgtagaatcttgagtgagaccatgggaagtaggcaaggctattttctgtgactcatcttggtggagagccctgactccaagatctgagacatttgccaggggattcccttccctgtttttctatccacacctctgctttcttctaccctccttctctctcttccctcttaacccttttgtttttactttttccacattcataggcattctttcctcagttgaacctgtcctcatggctccctgagcctgggttggctgatctgaaccagtgtcattttgtgtggttggcggtaaaggccaaatgtaagatgtgtgaaatcactttaaaaatgacaaggtggggccctatgcagtggctcacacctgtaatccaagcactttgggaggccaaggcgggcagatcacaaggtcaagagatcaagatcatcctggccaacatgatgaaaccccttctctactaaaaatccaaaaattagcggggcatggtggcacatgcctgtagtcccagctacttgggaggctgaggcaggagagttgcttgaacctgggaggcagaggttgcagtgagccgagatcacatcaccgcactccagcctggcgacagagtgagactgtcaaaaaaaaaaaaaaaaaagacaaggtgtttcagcagggtggtttttactattatatattcagtattgttataggacagggctcactccacataaagcaaaacttccctgtggcccagctttgccctgagctcctcttgtcattccaccaactcttgcttcccccagctcctatggtgatgtcccctctgggtcagtttcccttctctgtctttctcgtcttctcattatgatttatctactctctctcatttcctcagaggcttcttaggaactgattacttttggttgatcaagcactctggagccaaggggataacagttaacagatgatggtaacatatcagagaaatccacattttaactggagattccatgaactccaatatggagcttgacagtgaaattttaggcagcatgagaggccagtggttagggggccttttcttggtaatgtgaagccttgtgcatgcgaatgatttttctgttccacccattcgggaagtgagctaaggcagtgtatagaggctactgaataaaatattaaggcaggacgtgaagggaaggtttttggtttggggagggcaataagagtaacaatgtcttttaaagaagagttaggaaagaaatagtacagttaagacatcatgtacaaaatgtgggtattttcagtcaccccagcagcctctattctgttaatgtttctctgcatctggctctgagaaaggacaggcaaatacaggttatgcaaatagagatggtgtcattgagctgggagtgatttgcatgccaaaggagattgcagaaattatcttttcaaattctggggactgggggtgtttgctggtggctgggattttctatgaatccagggacaagggcttctgagtctctggtgtcaacaaggtggcttgactcagccagagaggctgtttttccctgaagatgtgtcccagccctctgcagtaggagctgagacttagcagaacctccctggagaagatgccctccttgcccacgttgatcttcatagccatcttttgcctggagtcattggctgcaatgctgcagaatggattcttggtcacaatgctgggcagggagtgggtaaggtgccagatgctgtccacaagtgacatgattgtggcctgtctcgctgcctcccgtttctgcctgcatggggtagccatggtgaacaacctcctggcctccttagatttttcgcgtgcagttccctatatgaacatcttctgggaccttttcaatgccctcactttgtggtttactgccttgcttgctgctttctactgtgtgaagatctcatctttctcccaccccaccttcgcctggctgaagtggaggaactctcggttagtgcccaagctgatcaagggctccctgatcatctgtggcctggaagtcatctcatcagccactgggaacatcctgtttggtcagaggaaggtctccctgagttcctacagaaacgaaactctagtttatagagtgcaggcttcatttcagctctactttttcctttatgaagggtttgtgtggtcgattctgttcctcctgttcctagtgtccactgtcttgctcatagtctcactgtgctggcagttggggtagatgagggacctcaggcccggcccctgtgatcccagcacccaggcttacactatggctttaaagtcactcaccttttccctcatcttctgtacattgtacttcctgtccttgtttgcttctgctttgaaaatcataaactttcagaatcactggcactgggcctggtaagtgctaatctatgccaacatctgtctgcactctaccgtcctggtgctgaggagccccaaactgaaaaagggcctgaagacatggcctcagctccagtgcccacgtgctgctggctcacagggctttggaaggtgctggccatagggtggttctgctcctgagttatctgtgtcagtaaccagtcctgggatgaatgatcctggtaggaatgtataaggtttgggtactgtctttctctttccagtttcttctttctctccccctctgtccatgcctcagaatcccttttccatcttgctgtctgtgttcttaccatcccctccactgctgtgagtctctagtcctagccgtcaatcaccttgacttttgctggtggcctcatttcctcatggggccccaagaatctataggtaagcaaccctaatatttgccaagcatcattttggtctgtatgccctttatagagaactgtagctgtcgtcagttgtctctgtgggcaaactgaagcttattttttatatattttattttaattttaagatggagtcttgctctgttgcccaggctggagtgcagtggcgtgatctcggttcactgcagcctccacctcccgtgttcaagcaattctcctgcctcagcctcccgagtagctgggactacaggcgtgtgccaccatgcctggctaatttttgtatttttagtagagatggggtttcaccgtgttggccaggctggtctcaaatctcctcacctcaagtgatccacccacctgtgggattacaggtgtgagccaccgcaccccaccttgaagcttatttttttatagtgacataggttgtccagcaccatccacttgacatcgcctgcccttctgctccacacctgttctcttggcctcgtctctccacttcagcccaataaatcttcttcccctcttcccccaagtccttttcttcttcatgtgcttcttgggcccacccaatacttccttctttcctttctctgccaatctccgtcattttcttcctttgtgctctgcttaagactgattccactcagggagtttttccagcctgatctcacagaaggctaaagacacataggagtttggtgccactgtatgtcacatccataacttcatgtgctcatgtcgaatgaataggaattgtctgatgtgaaaatgcttttaggttttggccaacagaagatagatggaaaacaaaggaaatgtcctacacttcttaattttgatgatcctactcttcctgtctgctcacccaggaggtggatcccagatgctgctgctgaggatgggaatctccagattgggatgtctgcatcccagagcttgtgcaagatgatccactaggcctgtagcaatttcagtttccatttatttttatctttttcttttaatcccctttttttgggtattttatgatgcatatgacgtattagtaaaatgtacatgcatataattaaaaataaatatgcatatggtagtatcttagtcagcctaggctgctgtgacagaataccataaactgggtgtttatgcagcagatatttatttctcacagttctggagcctgaaactgagggtgccagcatggttgggttctggtgggggccctcttctgagttgcagacagataccttcttcttgtgtcctcacgtggcagagagatttatctttcttgtgtttcttcttataaggacactaatcccattcatgagggcttcacccttatgaactaattacctcctgaaagcgttatctctaaatgttatcacattgagggttaaggtttcagtgtatgaattttgggaggacacaaatattcaattcatagctggtgggttgcatgttcatatatatatattttactgatggaattcatgataaagtatggagaccgatagactaaaagagattgggaaaaacactgcacacagttaagagagattcatatgtttgaactagtcaaaatagaagcagtaaataacaggacagaacagaggttacaaagaattttcaaatagataaatgcgtgtaaggtcaaatgtccaataataccaggaagctgaggccccaaaacattatgctacaatgctagctggaggccaggatatggcaagagaagagagagggatgactagaggcaagataacaagatcaggaattttctcttgcaagaggatgattaaaggtttaaaagaggagattctcaagttgctgttgaggaacccagggggatttccccagggggtagagcaagggtgaggcaggatggaggaacctgtggggagctggcactgtggccaggctttaaattaaatagacacctaaagtctgtgaattatcccacctagagaacatgtattatcctcatcatcaatcacgaagaatttttctttttctttgtagcaacatgagtgagctaatgacttcctacaggtagattaataataaattatgagactgagccttgcggctcaagccacaagttggttggaggcaggaaagacaggagcatggcgggagtggggagatctttctcctctatcccttctactcaactgtgagcacctggaagactcttcccttgggcggagctccagaagtttactgaaggtgtttgggtggggagtgggtggtgattcaactctcatgttctgctccatcttcacagtccttcgagtgataccaggttaagtggacttgtctcaggagttcctaattgatgttctcaatctcctttttaaaactctagctcataaaagccccaaaacacttggtggctctgtcttgactaaagatacaatctaatatctcatcaaggcttccaaaattttctgtgatctctctccagcctacctttttggcttgatatgccatcttctctatgtaagtcctctgttgtagctaaatgtatctaattgttctggatataatcacgtatccccctcctttactgatgcctcatctttttccttccaacatgcaagacagcatctttattgtctcacaattatggggctgttacttctcaactcttctgagagatcttgggatgggaatagcaagatccctaacacatagagccacagactgggagtcacttgttgagagtactgagttgaaggttttccatatagagagctaactcaggatccctatcctactaccctcatgattacatttataaagactggttatgaaaagttaaaaactctcagacttgacttttacctaagaagataaatctagacatgagaaagccaaatgcaacaaacaaacaaacaaacaacaaacaacaaaagaatcaccacgaaacacattgcatatttaaattcaaatgattattccctcttttggattaacttactctgcacatagtatatgtccagtaaatgtttgtggtttatgtttagcccataaaagtgctttgaaggcagatatctaattcactgttgtagcccaatgtctttcaaagggttatcatggcatatagg

SEQ ID NO: 12238 - DNA, 12222 bp, Human
aattacatttacatttggaaatagaagggaggaagaaatggaaatgcaatcagagatgataacccatgggcaaatcattagcttttcaaatcattagcttttcctcttctatttcctgaactttctgcaatgctgttggggctcagaaaccaaaaccccaaaatacggctcactgacaagctgaactgaagaagcctcaatgttcctttccagtgcccatcatctctcccaaagcacaggtctttatctgcctaagatccagactaccaaaaggaataattgtttctttcttctccacccaagaatgtaatcacacctgaccagagacccttatactgtcaaaagtagctatttacagccgagcacggtggctgcagcctgtaattccggcgctttgggaggccaaggcaggaaaatcgcttgaagccaggagtttgagaccaaactgcctaacatagcaagactgtctctacaaaaaaattaaatttggcaggggctagtggctcgtgcctgtggtcccagcagagacaggaggatcgcttgagcccaggagttggaggctgcagtgagccgtgatggcaccactgcactccagccagggctacagagtgagaccctgtcttcaaaaaaaccaaaccaaaacaaaaaaaaaaacacaaaaaactatttacaaatttatctctgttcccttattcattcattctgcctagtaatccctgaacagaattcctccttctcccaccctcacaaacctgttttaccaggagggtatataagcttctgaacccttttcggggtgggtaatcatactgtgattctccccgtgtatacattttaaatacatttgtatgccttttctccaattaatctgccttttgtgaattgatttttgagcgaatcttcagggggcaaaggggaggtttcccattggctcctactttgtcatttctccatttaattagaaaaatacttcaggctgggcgcggtggctcacgcctgtaatcccagcactttgggaggccgaggcaggcggaccacgaggtcaggagttcgagaccagcctggccaacgtggtgaaaccccgtctctactaaaaatacaaaatttagccgggcatgggggcacgcgcctgtagtcccagctactcagaaggctgaagcaggagaatcgtttgaacccgggaggcggaggttgcagtgagccgagatcacgccactgcacttcagcctgggcaacagagagagactccgtctcaatttaaaaatcaaaacaagccctttcttgcggtgacgacctacccacgagaacatgcctctcgcaaaggatctccttcatccctccccagaagaggagaagaggaaacacaagaagaaacgcctggtgcagagccccaattcctacttcatggatgtgaaatgcccaggatgctataaaatcaccacagtctttagccatgcacaaacggcagttttgtgtgttggctgctccactgtcctctgccagcctacaggaggaaaagtaaggcttacagaaggatgttccttcaggaggaagcagcactaaaagcactctgaatcaagatgagtgggaaacaatctcaatgaacacattttgggaacaactacaacaacaaaaaaaaccttcaaaaaacctaggaactccagatgacttcctttgggaattgtcccttaacccttcatgagaagtcaggagatgactcctgtttttcaggtgacaaaattggagcatggcaaaggtgatctgcccacttcaaatcgctagctagacggagcatagggactcgaactgccgttttcctcgcctccaagagtacagggacgaaccggtgagcagaaggcctaagaagtcaggcacaagaggtttctgcccaggaggcacagaatgaaacttgccggctgttggccccgccccacttcgaagctccgcccaggccaagaagcgcgggggcgggagtgagggggcggtttccatggtgacggcaaacaaggcccacactggacagggcagctgctgggttgctactctcgcctccgccatgattccgcccgcagactctttgctcaagtacgacaccccagtgctggtgagccggaacacggagaaacggagccccaaggtaaagacgggggctcgggagacaaaggagcctcgaaactccgatagggaaagacacattcccgcatggagggtcaggaatctcaagggacggggattgcagcgactgggagtaaagggaattgggaagtcagagaaggagggtgagaggattgtataggaagcccagatgttgggtgtgaccccagagggcagatttaggatggggaaggaggtcacagggagatggatggggctcactcttcttaatggtacgcgggtccaagaacagatgactaggtagtgatttccccatcaccagaggtgtgaaagcacatgcgccagaaacacctgttcaagcattgagttggggccagacttcatggcctccttcagctctgtgacataatttctgctgagaagaccgacccaaagtaggctaggaagaggggagggctgtgcagaagacctggagcaatatacaggttggggatgtgtggagctgagctcctgaacaatttcctgccctcacctgtgccttcatctcaggctcggctactgaaagtcagcccccagcagcctggaccttcaggttcagccccacagccacccaagaccaagctcccctcaactccctgtgtcccagatcctacaaagcaggcagaagaaatcttgaatgccatactacccccaaggtaagaaagtaggagcagtggctgggagaaggcctaagcttttacatcgtggattttgggagtgtggggggaggcactctgcctctgttcctggctggggtttcctcccagtatcacagagctcctagaacttacatatggctggatcctggcagggtggtgggagacctcttctcaatctaccctcatttcctgcatgctgtcacccaatctcatggctttagataccacctatgtgctgatggctcccaaatgtgtatttccagccctgtcttctccactaaactccaggaccatatagtcttctgcttcctcattatcttcatgaagatatctaatagacatctcaaactcaatatattcaaactaaatcacaatttcttccttccccaatctgctcatcccccgtattctcctttttactagggactcaaaccacctttcattccttttgatcactctcacagcatgtgtcctatccttcgtcacattcttttggctccaccttcaaattctttcccaaatccaaccacttttcaccacctctgcttccaccatcttgctcctagtcactggtggccactcgcactgctgcagtggcctcctatctgaaaacactgcttccactctgctcctagaatctatcctccatacagcccctaagtcataagtcagatcatgccagtctctgccagaaactcttttgtggcttcccatctcagactaaaatcaaaaatccttacaatggcctggaagatgtggcatgatctggcctacgatgtatccctgaccttatctcctgttattctgtttcttgttcactgtgctgaatccacagggacctcacttgctatttctgaaatgcctcattcactctcctaccacagggccctgacagctggtgttttcactgccaaagatgttctccccttgatattctcctggttcctttcatttcttccaggccttccttgagaatttgctatagcagagcacccctgcccaacatgatctccttttcttgcttttttcttctgcagccacattgataaaaggacatgccttttcatctatttttatgtaataagttgacagcacagttggtaaggctatgaggaaaagggaaatgggggcctacgcaggcacacaccttcatgaacctctccaccccgatacacacatctgcctctttctggctcgcacaaggttcatgatgtcctgtgtttcccaccccgtaagttggtgggtagttcctactgttcacatcaagcaacaaccataaatcggtcttcagcatgttaggagggtaagatctggaacagtggggaatgatttcacagaggcccgttgccaaggtggaaattgtctaccacctacccattcccaagatccctgtggaggcagcatagtgggtgtggctttggagcctcacaccccaagggatggaggattctggtgggttggtggcaaagctgcccctcaccactactcaggcagagggctcaaagggccctctgctcatgtgctagggaccttcaagtcaacgggttttgctcagcctcgctgtgtctgccacagggagtgggtggaagacacgcagctatggatccagcaggtgtccagcacccctagcaccaggatggacgtggtgcacctccaggagcagttagacttaaagctgcagcagcggcaggccagggaaacaggcatctgccctgtccgcagggaactctactcacagtgttttggtgagtgagccaggtgaggggtgggcactacacaccctactgctcccttcccttcaccttcagcacagatccaagcctgagcaccttggagctggagcccatctcatgctggaatcccctcttctccccctgcctgacccacccagcaacagctaactgcccccttccccttcccagctgaagggggccagcccctccacacctgtgggtatttctcctcaggcaggaggagagactaagaaaagaaataagacacagacaaagtatagagaaagaaaggtgggcccaggggaccggcactcagcatacggaggacccgcaccggcactggtctctgagtttcctcagtatttattgattactattttcactatctcagcaagaggaatgtggcaggagagcagggtgatagtggggagaagatcagcaagaaaacacgtgagcaaaggaatctgtgtcacgaataagttcaagggaaggtactatgcctggatgtgcacgtaggccggatttatgcttctctctacccagacatctcagtggagtaaagagtaacagagcagcattgctgccaacatgtctcgcctcccgccacagggcgttttttctcctatctcagaacaaacgtacaatcaggttttatactgagacattcagttcccaggggcaggcagaagacagaggcctttctcttatctcaacggcaaggggccttcctcttttactaatcctcctcagcacagacccttcacgggtgtcaggctgagggacggtcaggtctttcccatcccaccaggccatatttcaggctatcacgtggggagaaaccttggacaatacctggctttccagggcagagatccctgcggctttctgcagtgcattgtgcccctggtttatcgagaatggagaatggcgatgacttttaccaagcatgctgcctgtaaacattttgttaacaaggcacatcctgcacagccgtagatcccttaaaccttgattccatacatcacatgtttctgtgagctcaaggttggggcaaagttacagattaacggcatcttagggcaaagcaattgttcagggtacaggtcaaaatggagtttcttgtgtctttcttttcaacgtagacacagtaacagtctgatctctccttcttttccctacaccagccccgcctcttctacaagtcctccagctgccaaccactatattcttggcaacttgagttcctcaccccttagcagatgtttggagtaaaacgataacttccatctgttttttcaaagattttctataataagcatgtgctaattttttagtcagaaagattaatgttcagtatttacatccatccatccatccatcaatatttggcccttggtccagaaaaatattgtgatttgttgttaacccacagacacgagagatttaagatgcacctccttgagtgctggtgtcaaatggctgtctcccagcccagtctcattggctcttatggacgccgatctgcaaaccacctccaaaccctcaggcagctgcagggtctagcaggcttccctatccgtgtgttattatggtttgccctccaggtcagcatttatggggagatagatgggcaagctctagaccctgccatttccctcaaaccagtgcagccaagggggcacacaggatgtcccagctgctttaaaacagctgccatctttaaacagaaaaagtcaggttttttcgagtagtaaccagtttttacctaaggcaggaagggaggggacccagtgctgtaaacaaaccagagcctcttgtctcctttgctctggccaacccagtcttgctgactgtgctactcacaagtgccaagttcagaggagtgactgcatggcaaggctctttgggccactgaaggcaccctccctgaggcccttctctgaggccttgcactttgtctccaagcgagaacaccctaatgtccttcccaagaggaagggtgtttgcagtagacatactgcaagccccctccccacgccctgtctgatctcatggtgtgtgtgcattggaagatgagttgatccgggaggtcaccatcaactgtgcggagagggggctgctgctgctgcgagtccgggacgagatccgcatgaccatcgctgcctaccagaccctgtacgagagcagcgtggcgtttggcatgaggaaggcactgcaggctgagcaggggaagtcagacatggagaggaaagtgagtggggtttaccgtgacccttggtcccatctcttctgtaaacctcagggccacatgcttatcattccagcactacattctgacctcctaaggtgctctgctgacagtcacgacacctggacttgcatcacctcagtgagggacccctggttgagtatgatggccagcctggtggtcttggcagagttgtttccgctgtagacgctccatgccaggcactgacctcccactgggtggcagtatataccctggcaatgtcatgtcccatgtcccttccacccaggctcacaccattccattcacctggcgacatcccaggatgactgggcattctctcctcagatcgcagaattggagacggaaaagagagacctggagaggcaagtgaacgagcagaaggcaaaatgtgaagccactgagaagcgggagagcgagaggcggcaggtggaggagaagaagcacaatgaggagattcagttcctgaagcgaacaaatcagcagctgaaggtaatcaacgcgcagggtggggtggaggtgccccctgccctgcgacccagccccacaggccaggcattcggttccttttccatggcttttaaatgtttgtccacatgcactgccaaaggataaaggaagctgactttggtggtgggagaaggggagggctccagagggggtctctactctcaactccaaatctctgaggcgcctcagcctggctctccagtggaggattcttctccctggaaaaaagttgcccatcctcaaggaagaggtggatatggcaaaaagtggaactccattcccctggaagctggtatgttggagcctttctggagggggctgggctccaggtggcttgcgtggtagtgccatcccatggctgtctcctctgaggccctgtttcagggcataaccagggaagaagtcaaagggcagcagggccctttgagaggaagaaccatttcaaatcagaaaccttccccagaaatgtggtcggggaacccaggcacaggtgctcttcctcgaagtccgatgccagcagtggtcttttatccagctgaggtgataggagggagggggctggtggacaaagctgggcaggaggccatgctacaggcactgcaactcccagctgtttggtccaaaggtctcaaaaggtaggccctagatcaacatcgtcctcacctggcaaagcaagacaaattattgggcccaccccagatctaccaaatcagaaaattcggggttggggtccagcaatgtgctttaacaaggtctcaggtgattctaatgtttgcagaagtttgagcatcactgttctggaaagatggcctactgacatttagtggccttctcccatggccctggccaaaggaccctggatggatctccctctcctccctaggctcagatagaaaccttacaatcttgacattgcaggcttgtttggtctacacaccagcaggactggccatttgcgataaagaaggctttctgttaaccactactggaacttttcttgttgcacaaagaaaagcaagaaactttcacagccagagatgaatctgtttccttagcagcctctgaggctgctttccttaactgccatattcctttttcataagcctgagttcctcagttcttcctggattagcaacaagagcaaaccaaataccttagcatgtttctaacatttaaaagcaatcttgtaatctccagggtgaaagattctttagaagttggcatttttaaattttttttcttttgagacggagttttgctcttgttgcccaggctggagtgcaatggcaccatctcaactcattgcaacctctacctcccgggttgaagtgattctcttgcctcagcctcctgagtagctgggattacaggcatgtgccagcacgcccggcaaatttctgtattttgaatagagatggggtttcaccatgttggccaggctggtcatgaactcctgacctcacatgatctgcccaccttggcctcccaaagtgctggaattacaggcttgtaatacaggaagtgagctatttttattggctcaaaactgcattgcaaataaagcagctttgctgtccccaggatagacctacctaaagatctgtccagtattattttattggctaccagaggaacatagtaaataactcccaagtgtcttaagctttacataaagagggacagctctcggctgggtgtggtagctcacacctgtaatcccagcactttgggaggccgaggcaggtggatcacatgaggtcaggagtttgagaccagcctggccaacgtggtgaaacccatttctactaaaaatacaaaaagtagctgggcgtggtgatgtgcatctgtaatccaagctactcaggaggctgaggcaggagaatcacttgaacccgggaggtagaggttgcagtgaaccgatatcacaccatcacactccagcctgggtgacaagagcaaaactccattccccacccccaccccccaacaaagagggacagctctgtattcactggcagcatttctctaattgtgtgccaagttgtctcagtggctgaaaattcactgtttcccaaacctctggtcccagcagaactcccaggatcctaaaccagagagccaatatttttttttttttgagacggagtctccctctgtcacccaggctggagtgcagtggcacgatcttggctcactgcaagccccgcctcccaggttcatgctattctcctgcctcagcctctggagtagctgggactacagacgcctgccaccacgcccaactaatttttgtatttttagtagagacggggtttcaccgtgttatccaggatggtctggatctcctgacctcacgatccgcccgcctcagcctcccaaagtgctgggattacaggaatgagccactgcgcccggccagagagccaaatgtttaacttagcagacatattctggcctgaaacctgagccatgaaaagcccttacaacaatgcattcaatatccttttcaatgctttatatcatacccggagccattattgtgttgaaaccaggacagctctggcttctcctcatatactaaagactgtatgccaagctagaaactagctaatctagaaaatatggatttggggatcaaggggaaaaagaacccttggagtgacagcatgtggattcttcttcccagagatttgatcacctctcagctatttgtatcaggctgcaagtttcaagtattaatggagcttgtttttgtttttcaggcccaactggaaggcattattgcaccaaagaagtgataatttccacatgattaatttccaacaagacacttgggagttatttactgtgttcctctggcagccaataaaatcatcataagccctttgtaataaaaagctagtttcctgagtgaacaagccataacctcccctaaacaccacctaggtatttgttagaagtcacactattactccaatgtcatcagacacctaaggtctgccagccaggctcctggctgggcaatggaagatggtgtggccctgttagtctccgtgtgtggcttactagccagccttgggaactgccaactcaaattctaagaaagccactgctttctcatcatcactctataccaatacttatttctggccaaatgaatctgcttctctgcccctcaaacttttagttcacaattcatcttctaccttaacttgggcttcttgggcctctggccttccttacttaatgtcttcttttccctactctaatgcatttctaactcactttggagctttggttttctaatgtattatccccacttgccagtcaactggaccccttcctcctcggtttcagactgcctacattaggaaacaatggcagtcaaacccatggctttggagaaagtaaatgtttgccagaaaggaatactagtcacagtggcctttgtgagttgtctgcaactcagctcttcccccagcacagatctgttccccttatcctgcagaaaatcaagccctgactctgcactccccgaagtagtgatgttaattaacaactgaagaggtaactaaatctcacatgcaggtctaatgactaataattggagtacggctgctagacaactgcattttagtatttctcttccattctcctggttttgtagacccagaagattgaatgagtgacataaatctttagttcggggcaagccagggtgggctagggtggtaagctggaggacttcatccttcagttaggctgcacaagtaacattacctaaaaggcactaacatgctcaggttccccagaaagaggcgtaagaagggcctctccttagcagagcttccacctgccatccgtcttgggttcagtgagcttcaaggctcacaatggaagcactgtcatttccccagaaaagctgtgttccctatgctgaacacaccatacacattctcatctggaatctaaggagcagcttttaccctgatccagtatcctgaggaattttaagcctccactcaaatgacctgcctgtgttgtcatttccatgggaaagaactctttccacgagatctgctagttccaggcctctaagacaggaacgtatgtgccataagtgggtctacttcacagactcaatgaggcagaaattattgtagttttctcctatttcttctgcacccaactttctccttgtatttcaaaggccaggccatgtacactaacgtccttgaaatttgcagttctgtatgcttctattccaaatcattcattaccaataaaaacgaaataccaccctttccattttatagacctcatcccctatttctgtcagacagttatatgacagggtgactgtggaacctcttagttcatccaaagtctacctgaagtgctagactttcagactcttatcactgaaatccttaaggttgaggaggctttatttccctagcactggtgaagggcttcaactgtcaaacctcagaacaaatgcattagggccttagaaatgtcaatggggcaggaagaaaacacaatttctaactgcctgtttttgtataatttaataaaaaccttttaaacattactgcttttgtctgaattttttgcgtttgtgtttctgtccctctgagtcattggtcttctttttgttcctgttcctatttttcacgttgtgtgtttcatagtagcgcacaccaacttttttcggccgttgctgtcgtactgctcgcctccgctgtaaaaaatggcaagaaaagatgaagaaaaaaaacaacaaaaccctgaaagtcattcacaaaacaggagtctctgcttctcatctctgtgttctatttcccgtgctgcttccacagctactggaagcagtgctaatgagggagggctcccc

SEQ ID NO: 12239 - DNA, 13401 bp, Human
  misc_feature (1)...(13401): n = A,T,C or G
tcatttatttgtaaagggacatatttctcaagtgtgctagttttccttgattttaatggattaaaatgtgtcgtaggtgagccattttcttccaaatgacgaagagtttttgttcctttgaaagtctggcccaggattttgtttgtttttgtttttttaaagttcttattttacttacagagttaagaaagttgaataactatacaaccagtctctaaatagaagttctaataaatcctaagatgttgcagggcactgaaagaggacaaaatttgatccctaaagccctctccaatctcatactcggtgaaaataacaaacaaaaggcttcagtgttagtggaaaactgannnnnnnnnnnnnnnnnnnnttgaaatgccattacatgaaaaagtttcactattccaattatctgtgtttaccaacttgtggagtaagagtggctgactgaatatgttagctttttcactacactattatatacattggtcaagctttctatattttcttagaatttaagattttaaagtctttacttttttaaatcatttatttgtaaagggacatatttctcaagtgtgctagttttccttgattttaatggattaaaatgtgtcgtaggtgagccattttcttccaaatgacgaagagtttttgttcctttgaaagtctggcccaggattttgtttgtttttgtttttttaaagttcttattttacttacagagttaagaaagttgaataactatacaaccagtctctaaatagaagttctaataaatcctaagatgttgcagggcactgaaagaggacaaaatttgatccctaaagccctctccaatctcatactcggtgaaaataacaaacaaaaggcttcagtgttagtggaaaactgagttcttaaaaagcaggtaaaggtcctgtttggtccttctccagagctgaggagaaagggttttcagattataaataacagaggtgcccttgtatggcacagaattgcgataagactttacttcttaggggcttaaataatgaagtcagtaaaagaggactgaaaacgaacataaagaagagctttagctttgacgcaaagaattacatcagtgcttgacaaaaccgaggattcttaatttctaaaaacgctttctttaagcacttcctaacctttcattatctgagacaacatatcaagtgagcagcagtacaaaggatgcatgtgatttcgaaatgccacaattgagccaactgcagttgcacgcgtacgtagtatagagaggtgtgatcaaaaaaagaatatagggagcatagggcttcgtctgcatcaaaagatactctccccatcttctatagccttaagttttgcgaaggtaagtttctccccgcttgaaagcgcccccagggacaagaattcatcttgaccaagcctaaggccgtggcatgcaaggtgttgagtcaccgggtacagcggtcttgcgacataaatattatttgatgacgaaggtactcggggcccaggtgccaaggtaaaccactggcaaagatgaccgtggttaaggcagtagaaagcaggctcgacactgagacgcggttccagccctagaaggattgcattttacgattcaggcaaacttcgagtctcctcatgtgacatgtgtgcactcctggaccgttttaattatgagaaacgtggtttgcagcatgattccttccagtcgataaatcggaatctctctcgctcccaccccttcttaacttcaggcttcctgcatcccggagcactcccggcagccccttccctcccccgccccggggatgctccgactcggcgcttagccattcatcaaccggttcacaccggcggcggccgccgcggagtgacgtccggagggggcgggcctccgcccccgcctgtcggctcctggcccgcggttccaggccgcgattggtggctggagggttgcacgtcgcgccggctataaaggggagggcttgtgacgcaagggcgcctcggcgcgtgtattggctccttcggctgcgggccggctcggctacgcgctctgctccgagccgctcactgcatggtagagtctggtgcccccgccgccgcctgcatcgccgccaccgccgctccgccacgaccaccgccgcctcctgccctgcagccaccgccaccgcctgtgtcgccgccgcctcgggaccggctgtatgattaggccacaatcttcaatgagtaaacatattcctgtgagtagccgtcgcatcgtcgcctctcgggctgggaatccacgaccggccccccatccccgctgtcgcctttgttcggagcccggcgtctcctccaggttgccccgggttgcggttccggtgggtcccgggtgggagcgggcgggttatggccctgtggccggccgattgcggccggctgtgcggaggcagatgccgggcccctcggggctgcggggtggcggttggccgccggaggcaccggcttttgagtccctcccgagcccggagcgacgggggcggcgcggtccggcttctgcggcggccgggggcagtttcggcttccgcagcgggccgggtgggtggcacaaaagccgctttgtgaccgccgcctccgcccttggccctttggtctggcgcgacccgtccgggcatggcaggctccgcggcgtcccggggcctctttgttcggccggaggagagtggctgcactgggagcgggagacgtggcccggggtggggcgagggctgcgcgtgtcactgcggagccggatacggggagggcgcggcggtggcgggttcgcctccagatccgggcgggcgtggggtaggccggacagccaggcacgggtggtaacgatctggttccagagcttctcggagctccggggtgggcgcgggacagccactgggtgcagctacactcttgtgctcgacggccgggacccgagcctcagacaaaatggcctcggcgcccgcgcctgactgaaggcgcggcgcgaacccgtgattgcggcgcggagagggggcgcagcgggcgtgctcgggcgcacacagccgcgtgcgcggggcggcggccctctggggcattccgcgagctgcacccctgcccgggccagagtggggttctgctaggtgagaacttcggccgtccgccccgccctcctcccaggctccacctggtaattcgagctgttccggatttatcgccccacctcgggctcgtgataatgggaacaagtctagtcttgtcctttctctgggccagtcgtcgagaaatggcctggttcggagcgtcttggaaactgacagggctactgttagttacactgacgcgaaggacttcccgtccgggcaccagcatacatttcccctgccaattttggaagggccctggatggcgccttttaatcggggactgtttagaactatccctgagctctgtggtgtaatatgttgttgcctcctgttggtttgtggcagcagtagccaaccagagacggaattctgagggttttttatcttctgtccgcggagccccctaccagtccacgagtattaagttatttacactacgattggaactgttgacctgcccgacatctagatcctgaggcagtgcttcctgttactcagtcagttgaaaactagaaaactaaatcattcccaagagtgagcagcattttacacatgctttcttaggtgccctaagacctaaatagatgtggaacagactatacaacgaattgtttgtgacaaaggagttacacacattaattggcttgactctgcagtataataatgatttaagcttctgcacagagattactctttcctcctctcccttcttgtatatgattgtgattataatgcaactgataggtgggagggaaaaaatccccattatggatagtttttcctgtgggtaggagattgggaatggaggagtgtcttgggcggaacagaaatctatcggtggccaccactgctttaacagacgagtccccccatccactaggtggctccactcagtaaaaataaccatttcaggaagggaattcttaatatagttctttctctgcttcctgatgaaagtgcttacttacatgaagggatatggccagactaggttgtagccgacaggagttttagctattaaatatggaaatagtggtgtgaaatactgcctcaaattagcttttaattgaaaaaaaggtaatacctagaaattagaatactgtgatgagtcattataaagcttttaaagatcattgtatgtcattgggaaagtgtcagaatacactttttattctacggaggttgtatttagaatttggggtgaaagtataatgaaattattttcagattactacaatctgtattcactgtaactgtgatggctttgtaatttagacacttaattttttaacccagctgaccaactaggtgaagtaacctctgagggcttgtttgaacaaacttgtgataatgaaagttaccttttttatgggaccttttgataaatgattgttaatgctagttgtatgttttaccagaaaagtagactgggtttttgacttgatgttttctgcagtaatcatcataagaattattcttcaaaatttagcaaagttctagaaactataactagcatgggactatttaaaggtgtaaaatggaaatgggagcagatcgtttgaattttaattttaagacttcaaatgcttaaatttaagcatggaaactaatggaaccttttgttaaaacactttggtaatgagagtacacatgaagtgcttgaggcagtgactatgaattactgctcttgttaacctgttattaatactttccttagtgccctctttactcccgagtacacaagtaccttataaactatttggaagaagactgattattaacatcagtgtcttccatgtacatattttaaaaatatgctgtgactattggtttaatgtttgatattggcataaaaatggtttagttcttaagggggaacttagagaaaatataaatacattcatatttgtttatatttattggttacagtagttaccttgcttttgagacctgccacttccaccttcaacatccctttgtccgccttctctgagttggatttcagttttgagttgtatatgtgaaattttggttttaaaatacaaaagaacattattaaaattatgaatattttctttacagttataaatgagagttgtttcctttttagattcataagcatacattcttatgatatttcacataacaagttgattttcagagactcattttcctcgtcttcagtttaatgggaatgataacagattgttaaggataaagtgagattctaaatataggacttaaatcagtctaagaaaaggatataaaagcataaagttggaaaagaacttagatgtttcagtttatgagttaagtaaattatgcaagactaataacttcagagttatctggagtttgtattaatgtgtaaaaatgtttttgttagttggaaaaatcaacataaagtgtatgtaattacaatgtaaagaaaacaactatcgaaagggataattattagaatcatataattatatattatatatagatagtatatatacagagaatataactagatagaatatatatgaatatatatatgaatttcacaaaaatgtaacaatgggtttggtttttttttctgaggaatcttggtaatagatcatggatttcagtttaatctatctgactgcttgttttatgctgattgatttaatctgtactcaccccttgagttttgcaattcaagtaaaagtcgatgaagcggctcaggccctgctttagaaaaatagttgtgtacttaaatagtgtaaaaccctaatgtatttcttttgaattggaaaataacttattctctctttctgtctttttcttttaaacagcaattctgtggtgttcttggtcacacatttatggagtttctgaagggcagtggagattactgccaggcacagcacgacctctatgcagacaagtgaactgtagaaactgattactgctccaccaagaagcccccataagagtggttatcctggacacagaagtgttgaattgaaatccacagagcattttacaagagttctgacctggatggggtaaacctcagtgcacttcttttctgttggcctcagtattactggattgaagaattgctgcttcttgttaggaggttcatttcacttatcattacttacaacttcatactcaaagcactgagaatttcaagtggagtatattgaagtagacttcagtttctttgcatcatttctgtattcaatttttttaattatttcataaccctattgagtgttttttaactaaattaacatggctcgaatgaaccgcccagctcctgtggaagtcacatacaagaacatgagatttcttattacacacaatccaaccaatgcgaccttaaacaaatttatagaggtaagatttgatatgttttagtagcttaaattgattgcaatataatagtgggacttatagctaacaaaataaaaactactttggaaaaaatgagatgatatacctacaattccagttcccagaaataaatgtcaatgtcttctataggttagaggtatatttgtacattttgagaagggcatgtgcttgagttaatagttattgtacctgagtttgcttgaattggtatgtggacagtaaaacagtatagctcttacttatcttgtaagaaatttacatgggaaaggttgccatttatggattttttatatatctgcttaacctaatgactaatgccataaaccagttggtttttcttgaaccccatctgatgcttagaatccaattttcaactacaaattctgttccttcctaatggtagctatgtagccaaaactctacctgcctctttttactaggagaaaggaattgaatgctgaataatatatcgggatgtgcacatgttttattttataaatacctacagttgttaagaaatagcaaataggcctctcagaacataatggaaatacttttttttcctttttttgagatggagtctcgttctgtcacccaggctggagtgcagtggcatgatctcagcccactgcaacctctgcctcccgggttcaagcaattctcctgcctcagcctcccaagtagctgagactacaggcgtacgccaccttgcccagctaatttttgtatttttagatgtagtttcaccatattggccaggctggtctcgaactcctgacctcaggtgagccaccacgcctggctgggaaatactttaatggtactttaatttttattactatatattatatatacactaatatatactatatagtgtatataatagtatattatattagtaatatgtaattagtaataatgcattttgaagcctgtagttttaaatggtatgtgggcttttttactgtagttaagacttcattcaatgtattttaaatcagtaaagtttaaggagtgagtataattgagtgaagtcagattacccgattagttataaataatgcctttagttacatttacctttgtctgcattgctgctagccccttttggttaatgtttcatcccaatccggtattaccatgactgtaaacaacttcagtgtatgaagggggcacacaatttaaacaaaagaaggaaaacttttccagtttattaaaaatatgtatggtatttaatattcacttttctttttatattctagcattgtcacttaaaacaaaatttgcttttgtgttaaacataaatggattctagcattctttaaatgatcttctgttaaccagcatacttactgatcagagatgatcagaatataaaatgttgagttatagtgatgtggttaaacattaagatttttttaatgtacgttttatccaggaacttaagaagtatggagttaccacaatagtaagagtatgtgaagcaacttatgacactactcttgtggagaaagaaggtatccatgttcttgtaagtatttaacagttcttatgggtttatggtgctgtgctacaaaagtttattcaaatagtaaattcaaataaatatctatttaagtcataaatagacctcaaaaagctaaaaacaaatattatattattgtgcagaatcttaatttctaaataaaggtgaaaagctaagcaaggatttgaagttgtgaaacatttttgtaaagattgagcatttagtcacatttggtagacaacagggtttaataagatttgattaaacattaaaatgagaatgcttttgaaaacatttccatgttagaaatttagaattattactacagtgtttatattaatgatctaaaatgtttaaatattcttctgacttaggattggccttttgatgatggtgcaccaccatccaaccagattgttgatgactggttaagtcttgtgaaaattaagtttcgtgaagaacctggttgttgtattgctgttcattgcgttgcaggccttgggaggtaaatgaatttatcaatttgattctaggtaaaaatctattgataatgaaaatacagaaacttgaaaaattcttataattttttaatataaagtcaacatttgtcataggtattacttaaataggaagggtggtagataatacttctgagttggggaatgtttggagaaataaatttacaaagatctgattttgaaaaaactatttatcaaaattcttacctcaccagagctccagtacttgttgccctagcattaattgaaggtggaatgaaatacgaagatgcagtacaattcataagacagtaagtaatggattctcttttcatttgtactctctttcatttccttgttgagtgtcagtgagtttaatagtctaatagcccatttaatcattatgattattttttgagatagtattaaaaccaggaaatcaagatcttacattcttttttgcatttcatgcagttgctcatattactaagattctaatccaacaagagtttttgaattattgttttgctttaaatacttgattgaatatgttggttattttgtatttttattgaggtataattaagatacatttaaagatacaataaaatgcacaggtctccaaaggagaccagttgacaataacagccaaattaaccatccaatacaacacatagaatattttgagtgctgtagaacatgcctttgtggcttttgtagtcatcttccctgctaccagaggcaacttctgacttcactataaattagttttgtcttttcgtggacttacgtgtaaatggatttgtgagtcgactgttgtaaccaatactcaaacgaagatataaagaaaattaactttttatgattttttccatttacactgatgtgcctgttcatattcctttctgcatcaggtcacagcctaattaatcaaaagataaattgccacaagagaggtgatggttgtctataagacactaaatattactgtagggggcttttgccttgtttcatttttttttttttttcctcccagaaagcggcgtggagcttttaacagcaagcaacttctgtatttggagaagtatcgtcctaaaatgcggctgcgtttcaaagattccaacggtcatagaaacaactgttgcattcaataaaattggggtgcctaatgctactggaagtggaacttgagatagggcctaatttgttatacatattagccaacatgttggcttagtaagtctaatgaagcttccataggagtattgaaaggcagttttaccaggcctcaagctagacagatttggcaacctctgtatttgggttacagtcaacctatttggatacttggcaaaagattcttgctgtcagcatataaaatgtgcttgtcatttgtatcaattgacctttccccaaatcatgcagtattgagttatgacttgttaaatctattcccatgccagaatcttatcaatacataagaaatttaggaagattaggtgccaaaatacccagcacaatacttgtatatttttagtaccatacagaagtaaaatcccaggaactatgaacactagaccttatgtggtttattccttcaatcatttcaaacattgaaagtagggcctacatggttatttgcctgctcactttatgtttacatctcccacattcataccaatatacgtcaggtttgcttaaccattgatttttttttttttttaccaagtcttacagtgattattttacgtgtttccatgtatctcactttgtgctgtattaaaaaaacctccattttgaaaatctacgttgtacagaagcacatgtctttaatgtcttcagacaaaaaagccttacattaatttaatgtttgcactctgaggtgcaacttaacagggagggcctgagaaaagaatgggagggggctattaattatttttagcaaaatgttgcctttgtcttgtgcaaacatgtagaatatgctctttaatttagtaaaatatttttttaaaaggtagagatgctttgttattgtaatcataaacttcctgaaattcttgtaatttttttcccatacttatcagaagtgtgtttaccaacttatttttgtttgaaagtgtgattttttttttccttcccaacctctcttgcaaaaaaagaaatgggtttctgctaatgaattgagcagacatctaatattttatatgccttttgagctgtgtaacttaatatttggatacttgacaatttgttttattatgtaattgataaaatggtgatgtgtattaatgttagttcaaccatatatttatactgtctggggatgtgtggttatagttctgtgggagaaataattttgtcagtgttcaccagcttgtaaaaacttagtgcgagagctgaaacatctaaataaataatgacatgcatttatcatcattgagattggtttgcttaaaattaacttattttgtagaagacaaaatgaattgcacttcacttaatgtgtgtcctcatctttttacaaataaatgaaggattataaatgatgtcagcattttagtaaacttttagacaaaatttgttagggtcattcatgaaaactttaatactaaaagcactttccattatatactttttaaaggtctagataattttgaaccaatttattattgtgtactgaggagaaataatgtatagtagaggacagccttggtttgtaaagctcagttccactagttcatggttttgtgcaacttctgagcctcagttttctcctttgcaaattaataattacatacctttatagattttgaaattaatttaaatattagtatttggtacatgaaggcttaatgttaagtttcctttaatgatccacaataatccctttgatcacgttaatctaaatctagatgtctttgtctaattttttttgaatagcagttataaatgtaaaggactcaaagtttaagtaaaaagtgatactccaccttgtgtttcaaagaatttagttccacctcttcataccagtttaacacttaatatatttcattggattttagacagggcaaaaggaagaacaggggcctctggaggcccttggttatttaaatcttggattatttgtgatagtaatcacaaatttttggctaatttttaacctgaggttttgttttttttttaaaggaaatgcagcctagtcttgagaacataattttatataatcaattactaaatgttaaactattaccacacagcccataaaacagcatttgcgtttattgagagagaggatgtgccatcatgattaatgaaaactatcttttgagtttgaaaagaaattaatttgcagtgtttggattgtatatatggtgctaaaaataaattaatttactttataaaccttatctgtacattatacgatgtgatgaaatttgctttttatccaaatattttgtatcttgtaaatatggctaattataggaatgcctataatacatcttagattccttatatctaataagagttcaaagagttatgagttgaagtcttgaatgcaggaaactatctgatagtgttctaaaatttggttacttgggtttggatacccttagtgggatgatgtaaatagaggctagctacctaggcttgtctatagcaaccataatgttgatgtaagtaatgcggttactgaatcataagaaaatgccatctctttttagttgaaggaaaactctggaagtaggtgccattggtcattctgcagtgcactgcaaccattgtttcccctagtgccctcttttccctagggcattgctctcctattcccacgccttaacacagctctatacctagaagcagccagcccaggcatgcagtcacatttaatcacatcccccttctagagtgcttcaaaatgatgtagtccctcaacttggctaaagaatctcaatctcttgaaatttatttttttaatgtcatattcatctggtaaatatctactgtttgccaggcatttaagaatatggcaaagaacataaaagatggtgtcaccagattttggtcaccaatgagtacccgacccgttgccatgattaagagagaatgctttctattggagtttcaggaaatataatttgagaatactttaaagggaagtggaagtataagtgaatgatatttttcttttacatgtaaacaatgaagttatttcaaagttaagttttaaacaaaatacatgaagtagtgtctgccatacatgttaatattctacattcttgcttccttaaattaatatgtttgtgtgtatatatgtgcctcacacctgaattgaaaattaaagactggtttaaaagtggtttaaaagtgacatttaatgtttctccattacgtttggggtaaccagcctaagtggaatcttggaaggaaagtaagggaaaaacttgtatttgccttcaatgaattaaaccagtgatatgtgttaacgtatgaatgaaaggattgatggtgattttataattatatatattgccgcagtaaccagttaataaattgatagctaccatttattaatgattttattttcaggtagtttttataatttgattcccttccaacagtcttgtcccaattttacagtaagggatttgagcctccagataggggactagctaataagtggtagaagtcagggattcagacctgtgtttgagctggtccactacaccacacagttatgtaaataaatatgcatgactttttttgttttttgttttgagatggagttttgctgttgcccaagctgcagtgcaatggcctgatcttggctcaccgcaacctccacctcctg

SEQ ID NO: 12240 - DNA, 44208 bp, Human
ctgcaacccagctgggtgtgcacgtgttcagggcagcactgacacaccagccacctgccgccttggccctctctggactttgggcaccaacaagtgcgagaaagaggctggtggggctgagggtggctccgcgtgggcctgcaggcacccctcagcacaaacagcctgggcgccatggatgacatgttgatggtgggaggcagacacgttcctggggggaaaggggtaggtccctgcccaccttcaagccagggatggcctgaagcctggggggcctggtggccagttccaggtagagtctgcagcccagagcgaaaactagtggtgctttttctgggcccacccatgggccaatcagcacacacttcctcccttctgagcccataaaaaccccagactcagccagcgctcaggcctaccagctgcaggaaggagctacccactttggtctcctcaactcgtcaggaccacctgcctgcagaaaggagctgcccactatgggtctcctctccactgagggcaggacgctagtcgggacaacccccctgcagaaaggagcaacccacttcaggtctcaggagagctgttctgtccctcagtgaagctcctgtccaccttgctcaccctccagttgtttgcgtgcctcactcttcctggacacaggaccagaactcaggacctgccaaatggtaggattgaaagagctgtaacacaaataggggtgaaacacaaccccccactcccaaccacgttgcaggcagcaagaaggagagatgagctgtggagtgtggataggatttgagtgggataaatagtgtggaaaatggcataccgtttgagggtagaaatgacactattcgcgtatgttttggaaggggaacaaaaggaaaagggaagattcaaaggaaatgtctaatttttgtcctgcaacccagagtccaggcaaatttcactgatcacatttctattaagtccactgagtacaaggatccttcaggtgagctagtggttgaagagttgggagaaaataaaggaaatcacatacaaaagaaggcagcattgagcagggaagatactgctttgagtgtctgcagtgttgaatgtgtaaaaagcatctgcatagatgacctagaactctgggagaagggtctggacccggccaaataacatatttcctctattatgaaacagagagtgtgtgtgagagaggagaggagaaggaatggggtgggagggagcctctccccttatatttacaggggtgtaaatctatgtggctggctatgtgaacctttaacgtggcaggtaggatctttttcctttcggtgcaccttacaagcgatgcggtcctcagaaatacagatttgggagttatctatcacccagcatgatttctggagcattgatgagaccgctgattaattctcctccgcctcagagtaacactgtcgatagcgacttcggagatctctaaacttctttaccgcgcccgccgcgcccctccgcggcccgggactgctcatcatcttttccaggaagcgaccgtggaaacaataaacacgcaggccccctagcgtccttccgttccgcgctgccaggccgcctcgcctcccgctcccgcccgccccgcgggacacagcccgcccgcactccggggcccgagcgccgaccacactccaggcgcagccggggagagccccgcgcgcgcatccctccgcccgcggccgaggcgacccctcgcggtcccgcccgcccgagcttcccgcggaggcacccggccgccccgcctcccccgccccgcgcccgccaactcccagctcgcggccctgattggtcgccgcattcccgctctccttcccgaaccgccattttgaaaatcttgttgattctggggagccgagcgcgcggcgcgagcgtcacgccagacagcggcccgcgcgccttctcctcggcgtcggccgccgccgcctcccagaacctcctcgtgccctcgcgtgccaggcccgcggcggccgaaatccgcggtaagggctgcttcgggacgccggaggcccggtcgcccctgccgcggccgacgggggagggacgcggccatttggacggcggcctggggcgggggaggggacgtggagggccggcagctcgggccgggccgggaacagcgcaggccgggcgggcgcgcgcgcacgcggggcagcgggcgcggtttcccgcctcgggaatccctggacggcggcggcggagcgggagggaagccgcccctggggactgagcgctgcggtcccggctatgggaggaggcaactttcagggcaggtgtcccgcgggaagggtagcatcattcagggtggccgcccggtcctgcctgcgggagtaggaggaccgagacgtccggctttcttcccgcatgcaggttcacagcatgtccgcctcggcccctgctgcggagggggagggaacccccacccagcccgcgtccgagaaagaacccgaaatgcccggtcccagagaggagagcgaggaggaagaggacgaggacgacgaggaggaggaggaggaggaaaaaggtggggggagtcgcatcccaactgatgaatttttcagaccgaagtttttttgtatttttcacccaggaaacagttttcttgctcttttggtgtttagaggcgtgaagtcggagtgattttcagcgagaatgtgtgcacaatttatctgcttttgttttgagcgatggcgtagaattgactttgtgtattccggtttttaaagtatttgttagcgtggtagagatgtattggagtgcagccgacttctcgtccgctctaaacgttcgttaacatttcatcatttgacgggaagtttgtaggtcttggatttgatttttttttttacctgtgtgtgtgcacctttgaagttgctaagtggatgttctaattttgtccttttcattacacatcttttgccttttgaagttattgtaaggtcttggtgcagcccgttaagactgaagttataaggctagacccggaagtatttgaatactttcgaatatttttacatttaccaaaaagtttccctccctggcaaacagcggtgaaagctgttgctacttgagaaagtagttaaaaatgaagaaagtgaactctgaaagaaagttaaatgtgagcccagcactgtctcggtttcgaacctgtgtctgttttaagggagggcgatatgagccctgatttgactggaggtgtgaaacggaaacttgactgaatagaggagtgtgctgcggcagtttatccaggatgcatgcagtgtctgtttcaggtgtacccgcttcttgacatgtttccaaacatttaaaaatccgagtcgcatctcttagcattctttgatattagcttagtctgcggttatttcgtatatgtttacgactcagccacacttgggaagaggttgaagcgctcttcctaaacccggattttttttaagcctcaaccagcctgtggtcacaatctgggttaagattacaaggtgtgccttttgtttgtttaaagtggtatgtgccctaagaagggcatatttaagtaaagcatggctttttaaatataagttttcacataaactattgcttaacaacatgttattttaaaattatttttaatacaacaacaaaattggctgcactatctcgctgctagccaaagaggctctgcactttttctccaattttttgtttgtattttggtcttctggtgggggcagggttgagatgccaaagaaatggtgaattttcttcatgtcaggaaaaaattagagaagtcatgtaaatatactgtaagtggccaacacagtaatgcttggggaagagttggtagttgaaagaatcccatgttttgttctagacaaattatttttaaaaacatgatgttgtagaaattttatcccctaatagttttattgtagctgtgatttattattctttttactaatttgaggtgtttgtgggacaagtagaattgtgaaagtttttattttacttaaccctgaatatttaactttagaactgaggcatcatggaagccagacagtgaaatactttctgtattaggcttttttttttttttgcgttactataaagaaacacttgaggcagggtagtttataaagaaaataggttttattgattcgtggttctgcagacagtacaagaagcatggcgccagtatttgcttctggtgaaagcctcaggaaacttccaatcatggcagaagacaaagggggagcaggcatttcatttgggagtgggagcaagttgtagagggaggtgccatgctcttttaaacaaatcttgagagaactcactcaccaccacggattaccatgctaagccgttcatgagggatctgcccccatgatttaatcaccttaccaggcctcacctccagcattgcaaatcacttttcaacacgaaatttggagggggcaaacatccaaagcatatcattgcacccccggtcccccaactctcatatgtttctcacatttcaagattcagttgtgccttcgcagtagtcccccaaagtccggtcttgtttcagcattaacacagaagtcccaaatctgtaagtccagagtttcatctgaagatgagtttcttccacctatgagcctgtgagatcaaaaacaagttatttactcccaagatacagtgatggtacagacattgggtaaaattcccattccaaaagggagaaaggccaaaagaaaggtgcaataggccccacacagtctggtttggtttttgtttggtttttgtttttctgtgtttgtttgtttgtttgttttttgaaacggagtttcgctctcgttgcccaggctggagtgcagtggcctgacctcggctaaccgcaacctctgcctcctggttcaagggattctactgcctcagcctctcgagtagctgggattacaggcatatgccaccacagctggctgattttgtatttttaatagagacaaggtttctccatgttggtcaggctggtctcaaactcccgacctcaggtgatccgcccgtctcagcctcccagagttttaggattacagacgtaagccactgcgcccggcctacaagtctgaatcctagcagggcagtctttaaatcttaaagctccaaaattatctccttttactgcatgtctggcatccagagcacgctggtgcaaggggtgaggggtcccaaggctttgggcagctcaggatgcaagctgcttgtggctctaccatgctggagtttggaggtggcagcccccttcccacagctccactagccaatagagccttggtggtgaatctaggggtccaccccccatttcccctttccactccacactgccctagtagaggttttctttcttttttttttttttttttggagacaaggtctcacttgtcacccaggctggagtgcagtaacatgatctcagctcactgcaaactctgcctcccaggctcaagcaatcctctcacctcaggaaccacaggcatgcgccaccatgcccgggtactttctgtattttttgtagaggcagggttttaccatgttgcccaggctggtctcagactccttagctcaagtgacctgcccgtctctgcctcccaaagggcctggattacaggaatgagccaccacgcctggccctgagtagcagttttctgtgagagttccacccctgcaggaggcttctgcccaggcacccaggctttctcatatatcctctgaagtctgtcctaagaaaggggtcagattagccaaaattggcagtgattttggggaaaagggaagtgagagaaatgactagtaaaagatgactcttaggtttctgtctttggcaggtgggtggatggtattaatgttttttgaaaaaaattcacaaagtgagcaagtttggagatgattatgatttttcttttgaatattttgagtttaggtgcctgtaggacatgaattgtagctgtccagatgacagacaggcatatactgttggctctccatatctgtgggttcctcatctgtggattcaatcaaccacaaattggtaaaaatggatggttgcatctgtactgaacatgtacagatttttttattattcctaaacaatacagtataacaactatttacatatcagttaagttgtattagtcattatgagtaatctacagatgatataaagtatatgggaagatggtcataggttacatgtaactactacaccatttttttaaaaaataagggacttgagcatccatggattttggcatctgaggggcgtcctggaaccaatccctcacagatactgaggcaatattagttaatatgaatctcagatgaaagttgtggcttggagattgactgggaagtcattagcttgtagttagtaatcagagacaagcaaatagtttaaatcactaagttgatgaagttgagtgatagtaggggttgttttagtgtgtttggtcttcattctgtacaacatggccagaatatacctgttgatagccctttctcctgaagtattctttctgtgcgaatccttacattactaaatctaagctgtctttaaaagccagcacacgtgctttgttcctttttctctagtcccaaaataatcaattcctcctcagtgcacagcaatttatttgtgtatctttcttaagatgttttgttatcttttatattggcgtatatttatgtctcatttctttagtagcatctttttcaaaagatacgcagtttttatcatccatttatcccctcttagtattgagtgcagctgcacaacacaggcattaaataaatggcagaacctcgagcagtatatagtattcttttatctgactttatttcattcaaaaaatgattttattttagataaatggagcttaatgttttgaattttgaagtatatgctacctgttttctagatttttttttttttttttttgagacggagtcttgctgtgtcgcccaggctgaggtgcagtggtgcgatctcggctcactgcaagctccgcctcctgggttcatgcctttctcctgcctcagcctcccaagtagctgggactacaggcgccagccaccacacctggctaattttttgtattttttagtagagatggggtttcaccacgttagccaggatggtcttgatctcctgactgagttagccaggatggtctcgatctcctgaccgagttagccgggatggtcttgatctcctgacctcgttatccgcccgcctcagcctcccaaagtgctgggattacaggcatgagccaccgcgcctcaccgtagatttttgtgactaaacaatttaactttgagtgacttatggtcatcattaggaatgttattcataaactacaaagtaatgctctcccagttgattgcattaaatgtaaacttggagagttttatcctatccacgtacttcaggctgttctgcctggaagtctttatttgtgtttcttttgtcagtttactaaattgttattgttctctatatatcttttgaagttcttaatctcccagtctaaatttgattattcctgaagtacagcaaactgaatctcaattattaaatagaattatgtccaaagattaaacagagctagatttttttcacaaacgaagtgactggactgtaatggcaataattttagttggataaaaattagtttgctttctaatttttttttttaactgagtccctgtgagtgccaggtgagtaaaatgttactctgaaaaaattttcatggtgctctattaattaatcaagtgttttcctcttttatgtcatttgctttccaaaaccatgctcagaagaagaataaagtattaggttttggggactttgttctacatgtgtatctaataaagttaatacaatgtttaagctttttgttaattaagaaatactaaattaatttctagaaaagagtctcatcgtggaaggcaagagggaaaagaaaaaagtagagaggttgacaatgcaagtctcttccttacagagagagccatttacaattgcacaaggtaagtttattctagcttcctttcattttgtggtgaaagtgcctaaatttgtgaaaatgatggtttgtagcttagtatcagcaaggtagtgttttatacttttggtataattttatttaatttgctctgtaagagcagagttacatgtaaattatgctgtgaaaataattctcattaaattaactttgtaaatgtattagtaagccataggtatttaattgtgatttttttttttccccaggaaaggggcagaaactttgtgaaattgagaggatacatttttttctaagtaagaagaaaaccgatgaacttagaaatctacacaaactgctttacaacaggccaggcactgtaagacctttttacactttaaacctacttgtatattacttcacaatggaatcaatttctgtaaatgttagtgatccactagttcaatttccacactttatgactgagcagactgaggtatatacttattaaatgatttatcacaggaaacacagctggatattagcacttggattataatatccagggctctgtcttcttttttctttttctttttcttttttttttctttcttttaagacacggtctcactttgtcacccaggctggagtacagtgtgcaatacatggctcactgcagcctcaacctcctgggctcaagtgttcctcccgcttaagcctcccaagtagctgggaccacaggtgcatgccaccatactgtgtctggctaattgttttactttttgtagaggcagggttttgccatgtgcccaggctggtcttgaactcctgagctcaagtggtcctcccaccttggcctcccaaagtgttgggattacaggtgtgagccagtatgcccagctctagggctctttctcctgtagtagtttttattccaaactgaaatttcaaattacgaaatccaaattgtgatgaaaggttttagtgacctttaaatgtattgaaagaaattcatgtttttggattttctcgacattcagaataagtgaatgtcggtatgatttgtatgagatcatacatatgatctcatttgtatctcatacaaataagaggcaaaatcatttgtatctcatacaaatctcatacaaagtgaatttggtgtaattgtatctcatttttagcaaatacctgataaattggatgatagttctttgctaaaggattgttattatactgtacatatgacttagtatattatataatcgagggaactgctttaggttgtacgtgggcaaagtaaagttgggtgttagaatgtctgaagtagaatagaatgtctggtgcatgacataatttattttcagtgagtctgttaatctcatttaatccttaaaccaatttaatttacacaagtcccataactagtgaacggtattagctttttgtggtactcgctattctttactttgaaagaataaagtccttcttgatttggaaaagaagaattactagtaactttattacttatgaaaaggatatatttttaaatagtaactttccacatcccctggtactgtcaggtaacttttggttgtggtaaaaactccccagtgaaaatttgttcaaattgttcttttcagagacttaagtttgtaggatttttataatgttaatatgttaatgacaaatacatttttcagttttgaataagaaatgttgaatattgaacccatattgaattggttgactgttcagccagtattgtaacttacagacaggtatgaaaataaagatgttgactttgaattggctttgaatttattcttgtgtacattactgggtaataaataccattaataataaggaacattttcaggtgtcctcattaaagaagaatgtgggtcagttcagtggctttccatttgaaaaaggaagtgtccaatataaaaagaaggaagaaatgttgaaaaagtaagttatttttataaatactgtattttgatcaatatgctttaagtttattttttaatgttaaatcacattcgggccaggcacagtggctcacacctgtaatcccagcactttgggaggctgaggcgggcgtatcacctgaggtcaggagtttgagaccagcctgaccaacatggagaaaccccgtctccactaaagatacaaaattagccggctgtggtggcgcatgcctgtaatcccagctacttgggaggctgaggcaggagaatcgcttgaacctgggaggtggaggttgcggtgagccaagattgggccattgcactccagcctgggcaacaagagcgaaactgtctcaaaaaaaaaaaaagaaaaaagattcatagaagcattggccacttttttaaatgtatgtaactgagccaatttggttggctttccctttatattgtggagaacatatgtaagctttcctatattaacaccttggtttcttccattttctgtttcagatttagaaatgccatgttaaagagcatctgtgaggttcttgatttggagagatcaggtgtaaatagtgaactagtgaagaggatcttgaatttcttaatgcatccaaagccttctggcaaagtgaggatcaatttttatttttttcataaatcagttattcatagcctctttatatgaaacaaaaattgattaataacagcattgctgtcagtattcgttcatatctacattcaaagactataccttctgttgacgtatctgcagtaatttcctgatagaaataatatagatgccataggggtatgttgcttcggaaaatcagatacaagggatataaggttaagaatagtgaattaatgtcagaagggacagaaagtactagtagtcagggttaggtatctagaagacactggaagaataggaagaggttgggctgaggatgaggtgcaaggctggagggaaggggtgcaacctgtaatcaagtgaagacaaaatagggagtatattagaactggatgttttcctagatcctggaataaagtattaaaaagtgacatttaaaagctaactcttacaagtttcctatattgggtttccagaatctgcagcagagcccaggagccagacagggaagtaaaatggccttacagttttctcactcttcctaaaagctagtaggtttgccctaattatttaatggtaacgaatgacataggtgacttaaaatgtctgttgaagtgttacatgaccttgcctttttagtgtgatttaggtctgtcagcaaatgtttttatattcttccccatcttgacaggaaaggaagtgtgagagatctagcaggcctaggagttcaggggaatgccatctctgatgggagatggcattaatcaaaaccagaaaatagctctaggacttcgttttcgtccgcccttggtccttattaccattagctgcacgaggacagataaacagcagttaaagtgtaaacttttgttatacaactacaaacgcaaggggtatgatgatttttggtgttttaaattggcttgtttaaagacaaaatacttcttattttctaacttttactatagctatacttgtactttttaaggatttagtgtgaggcaaggtgatcactatttcctcagaagcaatttactaggttgttacgacagatatttttatatttatctttttctcagtggttttccaatttattggtttcaggatactgttgccctcttaaaaaattagtgaggaccccaagagctttttttaatatgagttattttgatcttcactgtatttgacattagaactgaaaaatttttattttaaaatgttaaaaataatattttctaggaaaaataacttttcaaaagaatgaaagagtggcattttatgtttttgtacatctgtttaatgtctggcttaagagaaaacagcttgattaccatttgcttctgcattcagtctttttgtgttgttgttgttgttactgttgttgttactgttgttttgagacagattctcactctgttgcccaggctagagtgcagtggcacaatctctgctcactgcaaccactgtctcccaggttcaagcaattcttctgcctcagtctctacagtagctgggattataggcgtgtgccaccatacctggctaatttttgtctttttaatagagacggggttttgccatgttggccaggctggtctcgaactcctgacctcaggtgatctgaccgcctcggcctcccagagtgctgggattacaggcgtgagctaccgtgcctggccgcattcagtcttttgcaatgtattgttttgtttaaaatctatgaagggcctgatgcagtagcttatgcctgtaatccctgccctttgggaggccgaggcaggtggatcacttgagctcaggagttcaagaccagcctgggtgacagagtgagactgtctcaagaagaaattagccaggcgctgaggcacgctcgtgtaatcccagccacttgggaggctgaggtggaagcctgaactcaggaggtcagtgctgcagtgagctattttcatgccactgcattccatcctaggtgacagaatgagatcctctctcaaaataataagtatatgaagaaaaccgagcctcacataaaaagaatatttttaaagtctttttagataattgtgtatattctctttttgataccatacaataccaaaactctacataagttgtagtttcctaaagattagttgtaatgtttaatgtaggtctgaaaccaggttaattaacttgggtcttgtatgtatagttttgtaacatgcatttaccgcttgtaaatattggttccctgaattatgtcttccaaatgttgacgttttattgaacactgtcattaaatcatgctcattaatataaatatcatctcatcagaaaaattacttaggccttggtaaactatcaagttcacagtagtagatgtgaattttccagaattctagttcccacttgaaatcataacgtttatcattggcgataaatgctctcagttttccttgaagtgacaagctcaccttgttcatgtttgaaaacatctctatcaaatacctaagtctgagttagccatatttgttcttttaaaaagtggtgttctctgggaggtgaagcttgcagtaagccgagatcgtgctgctgcactccagcctgggcgacagagcgagactgtctcaaaaaaaaaaaaaaaatgtggggttctatgaaaaaggagcttggagcgtgtttagctcacaactcagatacacaaatgcttttccttcagaaaaccattgaacttcagttgtagccatatttatgtatatcttccattttgtcacagatattagaaagacatgtacttgagagttaacacagtatttattgttttatcaaggacattattaagtgaaaccatttgccttgtttgtttctgctggtgtgtggttgtgaggaatacagtgactaatatatgttgcttccttgattagtactaaggtgccatcaattttacccacctttgctttcctttgcttttgcaattagtacaaatgtcaacacagtgaaaagagcagataaatagtgttgctattattatgaaaatagtttctacctcggagactccgaaaaaggtctcaggaaaccccaaagtccttgaaccacactgtgagaatctgttttttcttgtcatatagaatcttaactcttatgtcagtttttcatatgtgattctgtgatgattactccttaatctgatagtatcgagctcaggctattttcttttttttttttttttttttttttttggagacagcgttttactctgttgcctagactggagtgttgtggtacaatcatggctcaatgcaaccttgacctcctgggctcaggtgatcctctcacctcagccacccaagtaactgggactataggtgtatgctaccatgtgtggctaaattttacattttcttagagacaagggctcactatattgtccaagatggtcacaaactcctgagctcatgtgatcctctcaccttggcctcccaaagtgttgggattacaggcatgagccactatgtctggcctagagctattttctatgctacaagaagtttcctttttctcctctttaacaatttctcaatggtttaatcaacacaacattaatcattgattgctttcctatccttctattgtactttaccttattttatttgttaatcagattttgtttccaaaaagagataatgctgttgacactggattttgattaatagatttaactatttttggagtagtataggaaaactctaaggcatttgtatattactactttttggattttggttttaaaactcctcgtttacttttgggaattgcatttttttttttattggctgcttgaataacttaacatcttttcactttcctggatagatttatccagaacctgtttcagtcctcatactaataattcgatatacagattacatccttgctacctgtgtctggtttctgagctgagattgtgagggatattatgtttttctaatacatttgagacctggagatcatgtaacaagtagtaagagcttggacagtgagagttaccttttctccaaacggtgctatcaaagaatttatccacatggattaaggttctgataatagttgttaatggtagtatctcacatagcaaggatatgtgtatgcattcacgatttcttatagagaatcttctctgagaaatgtctttgatccaccaacttcaagttcctggagtgacctaattttgctgtttcctagtgtgcctttagaagggtacgttgttggagcaatctaggttatcctgtggtttctttgcagagagctcaagagtaccatattatacaaagcagccactttttcttaatttttgtgtaggtgacagtgacccctagactggaggttcctgggaggtaaaggacctgtcgttctagtctctgcaagaaaaatattgcctaaagttatcacaaacatttacacaattggataccttaaggttatgttatggaattttaccttaatgtttctgcttattgcagaaaataaagtaacaaaggtagaaataaaagaatataaaagatgctcaatcccagaaataaatattaattctgtaatgcgcattttaacattcttgatgttaggtaattttatggttttcaattttagaatttagcaaaacttccttgagaaagcacttaaaaattaaatttattgtttactgtaatcaactcattttcatcaggtgatctctgcttttaatatacatggtttaattgattatcagaataatagcagcatattcttagtttcataattaacatacttatcatttattgtatacttataggcatcagtgataatatgagcctgacattgttgaaagtagaggccagaagtaatgaatataaaccgtatagttcattcataaattcaggatgtataattggtaataaagttatacattttttttatgggccaggcgtggtggctcatgcctgtatcccaggactttgggaggccagggtgggtggatcacttgaggtcaggagtttgagaccagcctggccaacatggtgaaacactgtctctactaaaaatacaaaaattagctgggcgtgatggtgcatacttgtaatcccagctactgcacaacagaatgagactctgtctcaaaaaaaaaaaaaaaaaaaaaaaaaaaggtttttctcccattccttcgattggagtgttgggccttctaaagcaaggagcttctttggcagtgacagttttttgttttttgctttttgtgtttttttgagacggagtctcacactgttgcccaggctggactgcagtggcgcgatctcggctcactgcaaactctgcctcctgggttcacgcctttctcctgcctcagcctcccgagtagctggggctacaggcgcccgccaccacgcccggctaattttttgtatttttagtagagacggggtttcaccgtgttagccaggatggtctcgatctcctgacctcatgatctgcccgcctcggcgtcccaaagtgctgggttggcagtgacagttttaatgcttgtagggatgaaataaattacaaatctaacttaaaatattatcatgacaaagtattaacagccgttggagcttaacataatgtgtcttgagcttctagtcccatgtcagaacctagaatacatatttctctacaattgagaagggtcttgctaggtgtttagaacacaaatggtattagtaacacagttttaggttaacctgacacggttaaagattattctctgcaaagctgctgggcttgtaaatacaatttcttgagagaggaataagaaattgagttgataagttttcaagaagagaattgattgaaatattatacctcattggtgttatctttataaatttttatgcagccattgccgaaatctaaaaaaacttgtagcaaaggcagtaaaaaggaacggaacagttctggaatggcaaggaaggctaagcgaaccaaatgtcctgaaattctgtcagatgaatctagtagtgatgaagatgaaaagaaaaacaaggaagagtcttcagatgatgaagataaagaaagtgaagaggaggtaaaatattttactatatttttaaatcatttctttccatggggagagttaaatatttctgctataaggtacagccagaaaacacttccttattggttgtttttaattctgaagatgcagaaatgattaagtatgaacccatttcttttccttaaagagcttttagtttcattaccatgtcagagtatgagtcagaaaagagtgaggttggtgtggactggatttgaagtgggccttgagctggacgttgaagactagagtagataaatgggaagggaagcggaagtggtgcatatcctgaataggaccacataggagcagattcttcgaggatttttttcgtaatatattgatactttataattgacttggatcattttattttacggaaaaagcaagggacttaagggcctttttccccccctcaacctttaggggactatgtagtgagaataaacagcatttgaagtttatataatgagtggataaattttgtattacctgtcattttcttttatttgggagtatttgtaaaagttgagactcttagtttccaaagtgaaacttcatgaagaagagaactgctgaagcagttaaataagagggttaacctcttcagtcaggtagatcatggagagtgggtacaggagatgggtttctattattgttaatgatgttttggtagactgtattttaactttgatgttttcgttcaaaggttggaacttgctctatagattgggtaatcaaccttgccttatttagggacttggataatgtcaacttgacattttggaccagatgattcttaattgtgggtgatattcccaagctccccttgtgacaaccaaaaatgttcttcagacattgtcaaatgtccctggggcgagacaaggagggaatcatctccactgaattagaaggaataaagatatagtgaactctggtattatatgatatgtgtgggtgtttagtatgtatgtttgtcttgagttatttacaattcatgcttgttttagcgtcaaattttataaagacttctataaagctaagtatgaaatgcttcatcatttaagaaagagggttacgaatctagtaggtgcttcataaatatcttaatatatatttggcacaaaggaaaataagtaatctgagcattaaggtctttatggattggatatccgggaggaaaacatgtttgtttgtatgtatatatataacagtggaaatttttaaactgatagtatcttcattcaggaaatatttggtgtctactgtgtgccattcagattcctaaactctctttatgggcagagttaaagcacgaaacattatcatagaatataaatgtctaattttttcatagagacgttagcatgggctctggaaactgagttcaaatctgacctctatattggattattactgtattagtataagcaagttatttaaactatacctcagtttcccatctgtaaaatggggagtgataatagtattagcctcatagggtcatattaaaggattttatttaaaatacttagagcggtgcctggtgcatatagtatgtaagtattagttgctattattattagaattaaaatgatgttttatgacaagtaaaacttctaaatcgaatcttcttgtcattactaggtgcaggttaaaaagtgagggcaggccgggcatggtgacccatgcctgtaatcccagcactttgggaggccgaggtgggtggatcacctgaggtcaggagttcgagaccagcctcaccaacatggtgaaaccctgcctctactaaaaatacaaaattagctgggcgtggtggtgcatgccgataatcccagctactcgggaaggctgaggcaggagaattgcttgaaccggggaggcagaggttgcagtgagctgagatcgcaccattgttctccagcctgagcaacgagcgaaactccgtctcaaaaaaaaaaaacgagagcattttatactcacttttaaaattcgctttctaaattgttgtcccatagttctgtagaggtagttgaacttggtgtatgcagatgatacctgatttatacccatattggttccaggataataatcacaagtggaaccatctcactataaatcaaacctttaccttctgtagtgccctaatctagggtctgtgactagaaacccaggtcaattgatgaaaatccatgggagaagaaaatgtaaaaatgctttcagacattaggtgtatgaaatcacacaatataaaagctatatcatattttattagagggatttttttgctacctttgctagtacttgacagattttataaaatgtaaaataaaatttggactgagaaattgtttcccccccttttttttccctgataaatgtctctccaacaagcattgttgctttaaatttagcactgtcttcagctttttattgctgattcagtttctgtgaaaggcctttgaaaggtaagttctggcaggaggaacagtgtatctgtggcaactttgtttttccttattccattttatgaagactcagttctaaatgtcagccatgttaggaacttcataaatggagctatttttggtcattactatggaaggacctcttttctaagaagccataaagaaaagttgcaagttagtcacagaagttttggattgcctgtagatttctttatgataggaaattagtgagttaatattctgtttattttctgacacagatttttctttgataaataaaagactcttattcattaagatcagcttcttgttctgtttttcttggagtaaataactgtgaatttgggtagattgattttactttgttcagtttcctctgtaaaatgaggattttgaactgtatagtcaaatatactctattcattgttgaagtaagaaatcttatgcaagccgagtaagtttatagttctcctttggctaattatatgaggttaaattgtatttattttcctcctagtttcatgtttaactttagatgtgtagaagactaaggtgtttataagtaaattcagtgttaagatgaaatcactgaaatccatatagttaattgaaatgacagttttacaaaagtaatttaaaagaaaatgtcagatttagcatattagctgataattgctaaagcacttgtttgaggttttctgtacctgtacctctacctctgtttttatgatatgcagtgagtgagtcacaatagttttgcaattcttttccttgtaattaaataaaagagtattctttgtgagagtaacttcagaaagaaatccctttataaaagagccattttgaatttccttattagcttgtctcttggacattggctttttagaacagtaaaaggagagcaattgggaaggaagtggtggatgattttctttttttcttttgatgagaaataggaaaataaacaggttattttctctaaattgattatgaaaatcagctggttcctatgtgggattagcttcttcagggcaggattgctaaaatgagtgtattagtcctttctcacgctgttaataaagacatacccaagactgagtaattttaaaggagtttagttgactcacagttccacatggctggggtggcctcacaatcatggtggaaggcgaatgaggagcaaagacccatcttacgcggcagcaagcaagagggtatgtatagggcaactcccttttataaaaccatcagatctggtgagactgtttcactgtcatgagaacagcatgagaaaaacccaccctcgtgattcagttacctcccactgggtccctcccacaacgtggggattattacaattcaaggtgagatttgggtggggacacagagccaaaccgtatcaatgagccgttgaggttaaaccacatttggtcataaaccacatttggtcatgctattcacaggtgttaaccttgaggcatagagaaattactgcagagtacagaaaaaagggggaaatagtacatattggagaaaacaattctaacagtcttttagactctttaaaagcatattttatttctttttcatcttatcctaatacctctgtcttcaatttttattttctagtgtttttatagcgcatacgtatctcgaaagtatgaaacaaactgtggagttttacgagtatttagaatttatctgaatgttgccatatgttatcaggaatgttttctgctgaaataattgtcagccttactaataatgttcgaaacaggagtttatttttctttcatgacaagaagcccacagacagggacattctagggccagtacagcagttcaagaaaggaattgaggatgtgggtactgtcctttcctgatctctcatctttagtatatggcaattaacttcatgatcacaaggtggttgttttacctttagacattgtattcatgttccagataaggaagagcaaaaggttttcttctagtgatgttttggcttttttccctgaatgggatgccttttaccagagatctccatatacatggcatcagccagcactttgttgtctgcccacctaactgcaagagaagctctgagatctaggtgtcagctttcctacctttataagaggaaggcagatcaaaagtgggtggttcagtgagccatcttacaatgtttgccaagtcagagaaactccattataatttttggtaaactatctatttggaccattcaagggattatctggtagtggtaaggtgaatgtgaaagttttgttagtcctttcacattgtgttttagaaaactaaactatctcttcctctcacacgttgatcagaggaattgcaaaatctgtataaaccatttaaacctttcgttggaaggcagaattgaataatcaccatactaaaacccatttaaacttgctttcataatcttctgtgaaatataactagacttgcacattctttcctcttggcattctgagttttctcagccaaattgttgaaagaatagtgtattttaagctaatttttattttgttcatctgttcacccagtacaacctttctgctgtgaggacagaattctggctctgtgacaggcgtcttttttggagaccctccttcaagagccctgctgcctataaatcataggtaagccttgctttcccaagattttttttgccttccttcaaaaagtgcttatgtcattcctctgattctgtaccttcatggttatcagagacagggagaatccccttcacgtttttgaaacttctgtattactgatcctttaaaaatttaggttatagtacattgtactatctgacattaatggcagctgttcatttttatttgttcccctttagaacatctgaaatagttgatggtcctgattgaaccactcagcatatagagaagtagcaaactcgaatctttaaatctcatgacaatttggaaatcagctttttctttattctttttttaaaaaaacttaacctaattttccccccattttgttaaaagactcagtcttgtctccacttaggttaaataacaagatgttaaccattgtgagtattttcaacattatttcctcaatgccatataatttttattataatcactaaagttttcaagatattttgaaagagacttaaaatgggggtcagtacttcacttatttttgagacagagtcgtacgtcttactctgttgcccaggctggagtacagtggtgagatcatggctcactgcagccttgaactccagggttcaagtgatcctgccaccaagtggctagcaatttttaaattttttgtagagagaggttcttgctctgttgcccactggcttttgatttctgaggtaaccactttttgattgctcaagtcagtgaattgggagtatgctaaatgctgttagggttacagaagatattttccaagcaaatgccatttgatacttagcattataggatttctaaagaaggaaaatcttcatgcctcttgaggaaaggctttgggtagaagtggaagtactaccaattcaagttgaccttgggaatggagaggaaagttgtacgtgtgaacaaagataaggaacagggaaggcagggtgcctttgactaactcgtggttagagttgtgtgcccagaagtagagcaatgagagatgaaactaaggtaatgtaggttgaacccatgctatagagaacccatgaagctgggcattgttgtgtgactaatatgtttggtggtaggttcattattctcactcattcaaaatgattatcttattctatacctgagcattttactaagtgggagaaaaaaaaaatgagacacgtcctctggtcttccaggaagtaccactcagtaagcatttattagcaactgcaaggaagaaactattcaaagtgtatataccatgtgctttcacatcttgcatctcatttagtcttgactccatgagaggtgaggtatgtctcctcatttttgtatttgaggttataataaatatataagaaaccttttttagtgctttctcttcacagtagtcacctcttacctgaacggagtacatttcaagacccccagtgtatgcctgaaactgcagatcatgccaagcccgattgctgtcatttgggacatgtttctgttcacgtttcccaccctcaaattatgcctttttcatcataactaagcacttatcctgcactgtggccataactttcgcagtttgaggtttgacagcagagccagcacaaagttcttttcccttcacaatttcacatatagaagatttgttcttactatagatcttagaaacctcaacatatgatttttttctttccttgagtaaagagctttcacttaaaagaacccactttatggcttctctttggcatgtttgaattgccaacattactacttctgggctttggggccattattaagtcacataagggtacttgggcacaagcacaatgatactgcaacagttgataggataaccaagatggctgctagtgactaatgggccaaggttctgggagcatctacagtgtggatatgctggacaaagggatgattcacatcccgggcaggagtgagcaggatgacatgagatttcatcacactactcagaacagcatgcaattttaaatttatgagttgtttacttctggaattttccatttaatattttcagactatggttgacaacaggtagttgaaaccacatgcagaaagagaaaccatagataaagggagactgccgtattattctttcttcttttttgagacagagtcttgctttgttgcccaggctggggtacagtggcacgatcgatactcactgccacctccacctcccaggttcagcaattctcgtggcacagccaccctagtagctgggtccacaggtgcatgccaccacgcctgactaattttttgtagagacggggtttcacgatgttgccaggctggtctcgaactcctggcctcccaaagtgctgggattacggggttgagccaccgtgcatggcttcctattctttctaaagcttcttgtttatgtacttctatcttcagagttctctctagaattcctgatttagatcaaaatttgattttaagcaatagctttaagaaagttaatgagtataaatccacttgtgcttatcagaacttaaaactaaaagctattaaaaacttgataattggaggaattgtcctgttgattgctttgtctggttcctgcctttactgtatatagctccaataattcaaaatctaggaatcagcaggcagtgtagcctgtatgccaagtccagcctacagcctgtttttatacagccctcaagctcagaatggtttttccatttttaaatgattgtttaaaaaaatgaatatgcaacaaagattatatgtagccgggaaagctgaaaatatttactatctggcacttcaaagaaaagtcttggtgacaaatctagtccataaatgtgcttttcattttatgtggtatagctagatgagtcacctctggagcttcaaaaacatatacaggtgctcaggaatcaggatgtttggctgtaacacccttgttcttacagcttcacaataccttccataaagtagggataatgaattgcaggccaagtactttgagagtatggattaatcaaattgatggtattgtgaaagatttagaggaggtaattgttaagctaggtttagaatcatgagtggggttttcctaagtacaggggaggaatgaaagtaatgaagatttgaaagttcatgtaaaattaaaggggacattgtttaacttgccttgtcagctctccctgtgtttttttctgttacctccaaattctggttacccatatttaccttgacagacaaaaattgtccattgtgtcctaataccaaggtatgtcctttgagatgcccccattttccagagacctattcctcctatacctaataaccttcagggcagccgaagtgatgaaaacctgcaggactaaagcacaagatacaaattcattagtagttttactgttcagctttcatgatttcttaactcagcattaatctaaaaaagagactttaccaaattcctaccttaactttgtcacagaagaatttacagctggttgctaaagataaatgaaattctgtataaatgacatgacgtattactatagatgtttgcgggccatgtcgtatctactataatgtagtgaagtaagtgcgatatatcatggctagttaatacagttgttattgagtttgtctcactgtgtttataatttccagtctgtgtatctgccctgcttttaaaaaaaagaaaattagttttttagagatagggtcttctgattttgcccaggctggtcttgaacctctggcctcaagtgatcctcccatctcagcctcctaaagtgttgggattacaggattgagccactgcaccctgctttttgaaaacacttagaaagtttaagttattggaggaaattatatttgcataatcaaagaatttctcattctgcaaaaggaagcactcagtaataatagttaatatttagtgtttactatttgccaggtactaccaaaaatacttttcatctgttaatgtatctactccccataaaaccataggaactattgtttcttttgttttgtaaatgagacaagggcccagagatgtactggggctggaatttgaaaccaggcagcttgctgctagagcctgtactctttgaactattatgtcgtatatttttctttagtgcttgtgcagtatatttgcagtcttttagaaattttaatagatgacaggcctggttgtccgtttagaaaaactgtagaacattatcctttacagcagatatgaaatgtagaaagatgtggttttgttatacagaagtaagattttatggagatggcttgttatttattattataaatgtttatgctttgacaaactgtcactactcacaatttgcaggttttaaaatgatgtcatgttgtgtatcacatctaaaattttaatggcaagccttaaaaggctttggaagtattttagttatctaattctgattttctaatttgaatggagattgagtaattattgatgatattgtttcttttgctcaaccttcaaccctttcagtaataacttactttcttgtacctgcaagtccagattttattaccgtttaactaaaaaatgatatataatcatgattattgtattctgtgtattaagtgtgctaaagaacttaagaatttttaggattccctttcagagcctaatatatagttcacatgaactgggtggacacttaatgaaccttaaaacttagtttaagttcgtcataaaaaaacgacaaatcattgatacttgtcccatagccccacaccatctagaacatctcttaggattaggaagtaagttaaaatggcctgtaaatcgcaaaagtccatgggaaattcatgtacttacttttagaagcatgtcagccccttgacaccttaaaaatgtattttttagtagcagttaaactacatgcttcccagccagtggtatattattgaggtagtgcagggtgatgataggcttgtataaataggtacagtgatggtatattagcaaaaagaaagacaaacactaaaatccagccaggtgaggtggtgtgtgcctgtagtcccaactactcaggagcctgaggtgggaggattgtttgagtctagcatgggtaacatagcgagaccatctctttttttaaaaaaaaaaaaaaaaaaaaaaaaagacactaaaatccaatgaatagcttgaggccacttttggaacagattgatgtgtatactttaatctaaaggataggttcaacacagtgcttatgtctttaaaaacaggttgacttggccgggcacagtggctcacggctgtaatcccagcactttgagagaccaaagtgagtggatcacctgaggtcgggagttcctgaccagcctggccaacatggagaaaccccgtctctactaaaaatacaaaagtagccgggtgtggtggcgcatgcctgtaatcccagctactcaagaggctgaggcaggagaatcacttgaacccgggaggcagaggttgcggtgagccgagatcatgccattgcactcctgctcctgcctgggcaacaagagcgagactccatctcaaaaaaaaaaaccaggttgctttaggataactctcaggaatcaagagtgttaaacatttggagaaacgttctgtcaagtgatcgcagtagttttagtgtgtaaatgggagaatttaaaatatcttggaatgtttaataggaagcttttcctttgggaacattaattaaactaagaattaatgctttctaatttcacaggctccacatgagacaaagtatgaactctgattttgtctttttttttttttttttgagacagtctctctcctggagtgcagtgtcatgatctccactcactgcaacctccatctccagggttcaagcaattctcttgcctcagcctcctgagtagctgagactacaggtgcccaccaccacacccagctaatttttgtatttttaggagagacagtgtttcaccatgttgaccaggatggtctcagtctcttgatctcatgatccgcccgccttgacctcccaaagtgctggaattacaggcatgagccaccatgcctggcctgtcattttaatctatccatatttatgtattttgtttgtgtctaatcacctatgggttagtgtttaagaacacaagttctggagtcacatctatatttgaatcttgcatgtttattaatgtgactgtggacaaggtaaccacactgagccttagtttcctcatatagtcataagtatttattgagcaactactgtataccagagactattttaggagttagggaaacatcagtgaacacaagattctaggccaggtgtggtggctcatgcctgtaatcccagcactttgggaggccaaggcaggcagatcatctgaggtcaggagttcaagaccagcctggccaacatggcaaaacctcatctctactaaaaatacaaaaattagccgggtgtggtggcgagcacctgtaatcccagctactagggaggcagagacaggagaattcgcttgaacccgggagggcagaggttgcagtgaaccaagatcgggccactgcactccagccagggtgacgcagcaagactctgtctcaaaaaaaaaaaaaaaaaaaaaaaagattccagttgaaagagagagaacataaataagagaagataatattatctatatttaggggtcccccccaagattaagtagagtaatgcatatgtagtttatccatagtgttgaataaatatgggcaactcttgtgtgtgtgtgattgtgatttgtcatgcttagacttgtgttgggataaaattgttgtatattagtcatctctcaaaaagaatttttaattgctgataccaaatatattggttttctctaatattattaaggggcataggggaagtagagggatgggatgggatagcattgaatctcatcaatatgtgtacttttactttcttttgtaacagccaccaaaaaagacagccaaaagagaaaaacctaaacagaaagctacttctaaaagtaaaaaatctgtgaaaagtgccaatgttaagaaagcagatagcagcaccaccaagaagaatcaaaacagttccaaaaaaggtatgttagaaataacattaatcagcaactttaaagatatagcatatattaatatgttgtacatagtatttaagtgtgtgggagaaacaggtaaactgcagagaacattgcggggagaagtaatacaggttgaatatcccttatctgaaatgcttgggacaggaagtgattcagattttgcaatatatatatatatagagagagacagagagagagatatcttggggatgggacccagtctaaacatgaaattcattcatgtttcatattcatcttaaatagcctgaaggtagtttaatattttaactaaataaattatttattgcagtggtgccgttacagctcactgtagccttgaactgctggactcaagcgagtctcctatcttggccccccagagcactgggtttacaggcttggaccactgcccttggcctgaaaccaagttttgactgcgacccgtcacacgaggtcgggtatggaattacctcctggtggtgtcatgttggtgctctgaaaagctggattttggaacatttcaggttttggatttttggattagggatgcctaacctgtataccagttttttatagtttttgatttttcaaattgactaaaatttgtatgcatgttttataggtaactgtagagtagtgatttataatttttttgatccagtacccctttgagaatctgttgaaagcttaaaattcatctcagcctttgttaaatgttaatttactatgtaagaaaaattattattattatattacttttagaaagtgagtctgaggatagttcagatgatgaacctttaattaaaaagttgaagaaaccccctacagatgaagagttaaaggaaacaataaagaaattactggccagtgctaacttggaagaagtcacaatgaaacagatttgcaaaaaggtaattagacaaatgtttagattattttgcttttgctagaaaaattctttcacttatctctgaatttgaagctaaatacttacgtgcattcacttattgaagaaagatttattgaactactatatgccagatctccttacaggtgctgggataccacttaaaatagtcaaagtctctgtcctaatagagttattttataaacaacattaaaatgaataaagttagagtgaataaaattaaagtgacacattccaaaccacataggaaactttttctgatctgtaggttgtttctattgatgtatccttagtttatgttagtttaaagaagcagaatctcatgaaccgtcttattctcttcttagtgtgataaatgagctgttatagattaggttcttaactcagacttctgcagcgtctttctaatatttctaatacttctcaggaaataaagtggccttgtcttgaatatgattccatagggattctatggaaattttagaaacttgtctgttggggtaaaataaaattacaatttggaatgtaccaaaagtgaaatagtctgtgcttttttaaaggacattgattattattttgttcattcattcaccattcattgattctctactacatttcaggcactgggctaaatgttacaggtagaagctagatgtggtggctcacgcctgtaatcccaacactttgataggctgaggcaggaggactgcttgaggccaggagttcaagaccaacctgggcagcatagtgagatcccgtctctaccaaaaaaaaattttttttaatgttacaggtggaaccagagaagccattacttagctttcaagaggagcttacagtctagtgggatggaaagagataaatattttagtaattaaaatattgtaagcgagggctgtgttagaatatggaaggtactgcagtgccacagaacaagcaccctacttgaggctgggggaatctggaaaagcatcttggaagagctcttaactgaatttcctagtggagcatcacccattctatacagttgaggaacaataacacattaaccaaaacaataattgaaaggaatagtattagttcaacatgtctcaagactaggattggaaagaagtcctcacagaagttaggagaaaatattagagttttgcagatcttaaatatgccatgttagagtttgagtttcttcctgaaataaatgaggaattcagaggctatgtagattattgagatttagcaggggcataacgcaatcatatttttatttttaaaagttatcctagaaacattaagaacaatgcaatagcaaaggatgagatgagagaggcaggacacccagttatatcatcattaaaatgacagtgtggagtggagaggaagtcaaagagaaattagttctgtccattagaaggatttttgtgaataccttcatgtaaattttttaaagggattaataacatggagaggtcaggtgagaaggaactgacctgttttggagtctgcaattaggagacgatgacatagggtggtaaaagcaagagttattaatgaatagtgaggaaaatgaacaaagtaacttctgtttcaagcagctgtctttggaaggaaaatagtaggtaaatgggagtaggtgagaaagtatttttaatgggtagtaggggtggaggggagaaagcaatttggtgggaaaggagaagttacaggagaggtgaagggtggtcctgtggaggcaaaattaagaaccattgatgaatccagatacaactggaggggaaagtgctgtcagaaaattgaaggaattcataataatggctttttggctgacagtagcagtgtgagacacttgaataaggagatgaaactgccattggtggaaatgaaaggagagagcctgactgggagctccagggggaggagcctttgaagatgaatgccatgaactgaaaatgagaccagtctcttcaaagttattttcccacagcaatctgtagtctgggcttaaccatagaaaaatgagtggttagaccaattcgggattggggttttgcagggaaagaacaaggggcaaacaatttttttcttttttttaatacttttaagttctaggatacatgtgcacaacgtgcaggttacatatatatatatatatatatatccatgtgccatgttgatgtgctgcacccattaactggtcatttacattaggtgtatctcctaatgctatccctcccccgtcccccccaccccacaacaggccccgatgtgtgatgttccccttcctgtgtccaagcgttctcattgttcaattcccacctatgagtgagaacatgcagtgtttggttttctgtccttgcgatagtttgctgagaatgatggtttccagcttcatccatgtccctacaaaggacatgaactcatccttttttatggctgcatagtattccatggtgtatatgtgccacattttcttaatccagtctatcatttgggttggttccaagtctttgctattgtgaatagtgccgcaataaacataacatgtgcatgtgtctttatagtagcatgatttataatcctttgggtatatccccagtaatgggatggctgggtcaaatggtatttctggttctagatccttgaggaatcgccacactgtcttccacaatggttgaactagttaaagtcccaccagcagtgtaaaagtgttcctatttctccacatcctctccagcacctgttgtttcctgactttttgatgatctccattctaactggtgtgacatggtatctccttgtggttttgatttcatttctctgatggccagtgatgatgagcattttttcatgtgtctgttggctgcataaatgtcttcttttgagaagtgtctgttcatatcctttgcccactttttgatggggttgtttgattttttcttgtaaatttaagttctttgtagattctgaatattagccctttgtcagatgagtagattgcaaaaattttctcccattctgtaggttgcctgttcactctgatggtagtttcttttgctgtgcagaacctctttagtttaattagatcccatttgtcaattttggcttttgttgccattgcttttggtgttttagacatgaagtccttgcccatgcctatgtcctgaatggtattgcctaggttttcttctagggtttttatggttttaggtctaatgtttaagtctttaatccatcttgaattaatttttgtataaggtgtaaagaagcgatccagtttcagctttctacatatggctagccagttttcccagcaccatttattaaatagggaatcctttccccatttcttgtttttgtcaggtttgtcaaagatcatatggttgaagatgtatgtggtattatttccgagggctctgttctgttccattggtctatatctctgttttggtaccagtaccatgctgttttggttactgtagccttatagtatagtttgaagtcaggtagtgtgctgcctccagctttgttcttttggcttaagattgttttggcaatgcgggctcttttttgattccatatgaactttagttttttccagttctatgaagaaagtgattggtagcttgatggggatggcattgaatctataaattatctatggccattttcaagatattgattcttccaatccttgagcatggaatgttcttccatttgtttgtgtcctcttttattttgttgagtagtggcttgtagttctccttgaagaggtccttcacatcccttgttaagttggattcctaggtattttaatctctttgaagcaattgtgaatgggaattcactcattatttggctctctgtctgttatgggtgtataggaatgcttgtgatttttgcacattgattttgtatcctgagactttgctgaagttgcttatcagcttaaggagattttgggctgagacgatggggttttctaaatatagaatcatgtcatctgcaaacagggacaatttgagttcctcttttcctaattgaataccctttattttctttctcctgcctgattgccctggccagaacttccagcactatgttgaataggagtggtgagagagggcatccctgtcttgtgccagttttcaaagggaatgattccagtttttgcccattcaatatgatgactgtgggtttgtcataaatagctctttattattttgagatacgtcacatcactacctaatttattgagagtttttagcatgaagggctgttgaattttgtcgaaggccttttctgtatctattgagataatcttgtggtttttgtctttggttctgtttatatgatggattacgtttgttgatttgcgtgtgttgaaccagccttgcatgccagggatgaagtccacttaatcatggtagataaggtttttgatttgctgctggattcggtttgccagtattgtattgaggatttttgcgtcgatgttcatcagggatattggtctgaaattctctttgtttgttgtctctctgccaggctttgatatcaggatgatggtggcctcataaaatgagttacggaggattccctctttttctattcattggaatagttttagaagtaatggtatcagttcctccttgtacgtctggtagaattcagctgtgaatccatctggtcctgaactttttttggttggtaggctgttaattattgcctcaatttcagaacctgttattggtctattcagattcaacttcttcctggtttagtcttgggagggtgtatgtgtccaggaatttatccatttcatctagattttctagtttatttgcgtagaggtgtttgtagtattctctgatggtagtttgtatttctgtgggatcggtggtgatatcccctttatcattttttatttcgtctgtttgattcttctctcttttcttattagtcttgctagcggtctatcaattttattgatcttttcaaaaaaccagctcctggattaattgctttttttgaaggtttttttgtgtctgtgtctccttcagttctgctctgatcttagttatttcttgccttctgctagcttttgaatgtgtttgctcttgcttctctagttcttttaattgtgatgttagggtgtcaattttagatctttcctgctttctcctgtgggcatttagtgctataaatttccctctacacactgctttaaatgtgtcccagagattgtggtatgttgtgtcgtttttctcattggtttcaaagaacatctttatttctgccttcattttgttatgtacccagtagtcattcaggagcaggttgttcagtttccatgtagttgagctgttttgagtgagtttcttaatcctgagttctagtttgattgcactttggtctgagagagagtttgttaaaattttacatttgctgaggagtgctttacttccaactatgtggtcaattttggaataagtgcgatgtagtgctgagaagaatgtatattctgttgatttggggtggagagttctgtagatgtctgttaggtccgcttggtgcagagctgagttcaattcctgggtatccttgttgactttctgtctcactgatctgactaatgttgcagtgtggtgttaaagtctcccattattattgtgtgggagtctacgtctctttgtaggtctctaaggacttgctttatgaatctgggtgctcctgtattgggtgcatatatatttaggatagttagctctccttgttgaattgatccctttaccattatgtaatgcccttctttgtctcttttgatctttgttggtttaaagtctgttttatcagagactaggattgcaacccctgttttttttgttttccatttgcttggtagatcttcctccatcccttcattttgagcctatgtgtgtctctgcacatgagatgggtctcctgaatacagcacactgatgggtcttgactctttatccagtttgtcagtctgtgtcttttaattggagcatttagcccatttacatttaaggttaatgttgttatgtgtgaatttgatcctgtcattatgatgttagctggttattttgctcgttagttgatgcagtttcttcctagcatcgatggtctttacaatttggcatgtttttgcagtggctggtaccggttgttcctttccatgtttagtgcttccttcaggagctcttgtaaggcaggcctggtggtgacaaaatctctcagcatttgcttgtctgtaaaggattttatttctccttcacttatgaagcttggtttagctggatatgaaattctgggttgaaaattcttttctttaagaatgtcgaatattggccctcactctattctggcttgtagagtttctgcctagagatccgctgttagtttgatgggcttccctttgtgggtaacccgacctttctctctggctgcccttgacattttttccttcatttcagctttggtgaatctggcaattatgtatcttggagttgctcttctcgaggagtatttttgtggtgttctctgtatttcctgaatttgaatgttggcctgccttgctagattggggaagttctcctggataatatcctgaagagtgttttccaacttggttccattctccccgtcactttcaggtacaccaatcagatgtagatttggtcttttcacatagtcccgtgtttcttggaggctttgtttgtttctttttactcttttttctccagacttctcttctcgcttcatttcattcatttgctcttcaatcactgataccctttcttccagttgatcgaatcggctactgaagcttgtgcatgcatcacgtagttctcgtgccatggttttcagcgccatcaggtcatttaaggacttctctacactggttattctagttagccattcgtctcatcttttttcaaggtttttagcttctttgtgatgggttcgaacatcctcctttagcttggagaagtttgatcgtctgaagccttctctcaactcatcaaagtcattctccgtccagctttgttccattgctggcgaggagctgtgttcctttggaggagaagaggcgctctaatttttagaattttcagcttttctgctctggtttcttcccatctttgtggttttatctacctttggtctttgatgatggtgacgtacagatggggttttggtgtggatgttctttttgttagttttccttctaacagtcaggaccctcagctgcaggtctgttggagtttgctggaggtccactgcagaccctgtttgcctgggtatcagcagtggaggctgcagaacagcaaatactgtcctgcctgatccttcctctggaagcttcgtctcagagtggcacccggccgtgtgaggtgtcagtcagctcctactgggaggtgtctcccagttaggccactcaggggacagggactcacttgaggcagtctgtcagaggtggagtctacagaggcagtcaggcctccttgagctgtggtgggctccacccagttcgagcttcctcgcagctttgtttacaactcaagcctcagcaatggcgggcgcccctcccccagccttgctgccaccttgcagttaaatcttacactgccgtgctagcaatgagcgaggctccgtgggcgtgggactctccgagccaggcgcgggatataatctcctggtgtcccgtttgctaagattgttggaaaagtgcagtattagggtgggagtgacccaattttccaggtgccgtctatcacagcttcctttggctaggaaagggaattccctgaccccttgcgcttcccaggtgaggcgatgccttgccctgcttcagctcacgctcggttggctgcacccactgtcctgtacccaccgtccgacaagccccagtgagatgaacctggtatctcagttggaaatgcagaaatcacccgtcttctgcgtcgctcacggtgggagctgtagactggagctgttcctattcggccatcttggaacctcccggggcaaacaattagagtaatttaaatgatgaactatattttagagggttggcatactacagcctgtgggctaaatccattctatcttagtcacctggttttgtaagcaaaattttattgtaatacagccacatctatttatttaactattgtctatggcagcattgccactacaacgcatagttgagtagaaactgactggcagagtagaaactgactggcaaaattgaaactatttgtaccatctagccctttacagaaaaagttgctgaccctgaactatacagtggaagtaaagcctacagggtgcttgcagactgtgagcttatagagtcaggacctgagtcaagcagcaagtataacaggactgagaaaattgacaaaaggcagaaatttagtcaaattttaggagtacaggactcttgagaccacctgggtcttaggatttaactttagggagggactgagcagtggagtagaggaagcagttcattgcttttcaggttgtggaatcataggtagggtgctggataataacaagggttggagaagaaagaagttttccctaaaagacacttggcagatgacttgccaacataaagaacttagttctgttatctaagatctatctggatgttttctttacccatgtttgttggggttttttgtttttgagacagggtcttgctctgttgaaggggtgggttgcccctccacacctgtgggtgtttcttgttaggtgaaacgagagacttagaaaagaaaaagacacaaagtatagagaaagaaataaggggactcaggggaccagcgttcagtatacggaggatccggccggcttctgaggtcccttagtatttattggtcattcttgggtgtttctcggagagggggatgtggcagggtcataggataatagtggagacaaggtcagcagataaacatgtgaacaaaggtctctgcatcatagtcaaggtaaagaattaagtgctgtgctttagatatgcatacacataaacatctcaatgccttacagtattactgcccgcatgtcccacctccagccctaaggcgtttttcccctatctcagtagatggaacgtacaatcgggttttataccgagacattccattgcccagggacaggcaggagacagatgccttcctcttgtctcaactgcaaagaggcgttccttcctcttatactaaccctcctcagcacagaccctttaagggtgtcgggctgggggacggtcaggtctttcccttctcacgaggccatatttcagactatgacatggggagaaaccttggacaatacctggctttcctaggcagaggtccctgcagccttccgcggtgtttgtgtccctgggtacttgagattagggagtggtgatgactgttaacgagcatgctgccttcaagcatctgtttaacaaagcacatcttgcacagcccttaatccatttcaccctgagttgacacagcacatgtttcagagagtaacagcatctcaaggcagaagaatttttcttagtacagaacaaaatggagtctcctgtggtctacttctttctacacagacacagtaaccatctgatctctctttcttttccccacactctgtggtccaggctggaatgcagtgccaccaacacagctcactgcaacctcaacctcctgggcccaagccatcctcctgcttcaccctcctcagtagctgggattacaggcatgcatgaccatgcctggctactttttaaattttttgtagacacaaggtctcaccaggttgcctgaggctggtttcgaattcctgggctcaagtgatcttcccacctaggtttcccagagtgttggaattacaggcgtgagccatcacatctggcttgtttatggttagttaattcattccagactctcagcctgaaaacactgagaatgtttgcatgctagttttccacatcatatacaatattattaaaatactcatttggaatagaattccatatgggttaaccagagtactgttgggatggttgtggctatttgcacgtagcagatttcctgcttttattcaaagacaatattactggattttaaaatctgcttttaacattatttttccttttcactatacataggtctatgaaaattatcctacttatgatttaactgaaagaaaagatttcataaaaacaactgtaaaagaggtaaatatttcagtctttcaagtttgactttagaaatataagacaaaagtaattacataaaatactccatatttttcaaaatattcatgtcactaaatatcacatttgatcctcacatttcttcataatagggaaatttatttcttctcattcccactttaaagcttaaaattaaagtttgaacagttagtgataagacctgaactcagattatgatgtggcctcatggtgtacctgggtagctgggcatctcaacgttgctctcacaaatacttgaggaagttcctgtctacgaggcaaaggtgaggggaagatcagcaggtagctgtaattctgtattgatctcaactgatttttgaaggacaaaatagtaaaatagatgtggaaaaaatgggataaaggtttatgatttatggcaaaataatgtttctctttcattacagctaatttcttgagatagaggacagagaagatgactcgttcccatagatttgaagatctgatttataccattataccagcaaagagaatgtatttccttttctaaatccttgttaagcaacgttagtagaacttactgctgacctttttatcttgagtgttatgtgaatttgagtttgctgttttaaattgcatttctatgccatttttagtttaaaatcttgcatggcattaattgttccttgcttttatagttgtattttgtacattttggatttctttatataaggtcatagattcttgagctgttgtggtttttagtgcacttaatattagcttgcttaaggcatacttttaatcaagtagaacaaaaactattatcaccaggatttatacatacagagattgtagtatttagtatatgaaatattttgaatacacatctctgtcagtgtgaaaattcagcggcagtgtgtccatcatattaaaaatatacaagctacagttgtccagatcactgaattggaacttttctcctgcatgtgtatatatgtcaaattgtcagcatgacaaaagtgacagatgttatttttgtatttttaaaaaacaattggttgtatataaagtttttttatttcttttgtgcagatcactttttaaactcacataggtaggtatctttatagttgtagactatggaatgtcagtgttcagccaaacagtatgatggaacagtgaaagtcaattcagtgatggcaacactgaaggaacagttaccctgctttgcctcgaaagtgtcatcaatttgtaattttagtattaactctgtaaaagtgtctgtaggtacgttttatattatataaggacagaccaaaaatcaacctatcaaagcttcaaaaactttgggaaagggtgggattaagtacaagcacatttggcttacagtaaatgaactgatttttattaactgcttttgcccatataaaatgctgatatttactggaaacctagccagcttcacgattatgactaaagtaccagattataatgccagaatataatgtgcaggcaatcgtggatgtctctgacaaagtgtgtctcaaaaataatatacttttacattaaagaaatttaatgtttctctggagttggggctcttggctttcagagtttggttaatcagtgttgattctagatgatcaacataatggaccactcctgaatgagacttaattttgtctttcaaatttactgtcttaaatcagtttattaaatctgaattttaaaacatgctgtttatgacacaatgacacatttgttgcaccaattaagtgttgaaaaatatctttgcatcatagaacagaaatatataaaaatatatgttgaatgttaacaggtattttcacaggtttgtttcttgatagttactcagacactagggaaaggtaaatacaagtgaacaaaataagcaactaaatgagacctaataattggccttcgattttaaatatttgttcttataaaccttgtcaataaaaataaatctaaatcactggtgttttaagtcacttgcatttgatatcttataggtgtatatagcatttccttatggggaataattctgaaaagggatttttaaattgattcagccctataacctatacaatttggaatactcttttgtggtaatggaccattttcttggagtgacttcacaaaactgaataattaaggttaattttatgaccatttgctataaagaaggtaagtagtcatgcatagagtatttggaagtgaggaaatggagttgttctgtatgaaagttcttgatgagtacgcacacttattaaatggatgtatcaccactacagtacagagtacatgtgaaagtctagttttttattagttttacacaaccagctattcatgaactgtagttaaaacattgtaaatctgtatatttactgctactcaattacaaaatcttcagatggcattgaaaaaacatatccaaagtaactcaagaaaaaagtaccatggcttcttaaacaaaaaatcaaatgaagtatgtcacttgataggaagtttaaaacacacatttaccatactttaaagtaggttttcccctacttgtagcacagttcaagtgcctggaaactaacataataatttactgttaaccatttcaaacttaacattttgcatttatcactttaaaacacatgctgtctaaacattttaatacatgatactttaaagcagaatacttgccagtcagtaccaatgagtctcaacaaataacctaaatatcagagttgtcttgggttaacttttgagatatacagctgttggcttgttttgggaccacactttgattggggggggcggggggcgggcggtgggggaggtgtcttaaatgcctgaggttcactgcacattcttggtgtgttaggtatttactcgttataaactgacctacttttaaatttttaaaatactcaatattttgaagtctctttaaagtcatatttagtcccttctttaaagcaaaccagtatattattgttcaaaaacaaaagcatatttctaacctgtatactgaagtttcttggcaaaataggcatcctgaagaccctgcaaccagtgttttattttagaatgagatattattaaactgttttctgtcatgagtgtttttaaaaaaaagataaaagtaaatacttgccatgttcttaggcctttaaaatatagcttataaaatgtatactatttaccaggagagctcacatttttctgcagttttccagtggacctgcctatggaatactgtaaagaaaaatctgcaaaaatattcctagcaattgaatcagtgcttttaaataaaagaagtggagaggggcttggttaaattattctgacaagtttttttgctagtggttgccaaaattaaggatatttaaagtgtcctatcacccaaatttggctttaagaaaaagctatattctgtgtctatagtgtgaagcccacactatctgtgctgcattctcaatgatacaatacctatctggaaactttcctgttttgccaatgggtgcacaaatctaaaacattttatcacaaaaggtacttgaatttaaatttcttttgaacacccagtaggaggaaatatgtacaatacaaaatacctagaagcttcattttactgtcaactggagtttgtgctgtatccaaaaaaaagttctatctaaattttaagtaaaagctcaatattggacctatataaaaattaaggctcattggtaaagatactgataaattgtcacagaagaaaaacatggctttatctggtttttaaatgattcctgcttgattgacttggtttctcaatgtatgaaaattgatcagccatataaaatgtgaaatctaaagggaacttccagccatggaacaatcaaatccatggcctcaactgaaacttacattctgctttattctgaaatccagactttcagcagtagttgaacctatggaaaatgcaattaaatctaagtg

SEQ ID NO: 12241 - DNA, 141248 bp, Human
  misc_feature (1)...(141248): n = A,T,C or G
gatgcagaagagaatcacttacttcttcccagggccagggagtctttgcagggagaggatcctcaaaggtaagttcagtttcaccgtgagcatagcagaagaaggagtatgtgtgatgtggacatgtatgtgcttcatgtacatgtacatgcatgtgtgttcctatatgtgttcatgtgtgtgttcatacgtgtgtgtgccctgcatgcatgtatgtgtgtttgtgtacatgcatgctcatattgtatgcaaatgtatgcatgcagagctagggcaggaggagatgaagctgcaaagattcacggtgctcaaggccccggctgttctacgaagccatcttgatgttattctgcagtgaatagagagctaggtgaatgtttttaagcaggggagagacacacatgatagtagaaaaatattcctgcagttagtgtggagggtgggataaccaaagacaaatagggctgagaggagcctattgcatagaaatgataaaggcctgagcgggcgcggtggcttacgcctgtaatcccagcactttgggaggccgaggcgggcggatcacgaggtcaagagatcgagaccatcctggccaacatggtgaaaccccgtctctactaaaaatacaaaaactagctgggcgtggtggcatgcgcctgtagtcccagctactcgggaggctgaggcaggagaattgcttgaacccgggaagcagaggttgcagtgagccgagatcacgccatcgcactctagcctggtgacagagcgagactccatctcaaaaaaaaaaaaaaaaaagaagaagaagaaaaagaagggataaaggcctgacctgacccagggcaggggaagtggggaagtgagaaggacaaggattgagagaggctcgaagggatgtgtttcctgattattatttttaccagttactgtgtgccgggctctaagtgctttgcacacactctcaggtacacactattgttcttatttttaaagcagaggaggctgagatgggcagaggttattcatttgcaggacgagggatgagtgctagtcttgccaactcccagcagcaggggctcttggctttgactctactccccctactgtgagtcccgggacctcatgatgaccaagcagaggctgagggcgagtgggagaccacatgaccgccagtttcgttggagtggaggggcaggtagacgatgcttcataccccaggaaagggggagcaggaagaggagtttgaagggcactctgaacagtcagagatctgggtttgccactcagagagaggctatggctacatggaactttctggaagtcagaaaaacccacatggccgttgatatcctgggatgatattgcccttgtccacctttgaagcaggtcaaacttcctggcaacccctgcctgttgatgtgttttcagtagttactctttgcagattcaactttatcccatagtccaggtgcaggagaatcctggtgaaaggcaaatcctggcaggggggatgaagggtgggtcttagaggagacatcaaagatagcacggcagttagaactggacctcggtctagactggacattagaacccctggaggggagtttgtttgtctatttgtttatatgtttactttaggaaatattgattcccacaccttggcccagggattctgatttgattgacctggcacagggcctaggcacagatattctccagggtcctccagttatcctaacatgaagtgggactgagacgcactggcctagagggcggaaggcttaggtgcctgagctgggagcgcaggtgccactccaaggtgagcgagttggaccattgccccaacggcctcaggctatcctcagactgtccaacgagaagaaaacacgagttcttcttagacctcgggagcaaaaggaaatgataaactatattaaacccaaactggaaattgctgaagccccattttaaaaaagggatgtgtttgggtcctctgtgtttgtatttcttcacatttattctaggttatatcttgcttcagtttgcaaaaccaaaaatgagcaattaggggtttgttaataacttgcactggtaattaaaaaacactgtgcctcggaaaagtcctaacggactccgtggagtttgccggcctggctgtccttgtgtttctggcagggagagagccgatttgctgagcacacagctacccctggccctgacatccctgtccatccccagcagacgccaaagaccttggaggagatacccaggccccctgggagacttggtgcttccaagtctatgaacagatgactcccagctctgttacacaattctaaatttcagtttttcaactctacaaatgaaagtgtctcagtccagaaaacaacgactgtgccagtggcaacttcctcatttgctgaagtcttggctctcctggaccattctaacttaataactgcttgctgcgtggagaaagaggacatcctagactggaaaacagacgagtggtttagtgatgaaggtgacattctggaatgttcaggaaatccccccatgagcaaaacacagaaggcatgtctgacactcatgcttctaggccagacgctgagaattttccccgggtcctcattacattcccacaggagcccggggagtgcacctgcccatggagctatcgtggagtttgcatcttccacccttcacctccagactgtcctccttattcattaggaagttagtgtcagctgcaaattcagggacctgcttctgaaaggactcatcgtctatgtatttaatttcttttctttctttctttctttttttttttttttttagacagagtcttgctctatccccaaggctggagtgcaatggcgccatcttggctcactgcagcctccacctcccaggttcaagcgattctcctgcctcagcttcccgagtagctaggattacaggcacccaccatcaggcctgactaatttttgtatttttagtagagatggagtttcaccatgttggacaggctggcctcaaactcctaacctcaagtgatctgcctgcctcagcctcccaaagtgccgggattacaggcatgagccaccatgtccagcctctgtgtattgaatttcttaggatattttcactcatgtgacagttttcttctcctcctgtcccaaaccagttgcctgaaggatgcagtttccttcattagaccccaggggattccgcctcactgtttcttcccaaaagtctccagtgcagcgtccctggacttcctatgtgcaccactgcttggcagttcactgtattggagttaactgaactgacagttcagtgtgccatgccttaagcccctggtgacctctgagcatttgggtggcaggagcgagggcatccaaatctttgctctctctgccactgccggcccagcccacagcaagaggcaagaaaatatttgttgctgttgtgtaaacaggtgaatcgcttcagctggatctctgactgtgtccacatatgttctgggctttgtaagtcaggcaggcagctgccaagctccatttgtacagcagaggcccgtgagcttctctccgggcctggggtcacagtgggccgtcttggaagggagtcttagtgctcacagaagatggcagtgttacctagtgggttcaaacatgagcgtcagggttagctggcctgtgttccaaccccagccatggagttgcaatcttaagtcacctgacttctccaagcctccgtgtctttgactataaaatagaaataataataattcttaacacatggagttgttttcaggattaagccacagcacagaaaccaccgtggcatcatgcctgtgatgcagtaatgctcactaaacattagctgtggtggtggttattaggaagaatcaaaaggaacccgtcagcagccctggaaagaacttttagagcaggcagcaaaggcatcatgtatgatgacttgatgtgagtttagcataaatgacagtcaaacaatggcactaattttggagaggggaggttgtctgttatattactactaagtatgaaatctgttctaaggatgtggtttgagaagcctagtaggtggagatgcaaaacccatcattatcatgaaaagctccttgatgaggaagcagcaaacctagcactaaggaatgatgacaattagtcctttgctgaccttcattactggctccatgcaacactcctgggaggcaaacctagtgtctccttcccagatgccaaccctgagcccacgcaaggtgtctgaccccaaggacatctcttagcaagctggtgtgagcatcagcattggatcgcctccgtttctgctttctgatcactgttacctttgtatataatagagctgaaaatgtaatctctcagtggacagcagccaaacatgtgcattcagagttccagagccggccaggaacttactttcgccccggaagcctgggctgggagtttgcaagtagatagcgtgggccatgcaattcttgattgaaaacaaactgttgggctgtgttgtagtcatgtaatcgtctcgttaactcattaatgtaatgtctgtaattgtgatctgtttgaaaccaagttggaccaatgcaatcagcatatattctgtgatgcactttgtatcccggtcatattctcctgctaacccaatgctcaccagatgactgtggggaccagcaagggaaaagatgagctcaccttatgtgggttagaatctagggtcagatgttcaactttgagcagtttcttctactttagttcaccatgttggaatggtgcctaactagcaaatgcagaacttctataagttttgttattggccagatgcttccagcaactgagaataggacctgctttcatctggtgcttggctttggctgctatcactagccacccttttctccgtggctacctgggatctcagaagatgagggctttctccctgtgtgctgcctcatacactaggggcattgaaagatttgacagcccaccaggtgacaccatgtcctagccccctcaaccatgagtacaaagccatctgcttgtctatgtgatgcctatgaggacaatgggtaggtcatacctctaccctgaccgctcatcctggccctctgaactcctatgagacaaagccatcccttagtccctggaggagttgcttttccctgccctgacccagaacgacctgcctgtaggtgtagtcaggtatgggccataggctgaagtcaggaacacccaaagatggtgggggcaggcaggggagtgagaagtcttgctttcagtggtgtgccggatgctttgtttcacaggcgcataaaagaggaacttcatttaacagacctttccatgacactgttggtgagctaacttctggctgtggggaggatagtcattaatgttcctgaagaagggctctgtttatgcctttgttattctgaaagatattgacttctttattttattaaaacctgcgttgattataggtgacagaatatgatagtgttagccagagctgagactttgctgaaaaattaatacagattcattttcagtaactaataagcagaacattttgctcaaaatgaacaagttattgtccttggcagaagtgtctgaaagatcctaattcacttattgtttcacttgcagtggatattaactggccatctttagctataatacacatctgtatgtacattttaaatcaccagtgagtcatttgaaatgtatgcttccatacaaatgcaagtagacagtaaaaaagctgataacttcagcatctaattggtcaatcttcgagaacctagttaacacatcactttgcattaggcactgcaaatatttcttaaattccaacaccacaggaaccaaagagcacagagatatttttctcacctgtgtcagtgaccctcaaataacgcaaatctgttctaattttcatttcgagtttttattaacgtgatcccaactccaatgccagttttgcctgttttgcccagttttacagaccactgaacattcggatcgtgttggtaggcgtggaagtgtggaatgacatggacaaatgctctgtaagtcaggacccattcaccagcctccatgaatttctggactggaggaagatgaagcttctacctcgcaaatcccatgacaatgcgcagcttgtcaggtagggagttacgtcttgtctgcttaaaaaaaaaaggagtgctctcggcgaagcccttcgtttcacctgcacagccccaggagctgccacctttctgcagagcacactgccttgtgcaagggggcttctcagctcacaccaggggggcagatgccaccctcacctggaactgaaggtctgctaggaaagtctccctctgaacaccctggaaaacctgtccctctacagaactctcatttccttcttctagaacccggacattttcttctataccaatttttctgattttagctgtgatgtaaagttgttctgagtagcctatttttttgttttgttttttgtttgtttgtttgtttttgagacagagtctctctctgtcaccaggctggagtgcagtggcatgatctcagctcactgcaacctccagctccctggtttaagtgattctcctgcctcaacctcccgagtagctgagattacaggcacacgccaccacgcccagctaatttttgtattttttttttttttttttagtagagacagggtttcaccatgttggccaagatggtctcaatctcctgacctcatgatccgcccacctcggcctcccaaagtgctgggattacaggcatgagccaccgcgccaggccgaggagcctgtttttaaagattcatcattattagtggaaaatgtatgtttatacaatatctaaggacagtactttgggtgaatactgtcagattcctggagggaaaaaagactttattcctcctcctgttgtggctgtgactctttggttttctagatcagagaataccgggaagcatagcacattaaccttgtgttccctctttaaatcaatatgcatcacccgttaggaaccaaagagtgtttggggggctttgaacacagtggtgaccaacactgtaaatctccctgctctcagaagtctccactctactgagagacaacaataaagaggacaatttcagcaggatcaactggaagatgataaactaaggcaaagcatagctctattataacacaaaaattgttgagatgttgccgatgcttttatacttaaaaaaaaaaggaacaatctaaattagtatgaagtagatgtttctagaagtgacaaatttttatttaaatctttaaatactttgtgctattattcttttgttgtcatgtggcttatagcacagaaaggaaagcttctgggacagagactttcctttgacaaacccaatgtagctattgaacatttgtggaaagttaaaaaaccagtcctaccccattgtcacttcagaaaatgcctacgtctgaactgaggctgttggcattctttgataatttacttcggccattttcacagggttcccccctgcccctacccttggatatttgtggttgcctcacattttatgcattgattagtcttgaactactaaaagtacattttatgtattttgagtcagagtgttttgatatttttcccaaatggagtctgtccaacttgaacatctggaaataaattatcatcttatgtaactttattatttatatacatgtataattatatctgttcatatagtctatatagatgtaaataaaggccgaaatttctaccactgtaaatataagtatagtgggataggtggatagagagggagggagggagagagggagggagagagggagggagggaaggtgggagaaggttttatatacacttaccactttctgttcaattgaccatagctaaaatatctaacttttcaaacaatatatctgtatacatacatggccaagatagcattggtaagtcatttgactcctttaaaggaaattcaacaaatacagcgttttgtttttcatgcatgaggttggaattaacagcacttgtgttcaacaggcccttggtgtcattagattcatgatcaggttaagattccagatagaaggacgactgcattgaagccatgaagtccccttccagaagcttcctccctaggtgccaaggctttgtgggtgctcacttgttctacaccggctccagggttgataatttttctgcccatttcaattttgcaagctatcttagcgggacaatttgaaagaatttgggtgtctggcagaactgtagtaagttacccaggaaagcagttaagctatggtgaaaatctagtaaaccatctaatgcatttcttttagttaacagtgattctctgtgactattttcagcctttccatcagcagacattgtttaaatggagcagcttcctacagtccattaggaaataggcagattacaactcataagtacaaaagtaataactagttgtcatctgagtcttgaaaacaaaactctaaaaaatgacagaaccatgacgcaactgcagaaataaaattttcagggaaaaaagataaaatcacatgtgaatataccctcatacagctatttttatttttgcgtattttattgcaggaatatccaacagaatttttaaatattagagaatgcccccgttctaatttgattaaagaaagtcctctcttttatttcctagtggggtttatttccaagggaccaccatcggcatggccccaatcatgagcatgtgcacggcagaccagtctgggggaattgtcatggtaagccaagggcattgggagctggttccccttgataatgattccccaggaagtcactacttttatcagactttgtgaagatagatcctttcctttaatgctttttagatttaactctatttttactgtagctgtatttataattttatatatcccacagtgttttaggaaccatttaaaagcaaattgcacacaggaaaggtgggcatgtaaaatagctcagcagaggcaagcctacctcttttatggagaaacattttcaaccaggactttccaaaccaggaattcctcgcagcactggggtgagccagggcattggggttgccctcgtcatgcagctgttgggacgccctgtggtctcaccagacgttcccgtttggatggttttctgatggttctgtctccaagcccaatggcccaaagtctgaggtttttagctttttaccactgcaaatgctttacatgccttctggccagtatacagtttgtctttaaaataaccttattcttggaagtcagaaacccaggtttattgctttacaaggaccattttgtcatatataagctatatatgtttgtgaaaggaaatacagtgggaaaactatttgggtctcgttatgaatgtaggagggaggtagctttgataggcttgccagcagggggcttgtgctccacttcatcagataattaaaggagaggttttcaccctatgctgtccctgctctgaaaatttagtgtctcctctgcaccagacctcagacagggagtatcctcagagaccattcttccatctccattaaacaaatagaaccctgccctcccaagaaactgtgagttcctccatgttttttaaacagaacatgtgtgaatgttcagttgtattacatagtggaaggagttatgttctgctgatgattactttctctccacctactgcctaatcagatattcttcatgaatatacggaaccaacatttccctcttctgtgggttcagagattggtcattaatgtaagcctgcactaagggtcaaagctgcgtggagggattgcccccacttactggatttctggcttgagtggtgactgccttgttttctgtggacctggaggccctgcatgtgatctccaccatggcaggtccttggcaagtttggtttttgtgatgccaggttcacttcaagtcagatcccaactctatttttacagagcagactgtacatttttaagagggaataattttctgtttcatggttccatggtcagttgctactgactttgccacttcaagttggcatcatattttttttagagctggaactcaattcttcataagcatggtaagttctgctgctgtgcggtgctgaaatgggcctgtaacccatctcaccagagtaagcggctttcttcagctcgtgtcccttattccatttccatacaagcatttgatgaaaattccttctttaaaaggatacagggaaggctatttttaaaaaaggtatatgaaaatgaatgtgggaaatataagcaaattatgtgtcatgcaataagattcaattgaagatcaaagttaattatcaggaaatatgttttagcaatttgacagcagttaacatcatccttagacacactgcttacacgttccacatataacagaaacatcaaataggataaaaatgcctcagcacctttgatttctacaaaagtcatgaaatcagcaagatcaacatcttgaccagaccaaaaacttctagactcactttcttctcctgtgtctgtaaagttacattcacgggcatcccgtgtgactgtgcttcattagaggaccacaaatctaagaggaaggaatcaatgtagcaaggaagcagagatcctcataaaattgaaaacaggattgtagtaccatttctgtattttccaatatagagcaaatcattaattttagtgactgaaagtcattcctttttatctaactggcctaaaacagccttgctttggaaataatattaataacatgaataaagagatattttttcttactacaaatgtaaactgtttatcaaggtcttttaagagacattctgtttataatcattgatgcatgaaagaatgtaaaacaatctggcaactaaaaaccaagacattcaatgacacaaaagaatcagaagaatattttttaagggtgaattccttgaattttgtgccagagcatggtaacttcagcccctatgttcttagactgactacattctcttcaccattgtgttattttcgagaaccgatttcctgaaacatatttgtaaacttcctacaacaggaaactctaaaatctaaacaaagtaatttattaggaatttcatctactgtaagattatcttggttccttgatatgctattgttttcttagacagaagcctcattgtaaacactgtcaacaaacctgtaagatcttacatgagcacacttttatccaggagcctcacacagactgtatcagtgtgctctctgaaattcagtatcatatttgttttagcccattttctgttgattctaacagaatacttgaaactggataatttataaagaaagggaatttatttcttacagttacagaggctgagaagttcaaggtaggggggcacacctgatagggcttcttgagggtgaggactctctgaagagtcccaaggcagtgcgggggatcacatggcaagggggctaaacaaactagctcaggtccctcttcttcttataaagccactggtcccactctcatgataaaccatgaatgcattaacccattagtccatgaatggattaatacattatgagggcagagtccccatgacccaatcacttttttttttttttttttttttttttgagacagagtctcgctctgtcacccaggctagagtgcagtggtgggatcttggctcactgcaagctccgcctcccgggttcacgccattctcctgcctcagcttccagagtagctgggactacaggcgcccgccaccacgcccggctagttttttgtatttttagtagagacagggtttaactgtgttagccaggatggtcttgatctcctgacctcatgatccccctgcctcagcctcgcaaagtgctgggattacaggcgtgagccactgcgcctggcctgacccaatcacttcttaaaggcctcacgtccaatactgccatattgggattaagcttcagcatgcgttttggagggaacaaaccttcaaagcatagcagcactgtttcttggaagcctcttggaaaacatcttatctctttcctaagtagcacaaagcaagattcaaacagggtattttccttactccatggtatacaggccttttcagaaatgttgtatataggcactgtttctgtagatcatatatgctaattaactaatttcagtttgtaaaagttaagtaactatattttttagttaatttctagtatctgtttgagccaagccatccaggcactccactaagttaggggtggccaagtagtgcttgttgaatggagaagccgccttccatatccaagcaaaaggttaatgaacccccagccgcaagagtcagagaatcgggacacctcccatttccaaagtctgcctggcaacacaaagagccagcaagaataagatatagctggtttataatcttaaatgaaatgaatggctcttcaaacagatgactcaatgtggtcagatttattatgaagtattgtgaattttccaactgtcctccccgaccaagcacacaggaagaggcaggctcaatgacaacctctcagggctcatttagaatgtcattaagcgtgcttgcacctgtcacctttatatcagcatcatctcaatcaaaggtaaaatgatacttctatggcccatgaaggaatgagcttttcctatgatgcaggatgactttttgcttcattcaatggaagagttttgtggggcaattgtaggaagcagaatggagaccctgccttgaagatgtcatgtaaaaacataaagaatcacacatgtatacgtgcggcatacagacattcctcagccgaaaggaccccaaactggcttaatgaaatgtcaaattatatctttttaagtttaaactaaatgatagcgttttaccttggtcccttataaggaattacattaagtcaaatgttaatgaaaggtatatttctgtggggagggagacctgggaaataaggccaaggagatatgaattatacacctgtacttttgtgttttctttgaggaccattcagacaatccccttggtgcagccgtgaccctggcacatgagctgggccacaatttcgggatgaatcatgacacactggacaggggctgtagctgtcaaatggcggttgagaaaggaggctgcatcatgaacgcttccaccgggcaagtaccattgcttccatctgctttgacagtgtgcatggcttgaagtgtgtgttgggaaccagatgagtcaaagtgtctctggttttctggtcagagcacccagggaagcttccaaaaagtaattccttcccaagaagcaagggtggcctgtgctactctggagagccatgggcagccagatggcaatgctacatggtgtgtacaaggaagagggctgaccttttccttgaggaatggtgggcatggatgctgtctgtgtttagaaatcgctaattatcttcctgtcccagcaagtgttttttatttgagcctacggctccagctgccaggcagtcccaggagccagccatctgaaagcctgggcagtggagatgggccacatgtaaactcactgggcagagtggagatgggccacatgtctttagagggtgctgggtagaaggtatttctttccccagggttggccctagggtgtctctgaagtcggtagcttgggggtttgtagtgtctctgccctgacatcaccttaccagatcttagaggtttaaatgaaatgatttctctgctttggtatattacaatgctgttccttatttaatgctttcctgacactcccgacttggttcaaccagaaaagagcaagacagttccattatttggagtgttcaaacgaagtggaaacagatgcaccttggagggattagagattcagatgtgttcttatatctataaagggcctatcccaaactagaactttgtgctagtttaagaagattctcattagtaacgggaagcatgcgctggatacaatgctatcttctttattataccttgaaaccttatgaacactgactttcatggaacattccagcccaagcctgctctctgggtttcccaaaaggagacactggggcaagaggcaagtgctctgagcagcccagtgactcatctctgtgaagacttgctggccaggggacaagcgtggtgtgaggggatacctgctactgcggtttaaaagacccagtagagggaggaattgttaaagaatgtgtctgtgctttttcaagcaatagccttgtgggcctcctgggaaatagtttgtagggcattgagttgcccttgaaacaagaactgagcagaaccacacagctcatcaggggattgtcctttcatgggagccatcaggaggcatcttcttacagcaagtgactgattcctcatgttcatcgcccccatttgggcagaggcttcaggggcatctttctgtttgtggttccctcttaagcataattcaagggagtcaccaagactttgttgaggaagttgctttgtgagtgtgtaatgacagaaaccaaggatctgtacacaaagtcaaagtactaaccgataggaaatgaaatattgcaaaactcaagatactaacatgtgtgtctctccaaaagggaggccaccctaaaaagtaatatgttcctagtcactaaaggtgtctgagaggaagcacagtaattgtttgctggacatttggggcaaggatttccttcttagggtataaggttgggccaagggcctatagatgccttctgtttccaacatttcacaagccctgatcgctatgctgggccacacgctgggtgactttcagacagtgagtttggcaggagactgatgtgcaactgagtggccttcgtgttttctcactctcaatgaactcatagccatagaaaatgcactgtgtgtctaatttccctgatcatcagatgggcacaaatacattagcctatgggcctccagaaatggtttcccatgactaagaagatcatattgttaatattgttaatgttttttaattattgataaaccaatggaagagaggaaaacctagatcaagaacactggacttgaagagatctggttgtcccaattctcacaccattttttaaaataatataggcagtttagtaaccccctggctcttacattcctcatcaataagatgagtgagtcagtcttcatccacccatccaaccatctatccatccacccatccacccttccttcctcctttctttccatctgtctctccacccacttgttcacatattaaacaaatatttttgacccctgtgctcgtggggaggaatgcacagatgatgaagactctacagctctaaaaattatataattctgaaggcacaatagcaaggcatattttctggcactctatatggttttatctaaatcctttccaattggaaagtcttcatggcagtgctgaagaatgcaagccagatcgccccagagatatttgaacaccgtaggtagaaatggtattgttaagagctcgacaaatcatttaaaaggcttttttttcccccattaccaggggtttgctaatagcctttatttgatttataccatattagcaatttctgagttttctcttttgctgagcttgtgcttttgtataaatcttttctatttgcttctcatttatgatcccacattcctgtccagagagtggtgtttttaattttctcagatggaaagcaacttcctaagcaagtaggtgaattaatcacaaaagcccacagtgagggggaggtcgagcggctcagtcaaccctcagtcatccatcacccgtggtggagttttcccggctgctccggtattatctcaaaatggtggttctcttacctcatagtgtctccgagagagtgggagaatggactcaatgagatcacatgtctgtaaattgtaaatcattccacaaaggtagtatattattacttagcttacagggattttggaactatcaaaaagttaaaggctttttcagaattcctactcatcattgctggaaagactcccagtgcccttagcagtcactcagcagcatgtccacagtttccgtgtgatggctcactttaaactggcccacatccaaacaccagccagcctgtgtcttcctcctcccaccactgatggaggcttggggatgtcagttaaattcagtctcagctccaaaggtgattcagagatgaatcagtaactgctttaatgatattaacatctcagaatcaaaaagaaccaagtattgtagatggcttaaaggagaaaagtatatcccttcatataccttgtttattctttatcaaaacattccagaatcctaactctgaaaacattaaccaattgctgtcactgacaaatgggacctgaggcctgtaaatacaaggatagagtcctatttcaacttaagacttgtgtgacttcagttgcacattgcagggatggttggagggggttccttatggattgtatcattaattactgcaaggctttaagtgtgtgtaagagtgtgtgttttatgtctctaaacatttaagacctgtcctggaaatgactctttggcaaaagcagtatctggggattcatgtgggagtttaactcagttgagtttatccattaatgagcttggagcccttggtcttagggaggtgagggctacgtatgctgcatttataggagtaagaaaattgtgaatgacttgaacactcatagcaaagaatatttagcgtaatagtaaatgtcacttcctagagtaggaaaaaaggcaatattaacattcaaaaaatgactcttacagattcctttttttttttttttttgcagaaagtttctgttaaatgagagttggaggaatagggccatctcctcgggtggggtaggtgaatctgcaagtcatattcaccgagcccctgccactgttacacactgataggtgttagggacacagctgtgaacaggacaagcctgtttcttgccctcttggaactggtgttctagtggtgaaaagagttgaaaaatggaaaatttaaaacttgcagtttgggccaggtgtggtggttcacacctgtaatctcagcactttgggaggccaaggcaggaggattgcttgaggccaggagttcaagaccagcatgggcaacatagcaagaccctgtctctatttttaaaataaaaaaataaaagtaataaattgcaggttggaaggagtgctgtgaaggaagcaaaggaagaggacaaagagaggaaacatggggtgagggagcccactttaagtgggggtttgggggaggccaaaaggaagacagggatggagagcctgcaaagcatggaaggaagggagttcaggtgcaggggaccatgggcctgtgggcgctgtggggacaccttgctgccaggagccttggggctgtggggggctggagggaagtgatgctgggtagaaatggaggaaccagagccagcaaagcccagttggccagagcaggaacgtggattcttatctgcagagcagcgggacatcattgaagcttctcaggcaagataggaatatgatctgatttatcttttaaggtttcctcatttttaagaagaccatgcagcctctgagatattgtagtttgccaagttaaggggttttctgtctgtacaaaaaagaagagggaggcttcctttagaagaacaagtaataatagtgtgtgaattctagtttagttctggtgtaattcataggcatttggaaactgtgaagaggaaggatccttcaccagcacactcggtgctcatcacgccacgctccacactcacctctccagccttgtacacttgatgtaaaatatttcttttggtttgagatttctttttccttttcctatagtgagcatcctttagggattctgtcagagagccaccaaggagcacattcacattttcttcatgtgtatctgaaaagaattgttgccacagttgtcacacggatgctgaaatcaggagtttgggcctgtctgggttttgctgggtctatactggcaaatggcttcaactgacgagtgtgtccccagctgccaactgggagttggggcgggcagcgtgttcgtgttgtgcactgaggataatgtgggatgagaaaataagcaaatgagggttaccccctgctctcctggggtgcaaatcattcacattaagctgaggtcagaccttctgcaatctacacccagatcaaatgaccacgtttaaggagaatgtgttgccatcctacttccccgcaagcatgtataactggcccattcgattacatttaattccattcaggacacattcatggcacacctgcctggacacggaacacaaacagatgtgtccccaggtctaggtggcctccacccaggtcagccttctctctctctttttgtttttgttttttgagatgtagtctctccctgtcacccaggctggagtgtgcagtgacacagtctcggcttactgcaacctctgtcttccaggttcaagcaatcctcccacctcagcctcccgagtagctgggattacaggcacacaccaccatgcccagctaattttttttttttttggtatatttaatagagatggggtttcatcatgttggacaggctggtcttgaactcctgacctcaagtgatccgcctgcctcagcctcccgtagtgttaggaatgcaggtgtaagtgaccatgcacagcctcggccttctctaatgacatcagagaagacagcagccctgcccctgactcaggacaagcttgctacaggaaatgaggtcaacagacgagcagctggccaccaggcagagcaaagccactcatttactccactagtacttactgtgtaccctctagaggccagatcctggggagcagtttcggagcaggcacagaaacacaaggcaggatccttgacttcagggacctcactgcagggtacctcatcaaatctgcttacacagtccgggtatcaagcaccatctagaagtgatttcagtgtgggcctctaaaagacagagagaaaaatctataaccataacatcatttcacatcttttaaaaagcgaccaataatttattgcaaacagggagcaaaggttagaagaggcagcaggcagaaaagatatcctggaatagagtccagtctaaaccgatctcagaagaattaaatacaggctgggcagaccgctccctgaaaattcctacctcatactgtgggaaaactggatttctcttggaagagatttctgcctgaaaaggtgttttaagagggtaaaatgaactgcaattttcagtgaaaaaaatcccccaagggctttggaagtggtaggaattgatagaaattcaatgtagcgggaaagtccacactctgtagaacttgctttcctgaaaatcagtggacaatacatatcgttagaattctccctcgaactttggggtgctgttggagattatgaaatacatttgtcatgctggaattttaccaagatggaattgaagggaattatttttccatcttaactcttcatttgagagtgataatttttttctcaatgaaaagtttaagaaaatcttcatttccttcctcaaagtgttaggtgaaaaaatggaaatctttatccagagagagagaaaaaaggaggaacagctacagaatgaggaactctggtaagatgaaaacactactagttagaatcaatttaattactcagccagagtaatggagccagctgtaccccgacattatcacagggaaaaatgaactggcaggagggattcttgaaaacagttcaagaagggcgcatcaatatacagcctgttcttgtttcttctccatgtaattagatattgctcactggaaaatgaaagaatttgtgtgcaattccattagaatatgaaaagctgctgcccaagttagaattgtcctccccgttaagctgtacacaaaatagaggtcaagctcgggaggctgattctgtgtggccactgatccttgaatatccagtttaggggatattgaccctgaaggactgcattcatggtgtcctgtttcatcgatgaactttttaaatttaatttaatttttttgagctgagcctcgctctgtcacctaggctggaatacagtggcacgatcttggctcactgcaacctccacctccccagttcaagcaattctcctgcctcagcctcccgagttgctgggattacaggtgcacactaccaaacccagctaatttttgtattttagtagagacagggtttcaccatgttggccaggctggtctggaactcctgacctcaagtgatctgtgagcctcggcttcccaaagtgctgggatacaggtgtgagccacgcacctggcccatggatgaacttagtgagatggtcatgactatacctattttattttatatatatatatatatatatatatattttttttttttttttttttttttttttttttttttttttgaggcagagtccattggggccatctcggctcactgcaacctctgcatcccaggttcaaatgattcttgttcctcagcctcccaagtagctgggattacaggcgtgcaccaccacacctggctgattctttgtatttttagtggagatggggttttaccatgttggccaggctggtctcaaactgctggcctcgagtgatccacctgccttggcctcctaaagtgctgggattacaggcgtgagccaccgcacctggccaactatacccatattactggagctcagagtgttaaatgaactgcttgcatttttccagaccgacctaagtagaagccccaggacataaagtcaagcggctttttcccagtgtgtttgacacatggaagtggccgtgaacacatctgggctttatgagagaactaaagctgcctcagtacagagccatgtccctgtgcaacctctgggaggtgggaggtagccccatttttaagccatttaattctgcaaacctccttcaatttatgttccagcagcagagaatgctttcctgtcactggctcgttaacccagcattttatttgttgtacagcatgtgtgaaaacatttcaactgaaatcctgccaatcctgcaatccccctcccacacacttacccccatggcttcctcctctccccaggcacagaggccacagtgtggggtaaagggttatttctagacttctctacaacagacaatatccaaaaggactcattttcagctccacaaggtcaggaatttgtgttttgtttattgctgaatccccagcacctagaacagtgcctgacacatagtagagctcaataaatacttcttgactgaaaggatccatgagcgggtggctggatgatggatgcatggatgggaggaaggaaggatagataaataataggtagatgggtcagtggatgaatggataatgggtgggtggaatgatggatggatggacggacggacagacagacgaaggatggatggaaagaaggaaagatgggtagatggataaatcaatgataggtaggtggataggtggatgaatggataatgggtaggtggaaatggataatggatagatagaaatggacagataatggatagatagatggtacaatggacagatggatagacgttggctgggtgggcggatggagagagggatgatgagtacagcacaattagataagtgcagagtgaggttttctcttcctcatctgtgtaatggcaaaatctctggggagaacgctctgaggccactgtcttttgtactaaatctagcaattgcagcagcagcattttcattttttgtttattccacatcattctacaatggatttacaatagtttgtaatgatacacacaatacaataaatagaagaaaataaaaacaaaatagagcagagaaaacccagataaataggaggcagagtccactgcttttctgtacataatccatggagacctgggtgagggaaacaatttgctttcaaacagtagagtctttccagcagggccttcccctgaaagtctttgcttaatttagctaaagtgggaagagagagatcaaaaatatcaaatctaaaagcagttgtgagcataagactttgtagaaccattctccagtttacaaagatctttggcatctcctttcattgtcacagccctaaaaataaagaacaggtacaatcgtctccattttacaggtgagcacactgaggctcaggaaggccagagggcccacaggtggtcagggtcattctggatctcagcctgcagcctcaggctcctgatccattctttggcctttcaccgggtacctgtgagcctttggctcgcaggcttggggatggggagggttgagagggacagctctttcccattcttgagttccacattgccctggtggtaacttcagtgtcagttgctcagtggggcaagaactgggcacgtgtagacttcagccctggtggcaggcttgtagatatctaccgtgactgctttttctatcatgtttgattagaagcctctatcctgttacaggcttgctaagtcagcagaaagaactagcgtattctgtgcaggtctgtctactgggctaggaagaaagggtggtaccatttcagacatgcccactgtccattattaaccactgcatctgtccatgtctacgagagtctgctcctccaacaacccccacacaaattcagcagtcatttcttgcaatgaagctgagtagctcgtctgatacatggcctctgatgggctgaggtccttttaatatggacactgtgtcccccgcccctgggttcttggtctttcaggacttggtgcaggaagaaatagccatcgtagctcagaagtgaaaagtccactttctggtaacgtccagaagcttcctgtacatgtctcaactgaccagagctcagttggtgactttattaaaaattctgggaaattatatttgcacttaaattggtttcagggaggaggagcagaggtcaaagttcacaagttaagaccatgaattataatgtgctgcagatggctgcattctggggcccaggtgtttgctattaacaatggaaatggcctactaaggatctttctggtcatttgctcctggcctggtggttttcttagctttctgtggtccgtctggttggcccactggctcagcgtccagttataaggcagtcactttctgtttctggagtggacgtgaggatggattgccccattagcttcagcctcagttctgttctatcgtttgagcctgtgtggtcagagctgtgtccctgtgcaccgctgggcaggcagagtgggctgactcaggcccagttccctctcccatcacaccgtgaggaggagtcacgaggcttttgaggcggggcgcctatttcccctgcctgcagctcattagggtctcaacaggcttgcagccctcctcaggtgtgcacgatctggcccaggtatcacctcaggctagctggatgaatcccaagactgggcctttgtcttctgttacaccaaagacctttagggaagtcctctaaggtacacctggaaggaagtgtagaaccttgggtgttccttctgtttacgtctggctccagggagtcccgaggcatcggagcagctgcctctcccaacccatggatactactgctgctggcatagccatttgtgctgggtcatgcctgaggctgcccagaggccctgccctggggcagctcctgatagccctcgaggcggtgtggttgagtgggaagaacacaggccttctagtcagatctgtgctttcagtctccacgcagaaactgcagggtcccggcaaggaacccaagctgcctgcactcagcttcctcatctctaaaataggagtcataattggctcccagaggtgtcagtgagagaatgtctgccaggcttctggtccccagcagggtttcactaaacaaatggtagctcctggccagccccgctccaggcaggatggagtaaaaagcccctaaaatgatatgacctccttgcatccacagcaggcctgccacggcactgaacatgaggccggtcacctgcgagtacaaatgccaccgccctggcctaccaggcgtgctacttggttgcacataaattctgtgtgtggtgattgaaagtttttattgttgggcataactggggaaagacctgaagattttcctgaagatggccctagaatttttggtcagcagcttgtccaagcaatgtccattccccacactgcggtcccctgccccctcatactgtaagaggacctcgctctcacttgggaagagaagagggaattcatgttgggcttatgcttctcaagggactaggaatatgtagaactggctgtgaactaagaatggctaagttgtttttggaaaagctcagcaagctagttatggaatgaatgataaaagttgtggccggcatggtggctcacgcctgtaatcccagcactttgggaggccgaggtgggtggatcacccgaggtcaggagtttgagaccagcctggccaacatggcaaaaccccatctctaataaaaatacaaaaaaattagccaggcatggtggtgtgcacctgtaatcccagctactcaggaagctgaggcaggagaatcgcttgaacccgggaggcggaagttacggtgagccgagatcgcaccactgaactccaacctgggctacagagcgaaactccacataaaaaaaaaaaaaaaaaaaaaaaaaaacagtcattagattgtcttctccagagaatggatcccacaatttgtggccacgtctcactctgagctcagtgcctggacttggctgtggccaggaaatggacggaagatgtggggtgagctcatgtgacatgagctttaggaaaagggccagaaaaaagctttcaggaacagaagacaaccacagctgcgtagcaggtaacagccatctaaatggcgtttttgttttgtttgtggattgcttcattggttggttgtgctcctaactacatgctcttgttgagctaaagaaaaactggcccttccagaatggaacaggctgttttgcttctttgacaccatctatgtattaaacggagggaatgatctttaactgtttgctcatcccttcgcctcctgaatcatcttgctctcaaatttacttgtatttgtggttttacagtgtaaagcgtgctctattttggctacaagtactacattctataccatattggaaatgttcttgagcactatcatatacggggggattcgcagtcagggcaactcccaatgggagaaagaaagacacatcttttgcctgtcagtactaggagctagcatttcacagtgcttggaagttaaccagactttgatctttttgtttgaagctcgtttagcctccacttcagtgcaatgaggtagttgttatccctattttatagatgtgaaaacagaggctcaatgaagtacagataggctgctcagacttaggcttcggacttgagttctcaccacacgcccaggtaaagaagagcctcctgggtctgccgaatctgtggcatctgctgtcaggagaaaaacaaaactccattttggtctgcaaaaagaaaccagtgggaagcagaatgtcagcaacatattttccaaaaccagttagccctttaccatctaatcatttgtcagctgtggacgatatgaggttgttttttgttttgttttgtttttttcccccaatcagtttaaactgaaaaatctggatggattcccatccccggttccctgcaactttggcttttcctatcacacagttatgtcggctccaagctgttctcagccgctgcctggctgttccatccttcttcctcggtcacttccactcctttcctgccgtcagcactcagacagatgtgagcccctgagcttggaggtggggaacctagactcagtgcgtgtttattaatgaggccgcagagtcacaggaagcagcaggaccctgacctgcagccccccttgaatccagcctgattatagctggtttctccagacgcctaatttccagcaagaaaagcagttgtctccaaatcatacccagagagcttttgcaagtcagataactcccgacttctactgtcaaggttgataaattggcctagtgtgattcacccccaagaatatagcagtgagacgcacaataggctcctacaagaaaagaaccttctgactgcagatttttcaaagtaaaagtaagccctaataatattttacttggcagctttgtgatggctaaaatatgaagctgtgactgcctttatggtggggagctgtaagtggcattcctctttttaaaagtggtgtttttttccccaaaatcacccagctgtctgtttcatcctctttttatttttaaccttgcattcaacatggtaaacttgcctcaagtgtccctggtagttaaatattagagaaaaaggaaagcaaggctaacaaaagaggtcacatcgtagcgggggccacagtcaccctgccacggctttggagataaattctctgcctctgagctgaaagcagcacttttttttcctgggccgcaggtatcaccattttaaagcattctcacgccaagggaaaggatcgtgctaaagggcttctttcctgagtaattctccagttttattgctttgcaccagtctctcactgctataggtcacttcagttagctgctgtcctggcacatgtgggataatttattagacatgttaaaaagtacattgtgatgagcttgccaaaagctacggaagaaactgaggcttgtctttttaaccacagacgaggggctgtatgagatctttgatgtcatgagcaactacctggcccaagtcaatgttcttttcatggatgctccggggaataaagctgttaaataagaaaaatacaagcacaaaggaggcacaatgaccatgtaccatactttggatttggaagcaggtggaagggaaacatcactctgttcacaaccagaacttttcctacactttaattactgtgcagtatgaggattagtcaatttcacataacacttccaggtacttgaaaattcatttctgatatgaagtttgtttataagacagatactcttgggatttttagcacatgcctaaaatcagatcagtagcatcttgccagcatcctctctctggcatggctaagtgagccatagcagtcttatcaacgatcgcactgacagatcctgcctatgattccttgccttgcctgttgtccattggcacatctttcatgtgatcacaaaatcaggtcaggttttcaaaatgccatacattgggcttttcttagaagatgggacaagagagcaaaacagaattattttttaggatatgacaagtggcccatggtgagtctagattgcattttttattgtcacgacacaaataggtacaacagcatttgaattttaaatctagggaagttgtttccagtctctaatgggcatcaaaatcacctggatcattaacagatgagcagatagcaaattgtggtatggtctcacttgcaatggaatatcatccagccataagaaggaatgaggttccgatgcatgctaccatgtggctgaacctcgagaacactattctaagggaaaggagccaaacacaaaaggccacatggtgtaggattccgtgtacatgaaatgaacagaacaggcgatctgtagagacagaaagcagattcgtggttggcaggggctgggtggggaatggagaatgaggagtgatggcttcatggatgtggggtttgtttgaggggtggggggaagttctgcagttagtagtgatggctacacaacattgtgaatgtgctggaaaaaaacattggattacatatttcgaagtgacttaaaggatgaattttatgttgtgtaaattcaacatcaatttagcaaatcgtctgcagagcttattaaaatacaggttgctaggcccctaccttgagttttctgacttagtaggtctgagtggggcttgagaatgtgcatttctagaaagttcctggtgctgcttgtcctgggagcacactttgagaaccactggtccaggcatatgtgggatcacagcaggatttgtctcctgtgtttaaatcggtacattgaggattaatcaatcaccttctgtgtttcagcattcactgctggtcatccagtgctgaactggcactggtaataaagaaaatggtttttagtacctgaacgtggaatcataagaattggtgaaatctagtactgccatcccctaactgtgaactgtcaaatcccttcacctcatttgcaaatggagcaataataactgtttcattggattgttccaaaattttaaattcaaaaaaaagtataaaagaagaaaaatattaccatgagaaagcaccaccatatcacctagctaaaagcaggtactccataaatagttatgccaaaaaaattatatattttaactcaattactagtcttgggaatttataatgttgtggccagaatatggtgacacatgaaggcagcgagaacttacaacacagccttggactgcacagttccactcagactccatttatgtggcataaaagatatgtttctgggggtttgggacttcaaagaccgtttctggaggagtggaattatatgggccttggagaacggctggagaggaaatgagataggagggtgggcacatcccttaaggaaggagcttggcaaggggggcatgggaccaggttcaggtcatattggaattgggatcctcttcagtgctttgagtataatagacacttgaaaactattgctccataagtgagtgaataaatgagagagttgtgaatttgccactcaaagttgtattctgccatcatcagaggtatgtaggcagagtcagcacctggggagcaggtgatgcacctggccttgctgagcattggcacctgctttgctctaggcactaggtaaccagtggctacttaggatgtagaaaatattctaatatgtgtggattaagatggtgttaccattagaggaatctaatattcgctactggcaaatttcccttatctcttaagatttgaagtaattttcatttattaaattttttgtattggggggcagtcattgggtttgctgtaagttttccatacttagttctgtgtcttgatcaaatgagactatcttagagcagcaaaagggagatgaggagcagacctttgcctgcttaaaaagcagtttgctttaaaaaaataaaaaggtgggggaataagggtttggagttcttatgaaaaacacctttaaatctttaatccatcttgagttaatttttgtaaatggtgagaggtaggggttcagtttcaatcttctgcatatggttagccagttatcccagcagcatttattattgaatagggagtcctttcaccattgtttatttttgtcaatttttgtcaaagattagatggttataggtgtcggggtttatttctggggtctctattctgttccattggtctatgtgtctgtttttgtaccactaccatgctgttttggttactgtagccttataatatagtttaaagtcagataatatgatacctctggctttgttctttttgcctaagatagctttggttattcaggctcctttttggttccatatgaattttaggatagttttttctaattctgtgaaaaattacattgttatttacattgtaatctgtacattgctttgggtagtatgaacatgttaacaatattgattcttccaatccatgagcatggaatatttttttgtttatttgggtcatctctgatttctttcagcagtgttttgtagttctcttatagagaactttcctctccttggctagatagattcctaggtatttcctttttctgtgtgactattgcaaatgggattgtgttcttgattttgttctcagctagaacattattggtgtagagaaatgctactggtttttgtacattgattttgtatcctgaaactttactgagttcatttatcagctccaggagccttttggcagaatttttagcattttctatgtatagaattatattgtcagcaaagagagaaagtttgacttcttcttttcctatttggatgccttttattttggctttggcaaataatttatggctgagtccccaaaagcaattgcaacataaacaaaaattgacaagtgggacctaattaaagagcttctgcacagccaaagaaattaccaacagacagcctacagaatgggagaaaatattcacaaactatgcatctgacaaaggtctaatatccagaatctacaaggaacttaaatcaacaagtaaaaaacaaatagttcaatttaaaaatgggcaaaggacataaacagacacctctcaaaaggagacatacaagtgaccatatgaaaaaatgttcaacaacactaatcatcagggaaatgcaaatcaaaaccacagtgagataccatctcacaccagtcagaatggcgattattaaaaagtcagaaataacagatgctggcaaggctagccactgtggaaagcagtttggcagtttctcgaagaacttaaaacagaactcccatttgacccagcaaccccactactgtgtatatatccaaaagaaaataactcattctaccaaaaagacacgtgccctcatactttcattatagcgctattcacaatagcgaagacatggaatcaacctaggtgcccttcaacagtggattggataaagaaaacgtggtatggaatactacacagccatcaaaagaacgaaattatgtcctttgcagcaacatggatggagccggaggccattatcctaagcaaattagtgcaagaatagcaagtcaaataccacgtgttctcacttataagtgggcactaaacattgaatacacgtagatgtaaagatgagtacaacagacactggggactattagatgggggaggatgggaggggagcaagagctgaaaaaccacctattgggtactatgctcactacctgggtgacaggaccccagaccccagcatcatgcaatatatccatgtgacaaatttgcacatgtaccccttcattgctaataaaagttgaaattatttaaaataaataaaaataccttcagtcattcccagtgcctggcccatacagaggcacagctcccagtgtattgacactccatgggatcttctcaccatcagcatgaccttgacctatctaagaatgatgccaagtagaaaatgggttgcctctctgggtgtgtgtctgcaggaagagcagactgtttcccactgttgagtaagttcctccaggccagtcctgtctgcagacacttgtaccagctctttcccgaggtgcactcacaccttcttcccttcgggtgaggggctcaaatgaccctcttactggtgaggtttcctggtgaggtccactgtccctaaaagttcaatacacaccctcttcccttgctcttttatttttttctccttaattctactctttctaactcattctgttcccttagcttgcctattatctgttggccccactgaatgcaagctccatgagggctgagatttttttgttctcttcattcccatatccccaaagcctagaacaatgcctggcacctagtcggtgttgaataaatacttggggaataatggaatgatgtgtgataggctgttctgattttcttcctctaaagcctgacttcctctaactgcccaaatagggttcataaatatcctatcagagtgaatagtcacctgcctccttgctgagaaatcatgaaaggatgggatgagtaatgacatcctacaggtagaaaatacttctcagcctcatcaccattcgtcatcaaaagtaagttcttgaacaataaacgaggcatttttttcttcattacatagaggaaatggtagcgatattggctgacccagtccgaggaaatggcaggaatgtttgtggaagggctgctggactccccattgaccttgctgggtcgcctgagcaagtcagaaaaaccccaggttggtgggaagagaagccactcacacctgctcatggctggagctgtcacccatggtcaggagttgctggaagtttgaattgtcctgacctggaaggcaggcggcatgctggtgagctcaggccatgtggaaaggagccctgagaaaggatctgttcagtgttggtgaattcatcaagacctcatttcgcatctgaggaggacatcgctactttccttttaaaacagaggcatccctgaagaattaatgctaggatgctgttcctcagagcaaggttgaaaacccgtgaattggatgacgaccatttatgtatgcatgattctaaatgagaaagaattttgttaacacttgggagttgtccttcagcagaatgaggaaaagctaagggaagtagaaatagattattacacagatcactatacagtctgacaacacccaatgcagacacaaaaatacaatgatgatctttgccaatgatgatctgttctgttctcctctcctacacattctgaagtttaaatcctggacttaaactgttctccttcatcctatttggatgggaaacccccaaaaaacccaatgtttgtgtgtttgttgctttgaaaggaatgagatggggaaggcatgtctgagcttagtgaacggagctggtctcagctctccaatccctggggtctacggacgttctctgctcctttgggaaacaggccaattcagaccactcttttccaggcttctcttaattgctgtgattctggctataaacccttcctgagacttaacatttatcctagagtctttcctaattaactctaatattttctagaaatcacttcccttctagaatgaactgataatggtttgtcacagaactaagttgcgtatcactgagtgagaatgatgtttcatctcctagatcaggcctggagacatatatgtcctaggaaaactctcagatacagaagaagtttccatctgtacctccatgaaattgatttttatttctttctttctttctttttgcaaagagaagaactgctcttaagtccctgtgtaatataccaattacttcaatataatacccttctaaattgcaaaaacattatcatttttcttgtgaatcattgtttgaacctagttagtatattttgataccaggaataaccagtctgtctgccaggggaagttacaaagatttcaagattgttacagcactatgagtaagtcctggtatgttgcctttgcatccacagaggagcactttcatttattaatttatttgtaaattagaattattaatatactccagagttaatagcccgaggttgatagaaaccacttggagggaaaactaatgcaggaacagaaaaccaaatactgcatgttctcatttataagtgggagctaacattgagtacatatggatgcaaagaagggaacaacagacactgggaaaggagaggatcaaaagactccctgtggagaactgtgcttattgcctgggtgatgaaataatctgtacaccaaacctcgctaacatgcagtctacctacataacaaacctgcccatgtacccctgaacctacaattaaagttaaaaaaaaaaagttaagggccaggcttaaaggctcatgcctataatcccagcactttgggaggccgaggcgggcagatcacctgagctcaggagtttgaggccagcctggccaacatggtgaaaccccatctctactaaaaatacaaaattagccaggcatggtggtgggcgcctgtaatcccagctacttgagaggctgaggcaggagagttacttgaatccgggaggcggaggttgcagtgagacactgcactccagcatgggcaacagagtgagactcggtctcagaaaatgaagttaagaaaaaataaatacctggtcattaaaaatctgtgcctaatagtatgccttatatacttggggaagaaaagggaaaccactcggagaggatggtgcagtgttatcagtttggtcctggaaatcagcatgatctcaaaattcaccaagctcaatcattaagtggccgctggtctaccatcatcaggggagcgtagcagcttgcgttggtttggccaattgattgagatccagttctaatgtcatccttataaatgtctccattgggagagggtgcttgggtttgctggacagcagcccctgctccctctctaagtaataaaactttctgggtttctggcatgcttataccttaataatccttgctgcctcaagacatgggaaaatgcatttgtaaaaagtgagacactctgtgtatgttggataacactggctgctttggaatcaaaccccaaatgctcagtgggttaccatattagaagcgtgttttccttctgtatgatgctctgaggctctaggctgcaggtggccttcctccatacagtgagttaggaccagatgccatgcctgacacctccatctcctaaaaccgtgggatactctaatctcagctggcagatggggaaagaaaggatatgaagaaggaatactcgcttaaataccatcagccaaaagtgacctatatcacttttgttcatgttctagtgccaagaatgtcatacagcccacccaggtacatgggggctgggcagcccttctagagcacagaaggggagcataactttgctggggagttggctgaccctgccacacccggttgtttagaggcacccggttgtttagaccctgccacaccgtggaatttagagacaagggtaagacctgcatttctggatcacctccattctcttacaactgtgctgggggaagatagggacttggcctttatagacctgaatgccagcatcagcaggccctgccctacagtggaaccatgtgtccttggaaccatggaattaataaacaccgtcatttgtactcttttcttctttgcactttccaataaggacattgttatgtgtttgtattacaagctacagtccctacgaattcacttttcgtagcatcatttcacccagaactattaataatgtctttaatgagactctgcctgaacttattgatttgaaaaccatcgaaagatcatttcttttttgataaagcacttcttcatcagccgcgttggcactgtacggaatggatgtcgggatggaactgaatgtgcctcacttgacactgcatatctgagttttttgatatgcattgttcattgagaccaccagtgaacacctgggcagatgtggccagtgggtgccttcttgtgggcacaagaagggcagacaaagccattccatgccctgtgacttactgttctgggctctcctttctcaggtacccatttcccatggtgttcagcagttgcagcaggaaggacttggagaccagcctggagaaaggaatgggggtgtgcctgtttaacctgccggaagtcagggagtctttcgggggccagaagtgtgggaacagatttgtggaagaaggagaggagtgtgactgtggggagccagaggtaagaaccattcccagaacaaggatacaagaagacttgtatcctcggctaggcaaagaagagagaacttggaggaactgtacagccagatgaaagtactagaactcaggaaggaagagtcctatctgcccatcctgaacaagccccgtgagctagggtggctttcttgaattttaactattgcatggaataagtgatcacttcatttaaaaagataaataatcctatcgaagggtacagcattctcagcaagatgaggccaaaaacaataaaaaaaagtgtttagctttgagtttgacagagaagaaagccctggaattctagcttcaaatagctaataagcaccatttctttttcttcataaggtgtgctaccagaggggaatctgaataagcagcattcatttttaaccaggagcttcctctgcagttgaaattctgccttgctgctgcagacgcctctgtatgcatgactcgaggcttctgcctctcgagctggtagctttcagaagcaataagtgaaggcagggaacgtttttatctagcacagggcttaaccctgttttccagccaatatcaggaaatgtccttgttttaatagggcccaagataatcactataaaaattataaaagtcactttttaatctctgaataatctcaagaaggaaagagagaagacagcatgagacctcctagtaaaacaggtgccccttcgaagtctggaggaggttgtgtttagaataaatcaaagcaagcagttgtacagcaggcagcctccatgtgggactccctccccgagagtttatgcaagctgaaatagtagacaagttcaaggcaggcttagctaaattcacagatggacttaatgagggcttaggaagagcatctccaagggctgctctgaaagagggagtttagggtggaggagaaatcgtgttgagactggcgcatccggtatattcctgtgttcatcacacaaacaactggcaaacagaatgttcatcatatccccatcttcaagtctctgaggttttccataccaggaggaatgagcttggtctgacagtttctgcaagaacgctggaagtatgtaagtattgggtgggagtaaggggggatgtgatgtagaagtggtttcttcaaatgtttttatgcccttgccaaactcagaacttaaccatgataatgacattgtctggaggggtgtctaattttgctcaccatgagcagggaatggttgctgtgtaggagcaagtcctaattatagtgttacagaaactcttctcaagattagcagaggaaaacttaaaaccatcatgggttggggtatgcaaaggggaaattccttgtaggccttgttaatttcttaaaggaaaaaatgaattagtttaagtttctcacctttctcaggagaggccatgttggctgaaaatggtttgtctttgaacttcttatgattgtttgttcatctaaataaatttgacagctcttcatgaagccatgaactctcgggtttggaatgatttcgttagcagtcatttactccatatgccaccagcagcagccacatcactgctacaatcacgaccaccattgctaacatcaccatctccacaatcgccaccaccacctcctccacccaacatcatcaccatttctctcatgaccatcatcaccatatcactgccactgccgccaccgtcatcactacagccctcaccatcaccccactattgtaaccactgccatctccacagctactgccaccaccgtggccacaccagtatccacatcgctaccagcatcactgctaccatccccacccctatcattatccccaccaccaccatcacatcagcaaatgcttgagtgcctaaaatgtgtcagccactcatattctgatcctccctcttttctccatgaaggagtcatgcggcttgacagggtgctgtctcgccaggtggcatgttgcattatagggtagctttgattattacaaactccctccttgtacagagccaaactgcttgcatgcagttaccaactttgtatttctgcggttaaggtccttattttgtaggataacttcttgatatttgaagatagctctcattcccctcatccaaagttctttctttgaaagttacaggtgagccttttgcctcactttttagatttgcttttttttattttttgcttttcaaaaaatagtttcaagtagttattattagaaaataatagtttcaaggttcaaactcaaattgtgtttggcagtgtgacaacctatttacagtttccaaactgctttgcctaagaattttaggcaaaaagacttgttaacctgggttctttatccccctacccagtgctcaggccctggttattctgcatgcccttacatcagattgacctggccattccctggcccacagagggacccagtgtgttacgacatcagggaaggagtagtaaatgggatccgaaaaacaactgccagcacccaatggaaaccagcttctcccttgctcccagaaataatctccatcattttcaagaagatggcttctagtcttctcccagttcattgtgattaagaatctgtgtctgctacctacaacctgagaatgacaattagggctttgcagagaattctctaatgctttcattattctttcttctttggagacttggtattcattggctctgttggacttctctattgaggactaaaataatcaatgtagcagcagatgaagaatgtgtctcttctgagaaatatggtactgcagaagaaatagatcctgggtggtttgaaggcaggttgattgctgaagccttcccggacagggcattggatttatatcaacataaggaaatcctgacaactcactcattcttccagctaacaggattgggaaagcagccttatctccttgtttaaagtcaataggatgccagtagcttgcgaatatcttttaaacttagttatctttctcacattatcatcccctttgaagtcagagccatttggcatggctgcatttccatttgagctgctgcttatattactgggtgatttgagagaggggggaagatatttcttaaagaattttaggacccagatttaggatggctgatttaacatggaatttcaagaaaacttgtaatttggtaaatgtgtcatccatagagccatttagaccataaggaccaggatagcagtggtgtgcatttgatgacactgatttaaaaatgcaattaatggactactttttttaaaaaaagttcctaaactcttttagaattgtaagtccacaagttagaaacccttactgtcataaaagttacagctatgacttctggttgacagttttatcttattgtatatattacgcattctggatgtttataaagtcctcaagcaaatttaaaatttaataactttggaagtctgtataatagaatcaaatggaacatcaaatgagagcataattagagttttacataggatatagtttcagtatctgggtttgccataaatcttctggattattgacaaaattttattaattgcatttataaaactcatgataaatccattcaagaaagatggttttcaggagtaaagtattatattattaaactagtatgtgattagcttcaccccagccaatggtatataaatttttcaaagcatatcatatactggataaaataaaagaacattgataaattactcagtattaaagatctatgaactgttccatcttatgataattacatttcttctaaaatgtgtaaactgcagttacttgaatgttctcaagtacaaggacttcacttgataaatgcgtgcaggccttttgttgagaactgagcgaaaaatgtcaatctcttgtttttgttaggaaaaaatggaagcaatgggtacgtgtggagcacagcattataaaggagttactttcttttctcacttttgtttcagagaggacagtacatctaatgcttgaactatccatttaaatccctcgcaaatcaatgggcacagcccacaggcctcctgccggccacttgcttgttataaggtccatttctgactttccgagtgatggaattgtcaggccagacaacttacccgggctgctcaagggtctcatccacaaccctggcgagattgcagggaattgtggttgaaaccactggtttgacttcatttcctgccagtactctctaaatcaaaaaaggttcatttttgaagagtacagattgtatgcatctatgtatatttttgattgggtaatttcaaagtcctccagggatcctgatgcagtccactgcaatgagatccgcctggacacccctctacagagccccagtgtactgctgactagagtgatgtccccagccggccagcctatgttacaactgctttacctttcatgagggcacttgtgtgctactggctttttccagggactcgtagacccagttggttcataaacagcagaagctttgctttcctaacagacggaaacaggcaggtgtgcagttcaggagctgggccctcttggtctttcttgctttttgcagccatttaaggtgtgatgtttgcattcagtgagtgcatactccataagaccctgtcaaacaaatgccattcccctttccaggaatgtatgaatcgctgctgcaatgccaccacctgtaccctgaagccggacgctgtgtgcgcacatgggctgtgctgtgaagactgccaggtgagtcaccggagctacaacttgacccccaggtcgccaacaggttcaggtggttcagatctgatgcagggcaagcagtgtggctggaaggtttcccagcactcaccacagcacgcaccatccctccttctcacgccagttggtgttacccacctcttactgtttagcttccaatcttggggtgaaatgcacgcttcagttgccagtcacttgtgtttatttatttaggggctgacaactgatcagaccgataaaccctagttcaactttaaatgctccatttgtgccgtcagaggcacatggggttctactatgctgacaagaagagcaaggcgagaacaagtccccatccactgtcactcaggttcccccaggttcatcttcttgatcccgcggacatctgcctgctggcttgtcccagaagttttgtataaacaactcaatcttaatgtcctcccaaaagaagttgccaccaaccccgcccagccaagaatggcagttttatactctcgccattgctgctggctaggactgcgtttcttttggcagttccattgtctcattattcagagctgatatctgagagtagaagcctgagcttttgattcaacagttccaagggtagagttttatttcattttaattaagcaattgatcctgacattctgcttgcaggaaactccctcttagctgccccacgtgagcacggtgatttagaagtgcattataacatttaatgttcggctttaaaatagccttcatcctcttcctaatgctgattaacttctggggaatgttataagcagctggctctccctggctcccagtaactggtgaaggaaggtgcctggaagggagtcgggggaagggggaagcaagtctgagcctgtgcccaggggatgcccaagtaaggggagggaggaccacagggcaatgcctgattgtggttcacttttaggttatgactttttaacaattgctttcgacttccagatcttctagaagttggcaggggtcttatctctttgcgtttgaggagtatgcagggaactaagcccaggactcgcagggttccctagctgtgtagcctcagacgggctactctgagccttaatttcttcaaccacaaaaagctgagccattggtcagatggcttctaacatcctttacctctcccttgttcttctcctgttcttcccataaagcagtaaagagagagttccagttctatgatttgacgactgactaaaattgctatcgtgattgtgaccttaaagttatttttattaacttgcccacacatgccaacaccataaatgcaaatgtccccttgaaatgtgtcatagtgttgacacccagagacctttttcttaagaatcaaccaggccagcagccaacgcttccctccttcttcttcctctgaggtgccaagtgccagcagccagcttgtgtgtttcttggagaaccctgatgttgcatgacattaaccagaggctgctcttggttgtcccacccactttagagtggaacagtgaaccccagaacgagaatctgatgatttaatgaggtatctctacattagaagcaacttcctttgaaatcctcaccccttatgtgggacttatggccttgtccactccagcccaggagtaatgctgagagctgcctctccctttccccgggtgcatgtgtcataaatggccctctccttccagctgaagcctgcaggaacagcgtgcagggactccagcaactcctgtgacctcccagagttctgcacaggggccagccctcactgcccagccaacgtgtacctgcacgatgggcactcatgtcaggatgtggacggctactgctacaatggcatctgccagactcacgagcagcagtgtgtcacgctctggggaccaggtacgtggccgccacaagctcggcatcaggagaggcactggcagacctgggctgtgggactgggggcatgtgctctgttttggttagcccccactcctggcgggcgctgtccacacagcatccggtgtgttcagtcgggagtgattgactcccagggagggtctgaggccgcactgggcatggggtgcacagaaatggacactgcctggagcctggccttaagaagctcagtgcggtccaacaggagctgcaggagcacctactgtgcgccccgggggatacagaagatgcaggagcacctgtgtgccccgggagatacgggagctgcaggagcacctactgcgtgccccgagggatggcagggatgaatccaccatgactcctgccctcagatagcatagcacgtagttggacagacagacagaactttcccaccaccactgagattttagtaatgcccctttgtactcataagaggaccccaaccaagtgaggggcccagggctccatggggaaggccctgatcagacttgaagcatgagtgtgtctgtaatcggaaggcctgagagcagcagtgagtggctctcaaatgggaaagtggggtggttgcgtcaaacaagagaccatcagttcaccatttcaccagttcaggctgggcacttggcacagtttgtctcttctgaccctccaacaagcccctgaagtggggactatgaagctttacagaagatgatgctcaaactctgagaccaaatgtcagtttccccaggtctccgggctaggatttgaacctgggttactgtgacccaatgcccatgtgttactcccacaatgcacagtcaccctgaagagggaggtgttgctctaaagctccaccaaagctccaaaatgaagcagaagctcagatgcaaaagggaagaatccatcccctgcgtgtctctcctccatgccccaccttctggggtcagagatccaaggcctcattgggcagccctggactccaaggccccgtcaccccagaaccatttgagattcaatgcctgtgtccagctcccaggagtccaaccgtgaaatccacaagtgcaggccccaccctgtcctgcagttctctttcccttatgataatgtggttgagtcctttgtcactccctcctcctgctggctgcagaaatgacctcagcccaggccagagaccccagctctggcaaggcctcttgtggtcggccaggcccaggctgaaagccaagcagaatcaggcaggatctctagcgggagggaaacctgataggacctttgtcagacttttgttgtgaggctttggttttaggagtgatgagggaaataaagtggaacagaaattgatgactaaacctcgaagcctgggttttcaatggaatgtaaaagccacgcccaggcatggaaaacaagatggatgtctctcggagctgggtcctgctgggaggcccatgtcccctgccagccagcgatgtcctctgtacttggagctttctgggggggaaaagaaagggcagcttggtagcaaggagggacgagcgcaggcctctttagctcggcctctgaggagttgttctgatgctcctcagcactcagggatgcgcgtgggcaggtgggatggggaggcctgcagttcccgggcccttagtgcttcatccttggaccctgagcagccctcagtcctggcatcatcgcctgctgggccttggggcaccctgggcaaagcagggggcaggagcagtgggggacaccctgttgcaatgacaaggactaagccagtactcgctatacacattgaatggtgtttgggcttgacatggtttagtgacttcaggcagcttttagccaactgaggtcactttgggactgcggctactgctgcaggccaaatcttcatggcttcaggcatccctagtgccgtccccgtcccagcctttctccagaatcagcagtctccttttcttgagttacaagggctgtgatgaagctcctttccaaaaagcattttgtggccagagcacacacaacacttggagctttgggagtgaaatgtgttccttaatgccctgccgtattcgaacagctggccccgtttccagagtgaggtcagagggaactcgacagtgctgtctgagccacccccattgtgtgactcagctggctgtgtgcctctgattcatggtgaccaaagctggtatttattatctcatcagtctagtccttctgtagctgcctgaccagagagagaaccagacaggcagacagactgacaacctgacccacagactgagcttttcaaaagcaagagcaataggaagtcacctgcttgggctctcatcatccccatgatggagggggaggctggaggtctgagcacccaggtagccacgtcctcttcctaaggagggggcttccctgggagctcctggcttagctctactctctcccacccactctctccctggtaaccaggaggcctttgctggggtggtggtgggtggtgtcgtgtgtggccactgcacacagcatggaacatccatggcatcaggactgttggtaacaaatgtaaagttttggtgaagaggctttatctttggctcagggttcctgaaagccacagcacagagaccaggcttgggaagccacctcgggcttgtgacttcctgggttttggtctgtcctgcccgcccctcctcagttcttcagatcattatacagacttccttgggagagcagagagcagggaaggctgcaacccactgtggcccttgatgccagggagctcttggaatgggcctttgaccacctcctttgggagtgcagtgtgctccttcctccccttgtcggtgtttccgcctggtttccagtttacaggcgctgtgtgagtttcccatggctactgtaacaaattagcacaaacttaatggcttataaatgcttcattttacagttctggaggtcagaaatcctgaaatcaagatactggcaaggcagcattgctttgggaggctctggggagcatctgtttccttgcctttcccaacttttagaggccacttgcattccttggctcatggccccttcctccatcttcgaggccaacagcacagcatctgcaagtctctgtccctctccgacttctgcttctgtagtcacatccctttctctgacactgactctcctgccttcctcttataaggacccttttgattccatcaggctcacccagattgtccagggtgatctccccacctcaagatcctaaaagtaatcacatcttcaaagtcccttttgccatgtcagataacatgtgcataggttttagacaaggatgtgggccttttaggggagccacaggcattgaacagaccacttactagcaagggaccttctgcaaattgctcaaccttgttatgcctcatctgtaaaataaggatagtgatctacctaccccaagggtctgttatgctccaacatagcctataatctattccatgtaatatatgtggttctatgctagatgcagagctcctagtaaatctaaactctataaataagatgcagctgcactcccaggaagcttagactagtgagcaaggtactcaaatccttggggtctgtaaaacgggctgtaagagggtcatgggccagatatgttggggtggaggaaagcagccaactaggaggctttgaagacaaggttgccgtggaatagtggtttgccaggggtggaagaggatggatatttccagtatacagaatagcaacagctcagggcacaaagggacagtggggccaaccagggcaagtgcaggtagttctgtgtgtgtagagcttgggctgtgccttgaagagcagagatcctcaactgccacaccattctctcatttgtcaagtatttgttgatgtcctgctgtgtgtaagatgctgactcaagagccccgactctgccagagtgacacacttcccacagtccctgtgcactcctgcctggatctggaggggagtgcggatgtgaatccttcacaatatcctcccgggaggcatggatcccggacaaatgcagtcctgggagcggaggtgacttcctcagccaggcccctggccagccagatataccattgagaacatttcaatgctttgttgtagtggttggtttgaattagcttttcatgattcagaaaggaaaacttattgtcaagtttgcatttgcagtatttccccacccaggagcaaatgcttcaggatctggatcacgtatgcactggggtcatcacaggcctcctgggaaatgtaggaactcagagctctaagagtccttgagtccttgccccaccggcccttgacatttgcaccccagtgaccttgcccgagttgctgagttgcccagaattctccagttacattcaggatgtccattactcaccctccagatctggcgacccaaacactgactggacgaagcccttccttccaactaatgattcccttttgaaatgggcttttctcaatctggcgttatatttcaataaaacaatcctgcttccaaatctttctacaaataaaacaacagaaaattcaaaacacatgcctgcaacttctaactggcaaagcaatacactttgagaatgcctttgggttttttgttcatttatttgttgttctaattgtttttgttgttgataacgtacgttctcgttggctgagagtataatttttttctcactgatttttgtcccacaaatctggtatctcaagacttcctatgttgatttcaaacatacaaatgttattcacagttcaaactgtggttggcgtttagctctctttgcccagtttagtcttaatatctacaaagattttctgtcaatatgacatgacctttactccttctgaaatatagctggatatttttgtttaggtagcaaatttacttttaccaatgttttttgtgagaaccaccagcatggttactgaaaatattccttggcaattaatcttacagataactacacatctatagtcacaaacaactggcatcagagaattcccgaaatgtgttagttttttctattttatcactcaccagaatctaatgtttggtttctgcagtgtgagctgaccagaccatttttatgggctggtgaatactcagtgtttatttgcaaatctggtttacatgagcttggtttattgtgacccacttggggcagtgcatttatgaatcacctacaactcctgtggccacagatgggaaaaaaagagatttttgccagaagtcttattgtttagaagtcaggaaagtctcccttttgtcccatcaagtgagaaagaaatgatcaaatttgttcatttggacttcattttctgatgaatacaaaggtctgtctgaagaagagagatgggaaggacaatacagtctccagttgtctgtaaaaatgcctttgtctgtggatgttagtggcaggggttagggaaatcagtgacacagggaaggaggagctgatttgactgaactggggaagtacatttgcatcgtggagtcattttaagtaagattagattgagtaaattgtgggcttaattcaagatgccatcatttctctttcaaaaaaaacataatgacattgggaacttccaaactacaattacaaatataagttatagcactctgaagataaaactggtaattaaaatccatcactttctacatcattataaaatatagtatggtgtcaaaattccctctgaaaggctaaattttatcttttgataatggcaaaatacctaagtgttccattattaaggactcaaaggctctacattgatgtaatatggtagtgataagaaaaccattgtcattctttctaagagatgtgaaatcgcttgtcttcatgaagacagacattttttaatgcagcaactttgaaccaaatctctgcctttgtaacatcttacaagtggatagaagtcatttgcactttttaaattattgaccactctgtctctaagataaatgccagatggcagctaacgcacaaaagccacgggaagcactctgttggcccctcctccgctatcctgaccgggatcagcaggttctggacaggcagggcgcgcagagagttgcctgcgggctccgtgcctttgagcctctttcctttaatgatgttttctttcagtgctggagctgcatctgctcccaaggtcagcactcagccccctttggtttccctgcttataagttttcttccttaactttgagggaataacaatttacctttccaggaagtaaaacgtctgtctttttatgaccttacataagatcccacagtaatacttcatttgatgtcaatgaataagtggaaatccagagtcatagaaaagataaaccagcagacagcgttcatttacccaggctgctgtgtttgcagaaccacagttgacttcctccgggaagggcattggagacatgatgtgctttccccaaatggcttttcactcattcgttcttggaacacatctgctatgcactggcccgaggcagcatccctgcccacaggtaggagccctggggcctctcaggaggcaaaagcaagtgtggtaaatacaagaggaagacaaccttgggaggagggaaaggagggccaatccctgcctccatggcaaagctgggggcagaggagagccctgaaggacacgggagccctggaccctgatccagctggctcaggcatcgagttccaaggaagacactgactcccctggcttcggtcgtgtgcccagcattgacccgatcatataacctgtgggatggacctctctgattcaatcttatgtgcatacctctgccattagataggaaagttagctccaattaactataaaaaatggatttcccatggggaaaatgttctcgttcctagaagaagggatatgggagaggtgttcaacaaaacaataaccctgtgtctcctaccccacaatccgttttcacaaagtgctgttgctgctccaagctcccggagcaacctcctaccacacaggtagatttcaccctggaggggtgtggccagtgtgtgcttctggaaggagttgtgctgaatcactctggcgaccactagctggcagctccctggccccaggaagtggcccagagcccaccatggtaccatcctacaacctaacattggagtttggggcagcaggggcgtgttgcaaacaggaccaagttccggccgctgcgtccttagaagtttggttcatttgaaaccccttagcctttaaacatccgtgttcctcatgggagatttctcattacagcctggagactccagggtaaggcaccctggccaactggataagagtaagcactgtaaacagggctctgctccatcttcctcccaccttccttgcaaaccctcaccaccactaccaaattaaagcagcagcagtttcagagggctgataaaaggaagcaaaagatcgtatctattggggctacccgtgagttagccacttttcttcattctccagggaagagaatgaacaaagtagatgacaggggctggagtatgcattcgggcctttgattccatagagaaatgcatctgtcctatccccgtgtttacatggctgatgaaatcatagcctgcctctcctgcaaatgccccttttctttgccatgtggcagtgagccctatcattgctgtgcctcagggacatcacgtcctggccatatttcagtggtaaagtatgatatggcatccctcactccctcatgttttgggtgaaagctcaaatgaatgaaactcttagaaggtgaccgttattgccttcctggaggtagacagaaagttaacctttagaacctcgcatcgttcaagccactggatgaattaatggcagagtggagtcagttttactggccaaacttcactgagatttatttcttgaggaactgctccctcagaggtttccaagtcattctactccgaatttttcatttctttccctgaatcagtatagatgcaacaaaaagcatacaaatatctgctgcctgcctccattgtcccagttttaaagggaaatctcactaagcatgctcaggtgcagggggtaggccgtgacccaggtcagttcagcacctgagacatgagcatgaggcagctgtcgtcctcacctgtcaggagattttttggaaaaagatttggtgaagaagaagttgactccatgagcagctggattacaggagaatatgttggtggttccgaagaggaaaggatggcagggacaggagtctatagtcaagtagggggtttccaagaggaaggcagcacaggatcatggctggatcatgggttttggctttaaacccatgagacaaacccaactttgccatttacattgtgatcttcggcaagttgctaaaacgctgagtctaagtgaaaatctctgaaatggggagaatgtagaccttacagggtggctataaggatcaaagatgataccgcgtgctgtatccagcaccatactttaattacaaatggcctgctgatgatctaaaatgtatcgttcatttaaagtgtgtgtgtttgttaagagcaaggagagtaatgacaggaaaatgatctttgttctagggttgagtggcataaagagaagtcagactcaagggtctttgcccagggttgcctgctgcctctttcaatgtggcactgggtgctgactcagggggagtctggaagcccaggccaggagggttcccagaaccagctgggatttgggggccgtggggaaccacactcattgaaaggagtaaggggatgggtgcagggaagttgaaatccttgtgctggatgataattctgatttatatgcaaaggatgtgcaaaaactattagggtttcagatgagattctcttctttccttctcatttcctgaggcatctggttagcccacagtctccactagttgcccttaatgtgtaaggccctggagaccatgaagtgtgagggagatggatgtaaagcccctactgacgtgatcatgaatcgttacaggtgtggtaactgatgcgagcaggggctggtacaaggaactctcttctccccacacacacccccagccctaaagtccagaagccacaccttccccacagtccaaggtggtcttcattatcacttgggtttcctaggggtctgccacatgccaggagctctacacactgatgcacctccacagcacctttgagtcaggtccttgtccccattttacagatgaggggacagaacctcgagagcttgtacaacaaggccttttggacattgaatgccagatcagcccgagttccaagcctttgttcttccaactctgaagcatggttactgagtagatcagtcagacaggagggggcaatctaaaaaggctgaagactgataggcattaggtatttttcttagaccccatacatgcccagctataaaacaaggcttccccctgaaagtagtcagcaaaaagaatcgctaaccactgacctgtcactctctcagccacaccttttggatgtcgcagagcaggtgggaaggcgctttggcgctcatcatcctgcatccacgcaggttcatcaaggctgcctgacaaaatcaggtttaaaaaaaggcaggtgcatctatcacatgcttaaatattattcttcggctgtgacttcatcccattttggttattctggtaaaagagcttttaagggttcactttcataagcaatagagtgggtggttcagttgtggaggttatgaatatacacccactgggctaatagagaaagtgctcactttctctattaaaaagtgttggaagagtgggtacttgaacctagaaacaagatttccagcgataacataacagaagaaaaaatgtcagcatcttgagaaagccggaagtgcagggaatgtgccatggaaagcaagaagactgagaccaggccaggtacggtggctcacgcctgtaatcccagcattttgggaggctgaggtgggtgaatcacctgaggtcaggagttcgagaccaccctggccaacatggtgaaaccccatctctactaaaaatacaaaatattagccagtcgtggtggtgggcacctgtaattccagctaaatgagaggctgaggcaggagaatagcttgaacccgggaggcagaggttgcagtgagccgagatcacaccattgcactcgagcccgggcaacaagagcgaaactctctctcaaaaaaaataaaaagactgagaccaaaggaaacgtcatctcagtaaaattgttccacggtgtgggagaggttttttttttaagacaatctaaattaaaatgtgattcttttaactgtttctcattaagttaattgacagcatattataagatgatgcttgactgtgtcatctgtgttggtaaaaattcacatattcgaattggccacaagcctttctgagggtttgtctttgggagaatggcggtgctcctgaaatgccaggtggccttctgctggggcgtgtaccatgcttctgcgttattggtaaacaaggcattgcatcttacacacacctggttttctgagctgtgctgctccaccagcatttggggcattacaatcataagcacaccctgtattagtctgttctcacactgctataaataaataaatacctgagactgggtaatttataaagaaaaaaggtttaattggttcttggttctgcaggctttacaggaagcagagtagcttctgcttctggggaggcctcagaaagcttccaatcatggcagaaggtgaaggagaagcaggcacatcacgcggccggagcaggagcaagagagagaaggaaaagggaggtgccacacacttttaaacgaccagatctcaactcactatcccaagaatagcaccaaggtgatggtgctaaaccattcaagagaaactgcccccatgatccaatcgcctcctaccaggtcctacctccaacattgggaattataattctacatgagacttggtggggacacagatccaaaccacgtcacactctgacccagaaggctcagtgtgtttcagctttggattcccaagtagagatccagtgttttcacttccagaatgcttttatacttgattacacactgtttccatgcctttgcttgacttcctatcataacgatagccctttatctggtattcacgtatcaagcttcccctttgctttgccagtacatttgcagcctcttcaatccctgttgaggttggtctctttctcgtcctctctctctcccccttcctctctttgtttttatccttctgtactccccagtccaacctcgtccaactctcctcccaggctcctgttgagctgtttgtgagctcacgtgtctgaaactgcccaaagtctctttagagctccctataaggaaaacaaatgtatcaactgacatatttgaattgtgtcatggtatatgtattttttaagtggtcacaattcccaagaaagaaattactttataataaaggtagcagaatctaggacatcagaatagcattgcgtgcaatggcacagtgatgtcaactccacccacccatttcctaggagctaagcagtcactaggagctgcttgtatttccgagtcctagccttatgaagtagggaaagaagcaacaaagccatttcctgccccattttcttagcccttccacaggcagctgcagcagcacaccccacatccactgaacctgttgttgcttgggctgcagggccaggtcttaatctgctctctacacctgagacccagtgcagggtccagcacctgtgaggatggagcacaggagggaacagcccagaagcctggcttcacccttagatgatcctgccttcgttacctatgtgaatctgagaaatatatttaacctctgatgtgctaattttcttgtccataaaatggaataatgagacctaccttgtaggattaaatggtaggattcagctcatgatgtcttctctaagaggtcttccttgaccagcctgcctttaaaagcaacagtcccctgaaccctcctactctgtttctaccttcatagcattccctaacactgggctttagaggaacataatcatttgggtcttttttctgtgtctccttgcaattttcaagcaagcaggaggtttgtccagtttggtccctcttatactcccaatgtctggaagatagtaggtgctgaataaatacatgtgtctgattgaagcctgcaacatgatggctggctggctggctggatggatggatgggtggctggctggctggctggatggatggacgggtggctggctggatggatggacaggtggctggctggctggatggatggatggatggatggatggatggatggatgggtggctggctggctggatggatggatggatggatggatggacgggtggctggctggacggatggatggacgggtggctgggtggctggctggatggacgagtggatggatggatgaatggatagatgggtatataaatggatgatggaaggaagtaggaagggaaggagggaggaaaaagagggaaagaaggatggttgggagggagatagagttaggcaagcaacaaatacatagggtgtgtgcaaaaacacaaacaattgttgaattgttactattctagatgccagtttttccaaactgctttgatcaatcagatcccagtactttgatcaaaagtgctgccaaacaggattaaattaagcacaaagtgcaggttccacactgaggctctccctccccatccttccctgctctgacagatagacgaaagagaaaaagaaggcagaatgcggacaaatcaggtccccaataggagctgagtgtgtcggtggtgtcatcctactgtgagcaaggcagatgtggaacagatggaaggaaagggcatgtgatgtgaggagctagggacctcatctttctccatgacagagaattgtgtccagtctgggctaatgcccctgaaaaaagagattgcagaggcttctctaacatggcttataaaagaaatgagaaaaggagaggtgcaaggctggctcattgcagagattggagcactgagcacactgttcacatcaaatgatggcaaggtggtgtggcacatgtgtgttgaatgagatgatcatgtctgctagtagctgatgagaagggatcaggtgcaggctaacgaagggggatgtttttagtaagaagaacatcttctgttccctgggacgaggtatcttaaataaatccgttgtcaccttggaaagcaaagcctccccagggtggagagcagagaagggcaggagtcagagtgaggctctggagtgtcggcatcctggccatcagaagcgatgtgagataaagtgccaaacaggacaccaatcagggagagaaaagggaccacgccgcagggcatggtttgttctaaagaatgtggcatgttttcttgacttgctcaatagtcttcaacagacatcactatgtccaggattcaggagtcctccagaactttggctgcaaatgctgattatatgtgctctctccgtggctggaagatgtgctaaaaatggccatttctgagctctctggctgccatgaccctctttgctgggaaccgtcatgttgtacatagggattaccagggtttatgactccatggcctctgagagaaatctctgccttgcaaataaaatagaaggtattaaaagaaggtagtactttctcttatagggagctttatgggactaaaaatatcatagaagatatcttcattgctcctttggagcctgccctggcttgcatttcctcaccggaattgtgtgggatgttgttaaagagagcaaacttccccttctctgcagccagccagccagccagccacctcctttctgccctggatcagatctcattccacagccaggcctcatttcctgagaggccacacatgccacaagcccagagagcagacctaaggaagagtaagcattggaacatgtgctctgccagaggccgagtcaagagaggatgcgagctgctgacaccctaggcttcccctggccagctcccaccatgagtcgggacagacactgggtgtgattgctttgagcacgtctccccgtaaccatttgagaggcctacagccatgaaaaaaaaaaaatcacctgcaggagatgaaaatgcagttctgcttctgtttcaggtgctaaacctgcccctgggatctgctttgagagagtcaattctgcaggtgatccttatggcaactgtggcaaagtctcgaagagttcctttgccaaatgcgagatgaggtatggaatccagacatcctggcaaagtctttgctctgaccttcccacattgcatagggttggttccaaatggtttctccttgggaattgtttgttcttacccttccagagatgctaaatgtggaaaaatccagtgtcaaggaggtgccagccggccagtcattggtaccaatgccgtttccatagaaacaaacatccccctgcagcaaggaggccggattctgtgccgggggacccacgtgtacttgggcgatgacatgccggacccagggcttgtgcttgcaggcacaaagtgtgcagatggaaaagtaagacccaaatgtttgcttggatcataaatgtaagtctggaacagggcccattgaaaaacagcaagaactgggttacaaggtttgttggttttcctaaatctacttcttctcagatgcacctagaagaaaaagtcaataaatcctagatcctggtctgactattaaaatgcagattggggaaaaatcaagcctgtcttcttaggccttgagtgttaataagtcatttctacactccaggtggcatgaggacttctagccaggaaattactttggaaagaaatacaatcgcatattctattggttttggatatgtggcttggtttttagcacagagttcttgggggcttgtcctcacctgaacagaatgggaaatcagatgtatttttagaaccctgtagagagaagaataggagagggaaaggagtggaagaaactcaaaaccagaggggagtcctttcagagaacagggagaaagatacatggagatattttgaggtttagaaataaagtcaaactttttttttttttggaagaaaaaaagaatttgagattttcatgctctgccatactgattttttttttttcaccaaactttctcatcagactaaatgacagcaagcgaatacaatgttttaagaaaaggatgaaacaacccccaaatgcttcttaggactccattttcaacatggtcttgaaatcactcactaacatgaggtcacacaggcaagaaaagacagaggcagagacagaatcctgaggacaggtgttgcctccactctcctgtctttggccccacacaccctgagccacaaatcctttttccttgagaaataggatcgtacatgaatcttcttatacattctgaatgtctccttacccacatttgctcatattcaggccttgacattaaaatgacatctgatatttttaggctcaaatcatattttgtcttttaacttttaggttcaggggtacatgtgcaggtttgttatacaggtaaacttgtgtcatgggggcttgtggtacagattattttgtcactcagatactaagcctagtacccattagttattcttcctgatcctctccctcattcaccctctactctctgataggcccagtgtgttttgttcccctgtatgtgcctatgtgttctcatcatttagctcctacttataagtgagaacatgtggtagttggttttctgttcctgaattaatttgcttatgaaaacagcctccagttccatccatgttcctgcaaaggacatgatctcattcttttttatggctgcatagtattccatggtgtatatgtaccacattttctttatccagtctatcattgatggacgtttagtttgagtccatgtctttgctattgtgagtagtgctgcaatgaacatatgagtgcatgtgtctttatgatagaatgatttatatttctttgggtattacccagtagtgggttggctgggtcaaatggtaatttctgttttaggcctttgaggaacgactgcactgttttccacaatggttgaactaatttacactccgccagcagtatataagtgttcctttttctccacaaccttgccagcatctgttgttttttgactttttaataacagccattctgactgacaccttttttttaaactgtagcctgaacagccagggccaggtgcatctggacattccaattccaagggctcaatttatcatcaaatttgttttccacgttcaagatgaaatgtgctttgatctcagaaccttggttctctgagggctcagggatccgcagtgattcccatgagggtcctgctgtgttcactgtaatccaggacaggttcttttatcagctggaatgtgaccatccccttggccaggattcgcacccaccgagtgggaatccctcagtgctgcttgggccagcgcttctcccaaaggctatgcctcttgcccttatatgagctgttggggtcggatggtgacctcctcaataggaaggttctacttgattaaaaattcttctgccatttgaacgttagactctttttcctttgactccacggatttgtaaaatcttataggagataaagggctgcatcccttgagtctggagtatattatgcacatttgaaatgaggctgagttctttcagccagcccagtatcacttaggaaatgcctaccactacaacagcttgataaattcaaggagccgtctgttttcctctgctgagcctcgttgctgatggtttatgtcattgatgatactacttgtcagtcagtatctggaaaaagttcccatatttcaacctctcccttaaaagactcttcaaccctggattcttggagtctccatctatgtctatccaggccctgggataaggagtaatctgtctcgccctcccctatatcttttttttttttttttttttttttttgagacggaatctctctctgtcgccagactggagtgcagtagcatgatctcggctcactgcaacctccaactccctggttcaagcgattctcctgcctcggcctcccaagaagctggaattacaggcacgtgccaccacacccagctaatttttgtattttcagtagagacagggtttcaccatgttttccaggagagtctcgatctcctgacctcgtgttctgcctgcctcggcctcccaaagtgctggtattacaggagtgagcaaccgtgcccaacctcgccctctcctgtatcttttaatggaagaaaaaaatactgcagtacatagatttctttacaagctccaaacaaaactcataagaaaatcagttataattttaggatcaactgaaagttatattaaaagccataaaatgcaaaataatttaatagtgttgacattgaacttagtctcaaaatgtgctgagtttggaggagtcaggcaataagatccatgcctgagtccagtataaaatgtattgttatgctccatccgtattaactgagacaaggttgggtcttctccaagctttcttttgcttgctttttgtttgaatacaggtatgtatgcatgctggaggggttggagaaatactaagagatttgctgtgttttcctcctcctacagatctgcctgaatcgtcaatgtcaaaatattagtgtctttggggttcacgagtgtgcaatgcagtgccacggcagaggggtgagtaggctgagctgcccttttacagccagcccataacaagttaagtaataatacattcatttgtaaaaggttttgcaatccatagcattttttaaatagagcagttattgtgtttgaaatattttcttctaaaggtattcatttcttttgaccttttcatgtgacttttatttaacaaagaaaatcagactgagctgtaattaccttttaaattaacattctatgattttaaaaaagacttttgttgttcaaagtaatttgaaaagcaaccttccttcatgaagagtttcaaaataacatttcaaactgtgctgttcctcttactaccaacattcagaaccagtgtctgaactgaaatatttccaaaaggaattaaaacaaggacaacagatcatattaaacacatgttcttgaaatcacacacaatgggtttcaactaaagaaggctgttattttagttcagagaacctttagggtagaagaggactctaattgctgaaaacataatttatttttcttgatgggcttatttccaatggaatcatattagtcttgattaaccacaccagaggttcatttgttttcctgaaacctttcctacagaaatcctgctccaaattctttattttaaaacttgtagacacttgccaatgattcttacacagaattaccgggtgcatggggggagggggttgtaaattaccatcatgctggaaccataaaggatcacagtgtcacctcagatgggggtgttgacggtaaggttagctaactcccaatatacaatggaatcttcttatgtcttcattggatcatagattattttctgatggctgttaagagatgatcaagtccagtcctattattttactgaagaagccaggccctgagctgtggggatggtgtgcccaaggtaatatggccggcaagctgcaagctggttgaggaccctggaccactccctttccaataccccttggccttatccacacatgggagcggagaggcccgcatttgctgggtaggtggagcctacccagccttgctgaagggtagcttggccacagtcccaccctaacaagggcaggctcccggcagcaccttcctgtgggttttaaaacaaggcgcatgaccacaagttgcagagagaagccatgaggggcaggcatgaatctggggctagtacgtccacagcagcatctttgaggggacaggcaagacacttacatttgacataggctctgccacttgctgacaagttctactcaatttctgctttatagcagtctactttctaacttattaaagcctatcttgacagtcggccttcttatctgaagcaatgagggtaggtggttgattcatcaaaacaagtcggttgaagcaggaaagcattacatgggagacatatactctacgcattttattttgccttaaaatatgaaagtgtatatctggcagccatattttgatggcgggctgaggcctttaggattgatttactgaatgtcattgtgcatcgacttcctgatataaaccacccaaaaatgcatcatcaacaacttctagttcgtttctttttgtggaagggaaccttagacactcaacagcatccaagaacagcctcctccttgtcctctgcagctcttcccaatcattgtgcagtagtcccactcattcctaatttttcagaaattcttttagtgatttctcttttttaatccagtgttcccaaaggattcaacctaattttttttaacttttttttttttttatctttataaagacagggtttcaccacgttggctaggctggtcttgaactcctggcctcaagtgatctgcccaccttggcctcccacttgctgggattacaggcatgagccaccgtgcctggacttgacaacctaattttcatagaaaaaaatatattaaatatatatcatcttcatggtcatcttccattggatcatgtactttcagttagttacatctggcataatagcgagtccaaccagcatggacaggcttgggagtggccgccatcagtagcccttggtaaccaggtgggcaggggctgctggcccctgcatggaatgctctggtctatgagctgggcccaacaagggtgaagcacagcctcctcgggctttcttggtctccctttcccgccgtgccagaaccattctcttatttcacaatgaaaagaatccactgttggattcgcaccctggtgcgtgactgggagccagggaacagccactgggaacctctgcaagaaggaggcaggcgttgcaggaaggacacacggggacaggcttcaggaagtattagtggaaatcccatgcaccctgctaggattgcaggaaacaggattcctttgctcaggaaacagggggcctgcctcggaccccagcctggcgtgggacccggcagtcaccagcctctctgagccttctgtctgaaggagacagggatgcgccaagcatctgtcaggtcccgcggtgccccagggctctgggtctgtagccccaaagcacggtccctcctcactgctgagggggcttctcctcatggtcagacagttttccagattgaaaaaggaagatggggagatggagaaggaagtgaggtgggtgggggaggcaagctgatgaacccaaataatcttcatcactctctttacagccactaataggcagatgatgcatcttcacagcctcaggtttggtcgcccctgtgtggtgtgtagtgccggctttgggcttattcgcaccatggcgtgtgctgagtctggctgtgtcagtgttgggggggggctctgaccatggccccccttgcttctgctgtggtgatgcacagagcatatgccctaaccccacgtccctcccctctgccctgaaaggtgtgcaacaacaggaagaactgccactgcgaggcccactgggcacctcccttctgtgacaagtttggctttggaggaagcacagacagcggccccatccggcaagcaggtcagtgaagcccctgcatcccggtgggaggaggctgagcacctgggggcgggtgggctcgccagctgtcagcatgggtgcaggtagagccaacaagaaacccagtggggaccccacatgggtctacacagcctagggtctcccgcagtttccagatgcccctctcatccctgcccgatcttctctgaggctccttgctctctgctttgactgagtggctgagtttgccagttccttagcctgcgacacttttcttaactaaggtcatttctatagtgaactgctgaatgggtatgaatgtcatcactgtatcaaagtactttgtaaaggccgacatctgtgtggtagggtgacaaggtgtgaagtttaatgccttttaaaaatcttactggaaagacacccacctcttagtaaaggtgacagtcacggcagcagtgggagtcattgcaacagcttttgcatatggaatgatgtgtgcaggtgctgtgtggtgcattttatgcccacgatgtcatcccctccttatacaactctgaagaaggtggtatgattcttttctcacatacctaggacctgaggctcagggaagttaagtaatttgcctaatgtgatctcgctaagatttacacacacacaggtctgcctgtcccccaagaagctcttagtagcagctgtgcttgaactcgtggccatttctcctcggatgacctttagaaatggtttactggtgcggtgctgttttctctgagttcttattgggcaattcaggggcaagtctaaatgatgcctcttttcgagggaaagaagcaaggcaggaagctgcagagtccaacagggagcgcggccagggccaggagcccgtgggatcgcaggagcatgcgtctactgcctcactgacactcatctgagccctcccatgacatggagaccgtgaccagtgctgctgcagaggaggtcacgcgtccccaaggcctcctgtgactggcagcattgactctgtggctttgccatcgtttccatgacaacagacacaacacagttctcggggctcaggaggggaagtccagcctaccaggcacgtctgcagaaacagtgcaaggaagggcagcgacttcctggttgagcttctgctaaaacatggacatgcttcagtgctgctcctgagagagtagcaggttaccactctggcaggccccagccctgcagcaaggaggaagaggactcaaaagtctggcctttcactgagcctccacagcagtgggggagaagcaagggttgggcccagtgtcccctttccccagtgacacctcagccttggcagccctgatgactggtctctggctgcaacttaatgctctgatatggcttttagcatttattatatgaaaatagcagggttttagtttttaatttatcagagaccctgccacccattccatctccatccaagcaaactgaatggcattgaaacaaactggagaagaaggtaggagaaagggcggtgaactctggctctttgctgtggacatgcgtgaccagcagtactcaggtttgagggtttgcagaaagccagggaacccacagagtcaccaacccttcatttaacaagtaagaatgttaaaaagtgaaaacaatgtaagagcctaactccatcccccgtggccattactgcataaaatagagtgcatttgaaataccgctgcctccaccctgttcatacatatataaaatcaaggcaggccatgagcaagcatggctcactgctccctggcctggccatggctcaggggctcattaaacaagtactcgtgtgtctgccacacaccagccactctcctgggtcctggagagacactaagcaagaatgacatggcgtaagtgaggggtacgactgcagggagagagggcatcatgggaggggagcaacccccacagagcggcagggggttgtcaggaaggctcctggggaccctgcatctgttgaggtctgaagggggcgagggaaacatgcattctgaagccgagatagctggctgtgcgaagatctagaggagtgtggactggcctgggctcagattctagagtgcggactgggccaacaggaggggacacaggacacggtgctcgtgctggtcctggggaagagggaaatggagtcagtcactgcccgggcctctggcttgagcaaccctggggagttcagcaggttcagtgtgggggccctgtaaatgttcagtttcatagattgatgtattgaagatttatggattcactttatggaactagaaattatagttcaagatttttgctgttcactttttaaattaactttaattaactttgttatgagacaccagaactctagctagagccccctgtgatcactactaagggtctgaaaagagtgacattttgcccaggaaaccagaagcaatgcttttccagtaacaccaacaagtaagtcaagactgtcatctgttggctgtcttgcttaggctaagacacatccctgataggccttgttagtgggggatggggtccagaaaccaagaaggtgtgaaagacattctttccctggagtaggagctgctgctgcagtgatccacagccagctgagggtccaggtgggaggcagggccgaggagagcccaggtaactgcatcacggcgatcaccagcagccggaaaggactgttgcacacttacctgatgtgaagtacaccctgatccttgctgatgggaagacaaatgaatcaagatccctgtcctctaaaaattcactgtccagttgaaatcacaggtagacctcctctaagtctgagcatttagagtccttcccagacagccgctgaccatagctactgtaagaaaccaacctgatggtttgatttttttccttcctttccctacccttgaggaggctcttaactgtattaaacaaaatggcagcaggtcatagaaaagaagatgttttcatagagaaaatagcttcctcccaggaaaagggtttcccccacaaaggctgtgtttttaagtccccaacataacaaagcaaaacccatgggtgtttcatttaaatgagttttctttctcttttttcactatctactttgagatgtccagcaagaaagcaattcattttttaaaaacacgaaaagagataaagcagaacccaactacagaatgagtaaagaaaagcactttggaatggcaaatctgtgctggggactggaaacatttgagcctggggatggctgtgattccagtgaggcttcagtgatggctccctgctaccttctgtggctaccatggtccactgtgccgttgtcacgcctcagggaacctgcgtggtccagaccatcaccccacctacccgactatatattcctgtttagcaagttctagagttgtcagaaatgaatgatggtaacatagattgaacctcaaacatggcatctgaagtaagacagtttattagtacatcactcacgggtgtactctcttcatttctgttgcttcagagttcactttgccataaacgtcacaacttgatacctcccatatttcattgtaactgcctccttctgtgagccccatgtgttttgtttcagataaccaaggtttaaccataggaattctggtgaccatcctgtgtcttcttgctgccggatttgtggtttatctcaaaaggaagaccttgatacgactgctgtttacaaataagaagaccaccattgaaaaactaaggtaccctgggtttagcttgtcatctgttctagaaatggtggctcagaggctgggtgcggtggctcaagcctgtaatcccagcactttgggaggctgaggcgggcggatcacgaggtcaggagatcgagaccacggtgaaaccccgtctctactaaaaatacaaaatatcagccgggcgcggtggtgggtgcctgtagtcccatctactcgggaggctgaggcatgagaatggcgtgaacccgggaggcggagcttgcagtgagtcgcgatcactccactgcactccagcctgggcgagagagcaagactccatctcaaaaaaaaaaaaaaaaaaaaaaaaagaaatggtgtctcagaaaatgtacagcaaactgcttctcacttcatttttttagcaaaggtcagattttctggatcataaacctgggacttggttcttttttggggggtttcttgttttaaatttctgccagatcagctgcctcctttacttcccttcaaacaacaatgtgctgcttattacataagctagcagggtgtcaggaaattccactgatgtgttttctcccacccttatattagtaatttttatacaacatggagacattgaaatattttcatcagatggggtagcttttgatccaaatatattcaaagacattatcgctgaaatgccagcttcatacaaatcatcttccaggtgtcactacactgcatttctatggagcgtgagaactaatttgacaaaatagaggttttgagggaaaaaccagtatttattttttaatctcctaagagtgttattaggtaatttttcctttgcatgtttagcacactgagttaagtaaactgtcttttgagtgccactatgagcaaagtgtaaaaagtcaagtcagtgagaaggggaaacacgcttggtcagcaggtatgggattctgttgcaggtgtgtgcgcccttcccggccaccccgtggcttccaaccctgtcaggctcacctcggccaccttggaaaaggcctgatgaggaagccgccagattcctacccaccgaaggtgagtcttgagtagatgtgagtgctcagggcacacatgcagacatgaggttttcaatacgagactgaataagaatgggatcctagaggcgctgcctgtgaaatgctgagtcagcctcactaggtcagcaggctctgagggagggtctctgtgatctggggccagagggaggccccacggtgcccccatggaagcccacctagatcctgttggcgcactcagtgccccctgcatgatatggtgcagcatagtgtgagctgtgatcccttcagtcacccagaccagccacatttctggggccccactgggtctgcagcccgagctggctcctgacaccagcccccaatgccagccccaccatggtttccaaatgccaccacctggctttaggtgagctgctttagcccactgttactcttaaaatatttttcaaaagttacatggagctctcagaattgaccattttgctccagccctgagctgaggaagccctgtccaccctgtggtttcagagaactggatccttaacccagagtacctcacggctccctgctgtctcttaaccctcttgctaccctggtgaattacagctagagttcattctaatagttcttccccaccgagtttttctgatgtacccacaagaattcttgaatattgaacttagtcaacaagagtccaaattataacagtgaacaagattggtgtcaaaaaaaataagtgattgaaaaatcattgctgcatatgcagtaggcaataaactgttttaactcccttgatccaaaaaacgcaaagggtggggctccaaggaggaggctgccattcccaataagctttacccctgctcgtccccaaaggtggaaccataagcgagaacggctttgtgtggtagccaaaagcacatcttcattttcgtaaaaaagaaaaatgcagctctattaaaaaaaaaaaaaaaaaagcacagccttatttttgagagccccaaactagaaacaatccaaatatccatcaaccagtaaaaggataaacaatggtatatttgcacaatggaatgaaccattgatgtatacaacattgaggatgaatctctagataattattctgagtaaaagaagaaaagccagagtatatactctgtgatcccacttatatacaattctgacaaatgcaaactgatagtgacagaaagcagactgatgattggagggagagggaagggagaagcatgacaagaaaactctttggggtgatggatgcattcatttgtccacttgtttgttgtgagggtttcatgggtgtaaacacgtcaaaaaatgaccaagttgtatactttatgtcaactatacctcaattaagctgtttttagaaagagaggaaggaaggggtagaagcctgaggtataagggtccctgcagcacctgttctaagaacaagggttaccatatgggagaacgtctccaactccaagccccaacctcagccctggcttcctgaagccgcaactctcctttccccagtggttttctcagttctcattgagccttgaacacattaagctgtatcttattttcacatctcttttgtaacttccctaagatctcggtccgtgtctttctttatacttggtactttttcaagtgctttgcacctatttgttaaacagttttttaaaatctaaacaaaaatcgatccttctattccagatttggcggggtggaggcaggtgatgcttctgtttgaattttgaagtttaaataaatacaaaaataattcccctcttgtgtacatccttgatttctttcctttaccccaccttggccttcagctataacagatgagttagcactgctttttccttaaggagttactgatatttttgaaacccgctatagcatggctttttactttgactgtacaggacaatcccaggagattgctgcagtgtcagaatgttgacatcagcagacccctcaacggcctgaatgtccctcagccccagtcaactcagcgagtgcttcctcccctccaccgggctccacgtgcacctagcgtccctgccagacccctgccagccaagcctgcacttaggcaggcccaggtatgctttcagtactaatatgataggatgtagttcaaatccagattctgctacttgttaatgtgtgagcttagataagttgcttaacttctcggtgcctctgtaaaatggagataattcagctactcagatggttaaatgagataatccacataaagcagttagtttggtgcctggagtataataataagagtgtcatatattttaatttactagttataattttttaagtatttgaatagttagaccactcatgcaactaaacgatgacactattgagaatagcagagggactagtaataattaggcctgtacagtaaaatagagacaggcaatctaagacagatggtcaccctaagaagcatcagttatactctctcatcattttatttcaaaattatttacaagaactataccacctatatacagagtgtctccgtaccaaacttagcactgtattgtttatgtatatcatctcatttttatgctgtttttggaagtaaccatttctgtttgctgcaataacgaatgatatttcacaatagaaaacttgaagggaggagaaaacaagcaaataagtaggagataatcactggtaatttttcactgctattaatattttttgtttataattgtgtattttaacataatttatttgtacacagttttatatgctgctttgttttgccttaaaaattagtcccatttacaatggcattaaaaatcctatttaataataacactatacttgaatataaatgtttaagtacttgcaaattattgggcatgtattgatgtatcattttttgctgttagaaagttctagagaggtaaatcttgggacctctttattcccctaggagagattcttaaaagtaaaatattgggttgaaagattgtatgaccattttaagcctcataatataaaaatattttttcagaactcatatacatttgcgttcccacattgttattgtctttctcaccatgactttgctaacactaaattttaacttttaccagtttgataaatacaacaaaatatctcaatttgttgctgtctagtagttctgtcagttaccaagaggagatgttggacttttccactataattgtgtctcctttgagttcatcagtttttgcttcatgtattttgaagctctgttgtttgcgatacacacaattaggattgttgtgtcatcttagtaaagtgacccttttatcattatgtcatgtctctgtttagctctggtaatctttgttctaaaatctactttatctgatattattatatccactccagttttattttgattagtattagtgttgtctttttgcaatcatgaatgatatttcacaataggaaacatcattcatgattgcagcaaacagaaatggttacttctaaaaacaggataaaaagcaaagtatgaatttttccatccttttaacatacctatggaattacatttgaaaagcgtttcttgtagacagcatatagattttttcatccatttagccagtcactatattttaataggtgtgtttagaacattcatatttaatgcaattgttgatatgtttggatttaagtctaccatgttaatattattctgtttgttctctctggtttttgtttcattgtgctttttctgtgttcctgtagattagtattccatattgatttatctgcatttatgtttttgagtatatatctttgtattttttttgtatgattacactagggcagtttctcaacctcagcattttgacatattgtactgaatactctgttatgtggggttttcctatgcattgtagaatgtttagcagcatccatggcctctatcaactagatggaagtaacatgtgtaattatgtttccaaacattgccaaaatgtcctctgaaaggcataacctcccttgattgaaaaccactgctctaaagattacagtatgtatgtacttactttatcacagtctactagtcaatatttcttcactttaagtagaatacagaaactatcaccttttaggtcgcttttcctcttccttttataatacagatgtcttaaatactacctttatgtgtactgagagtcactgcagatgttgtaattttgctttcagccaaacataatctttaaaacttaactttgcttattattttctgtctgaaaaactttctttagccattttttaaagcaaatctgtaggtgacaaattctcttcattttcctttatctgagaatgtatttattcctagaggatagttttgctggatatagaattctgcgttgactgttttctccattcagtactttaaaaatgttgttccccttccttctggactccatggtgatgagaaatccactaaaagttctacccatagtctctgttccagggaagggatgtggcatgttattgcaagaagtgatagaaagtagagatctgccagtctctaggctatgatgcctggtgaggagcaggagggaggcatggcttttttcaagtgttgagctggagtaaggtcaggtatggtcaaaacacttctgtgtttctggactgctctttctctagtcttttggctcgagatagcaggcttttccagttgtgggcctatccagagcccaggccaagatatataaaagaacacacacacacaaacacaccactgggtagttccttgagttctgagatccctagccagcatactttatgtccagacatttttgttgcacttagcaggagaaatagggtgaaatgtacttattccaccttgtccagacctcatttctccttgtatttttttgattactggtacacttgaactactttttatgtatccattagccaatggtatgctggcaaactggcccttttaaaaaaaaattctgatttacagctgatttctctggtataaaacttcccattgtggccagtttcaagctactagtgtgacattactgaatgaggagtagggaactggcagttatgagccagtaccagccagctcaagcataccactgctgttcactgtatttgttctgtgacttgtcttttcctatcctttgcctatttatttctgtttgagaggtagaggttttcttcttggtttataagtttcttttaaaaatattttaatgtaattttagttatgattttttggcataagaataattctggttttgaatattgaatttttcttttgtgaattttcccattcctttcatgcttgcaaagtccactcccatttcattattagtgaaagtccatatataatttcttctgtttattgacagttcttttacatttgtttttctaatttgttttagatttgcagtcatggaaggtggtgagcatgccctaaacttttctggtccgtggacttgagaatctgacaaaagctatgaactcataaaatgcaccaatattagcattttgtgtgcacatttcaggtagccaaagagcagagaagctcctttcccatgtacccctcatcctgaacttttttatttattttaagcaactcacctgtgtaccatgtcaaactggggctaacagaccatgttatcagaggaaggtattcctactgctggtgtttttttctccaccagcagggactcttgcaagatttcctttaaagcaggcccgaaaaagtccttcattctgttttatgaaactaaggaaatgttaccctttaaacatcagtcactgaaaaatccacatttctcactccaggctggtgtctgtctggaacttttctaagacatatgatatagattaagtgggtgatttctctcccatcacacatagggaacggaaattaattccatgcaggtgtggagaatatttggaggtgactcttgtttggcagcacaaattgaatccactgacattttgtactttggggttcctcatgccctgcccaggacaacgtgacacacagctaatcctgcttcatttgtcccaatgtactaagcattccagaagaaaacactaccacaaacaccatcttggtccacctcacatttaaactgtaagctaggtctttatagaaaccatttcattttctataaatgttctgtttgacttataaatgaaggagagctgaatgaatgtaccctcttgtccacaaacatacctttgcaatgtaccacttccttcatggtaaaaggacccttggaattcaagcttctcatcctaactccccagtcttgatcaaggaaacaaacttttttcatcccatcagctatattagaggaaaaataattcagtgtattcatctagctgttcactgcatcttaaagaaggctctatgcattttctgcagaggtggagatcttcagttcagtgatgctgtcaaaacacaacatttctcctaatcaacaacttttatctgtctgtattatatgcaacatataatattttataacacaagactcaccagtctggcacagtctcatctaagaaaaggctactttgtttaagttgccatgggaagacggtggcagctattacaaggaagtccaaattcctcttcctcctcaaacctttataaaaggtgatgaatgatgagctggggctgttactggtaaacagcagctactccttcaaatgcctggtcaggatgcagatgtgagcaaagccaattaatttaagccacgattgtagatcagtcaggtgctggccagttcagaggttaagtccaaactttcaaactgttcaacaaaatgaatttggctccgaatggataagggcatgtgcccttctggacctgtgtgggtgtctgatattgaaacctgcacttgcagagcctagaaatctggggattaggtccttgctcatcagaaatgccaatttgtaatgagaaaaagaagacccatttgttagtatgttctcctgaagaagatgaaatacaagaaaactgagttttatgagagcttctgttgctacacacaaagcacaggctaataactggtaaaggtgctggtgagtgtccttctgtgccctttccctgcattccagatctcaccctcccctaagacctctccacagtcctccctccaggacctctgatcacctgctgccgtagcctggagttaccagtatgccagctctgccctacttctgaaggcatagactgatcccaggcacagctaagtccagcccctcgaacataatagatgtgtaggaaatatgctgaattgatgtggacttaaaatagtaaaaaatcagttgtcacagtgtcattctccatggcgccatcacactcagttacggattaatgacaatgagtccattccccctgtaaatctaaaacacagctaccaaggtcttggactctccctgccacctacccaatacttccagaaactttagctgaactttctttggcatcatatactaattattcatcagacacaaacatcaaatgtctttaagggtatcagttatccacggaagcatgatctctccctgaagggaacttctcagaacatgttttcaagggaagttgttcacgtgattacagggttcaaaggggtatttgtttcccacttatttgttactataaacatgaaaattacataaaaagcagatgcctgatattttagcctttacatttgctaataggtaatataggcctataattaaaaatctcaacagtataaagggtcattcggaaaacagtctccttcacacctgtcaccagtctcccttcccagaagcaatcgtcactgttactaggcttttataaaacgcaatttgggatacaatgaaaagtctcagctctaccccccacccacctctctgctaggagagattatggaaattttcaaacactcaaaattggagagaagagtacagtgaaaccctatctacccatcactcaacttcagcaaccgtcaacttgctgtcactcatcttacatccttgttttgaattcaaatggcaacacattatgtactttcttctactttggttattccttattagttttatacatctgcttcattcttttcactggctacatcattatttgtgaagctataccatgacttctttaacctgtcccttccagattcccagatgggttgttttcaatcatttgctacgtcacacaggcataatcttgcccaagatggataaattcctgaaagcacaattgctgtgcaaaagtcatatgcatttagaaatttgatagactgagtgaagctgcctttaaaggagctgtttcagctattctattatccagctcctcaccaacacagtgtgttcggaggtttttcatctctttgccaatcgataggttaaaaacagtggtctccatgtttttcttcataggaaatacttcatagtgagatgaaataccttttcacaggtttaagattttctttttcatgaactgccttttcatctttgccatttttaaaatttaagatcggggtacatgtgcaggatgtgcaggtttgttacatcggtaaacatgtgccacagtggtttgcagcacagatctcatcacccaggtattaagctgggcatccattagctattcgtcctgatgctttcctcctccccctgccccattgtgtccatgtgttctcatcattcagctcccacttaataagtgaaaacatggggtatttggttttctgttcctgcattagtttgctgaggataatggcctccagctccatccatgtctctgcaaaagacatgatctcattcctttttatggctgcatagtattccatggtgtatatttaccacattttcttacccagtatatcactgatgggcacttaggttgattccatgtctttgctattgtgaatagtgctgcagtgaacatatgcatgcgtgtataatagaatgatttctattcctttgggtatatacccaataatgggattcctgggtcaaatggcatctctgctgctaggtctttgaggaatcatcacactgtcttccacaatggttgaactaatttacactcccaccaacagtgtaaaagcattccttttgctctgcaacctttctagcatctgttaactttttaataattgccattctgactggcatgagatggtagctcattgtggttttgatttgcatttctctaatgatcagtgatgttgagctttttttcatgtttgttggctccatgaatgtcttcttttgagaagtgtctgttcatgtcttttgcccactttttactgttttcttgtaattttaaattccttatagatgctagctattagacctttgtcagatggatagattgaaaaactttctcccattctgtaggttgttcattctgtgtttcttttgctgcagacactctttaattagatcccgtttgtcaatttttgctcttgatgttgtcatgaaatcttttcgcatgcctatgtcctcgatggtgttgcctagattttctcctaaggtttttatagttttgggttttatatgtaagtctttaatcgatcctgagtttatttttgtatatggtgtaaggaaggggtccagcttcaattttctgcatatggctatccagttcttccagactatttattaaatagggaatcctttccccattgctttttctcaggtttgttgaagatcagatggttgtaggcgtgcagtcttattcctgggttctctattttgttccattggtctatgtgtctgtatcagtgtcttcacccgggnnnnnnnnnnnnnnnnnnnnattggtctatgtgtctgtatcagtaccatgccattttggttactatagctttgtagtatagtttgaagtcaggtagcgtgatgcctccagctttgttctttttgcttaggattgtcttggctatttgggctcttttggggttccatatgaatttttagttttttctaatttggtgaagaatgtcaatagtagtttgatggggatagcattgattctatttgggcagtatggccattttcatattgcttctttctatccataagcatggaatgcttttccatttgtttatgtcctctgatttctttgagcagtggtgtagttctccttgaagaggtccttcatgtcccttgtagctgcattcctaggtattttattatttttgtggcaattctgaatgggagttcatgatttggctgttggcttgcctgttggtgtataggaatgctagcaatttttgcacattgattttatatactgagactttgttgaagttgctcaagaagcttttgggctaagacaatggggttttcaagatataggatcacgtcatctgcaaacaaagttagtttgacttcctctcttcctatttgaatacacttcctttctcttgcctgattgcccttcccagaacttccaatactatgttgactaggagtggtgagagagggcatcttgtgctggttttcaaggggaaagcttccagcttttactcattcaggatattagctgtgggtttgtcatagatggctattattttgaggtatgttcctttaatacctagtttattgggagttttttatattatggggtgaattttattgaagactttttctgcatctattgagataatcatatggtttttgtctctagttctgtttatgtgatgaatcacatttattgatttgcatatcccgaaccaaccttgcatcttgggacgaagcctacttgattgtggtggataagctttttgatgtgctgccagattctgtttgcctgtattttgttgaggatttttgcatcaatgttcatcaaggatattggcctgaggttttttttttatctctcccaggtgttggtaccaggatgctgttggcctcacagaatgagttagagaggagtctcttctttccaatttttttggaatagtttcagtagaaatggtaccagctctattttctacctcttgtagagttcagctgtgaatctgcctggtcctgggttttgtttggttggtaggctatttactactgcctcaatttcaggactcattattggcctattcagggattcaatttcttcctggttcagtctcagagactgtatgtgctctagattttctagtttatgtgcatagaggtgtttatagtattctctgatagttgtatttctgtgggatcaatggtgatatcccccttatcatttctgattgtgtctatttgattctttatagtctagctagtgatctattttagtaattttttcaaaaaaactagctcctggattcactgatttgttgaagagtttttcatgtctatctccttcagttccactctgatcttggttatttcttgtcttttgctagctttggggtttgctcttgtttctctagttcttttagctgtgatgttaggttgttaactttgttaactttatctttctagctttttgatgtgggcatttagtgttatacctttccctcttctgctttagctgcttctcagagattctggtatgttggctctttgttctcattagtttcaaagaactttttgatttctgccttaatttcattatttacccaagagtcattcaggagcaggttgttcaggttccatggagttgtgtggttttgagtgaatttcttaatcttaagctttaatttgattacgctgtggtttgacagactgttatgatttcagttcttttgcattagctgaggagtgttttacttctgattacgtgatcaattttagagtaagtgctgtgtagtaataagaatgtagattgttggttttgggtggacagttctgtagttgtataacagatccacttgctccagagctgagttcaagtcctgaatgtctttgttgattttctaatattgtcaggtgggtgttaaagtctgcaggtctctaagaatttgctctctgaatctgggtggtataagatgcacacatatttaggatagttagctcttcttattgaactctttaccattatgcaatgcccttttctttttttgatctttgttggtttaaagtctgttttgtcagaaactaggattgcaacccctacttttttctgttttccatttgcctggtaaattttcctccatccctttgttttgagcctgtgtgtgtctttgcacatgagtttcttgaagacagcacaccaatgggtctttcttcattatctagatgatattgggccagatatgaaattctgggttggaaaatctttaaagaatgttgaatattggtccccaagctcttctagcttattgggtttccactgggaggtctgctgttagtctgataggctttcctttgtaggggacctggtttttctctctggctgcccttagcattttttctttcattttgaccttggaaaatctgataattatgtgtcttggggttgatcttctcatggagtatcttaccttctctggatttcctgaatttgaatgttggcctgtcttgccaggtaggggaagttatcctggattatatcctgaagtatgttttccatctttgtgggcttatctacctttgatcttcgaggttgctgacacctttggatgagatttttgtgggtcgttttctgtttaacagtctggccactcttccgtaaggctgctgcaatttgctgggggggctctgttctgcccgcctcttttgggtaccccaatcacttgtagatttggtctctctacataatccggtatttctcaagacgacctgttcattccttttcattcttttttctctattcttgtctgcccatcttatttcagaaggatagtcttcaagctccgagattttttcctctgcttcatctattctgctgttaatacttgtgattgtgaagttcgtatagtgtgttttttagctctaacaggccagttatgttcctctctaaactattttggctgtcagctcctgtattgttttatcatgattcctagcttctttgaattgggttaccacatgctccttcagctcagcaaagttctttattacccaccttctcaagcctacttctgtcatgtcagccatctcagccccagcccagttctttgcacttgctggagaggtgttgccatgatttggagaaaaagtggcactctggctttttgagttttcagtgtttttgtgttgattctttctcatctttgtgggcttatctacctttgatctttaaggttgctgacctttggatggggttattgttgttttctgtttaacagtctggccactcttctgtaaggctgctgcaatttgctgggggtctgctccagaccccagtagcctcagtttttcttgtaccacttcccatggtgagggttcccttggctccgtgtcactcccaggtgggccattgcctcaccctgcttttttttttttgttctccatgtgtctatttgtttcctgaatcaatcccatttagtgtataatcaaattttatttttttctagatgaccacctagtaatccttaataccatttattttatttgtccttgattggcctatgttttattagatttgtctggtttctcattctcccctaccttcaaccagctcaaagtcttatatgatcttcctcttgctaccattagatcttggaaacatcactttaatgtcccctctacaaatgtgaaataatagtacttgcttttgggactttgtgacagttacatgaaaatattattaagaactttcctctaaacattgctttacaccttgctcactggttccaatttgtagtgtatattttttaaatagtctatatattctcttctgttttcctccttagcccaaagattgaagttattttttaaaatatttaaaatatagaaaagtaaaaactaaaatttactcacatttattctacatagaaataactagttttacatctttctagatgtacatgcctatttaagtttcagatatatatcctttttcaaaagaagtgaaacattaaagtcactacattagcctccctccagatacaagcactgtcataagtttgcttactgttttcaatatttttgtataaatatgtatccatgaatatagtgtttcgtgttttaaactttacgtaagtggtatcaaactgtacttaccttcatgcaatttgcactcatctatgttgtactttttttgcttctagaagttctctttggttctaattcaactatgctagcttgtcttgtacttctttaaacatagtaagaaaactttttccaataatacccaaatctgaagtctttggatatgttactgctgaagtttctatcacttctcactcctggttccttgtttccctgtatgctttttttttttttttccatgagttcacttttttaaattatagttcttcaaggcctaggatgcaggtgtgttcttccataaagggctattttgcctctgccaggtgcctggaggcagtaccagtttgagaccactttaaaatggcttggagcttattgaaatacccaggtgatgtgatttcagcttcaagtcctcaaggacaatttgtggtgacaggtttatttttctccctcggtctgtccagcaccagaagaatgctccttgtagtatcctggggatagattatagtatgtatttacttctagaagattcttaacctgaggtcttgtctgtagagcccaacttgaatggagaggagtcaggaagagaattctctctcattaaacttggacatttggtttctgcccatatgtcttgaccttggttggatttctctattcctcactgtgaaagagtatcaaaacccacatttaggtttccctaacttggcagatgcctccatcttcagttactactccctctccaagctgctgctttcacttagacttaaaacatttgctgtcttgtaactcttggtggtcatcagagaaggggtagggcacaacaacagagcctgccatgttactggaaatggaagacccgcctgtcaactttggcgagttccatgatacctacattagggtttacgacatttatattctgatctatagccataattcccacaattgtttttagctagaggtagaccgaatttgcacagtgaaacatattgatgccgccccagccctgcatgagctcgtcagggatctctggggcatctctggcattttcctgtgatgaattccagtcttcctgcagagatttctctggataagcagggcatgtttactctcgtttaccatgtgaagttgataacagctgagacttcatgatgctggtcaaggcaaagtggttatatctggatttaaaattgttttgaaacctctaaaaaatttgaaatatgtggctattgccagaacatgagcagaatatagaagaatggaacagccctatttaatagcatattaatagcatacctggatttttcttcaatatctggaagaagttaagagggcataaaaatgaggtttgaattcatttccttgtttaaaatgaaaatagatttaaagaaatgtttatcgtgtgtgagcaatctgcttagagtcatttctcagctcccttcagatgatgcttggtgatcacactggacttctctgggagaggttcaggtttaggttttgcaaaggcagaatgaaaagcaacacctagaagacagcatggcaatttcatcccttcctccagggtcaaaatgtgcagctggtgcttcttgcatcatgggttccacacctccatgcctaatgtctaaggagtgaaggcacatcttcttggactaacccccactgttccatggccattctgtcccagttaagccctggcaggaagccagcatcttacctaggcaacatctttgcttgcaacctgtctcatgcttccatccaaaccatgtcctggccatggctggaggaagcagatggtgcctgcgctgatccccaggttggaggtcagacccttcaatcagcgtctcagtcatttgggttttcatcactatggtgaccatataatttatcttctaaagtaggagacatgcctgagagagtgtgattaataattaaacaggacgataaacataaattgggaacgtcccaggcaaactagaatgaatggctaacctaactatctcctatgtttccatgataaatccaaatatattgtgatacatacctcactttttctccagcattgcaataaaaacctgacgttattctttattgccaagacagcttagtcatacttagcagcaaaactagtattgctaattatttcaatttgatgagtgcatacatccatttttacatgacacactaatgtcttgctcacagttttctgttatctataggaaggggagcttgatttgttaccttagttaattatccaaagtttgttggtagggttatggtgctttttggtggtaaattcactccattaataatagttgtaatccagcagcagctaacactcatgggttatattgcatgccaggccctgtgctaggagcctcaatatctcatttaaccctcacgtccacccgggaggaagggactatgatcatccctgctccaccagtgaggatactgtgtgtgtatgtggaactggttgaatatataaacaatccatgctcttgggcacattatatggcctttattcctagctagggaattttttctatttaatgtttcttttaatgaaaactaatgtagaaatatcacttctaagtctgtcccttgttcagggactttttcctagcccaatgtgtccgttgttccaactcagcttatcttccacacacctgtggacacttgtgatttacaaacttctgtggtagcttcctttgctttacaaagatatgttaaatggtgattatattgttgcattctttcagctgagccccaactgctaaataaatgtaattttcatatgataggcactgtgagagaaattcaactcaagtgtttgaaatcattgttgagtgttgctagatatatactgggtcctatgatggtgaattgaagcacttggttattaggggtgttctgtctccctggaggttctagcaccatttccaacagacattctgtgcattcatgagtgtttccgggcttcaaagacaagacatggcacccacattcacctggggccaagagcagagatgtgtccaacacttactgacttctggacacagctccaatgaacccctctctcatgggtatccacaggaggggccccacgaaaaaaaggggcatgtgttcttacattttttttttttttttttttttgagacagagtctcactctgtcacctaggctggagtgcagtggcacgatctcagctcactgcaacctctgcctcccgggttcaagcgattctcctgcctcagcctcctgcgtagcctgggattacaggcatgtgccaccatgctaggctaatttttggtatttttagtagagacggagtttcaccatgttggcctggctggtctcaaactcctgacctcaggtgatccgcccgcctcggcctcccaaagtgctggagttacaggcatgagctaccacgccccgccgtttttcttctatttctactaaacatttttaaattgcggcatgaaggaatgctgatattaataactattatctgtgtgctgggaacttcctatgcattattttctttaatcctcataacaatgctgagataggtctttttccccacattttccagagaaagaggtcaagtgacttgcacaagtcccaaagcatcatttttggctaaaacctagcgtggaacaaccccaccttccctggccagctccctcacactggcttctggtcaacacagccctgccccttagtgtgtttacaaagcttgacttgcccctcagaccactgcatcaattctctgagcttatgagaaagtatctagtggaagaacttcagtgcatttcgcggagccttcagagcaacatgtggaacagtgcctgcacgtggcagactgagcacaaccatcctcaccgtctcatccacccacagatgaacgagtcctgctatgtgatgttggcaaaactgaagaaacgaatgtgatgtttgaaaagattttcaccaacttcttattttagggtgaacagagaagccgcctaactaaaagcacaggaaagtgtgtatcctcagggtgacactgacagagaaaccccaacatcaacgctaccccagggcccaggggcagtccagaagccccatagttgagtgtttataactacgatccatggataagtcttaaatgttacagaaaattttggcaagaagattaacagaggtcagcctccacccaccttgtatggtgagaggatgatattcaggaagcagggcctgtgccaagcggcaggccctgcttctcaggggcctctgctggctcctggaaagtgaccctgcctaaccctatgtttattgcaggggacctgtaagccaaacccccctcagaagcctctgcctgcagatcctctggccagaacaactcggctcactcatgccttggccaggaccccaggacaatgggagactgggctccgcctggcacccctcaggtttgtgtgacatgccatgcccatctctttctctctcaaactcttgtgggaccaaccacgactaatccaagccaggacaggggtgcagtggtctaggccgtgcttcctgctccccctacaactgggaataccgtaaaatagacatgacaattaccaggaaggaagcagtccatgtgagcttataatcacaggcattggcacacagtgcctatcaacagccacagtggacctaagagagcaaatcaagatgtcataaaactacagtacctcagaaagccaggcctgtaagacacaaagaaaaagaggagctaccaagtagcatgacagtatgaagactggacacctgtgttagtctgttctcacattgctataaagaaatatcgaagactgggtaattcctaaagaaaagaggttcaattggctcacagttctgtaggttgtacaggaagtatggcagcatatgcttccggggaggcctcaggaaacttacaatcatggcggaagggggagccagcacttcacatggctggagcaggagaaagagaaaaaggggaggtgccacacacttttaaacaaccagatttaatgagaactcctatcacttagaaccaaggagatggtgctaaaccattcatgaaggatctagtcacctcccacaaggccccaccttcaactttggggattacaatttgatatgagactggggcaggaacacagattcagaccatctcaatgcccacctccacaactctcagcagaatctgcccagttcctgaggtcctgagacattagtcgggttggaggcatacggctggagcaagggacatatggggagtaagggaaagcagctgcctggcagcaggacactgggaaaacagggacaatgggcaaaaggaatcacctttcacagcttatcctgcttggtccactaggaaggcagagacctcaatcccaacttatgctgggaggctaaccccatggtgtaggggagccagcttaccctggttggtgagagataaccaatttccaggaattttgcaagctaggtgttaaacctagccaatattaaggattaaattatacaaatttatgatattttatattagaaacaaaggtaataagtgctcaaaactcacttcacatttttctccattttgctataattgtctgtgctcttgagattgcactcatccattatttctgtatggcagaaaacctaggtcatggtagctgcctgcatctcttccatgtttagtgatgtcaggtggtagcttgaaaccagccacaggaggagtatttacaccatggacattggcaaatactgcaaatcaggctttcctgcccccaaccccatgggctgttcaacatttaccagcacacagatgagttaaacccacagccaaagtactcttctgacacacatgccctcttggcaggaagcctgctttgtgagctcaaaagaaccaaaggtactgtgttggccaggccctgggttcagtaatcctgtatctctgaaggagaagacacactggagtgatttcattacagctcttgggaagaatgtttggcccgtgaaagaaagagctgcttaataaatgtcagagataaaggcggtcaaagggtcaggacaattgtttaattcccaacttcataaatagagaaaaattgcatagcatcctaattatttcattgtggtttgcatgttgatcttgaagttatttttcttgttctatttgaggaagaaacactactttacatgaaaacaatgaggggaagccctttttcttaaatgccctcaagctgtggccaatcttacctctggtcagttgctgattttggtcctgtcctgcacatttcattttttagggatactgggtgcccacctttgctccctgttctctggagctgtgctgtgggatgcagggactgctaggcatgttgcgcctggtaaaagtcttactgtattttgaagacttagtaccctaaaatgtcaactatccatttttttctattgatgatgacctgttgaaataatcctctaggtatactgagttaaatgtattactaaaattaattgcacctttctctttacttttttcatgtggctactagaaaatttaaaatttcttgtgtagctcacattttttctgtgggacagtgctggtctagagttgacttgtgggtgggaagtgcggctttggagacaggtttcccacccccgttatgaggggcagtggtatctgacacagaaaacccttcagactatcagaatacatctccaaccccagacctctctatcctcagaatcacttctcaaggtctctgatcatttttttttctcctctcttcattcagacctgctccacaatatccacaccaagtgcccagatccacccacaccgcctatattaagtgagaagccgacaccttttttcaacagtgaagacagaagtttgcactatctttcagctccagttggagttttttgtaccaacttttaggattttttttaatgtttaaaacatcattactataagaactttgagctactgccgtcagtgctgtgctgtgctatggtgctctgtctacttgctcaggtacttgtaaattattaatttatgcagaatgttgattacagtgcagtgcgctgtagtaggcatttttaccatcactgagttttccatggcaggaaggcttgttgtgcttttagtattttagtgaacttgaaatatcctgcttgatgggattctggacaggatgtgtttgctttctgatcaaggccttattggaaagcagtcccccaactacccccagctgtgcttatggtaccagatgcagctcaagagatcccaagtagaacctcagttgattttctggattccccatctcaggccagggccaaggggcttcaggtccaggctgtgtttggctttcagggaggccctgtgccccttgacaactggcaggcaggctcccagggacagctgggagaaatctggcttctggccaggaagctttggtgagaacctgggttgcagacaggaatcttaaggtgtagccacaccaggatagagactggaacactagacaagccagaacttgaccctgagctgaccagccgtgagcatgtttggaaggggtctgtagtgtcactcaaggcggtgcttgatagaaatgccaagcacttctttttctcgctgtcctttctagagcactgccaccagtaggttatttagcttgggaaaggtggtgtttctgtaagaaacctactgcccaggcactgcaaaccgccacctccctatactgcttggagctgagcaaatcaccacaaactgtaatacaatgatcctgtattcagacagatgaggctttccatgggaccacaactattttcagatgtgaaccattaaccagatctagtcaatcaagtctgtttactgcaaggttcaacttattaacaattaggcagactctttatgcttgcaaaaactacaaccaatggaatgtgatgttcatgggtatagttcatgtctgctatcattattcgtagatattggacaaagaaccttctctatggggcatcctctttttccaacttggctgcaggaatctttaaaagatgcttttaacagagtctgaacctatttcttaaacacttgcaacctacctgttgagcatcacagaatgtgataaggaaatcaacttgcttatcaacttcctaaatattatgagatgctggcttgggcagcatccccttgaactcttcactcttcaaatgcctgactagggagccatgtttcacaaggtctttaaagtgactaatggcatgagaaatacaaaaatactcagataaggtaaaatgccatgatgcctctgtcttctggactggttttcacattagaagacaattgacaacagttacataattcactctgagtgttttatgagaaagccttcttttgggggtcaacagttttcctatgctttgaaacagaaaaatatgtaccaagaatcttggtttgccttccagaaaacaaaactgcatttcactttcccggtgttccccactgtatctaggcaacatagtattcatgactatggataaactaaacacgtgacacaaacacacacaaaagggaacccagctctaatacattccaactcgtatagcatgcatctgtttattctatagttattaagttctttaaaatgtaaagccatgctggaaaataatactgctgagatacatacagaattactgtaactgattacacttggtaattgtactaaagccaaacatatatatactattaaaaaggtttacagaattttatggtgcattacgtgggcattgtctttttagatgcccaaatccttagatctggcatgttagcccttcctccaattataagaggatatgaactgagtttttcttttgttgtttgttcttagctgtaattcctatgcttctatttcagagagccaggagagtttgatattaaaggaggttaaaactgtgatcttatgccatgtcatcaatggccacttaggggccatggctgatgacacattcttatctctacagtactaatgtgttattatagagccatgcattttatttctgaataagaacatatttaaactaatattcccttacaatatggacagtattaatccttccaagatgcagtatttatcaagtgaagcatatttagcagcaaattccattttaacataacttaggaaccaataaccagggtgttttgtggttgggggaggcacggggtggagtattcttttttatatcctcaaaacaaaaaaaatcaatacttatatttcaatggcaatctagtatttttttaaaagactgtataggcatgaataatagaggtggtttgagttttgtagggccatcacctggaaagtcaatgtgactagacacaaagtagcccagaggctacttttcttcctacagcttattatagttgtaggttctatgacctcacttcatgggttccaggcaattccgctgaaaggtttgtctcctgaaattttttaagtttgttttcctgacacatgtaatcagatgtgtagcaaccgagggaaacgaagcctaacattctccattgtggaaatacacacaggaggttacacttcacagcgtggatttttccagcttacacatgtgggatgacatcacagaaaccacaaaagcagcaaattaaactgtaggagagtcaatactcctgacgagtctcggggggggggcatttttatgccttcttaactttatgagaattctcaggctgaactataggccattgttcccaggcaaatcaatacatcaatgcatcctcaaaaaaaaaaaaaaaaaaaaaaaaccggctaaaactgtgtcaaaatgttcttaaggagcctatggtctccacggtgctaaaaagagcctggtgctgggccgactggcagggctgagcatcctcctgccccctcgccactgatgtttactaagcactctgagccaatgagacccccagcagcagaaagggcacaaggtggcgccagggcagcagggccagatctttctcatgcacctcgacctcttgcagactttcttcgtgagatgtactactcatttcaaaactgctttgcagggctcccctatgtattcggggggcccacggcacactcaggctggagatccttcctcactgcgctcaagatggcctcagccagacaccagttacccagctgaaagtcacaatccctcccagaagtctcccaacactagtgctgaccagaggtggggctctcaggctaggagtttcacacacaatgacaggctgctgggggacattgcaggaccccttttcctctcctctccatgctagaagccagccctaggcagctgcagttactccctgtgactcagcagcaggctgattcaacacagctgcccacacaaagccagtggctaatacatctgtttacctttccctatcacccagacacaagcccctttcccaggtcaaaccacaggccgatgcatctccagtttgacagtcaaatcactacttccattgctactttagatcagccaaagtggtgactgctgcagtgtgtggctatccctacaaggcccacccaagggatgcccaaagcccaaccttctccagggctgcagcccagagcaaccccaccagcctaagtccagcagaggacctcccacccaatgtcttgttctaattagaaggggaagttagccacagaaaatcaacttatctataattacaaaattctcttgactcaccttaaagttcctattgacatctactgcttttaaacctatttgaaaactctgatactaaaacaaatgacactctaagaaagtttgggagccccatgctgagaaccatttctgtgcagtgaggatgtttccagaagctacttacctacatgtgaatgtgccattttctttccttttgtagagaaaatcccctttactttttggaacagtaatggcagcttctagtacagccattacagtttcatatgagaaaaattaagaataactataaaattgttaaaatatccaataatggataatgatggccagaagatttaacatacaaagtaattctcaatgtaaagctattcagctcttccaggttgaatgccctgtaacccaccctgaccttccacatcatcttcaaaaagcagtttctctgttccccatgattctcctataaggtaactctttagtcctccatttagcacattttaaatcctccaaagaataagtatcatgtgattattttagctttacaaaaaaaaagttgaatggcgttttattttcatggcctataagcaggtaccttagtagggcagatataggaaaaacaaattagagcaaaacaaatcctctacaaatccaaggcaggaaaagtggtggcagagtgactcattctcctgtccctcccatcaggtcaaatcaggaggctgcagtgaatgcctgttctttgaatgtgtagcagttgttcctgtaactctttaaaacttggctataggctgtttagcacagtacagattaaagatacagttacgtaaacagcaaagtaattttatagtgcttcatccatttatcatgctttggtttgctaattttttcacatacctttttctatcacagtctgttgcttttgtacacatttctcatattggggttcgacaggtaaacacaaactgctatttcagtagaaaaagttattgttatgaatattaaacccaataaattgtataaaggtaaatatcaatgtgtctctcatttgttactgagaatgttacaaaaattggcggaaggccttcatgtagaaaaatgtattctcattcatttatagatgcttgagaaaactttggagcagtacataagaaactaagaagaatggttggcagggtgggggtgcataaggggtgtgtgctaccaacctcatgaacgtgtgagaccacggcacaggaaggaagatgctcacacacaacacggggggtggggcatgatatggtttttgaacaatgtgaatgtataacctaattttttaaaactcatctatttacataagaaatccaaaaagcaagcaagcagtggtagagacaatatcggagttatttggtatgaaaaatctaagtgtaaatagatacctatttaaaaaacacagcatccaacttaataaaactacagaaaatacaaaaatacaaatacaaaatgctaacaagaataaaggagtctttttttttttgttttttaagacggagtctcactctgtcacccgggctggagtgcaatggtgctatctcagctcactgcaacctccgcctcctggcttgaagcgattctcctgcctcagcctcctgagtagctgggattacaggcacgtgccaccacgcctggctaatttttgtatttatagtagagatgaggtttcactgtgttggccaggctggtctcaaactcctgacctcatgatccgcccaccttggcctctcaaaatgctgggattacaggtgtgagccacggcacccagccgaagaagtctttattcttaccactctccacctatgatcacacaagctggcaaaaattagtacatacagaacttcagacataattgatatatatcaaacaggatactccaaacatacagaatatatcatctttccaagtgccttggaggaataaaaattctcaaaaaataattccataccctagaaatgaattgattcattagttttcaaagatgaattgcagattagaaaacagcaagtgaaaacatttctaatagcacatgtgatggtagggattctcaagatcttagaattagaagacctcacttgtgatgcttgttcaaacccattaaaatccattgctcatgccctttccctgaagattccaattcagagagcagagatggggctacgaaatgtgtacttagcaagttctcccagttgaatttttcattagaaaagtttagaaaacttctatgataatgtaactaaagcactgctgggggaaaattcatagccctaaatctataaattaatttgtaaaggatgaaaaagggaacttaatatctactataaagttataaaaggaacaataaaataaacccaggggaaaaaatagaagaaatgaatttgtagacctaaggataagttcattagaatacagtagagctaataaaactatgagttgctctttaggaaaattctaacagtgtatacgccactttctaatctcattaagtaaaaagaagaaaaagagcaaacatacatagcatatgagcatgaagaatcctgcagtccaccataacccagggagatgatctcaagaatataaggatggttcaatatcgatcgggagggtgggcagttttgccaagcttgatgtcaaccagaagggatgcacactcctaccataagagcaggctagtgaatacagtctacaacagaccaaaaaatgaaactaaggtgaacatcaacattgaccaccaaccaaaggagggacctctggagggttgtaaatgtgctccaatttttaaagaggttttaaaaacctaatctggcaaatctaaaggaatttgcatttgtacaaaaggtaaaacactcatgaaatatctaaggaatggactatatatggtccacaaatccaattcctaaaacgaatattctgtgggctctttggaataaagctgattgctaacgtcaataaaattgtgtgctttttctctatgcccctcagcaaaagctttggagctttaattaccttttattaggctttccctacaggaaaaaaaaaatccactcctctacagacctatgtagctggttttcccatggggtcaagttaaccagtgtctctctggagacataaactcatgtggtctgtgtgctcacttttttgctgattttgaagtgtgtttgctgagttgaagctctaccacatttgtgtctttaagctcccaaccagcagacatggttgcagttaattcctacttgtctaggaactgcatgatcagcatcagaaaaccttctgctctgaagacaaaatttaatatactaccctttggctacgtcgtccacccatcagcaggctgagtcttccattgtcagggcatgagtatatgcaaacacattagacctgtctgtggccaaaaaggctgaccctcaatcagacacctccaatagaacagaatcagagtcctgaaatatgtattctgagctttgatgtgaggccaacagctgaagagaaaactcctgggcttttcggaggagcgccactccaggagggagcagcggcctgacaaccagcctggaagccctaagttgggaggggaggatttaattgaaaacacatgagggaaagaattccaacaaggcctagcatggtagaaggacagcttgcggggcaggagccgggagtgggagaccccatgtgtgtttgtgtagctccggtgcataaatattttgtttcatgtctaactccaaaaggcgcaagtgcaagaaaacatccccattctacagacacccaatgatggtaccacatacgcacatgcttaggtaaaaagatgtatttcaaagtgggatcagtgaatcttcaactaaataaataaatgtacagccccccaagatgcagaatttcccatccctagtttaacagtcacggttcactttgttttacgtgcgtttcgcagatgagtggtgctctcatcagcagacacaagacttctttggcctctgcttttttttcctttcttctaataaggagactacactctagataaacaaaacagacaggcgaatgtaatccagggttttggtggtttttctgagtctagaaggactaaaaattagccttgataggcagaaagagcatcccaacctgtctgtcaaaaactctggccatttctaggacacctttgccgaactgaaacaggaaacaacaaaaattttacatgcttataaatgttttctccccctccgaggaaaatctttacataaagatggactcatttacctcattttttacacttgcatctgcccctttgtcaagaagtaactgaactaactcttcatgattatttaacacagccacctagaaaacaaaacccagggtggtgtgcatgagcttctccctccagggcacacacagcagggggcatgagcctggcacatgcagggtcccagcagcccccctgcaaccccaaaagaccactgtggctttgcatggcctgcaggcacagcgcttcctctgcagctgtatggtagcaactccagggaaaatggaaaatggactccctctctccacactaaaaccagaacagaaagcagcttgttctttgtttcaccagttctgttttgatcccacagtggtcctggggacaggggttctttagtccttaaatagttgtaaaaagacaacgaaagtattctagtgacagcctcatgcccttatgaacaagccgacagggaacacacacacacagtcaaacccaagggctggtgcagggctgaactcacaagaattgtctaattacagaaaaagctctgaccttaattccacgtagaaaactgcctattttcgggaggaggacctaccataaggggcgtctttccatttctgtccttcacattcacattggccccagcatcaattagaagagaggccaccctctgatttcccgacaccgcagagactctcatgagtggggtccatcctgaaccagtgtccacgacgtctacctgttgggccagagaaacagctgtgttgagcccaatttctttttcttaaaatgattcaaacttataaaaggaatatttgcttgccccaacacccggacttagatagccgtctttctatatttggttcattgcactgtgctaatttaagtcacattttggtgctgagaggccccagggtctccccaccggcttcttcatctacatcctttaaagtggaaaaaagatgggctagaaaagttaactgaactactttccacttggcccctggggagttcttattttctcttgcctaactttcctcacctagcattcatttttcttacttttatgtattgttgtaagcagctttacatcctttctggaacaagacagtaataatatatatacacacttatacttactaatgcttatcaattttaggcaggagacctacaggtaaaatacagaacaaccagattcattacacaaactctgtctgaaaagtctgactaaaggcttctccaaaacagtgtgcccagtaatcagatggctgtttcctgatcatcttctctacactgaaatctctcaatttagtgttttaaaataaatattttagattaagaaaatgtaaatattgtcgcttccaattccaatgaagacatcgccaatccatgaagagtggtgctgaagtaaagacagatacgtgtttgtgctcagacacgcacacacactcgtgtgtatgcacacacgcataccatgtgcacataagcacacatgagcacgtgcacacacacacacaatctgttacagaagaattactcaaagatgatccatagctttagtaaaacatcagaatggaaaaacaaacaaggaatttccaggagatcttgggagcacttcagggtatttctacatataagattatccactgtaacatgatttggatttgcagctcttcttcatgcaaagaactaacctgtgggcaacacactccattatatttaaagaataataaaataagcacctcatattacatgatgctttacacagctttcaaccctctttacacacactttctcttttggtcctaaacgttaatcagaggtaggtatttttattcttggtttacaaacaatcaaaataaacctcagagaagtgcctttcctgagatcacatggatcattaaatgcacaaatgaataagtcagtcgccaagtaaataagtcactcttagtatatgatcattacatttgggaagaaggtggtgattggctctcaagtccttcccatgggcttcagaagcatcaggtgagccacctgccagaatatggaaagactcatgttgacatcatccatccgccaccaggccagtcatgtggaaatctatagtaaacacatccatgcttattgttctgtcctctgcaaagtagttccagtgcttcaaagaaagatggaatttatcccaaataagtatattcatatctgaagcccagagagcctacatttccaaaactccagtatttaaatgttgatagcagagatttgccctattgtgaatgatttatttatttgagatggagtctcactctgtcacccaggctggagtgcagtggcacaatcttggctcactgcaacctccacctcctgggttcaagcaattctcctgcttcagcctccctaatagctgggattacaggtgcccaccaccacgcctggctaatttttgtatttttagtagagacagggtttcaccatgttggccaggttggtctcaaactcctgacctcaagtgatccacccgccttggcctcccaaagtgctgggattacaggcataagccactgtgcccggccccgatgcttgacttctttcagcaaagtacaaccttctttttcaaccacagactttcactaggtgcaaaacctgcccagaattcatcataaaccaatcaaggagtgtgtggctgtcactaccacacatggcacgtgggcccggctctactatggaagcccactgactcagccttctgcctctgtgcctgtctctaaaacataaggaaaataagaaatgtaataaatttttaatgactgagatttttcctataagggggcacttttcttaattctccaaaagcagcagcaggaaccagatagatcccataactgcagtctcactttccctcaattacccttcagaaacaaactagaagaaatctactgacatcttccaggagacatgacttttctcaatttgagttgattttccaggtcatcgacttaatttctcagcactctacacaccatctggcagtcacagatagcacagaactttgtccatcattctttagttccatgctttgaaatttttagctaatttcttcaaagtcttgaaataaagttttcaaagttaccagcaatttccataattgatctaattctaattacccatcttcaaatatctatagacgtccaacaacactgcttctatttgctaaatcaaatttgcagtttctgataacgtgaaatcaaaagtagaccacttgcctgtttccaggtaaagatgcaaagaactgaaatgttttattcttgatatggtcagtttcctctttggaaattttttgtaatgactaatctttaaaacaaaccaagaataaaaattacctaattttagaagtaacaagaagcacaatggctataagggctctcttaatatctttgtatctccaccatttgaaataatatctggtacatgcttagtaaagctttggtgacagactgaatggagagagaagcaaatgaacaaaagaacaaagtagaaacatcaggctgggcacggtggctcacacttgtaatcccagcactttgggaggctgaggcgggtggatcacttaaggtcaggagttcaagaccagcctggccaacatggtgaaaccccgtctctacttagaaatacaaaaatttagttggggcatggtggccatggtgcctgtagttcccagctcccagggaggctgaggcaagaagaaattcgcttgaacctggggaggcggaggcctcaatgaaccgagatcgcgccactgcactccagcgtgggcgacagagtagtccatcctcaaaaaaaaaaaaaaaaaagaaagaaagtagaagcatcaggtccagctctggattcagacctgtttcttttccctacacaagataaacccccatgacaatcggaaagctcactctcatgtccattctaaggtttcaggggctttcttgctaagtcagaaaactttctccagcatttctaaggttagctaatcaaaggccctgcttctgccagaccccatggagcagcatttcagattcttaacgatatgtgcgtggttaacaaggcaggtcccgtacctcacagccatcctttatcatccactcaatcacactgcagtggcctccatctgcagcccagtgcagagctgtacagcctcccaggtctctagcctgccaagaagcgccatgtcttcggagatatttcacaacatctaggtgtcccgcatagcacgccagcattagactgcaacatatggaagaagcagcatttgacaataagcacagtcaccaaactcagctccaccttttaccctacctggcttaaaccaagaaatcctaacttgagtggaaaagccatgggaactgttcatataaaacgtacacgtatccatcaactgatgtacaaaatgtggtatatccatacaatggaatattagaaatgaagtgctacaaacatgcatgaacctcgaaacactgtgctgaaagatgccagccatgaaaggccacatattgtctgattccatttatacgaaatgtccagaacaggcacatctgcaagacagaactagcaggtgagcggttgcctgcggctgaagggaaggagtaatggggtgtgattgctgaagagggcagggcttctttcaggggggcaggggatgaatattctggaagtagatagtagtggtggttccacaactttgtgaatacatttttagatgttgaattgtatgttttaaaaggtgaattttatggtatctgaattatatctcaataaaaaatgaatagtgactgtaactgagggtaaaatattggattttaaaacatccaaagtccatgatattcaaaaaagagaaaaaggaaaaaaaatactcatttgacactattagagataactatcaaaccaatttcttactctaaaaattggtatttaaaaattaaatattttcttttttttttttttttttttaaggataaaatgtagtccatccccagttggtggggggaagctgtttttcacagaagactgccaactaataaatataaaaggaaccatagagttagaaaaacccttatttgcaattcccaattaaataattgattcaggcaataaaattattggcactgaaatgattgggtaaaagttaatggggaggccaggcacagaggttcacccctgtaatcctagtacttttggaggccgaggtgggtggattgcctaagctcaggagttcaagaccagcctgagcaacacagcaaaacttcatctctactaaaaatataaaaattagctgggagtggtggcaagagcctataatcccagctactcaggaggctgaggcaggagaatcacttgaacccaggaggcggaggttgcagtgagccgagatcatgccactgcactccaacctgggagagagagcaagactctgtctcaaaaaataaaaaaaaataaataaaaaataaaagttaatggggaatggaatattcacatggcaatgaattatcccagaaattattttctaagtgcaatgggaaaactgtatctttacagagaagaaaatttgctgtcatcattctaaaaaaaataatgaaacctagaatcactacctgtgagacaacctgcatcacaggcctcccaatggatgtaacatgaagtcacaacactagctctgaagcattcttgctaaagtgttaacctgagtctaattaagcctttaatttttttttaattcttaaaaaatttcagcttattgcccacgctggtttcaaactcatggcctcaagtgatcttcctgcctcggcctcccaaagtgctgggattacaggcaggagccacagcacccaacctaatagagcccttaagcctgtctttaactttattgttaataaagggatagatgaacaagtgaaatgcctgccccacaaccgggagacaagcaaatccagaacataggacattctataagataactggtctgctctcctcaaagagtcactgctatgagaaaaaaaaaaaaaaatttaaagagaggactggtctagaaccagagactataaagagagagaatggccagatgaaatgtgggaacgtctcaccccacaacacccccaaaaccccacaccacctcccaaatagagctgtggaagacctttggggaacaggttgggagacctgcagggtggttgtgtatcagtgatattaaggaattagttgaagtgtcttagaagtgatatgacacgattactatgcaggttaatgactgtgtttttaggaaacattttctgacgtattgaggggtgaagggttatgctatctactaatttcagaatagttcagcaagaatgaaaaaaaaaaaaaaaaaaaaggagaggcaaatatggccaaatgtcaactgccaagcctaggtggggggtatacaggtgtttgttgtactattctttcattttttctaaatatgtaaatatttcaaaatagagagttggaaaataaaacagaagatcttctcaatagggaaacgtgcaaagcctctgagtgataactggaatatccagcccccaaggcaaggcacagccgagctgagatggcgccagaactctgcagctgcatgtcctcacacagtccctcatttcttggagacccccagaagacagtcagcatggtgcagcacctgcctgctgggtttagggtgttcatactgctttcccaagcactcaaaggtctttagaatgacctttgctaagggaagaaaacttcattttttaaattatattcaaatagaactctaattatctgcatgactttttgtttgttttttttgagacagagtctcactctatcgcccaggctggattgcactggcacaatcttggctcactgcaacctccgcctcctgggttctagtgattctcctgattcagcccctcaagtagctgggattacaggcgtacaacaccatgctcggctaattttttgtatttttagtagagacagggtttcaccagcctggccaggctggtctcaaactcctgacctcgtgatccgcctgcctcagcctcccaaagtgctgggattacaggcgtgagccaccacgcccagcctatctgcatgatttttaaataatgcctcttttctgattataaagtaaggcatggtacctagaaaaaaaatcccatatcagagtcacccatagcctcacctcacagagaacaaactcttaagattctgttgaatttgctctaggtggtgaggaggattgtttaataatcctggattattttaacaatccagagactccagccccggaggctctggattgcccagcaatgaggtcattgagaccaggcgctcttccttcccagggataggcacagccctgaacttaccacctcccactggcagaaagccaccaaggtcctccaagggccaagcagctggagtcagccaccagcccaactgccatctgaactcaaactgcctggcacccatggggtctgttatctgctgctctataagaattcccctctctggttcacaaggtgggagaaggggagagtggccaggacatagcacactcctgagcacagccctgcagggcatcccactgtgccctagtacaagcccaccagaaatggaggacccgctccgcttgcctgctgctgagtcccctgctcagggtcacattcctagctctacacaaaatcccgtcttttctctcttgttctgtatgattttctcttctccctgccttttaaaagtattatttcagtttcttattatttcatatacttccctgtttacttaagcactgaaaacagcattggcatactaaatattccatcatatgaatatatcataacacatactaaatattctatcatatgaatgtatcataacttcaatcagtccattattgtcagacgtttcagttgtttcacattttccacaatcttaaataaggcaacaacaaacacccttactaatcgtatttgcatttctgattatttcctaaaatgggatcactgtgtccatggatgtggcttaatatggatgcacatttccaaattgctttccagaaagatgataccaattcacatttctatcaactatatttgaaagtacaggttatttcactgcatctttaccaacatgattttttaatcaccaatttgatagaaaaattgttattactagtaatgctaaacatctttatatgaattgcttatattgattctgctataaattgtcttcttgtgtaaactgcttttttctactgtgtgtggaggcttttttggagtatatgtatgggcatgtgtgtgttctgtacattaaagatgctggtaatttgtctctaatacatttgtaaatatttccctggaatgtccttaacattgtaattaagtttttaaaaatatataatacactcaatctttttcttaatgattcctttcaatgcatttattcctttcacattacaagataaaataattatgcctctgtgttttctggtcattttttatggttttgttttttacatttaattcttaattcatctggaatttattttggtacacgctataagaccaggatctaacttgactttttccttcaaacatcctatttttccaataccttcctcaatggtttatgttacttccatcatcatataccaggttcttacgtagatagggatctatttgaggatttccattccattctactttttttctgattatttgttccagtatcatactacattaattactataacgttatgaggcattttaataactgtcaaggcaagtccttccacattcttccttgacaaagttttagtagatattatctatttgttcttctagataaattacaatcattttgacaggttcccaagaataattccagttgagggtccattgaacctcaatgcagtatttgagaagaactaaaaattgtataatagtcaatcttgccattctggcatatgacatgtctttatttcttaaatttttatatctctcagtaaggtttttagggttttttttaattcagatttcctacctttcttgttttcattctatttccccattatatttattaaccagtaattgcagggatttaagaaagtcttttctttgccttgtagctgtccactttactgagcctccttattaagtctaagtttttcaagttgattctgttgggttctacaggaaataaatcatacctcttatctcagttcacatcttcttaagtagatcagccttcaaaatactgtctaatcatgaaataacaaaatatatctgtatttaccatatgccaggaactgttttaacgcatttttcatattaactcattaaatgcctacaagctataagtacttctgttattcgaattttacagacatgaaactgagatacggagaggttaggtagcctgcccaaggtcacgccacatcctcagagggatgcagatttcacatcaagctctccaccactctcctgggcttcactactaattttggaaaggaatttgccaatactaagaatgacactggctgattgagatgatttaaaaaataaaagaaaccttggtatgctgcaatcaaaggaatccttcattcaacagacacttcctgcctcccatgtgccatacactgttcaaaggctgaaagtatccttcactttaaaaaataagatacttctatcaagaccatcctttctaacacggtgaaaccccatctctactaaaaatacaagaagttagccgggtgtggtggtgggcgcctatagttccagctacttgggaggctgaggcaggagaatggcgtgaacccgggaggcagagcttgcagtgggctgagatcgcgccactgcactccaatctggaggacagagtgagattccgtctcaaaaaaaaaaaaaaaaaaagatactttttaacatacatgccaagttacacccaatttttgttttgcatctacacaaataaaggttttcacctttaatcgactgatggaaagtgttacgttaaaaaatttcctaataccttaccctctggtatggccctcataggagggatggaagagatttataaatacctacacacaaacaaacatacaaatagcttttttttcctctatcaaattttagcaataaggttgtcctctggagctttccagcttcctctctgctctggaaaagcccaagtttattatcagtgcctagaaaatctgaacaggttcactggtcgaatagtcaagccacagagcctacattggaggtaatttttaaatgaattttctagtttcttgcatggatattggttatttcgaattttctgcttcttgggttgacttggcggtttaaattttctcagaaaaaaagtatccatttcaatgaaattatctactattatagacacaaacttcttttcatgtttacattttctctataaccagttattcttctctttcaaacttctaatttttttcttcttagatttacaaaagattggtgtatcttattagatagctttttgtttaagaggcaactctcatttctcaataacctttctattttttaatcaatgtctacttttaattctttcatttttcctactctcctcatactttttttcttttcccttttcagattgctatttttcttttcaaacttggagttgatggcttagtctcaacctatgagttatttggaaaaatactttttaaatttataagtgatatttaagatattgttatttaaaatctattgctgtattgtgttcagagaatgtaaatgtagaagataggccttctgatttgagaagttagttggggttttcttcaaggcctcccccagaaggtgtttggcagctgtctgtcgatgtcatctacagtgctcaagccctggttctgtgtgtgttgtgaccacagcccctgaagccagggcctggcattttgctcagtgtttcacccatgtgccaaagcacagcacctggcaagtagtaatccatcaataaacatgggttagttggaatttattgatgaatgactagatgagcaagtgtttttaggtctttcaggaacactctcatctgtcctttatgtgtgtcacgttcttcccctgagcttttcctatagcgttctcagccctccaaggggacatgtgcctctcacctcaggaaagtgctcttggtgtctctcttgtggtaatttctgtctgcttctttagaaacaacgaagatttcttagcaatgaatgaggctgaaatgcagcgggggcctgagagaggcacggggtgccaggggcaggcgcttgcacccacgcccagcgcggatggcgagagctgctctgtagctgccatttcccgtgcactgcgtgtccactgggcacagggaccatgccagagaagtcaccatacgttacaacagatgcccccctaagcaccctggtgagcaaaagcacaagaccatgtgagcaagccagcttttgtgatcaccatctttcctcagcgacccactcacctctcaggactgtcaaactcaagacaatgttttggtgaaatcacaacccctctgggcacaagcctagcaacacaattctgagaacatcagcacaatttcagtcatatcccacctcctacctgtccttgccacttccattcttcagattcacgtctgtgccattagaaactaggattttcacaagcctaaaggaaacaaacttaagtgtagctagataagtcaccttgatcactcagaacccacaatagtccagtaaaaatgagtaacacagcatccaagatgtatctttcaacagtttcttctgcaccttcagaagccagctggttttaaaaccaggcaccattaaaccagaaaaccacctctttattccagaaatgtgggcttttacctttgacacgagttattcattaaaatcaaatgaaagcacatgaaacaaatcgggctaccaaaataattcgctgtcctttgaatggccatttttaatgtattcttaaatggtagcatgtaatgaagatgcatttctgtttttttcaaatggcatttaattaaaatataaatgaaaatgaggtattcgtattaatacttatctctgtgtggaacagataatgagagtgtatctgtgaaaattataacttagcaacctagcagaaagttttccagaatatccctctctctacatcttaaaaaaaaaaaattgaattccaataaccagttttccaagaacataaaaaatatattgcatgtaattaaatggctacctctcttcctcaacacatgatttacattctctcctgcatgttgtgtaactttatgattacaatagttgaatttctaagccatcatatggtacggtttgggagatagaaaagaaacggttcctccatggccctttttcctcccatccttatcctgaccagagcctttgaataaaataaaaagttaaatccccaagagagatttaaaaaaaagaagagccatacctggtgtatcctttctgggcagcaaccatcagagcggtaaagccaaacttattgggaacatcaaccttaacacggcttgggaaaagcagagaaaagagataagcatgctcagtacagctactgcagagtcaaagccggtggttctcacagggcttaggtgggtaaaatgactcattttactgaaaattccaatttctttgtggccattaaatcttttcttgtcttagactgctaagaatcttctaaactatatacctaatattctatgagattcaaatgtatcataaaagagaaaattgatgtaatttcacttaaaatatacatgcttcggctcaaagccatgaggccatcggataaagcactctccagtgaacacagctctttaagatagctgaggacagtgtcttcactactgactctcagctctaccgaacatgagtctgtattggtggagactcaagctttatccttgcctcccatctcacctactgggtagagagcagccctttcggaggtcttcacgcacatactccagcgtagcagctttggctttttgtgggaaccttctcttaagagctccaaattacagagccgaattcacaaatgacttgtcttctagggcactcaaaactattgattcaaaaagaacctagataacatctacttttcatgtagaaggtaacttcaaacatctcatctgcagcagctatattcaccatttcccctctagtgttacatcaaccttctaaattagaaagcagttgatttggcgagtcccttgtttcatcagaaattagatgtgggcatttgggggtgaaatttgcctaaatgctgcggcttataagcaagagacagaaattatttctgggaagaaaatatgacacccagccttgtaattccttttacaatttctattacacaatcacaaaatataacatttacatggggcttcacgagcatctttattaactgtggtttattaactcacaccagtcacctgagatccattttggaggcagtttcaaagccatgggaatttttaggaaaacaaaatgaaactactgcatgtatttctatgcactttataggcatgggggaaaaaaaacaactgacagagttctctcaccctccttgaagtattcggaccagcaaatcttcatcattcacactgacagcccggtgcaagtgctcactacttatgggctctcctggagaaatgagatggaaggcagtcatccagaacatcagaaaaggagactgcttcccgccatcgtcctcctgtggccttcaggggatcatcttcaggaaggcgcttggctattcctgttaagtatatcttacatttcctactcacctgcttcttttaccgaaaatgaccttgttttcacatattaagagaacattttgactgacctaaagcttgggacatttccaagttatacagtattgctttgtgaatgttactttgatatttggaaataatcctttcagatttcataagacttaataaatgtctcctacaagcaaggaaaacctcagcaattgtcacaatatgctagttttatttgccaaagagatgttaaactacttggaaaaaaaaaaaaagacaaagtgctttaacatttgaaattaaaattttcagttcttcccaggaatgtgacttacatattggccttgtcttctctgagcttctgggggcagaagggcttcgacccacaggaaggtggggagcaccaggagaaaagccaattaggggagagagcttgccaaccagcgaagacccaggaggagtccagaagcctaaaagaacaatgggccacagccggggaggagggcatcctttgtacaggggacatcagctccacagcgaagccaacaggcaggcgggcagcacaagcagagggagaataaagggctatgtagaagccacccatctttctaggcgtttctagtttcatttgttctttattctacaccttctgattttaaaaagtatcacaattaagcttaaatgaaataacaccaatgaagcacttcgaatagcacctgacacatcgtaagtacccagcacacaacctgttgttgggggtgacagtacagcagctaccatcgtcagtggatacagccccaccacttcttacatactccaactgtacgcccagcccctcatccgcaaacggcaagagtttgagtttataatccctggtctaaaaaaacctcaaaggtctcatttattcattcaacaaacctaagtaatgtacatgccaagtcctgtgctaggctctagggggttagcatgaaaagagctaaccattagttcccatgctcacttacactgtagtgcctgctttcagcctgttattctaaaccctgaaagaaaatatccactcctaccccatcctcccccactgcaccctacactgcctcctggggctcacccaccctccctcttaccccatcctcccccactgcaccctacgccgcctcctggggctcacccaccctccctcttatggtccggcccagaaagatcagctggcctccctcttcctgctccttatggtagaaaatctctctgggatgccagttcctgggcataggagacactttttctctgggtttcctcggagggtttcagtggtgccaagtgaattgggcaatgtacaaactgggaaaacagtgagacaggagaataaaaggatttctaccagaaggatctttagccgataccttttcctttctttcataaaaataaatttatgccaagtttaaattattttgaaataacaattttgtctgctagagctagccaatctcttacagactttttttagctacattatacttccttttcatcattctacacattttttagatcaaaagtgtcaaataaaagtcgcacgataacctgtcaaaggccaaggctcacagctgtccctggccttccaagggagttcatgccatgctcagtggtttcactagaagggcttagaaaggaggcagggttttataccccagaggacatttggcaatgtctggtgacatttttgattgccacaacgaaggggatggagcactggcatctagaggatagaggccaaggaagctgctaagaatccataagtgcacaggacaccacaaggaaccatccagtccccaaatatcagtagtaccaaagttgagaaccctgggctagattaataaggacttaaaatcatgatgcgtctcatctatactttagatggatgaactaaacccatagactgtttccccttctgttgctaaccaggagaagaaaagtggtatgtttataaaagtctctgttatcccattaacaggccccactttttcctaatctgaaacttcacctgccactcaaacataaaaacaagtcatttggataaatcacctataacaacatataaagctcattctatttctactaagttgtacaatgtgtagtatcctaaatcaaatcctatgaattaagctgtacgtaggctttttacccagtgcttttaaaattctcctccaaaccacaagactgggagtcagaaaagctaagttgtccaaggtcgcccagttaggagagggcagcatcagagccaaggccaagtcttccatgaggcccactccttccctttagtacttagtaaacactgcagtatcgaccagttcactatatgcttccattcttaccaaattttgaatacagatgaacatcataagtaaatgtgatcctcccgcaaagtgttaaaaaagaaaggggatgcctaaaaatcttccaaaacgtgctaactgcttgagatgttaaggaaagttctaagggcacagccccaaccacctctctacaccgacccctctactccacagcctccatcttacctgaacagaaaggctctctcggtggggacacttcctagcgcatcctaaccaggaagctctgcagcatgcaaaggttgggaaatgaaacaagttcactgcatgtttataagcttaaggaccgtttgtagcaaagaccagggcttttagtattaggatataataaatgtaatgccaattccagcttccacgggaggtaaagagcacttcacagcttactctgagaacaaagggacacctcactgaagagaggggaatgacataattgttcctcagtccttgcttgctgagcagtaaccatcgttccagggtgtgagagctctttctcagtgttaactccttaatcgtcctcacgctactaccaagagggaaaggagggactgaggattacactgaaacctgtgtgaagcaacagaggtacgaaaacgtctccatttacctgaatttgacaaagaaacagaaaagaaatgaaaaggcccttgtttgcagtgcacagcaattctttctactcccactataggcaggagtcctgaggaacagagaggaaattccagggtgaacagaatgtttcattcctcccacccctgaatccttcaagactttgtgggcctggcccaagggaatgccatcaataagtgcaactgaatatttttaaaaggccggccattgctctgcgggtttttctagtgttttaccctgagtgttgcaattacaattatcaaactgattctgcccatggtgaggatgttagcccatgctcacctgagccggatggactcaccagtcagggccaggtgagcaggggcaccgaggagaagggcagagcagggcagagtggtcttgaggaagccatcgctcatgttctctaagagggtcatttagttgcagatgtacctgcagatattataatatggtgctaacacctttcttggtggaattttaagtctttattaaaagcagtgaataaatcacgagctcattggagaagatatttgccaattaacaagtagcagctgtttttctttctttataagggcccaactgattaaaattgtaagcctcatttaagcaagaatctgtgtactttacctggggggaaaaaaaaggctgttcattctttattcaaacaaagtgcatgcctctgtgactcattaaaacactctcaaactgaatgcaaattaccaccacacagaagcattttgtatcatgtgcaccttcttagttctttgtttagcatgatctgcctccttaggagaatctgctttggatattataaatatataacacaatagcataagggagctgcagccagcccacagagccaagagcctgccccagctaggaggaggaggacacctgatcctcaccacccagtacagcccccctgaggttgagaaggcttcctggctgcaggcagtgatgctatctattatctggcagtgaaatggccaggatcactcccccaacacacacacacacacacacacacacacacacacacacacacacccctggtcaccaccacacactcatccctgcaggaggcctcatctaattactcatggaagccatggcgctgtaaggacaaatgcgctgcaccaactctccatggctgcctctggagccagctcagtggggagaaggcacatctggcccacaggcacagcctgatatagtttggctgtgtccccacccaaatctcatcttgaattgtagctcccataattcacatgtgtcatgggagtgacctggtgggaggtaactgaatcatgggggtggggctttcccatgctgttctcatgatagtgaataagtctcataagatctgatggttttataaagggaaattcccctgcacatgctctctcttgcctgccgccgtggaagacatgcctttactccttctttgccttccaccatggttgtgaggcctccccagccatgtggaactgtgagtccattaaacttctttcctttataataaattacccagcctcaggtatgtctttattagcagtgtgagaacacactaataaacagcccttcctaaaattgctccaaatggtactccaaccccatgtaaactcaggctaggagggccagaagcccctgccctggctttggtgtgctattaagaggatgctagaggccacctgaagcccaccatggaaggctgcagaaccaaccatattcaccctcacctggaaggttcgggtggactctcactggccagtggaaaactaatacatcttccaacaaacataaatgcaacctgagaaaatcagtgtttcttttcatactcttaattctgccactggtctttaattcattacccatccatccatcaaggatcttctttttttaaagaaagggtcctgctctgttgcccaggctggagagtgcagtggtgccaccatagctcactgtagccttgaactcctggctgaagcgatactcctgctcaggccacaggcacacacactgacttatttattaaggaactcccacaagctacagatggccaacccatcgtccatcctttcggagcccgcaatgtaggtgagagaccaaaaggtagacaaatacttaagatgcaagaagtgttcatagaggtgggggaatactgctctgtacctggggaggagggaaggcatgtgacagaggaggggaaagccacacgaggaatcgcccctgccatgcttgcccatggagcaggctcagtgagcacagcaatgaagtgagtgctccagggaagaagggcagaggtaggggagtgtgcagtggcaggaggcctgtgggcggtggggacagcaagaggatgggagggagcagaaaggtagcctgggacggcatcctggctggggttgcccggagtctctgttcatatgcctgactccctttgccacctcttcctcctgccccttctcctgcaatgccctctgccttccttcagcacacagagctcatgttctgctgtctttgctttctcttaagaaccccagaggtaagtaccttccatgttacagcaaatgttctcaacactgtcggatgaaggaacgagccctctttttttacctgcatccccagagttgaccatttcatatcacaagtctcctctgaaattgtgtttttcacagataaactcccagtttgctaaactcagatcctgtcccctcatgccaggtctgcaactgaaggtaccacagctcaaaagctgagttaactcaaaagctgagttaactttagtctacacaaaacttgtaatgaagaaatgcctaaaggacacagttgaaagccatggaaagcacatacctccaagccaaatgctacctggaataaaacggaaaaagagctttactcacaaaaggaaggtttcctttgtgcaactgaaaaattacttgcctgtgttttcagtgggtgggccgtggagaacacttgtgaccatcctaatttttacaaggctcttgctcagagatggccctggacatagatagcatctttaaaatgctttaaaataccaatctcagaaacaaccttaaaactcagccggctgaagggctcagaggtctccatgtggggctctccctcacaggattctccgtggatgcagcagcactgttcgttcaccctcactcaccgtgaccccaggaatcgggtttgtgtggcgagttaagacgcacaccctggggttgtctaaaatggatatgacactgaatggagctgcttgcccaaggacgctcaggcaggcagcctgcttggctgtgtggggacgcttaggcttacccagcccacacccctgtggcccatttcctaagaaaggtgactccacccttttgtgctgaatggctactaacaggacagttctggcacaaaaatagctctcccagtttgtgaaagcataattagacttccctgacattacaagttatggcaaggcccaactagcaaatattattgcagtgtttaaaaattgtatcatttctgcttctggtaaggccaaacgagaggcagaatattttttctaaattgcttgtcatctccattgatctagagagaggtgagtgtggacggtctgaatactcactggttgtagacactgagacgagtgggctgtactcacactccccagaggggctggtgaccttcaggcgaaatctgtacagcgtccttggttccagaccttcaacaacatgcttcgttgcatatcccctagacaggaggagacaaacatgctgataacaccaggtagcttaatctgcactctctgataagacagcagaagagcaggtggaagtgattttccttctatttccaggacacagccgatggatcctgctttgctgaactccgagagaatgaaggacaagtcccacatggcgccccatccctatccagcaggtgcactctgtcccatagggcctagtccagggcctgacacatagccagcatactgttttgtactttggagaaataatcacgttaaccacgacatttgccctcaagtaacaaagttttatatttgaaagataagacaggcagtcaaatcatatatttgtaattttcaagtgggggccatctagtgatgggggctgcaaggctaatacatggctgtataactattgcaggcaaaataccactgcagggaaaggacctgaagaagtcacatgcaagattgctcgtagtccataagcaacttccagtagagctgggagctcaggcagcacatagaagacaatgctaacatcatgccccatggtcaagttcatcttaggaatgtttgtgggaaatggatgctgagcacttctgggatagaaatctgatgagagactcacgatggaaatccacacacctccagagggaagtagtactgagtctcatcatttgcagtctgcaaaatcagcaccaagaaatgcctgcctgctcagaagatgctgggacctagcgcaagtgctaagataagaccccaccttctgcttgtgaggcaggtcccaggagcctggctttgacttggcatgcattctacaatatcaggtctccaaaagttgacagagctgtatatatttcccagtattacccaaaacctccatgttacccatttctcttttctgccaacattctttcttcttatccgactaaactccatgtatcccttttcaaatcttatctctaaatttttcttttcttctactcaaagccttggtttttgagagggtgtgtgtgtgtgtgtgtgtcatttccagctctttcttctttcctgcttcaacacttaatccagttcttgttctcctcccttggaccattctccatagctccttagatgccaaggttaccattgtttcctcctttttttttttcctgtctctagtttttacttttattctcaatagatcctccaaagataccagaatcattctttgtgattcacaactaatttttccaggatgtttatgtgcaactaaatatttatacatcaattccattccatacaactcaacaagtgtatctagtgcccattatttgcaaggtgctgggacaggctgggatgtagtcctgaaccagctcagggccaaaatgaacctgtcaacactgagttgaccccaacttcctactgatggggtccaagaaaaggggcagtcaaggacagtgaagaagggacaactgagcaagggtgaaatgacagtgctggagttagcatcactaataaacacttgaaaacctgacgtcagatctggatcaggtgggtgagctaacacctcacctaatcatcaaacagccttgcccactcactcccagcccccactggattctttctcctaaaggacgaggcatggcacaaagtgtgtggctaaagaacagacccaacacttgtcctagagggaggagtatccccaaaggagaagccagaaggtctaagttccttccgccaaattcatccatcaaacaagtaattcccccactgaggaacaggcatggggcaggaacaggtacctgagaaacaggtacagggcagagggaatgaggtgccaggacagtgtcctctggttgaggtatctctgatgtcaagtgagaaatggcataaaggacttccatgacagacaggcagacgtctcccaggcagtctgagaaagggacttcccagtagggttgaaagaacacacaacacctgggaaagtcatggtctaggtactctcactgcggtgagtcagggcgcagaagagtctggcacgtccaggaaagaggtgcctccgtgaaatctggagacaactctaacatcataattctaacatctaacagaacctttttttgaaaactgaaaaacatttacaaagactttcttcacttgatgtttctgtcctttgttaaaatgtgaaatttcaaggtaaaatcaaacactgaacgttcactgatcctgtttttgcatcacaaagttacttcagacaccaaatctaaatgacttctcgggtgtagcaccagcagagccaagaaaaagactaagcacattgaggcacctctgaccacgtacgtgtctctgcctccctgctctgtgctggtggattcagtctcctaactgacatcatctttgccagaaacacatttctcttcacctaaaagaagccaaatgagctggaagtcaagctgacctccacagtctccaccatccccgcaggaacatgttcctcccccgccagagttagagtctagttcctctccccttgaacaggatgggaagtggtagaagagaatctgtacagctctgggtctgggccttaagatgcccagaagtttctgcttctcctcccttggaagcagggaggagaagctcaacttccctgttagagaaagaggccacctagtaagacagtcagtggaagatccagaccacaaaggagatgaaaaagcccagccagtctcctgctgtcctggccatcccagctgatgcatcacacatgggtgaagccatttggttcttccagccccaagagagctgcaacggccaagaccacatggggcagaaacaagccatcaacaccctagccaaattacagatcatgagcaaacacatgcctgtttctgctgtcaaccactaagtctggggctggtttgtcatgcagcagataactgagatagtatgtatcaacaaaaaagaaactgtaggaaagacaatgaagaaataacgccaatggcattacagaaacttttcgatcaagaaaccgagaagtagataagtgttaaaaattgatataaacacatttaccataaaagtaaaagctctaaaaccaagataaatattcagaaaaaccgccagggctaaaaagtaataatttttttaaaactaaaatgtatcagcctggcacaaagtagtcttatgagtaggtagattttgatgttaaatgaaaataggtccatgaatacttagatatttgagtcatagaaactgagccctcaataatgtgtggcatctgaaaagatctttagaagttcagtgagaatataatagccaagcctcaccagaattcagtgcaaggtgtcaaagacttagcatagcattagaccaaaataaaaccagaagtgctcccaataaaattcagtattgctaaatatcataaggtcaccctgaagcaaacagcacctccataacccctggaaagggaaataacgcaactgtgttagaaaccagatgttaccaagcacgcttgtcaaaggctgaagattcttgcatcactagagatggctccaaagaggacaaaagccacagcagggaccaggacacaactgcccaccagggtactctacagcgattacaacacaggcgcagggaggactcatgagagcagttcattgaacccatggagaagcgcaactttacctagacatgacagctgaaaaaataaatgaatcttagagtgacttccacagtagaggaaagtctacaaaaatttaaagcatagccttgtttttgttatcagtcaataagcaaatgtttgatgcaagagctgagcaaatatgaaacataagaagctaaataaatattgaaaagccccaagactcagttaccagacttccctttcttctctaaactccctcccccagaattccaatccagcctcatgctgatgactctggagtctgtctctccaacccagaccctttccctggcccttgacatccccaacaccctccctgacatctcggcttggacgtcagacagtttcaaactgagcatctactccacccacagtcttccccatctctgttattacagttgctcaggccagaccctgggtgcctcctgtggaagactggattgttgttcagagacacaaggtgccctcccacaaggattctatctacctccccgccctgttgaactcggacatggctgcatgtcttgctttgagcaatgaagtatacacagaagtgaagtatgtcattctgggcagaagcttcaagaaacagcatgccatgctctctcccctgctacagtgactgacaatgttcacgcagaggctgccgcatggcctgggctgtggcaggaggacaatgcaggatggagccctggccgacccacggtgggcatggtgtgtaggagggaatcactgctgccataagccactgagactgtgacgctgatgcttccagcagcatcactgggcctgtgctggctaccacatatcccttgaccatcctctctctcacatcccgtatctcacatcccatattcggtccaccaccaagttcttaaatccatctttaaagcatatcctgcatcctcccactttccacactgttgtgttgtctcccacctaaactgtttcaaaagcttcttcatcagtcctccctgctgcttgctgcctggcctccctacagcctgttcccaactcagcagccagagggatcctcgtaaaacataagccggatcacacctcttctcagcttcacaatctccagtggctttccccgcctctctcagagtaagccagagttctcccaataaccctcaaggcccaggcagtgacctctcatgacccagctgccctcgcccccattattttcctccttgttccctctgttcctcaatgctcctgggaccagccaggtacatttgtactgccaggctttctcacctgccctttgctatgtctggaaggttcttcccccagatagttgcaaggctccaggtatccttgcttcagatctactcagaagctaccttcttggtgaagacttccccacctctaccccaggccctcaatttttcctatgctgctgcccctcagtatgtattgcctgctgactacctatttttacttatgtatcttatttattgtttgccttcatcatcatgagggaggaattttttcccagtgccgtatccccagcatccggagcagtgtctgacacacggcagacactcaataatacacgctgatggaataaatggaatgcgtggcatgggcagcaacgatcacaggaatttagggcacagacaatagggtagtaaggagagcttctcagtggaggtaaaatctgaccagggcagaagaaagaatagggtgagaggggaaaatctgtccaaacagggaaaacaactgaacacacatgcagaaaacgtcaaggcatattcaaaggacagtaagaaatctgactggagggtttgtgctgagaaataagaggcaacaagaaaggcaggtgtagggaaactgtgaaagacattaaatgttagtctaaggaatttggcctttatcctttaagcaatggaggacccaccaaagacaatgtgacaaaagaaagattaaaatggaaattagcccagcaagatagaatgatgagaaaaaaaaaaaaggaataaagtcaactccttccatcagaaaatacactgggcaggtgtaggagctggggatccacaaatgagctagacagaaataaagcctacatcctgcaggggaaaacgcagctaaagagggaaagcacagaagcaattctacaaatggagaactcagtaactgactggctatgagaagccatggaggaaagcccaagtcaaagacaatatcattgtttccagatagactgatgactgatgggaacagaaactgacaaatcaggaagaagttcttaaatccacaatccaaacatcaggtattctagataatcactttttacaagaaaagcatttgctagttttaatgctatgtagagaaagaaataaggaagcaaaagaggtcaagattaatgcagcctaattctgccacctagcgtcaagatttgtacttgtaattctgtgagaaacgcaggcatttccccactgtccttagagcagggaccacagatgtcactgccagccccacaatgccaggctgtcgtcagagtgagagtgcgttctccagcctgacagcaaccaggtctctggggagaatgcagacaacacagacacacacctcaggctggaagccagcacacgcagctatggtttctctagctgaggctgcctacctggccacccagcaaaggcacagccaaggaagaaagaacgatgcaggatggccccattcacctgcccaacacagcttgtggtgctaaggtgatgggggaaagaaagatgtctttttctttctcaagagaaatgtttctcataattcatgcttttagatagaaaaagcataccttcaataagtaaaacgacatgattaaaataacatttgagtagtcagaacaagaactatttttacattgcaactacatttcagatttttcttaaggtacagagaaatttctcaaatatcagatatattatcactcaagtaacagttgaaattggagctttcatatacagattatatacatatttatagatatttatacacacatacacataaacatatctatcttctcatgtcagcacttttatcacaatgcaaacttgagaaaaggccaggaaagtgatgaacctgttctgcatcttgactgcatcaatgccaatatcctgactgtgacactgcactattattttcaaagatgttaccataggggagaaatgggaaaaggtacaatcactctttcttacaactggatatgaatctataattatttcaaaattaaaagtttcactaaaaaccatatttgtatctcatttttggtattcctgaatcacaaaatagtcattttgcatttttcaagtggtaaatctatcaaggggaagaaataagtcagagatgatatgaagactaagaagaaaaacataacttttttttttttttttttttgagacagggtctcactctgtcacccaggctggagtgcagtggcacaatcatggctcactgcagcctcgacctcccaggctcaagtgatcctcccacctcagcccgggactacaggcataagccaccacacctggctaacttttggattttttgtagagatgggatttcactatgttgcctaggctggtcttgaacatccaggttcaagggatctgcccacttcagcctcccacagtgctgagattacaggcatgagccaccatgcctggccaaaagtgacttcttcattactcctggtggtattggttcatgccagaagcatttggaaggcctgctatataacagccagcactgtcaaggaaccggctagagcgttaagcaggcagaagtcttatttgtctctcactgagtttaatactgggtgaggaggcaggaaaggaacaagaagtaaacaagtaaacaacaaggtaaacaaactaagcaaacaagtaaacaagtaaaataagcccaacagagctaaatgctatgtggcatacaaaacaaggttctgagctacaggaggcctgcatgaaaggatggctacttcagatggccttctgggggcggggggatgtttcatctgagattggcatggtgtgaaggaaccagctgtataaaaacagaaggaaatgtattcaagaccacagcaacgagcaagatcctgcgatgggaaccagcttggcctgtccaggctgagaggcagccagcgtggtataagagagttgacaaggggacaatggtatgacatgagatcagagaagctagccagggtagaccatgcggggccattccacgtcagtgaacacaacagcctgatgggaagctcacctaattgcatcaagctattgtttgagtctgtctctacattctggattttaaatacatatcattaaaatatttcagaagtcaaagaagctctcaaaggtacagaggtttaatttcaaagttactgctaatgcctattttccaaaaattgtaattcataaaagagcatgaatacaaatgatgctgactcattctttaatttgaaacaagcagtggctttttagagacaacagaaatcattccagctaatcaggaagtaaggcaaagtggcaagcaattcaacactgcacctacgtataaatgataccataagtgtgcattttggggtcttcttcttcaatcgagaacctgaaccactgctcttgaggtccttggcgtttggctttcttttccagatcccagtataattcaatgctgtgatgagtcactttgcccacgacaggtggatgaggctttgagggtggcatgatttctaaaaaaaagaatgacaccgaacttcaggacccagtttccataaggaagagagaccagtcgagtggattacagctgcttggtgatcgagctatttttctgagcataaggcacacatatgagcatacctccctgttgcttaaagaacccctgaaaagctaaagagatacaaaattcagctgatgtgtgagctaccacagtcttcaacaagcatatattgtaccatgcccatcaatatcataccacccccactgacccttccaaagggctgcttaacatatcaaactaataaggttgtatttgacctgctggaactcagtttgcttctgtaatccttcagtgactaacaaagccaagagacaaatgctctatctgatccaagtatgtggaacatagatgacaaagggttgacacctatgctgtataaacagccctcagaaactaaccaggaataaaggcccaaggttagtaacaaacctagcaaaagatgagcagcacacaaaagagcaaaaacaaattgccaaggtaatatctggaaagatgctcatatcatcccctagtgctcacagaaattggtaacaatggggtataactttatatccagtcagaaactgaaaaagaaatttcataactattggagttcacaagatagggagaggatattctcatgtgccagttgtagtgaaatatgaattatcgcctttttagagggcaatatggaagcatctattaaaattaaaaatacacatatccctgtctcaccatcccacccctggaaacttctgcagaaatcagagcataaatacacacaagagtgagtggccaagatggctgactagaagcagctggtgtacctgactctcacggagaggaacagaaggggcgagtgaatacaacaccttcaactgaaacagccagatactcgcactgggactaatcaaggaaacaacctgacccacagagaacaaagaaaagcaagacaggacaatggccccccgggggtcagcacggagccaggggatactcccctgcccagagaagcaatgaccgaatgagcgacccagaaaccatgcttctcccacagatctttgcaaacctcaggtcaggagctctccacgtaaacccctctctaccagtgccttcagtcttcattctgacagagcagcgtggagtcttggcagagcagccgctcaggcacgcgtggagaccctggagccttagctactcaggctttccagcaaaagtagccgtagctctggcaaagtgagaggttagactcctgtacatacacttaggaaagaggatgaatccaggcagctaagcagcaacagcccccacttccactgcacctcacgagataagacccactggcttggaattccagccagctaccagtagcggcattgcaccaccctaagaaggagctcccagggggaggggcaggccaccagctttgctgtttgggcaccttagccattctagctttcaggctttggagagtccgagccaacacagggcagaagggatcccccagtacagcatagctgctctaccgaaacgtggccggacagctgctttaagcaggtacctatcccgttccctcactgggcaggaccttccaactggggcctctagccacccctgcccgagctgtccatctgacagatggacattgaatttcccctgggatggcactcccagagggagaggtaggccaccatctttactgttcaggtgccttagctgttccagcctttgagcctcatagtatccgaggcgatcaggggctgaagcggacccctagcacagcacaactgctctcccaaaatgtggccacttttttaagtgggtcccaatcccgttcctcctcactggccgggacctcccaaccagggtctccagtcacttcctacaggtgcctttgggccgacaccaggtccatacctccctgggacgaagctcccagagggagggacaggctgccatatttgctgtttctcagccttcactggtgacacctccaggttctggaaaatctgaggtgactagggactggagcaggccccaagcataccacagcagccctatggaaaagtgggcagacttgtccatatctcctcactggacaggtcctccaggcctgggcctccagccacccccgccagagctgtggagccagtaccaactcagcaactccccgaacagagcctccaggggcaactgaaagcctctctgccactatctcagcagtggaactgcccttgccaccttcaaactaacaaaggagcaaagactctaagagtaccttatctacacctccaataagctacagtcgacccaaggagaggcagccagtctgtctcctacaggtcccacacccactctccccagcatggctcatcaccagacagggaacccctggcttgggcacacagcacaaaccctacatcttgggctgactgcaccaagtgattgctgacccacatctctctgaggtggagcaagcaaataacccccggccacaacccctgctaagatctcttcctctgctgcctctaagctgagaaaggaacataaacactgagatcaccccagagctgcagtgggcatcccaggagtgccaaggagagccagcactcaagtgggagaggaacacacagtttcagagcactgaaagggagcatgacggaaactgtgaggaaacaggggagccacgcaaccaaacaagagtctagcaactgaccaattcacctaagcgccacctactggatcacaccccaaagcttcaataccaaaaatacctcattaacatacccccctctgaaaccagagacaacaagtaagcttcaaataaagaccctacataaagcatcagcccagtgaaaacatccagaaaagaagtctgttgaccgtactcaatctacattaaaggaacacccacactcagatgagaaagaaccagcaagaactctgataacactcagatggccagagtgtcatacgccctccaaatggccacaccagttctccaataagagtttgtaaccaggcagaactggctggaatacagaatatggataggaacaaagatcactgagattcaggaggatgttgaaaccaaatctaaggaaaagaacaatcacagtaaaatgatatagaagctgaaggatagaatagccagcataaaaaaaaaacctaacgggtctgacagagctaaataatgcaatatgataattttatgaccgggcacagtagctcactccagtaatcccagcactttgggaggctgaggcagatggattgcctgaggtcaggaatttcaggacagcctggccaacatggtgaaaccccgtctctactaaaaatacaaaaattagccaggcatagtggcaggcacctgtagtcccagctactcaggaggctgaggtaggagaatcgcttgaacctgggaggcagagactgcagtgagcggagattgttccactgcactccagcctgggtgacagagcgagattccgtctcagggaaaaaaaaaaaatttacaatgcaatcacaagtattaacagctgaataaacctaactgaggaaagaatctcagaacttgaagactggttctctgaaataggacagtcagacaaaaatgaaaaaataaataaaaatgaataaaacctcagagaagaatggattatgtaaagaggccaaatctacaaatcactggcatccctgaaagggagagagaaagcaaacaacttggaaaatatattcctagatatcatccctgaaaacttccctaaccttactagagggacctacagtcaaactcaggaaatacagggaactcctgcaagattctacacaagaagatcatcttcaagacacataattgtcaggttttccaacgttgaaatgaaagaatgttaaaggcagctagagagaaagggcaggtcacttacaaagggatccccttaggctaacagtgaaaccctacaagccagaagagattagaggcctatattcaacattctttaaaaaaaaaaaaaaaatcttcaaccaataatttcatatcctgccaaactaagcttcctaagtgaaggagaaacaagatccttttcaggtaagcaaatgttgaggaacttcattaccagacctgccttataagagatcttggaaggaacagtaaatatagaaaggaaagaccgctaccagctgatacaaaaatacacttaaacacacagactagtgtcactgtaaagcaaccacacaaacaagccaacataataaccagctaatgacaggatcagtgacagcaccagctgacaggatcaatgatatgatcaaacagcacaatgtcaggatcaaatccacacatatcaatactaaccttgaatgtaaacaggctaaatgccccacttaaaaggcacagaatgggagaaaatatttgcaaactatgtatctgacaaaggtctaatatccagcatccataaagaacttaaacacatttacaagagaaaaataaacaaccccattaaaaattgagcaaaagacataaacagacacttctcaaaagaagacatacatgtggccaacaagcatatcaaaaccacaaagagaggccatctcacaccagtcagaatggccattattaaaaagccaaaaaaataatagatgctggcaaggtcacaaagggaacctttatacactgttggtgggataaatttgttcaacgattgtggaaagcagtatggcaattccacaaagagctaaaaccagaactgctatttgacccaggaatcccattactgggtatatacccagaggaatataaaccattctaccataaacacacatgcatgtgaatgttcactgcaggactgttcataatagcaaagacatggaatcaacctaaatgtccatcaatgacagactggataaagaaaatgtggtacatatacactatgaaatattatgcagccataaaaaagaaagagatcaggtcttgtgcgggaacatggatggaactggaggctatcatctttagcaatctaatgcaggaacacaaaatcaaataccgcatgttctcttttataagaggaagctaaatgagaagaacttaggaacacaaagaaggaaacaacagaccctggggtctacctgaagcgggagggtgagaggagcagaaaaggtaactattgggtattgagcgtattacctgggtgatgtaatactatgtacaacaaactcctgtgactcatatttatctgtgtgacaaaccttcacacgtacccccaaacctaaaataaaaattaaaaaaataaaaatagatacacacaaagacacataggacattactacagttttcagcagtttacaacaaaacaaaacaaaagatgacccatttataagagactggacaaataagttattctatgtccataaagtggaacattatacaccctttgaaaaatgaatttgttctatactaggtgctttgaaaggacctccactaagtattgttgggtgagaaatcaaggtgcaaagaaaaacacagaatatctcatttttgccaaaggtaacaaggggtgcagtagagtgtataccaagctgtgtagcatgcaattgttctatgttagttttgtctcccctgctacactttaagtttcttacaggctgggtccatgtcttacacttcctttgaaacttctccctgtaactcaatccttcttgagcctcaaatatatcacagatttactgcattgttcatttaaaaaaaaaggatcttgtatttcccttgagccagtgtcccaagtagctgaccagcaccctctgaagacccaggggtcttcctgcagtgcagacccactgacgaagacagggctgccctggtcttgccaccccaggccagtggggcacacagccaacaatttcccttacacgaagaccccagagatatgctaggaggcagcctgcaagctcactttcccaactttattttccaaatgtttatagaaagcatgatggaattggataaacctaggtttgaatatgttctctgaaactgagttaaaaataccacaaagtgttttgtgataattaagttacaaagtatctaaataaatgatggcatatttcctacagtaaaatcctatacaacaactaaaagaaattagctgtatgagttttgtatacacctgcatcaacatagatcaattcaaaatggatgggtggaaaacatgggttgcaaaaggacacactacataacacgcaaaaaacactacatgttatttatgaatgcacagatatgtagtaaaagttaaaaagctgaagggaagaacatacaccacacctcaacaacataacggaagggatgggggcatgatgggcaggaggggggtcttaccagtatatttgtaaggtttgatttcttcatgaaaagactttatgacatatatggcaaaatgttaacatcttaaaccaaatggtacattgagtacattaccatttgaaataattttgatatgtttaaaatattagtttttgaaaaataaccataaaaatcaacagtatacattacccttacgggcctcttggttttcttagagaaaccaatttcagggttctagatactgagggatacatgtggaagaaggaactactgaaccagacactgacctcttactgtgagtcatctcactgaatcccagcaattctggctggtgatgtcacaatgactcacatcttcacgtccttgtatcatgacatcagtgttgaacaaatgatttttttcacagcccactaaaaccaaacaccaggaatggtagactgttatggattacccccaaaataaccagaagccaacaagtatttcaattccaaagacatccagcctagaatcctactagagatcagaacaggcaagaaattctaaattaatgtcaaatttcaaaacagttcaccatgaagttatatgaggagtaaaaagataacattcccagagacccaaaagtttcttatggcttgttctttactgatcattgatgtaggtacataatgagagatctccatcagtgagcttggcaccagccacaggtggcccactgccaccagagctgggcacaggcccacttccagctgctactcatgatggagcaaaaaccctcacttctagccatcacccctccagatctggtacagagcccggaaaaggtgggtgtggtgcttggaaagttggttcgtgtgtgtgtgtgtgtgtgtgtgtgtgtgtgtgtgtgtgtgtgttgggggcaggtagtgatccaaatgtaatggcagcatggtctctccaaggaagccttaggtgtgagtgaagcctcagtgaacacacacacgtgtcagcaatggaccagctgctgccaaatcacacaactacgcaacacgttgctcagaaatgccaatggttagtgtacgccccactgataatgttcctgcatcttctttactttcatacaaaactcatcaagatgtaaatctccacttaggcaagagttgctttttgcaaaaagctattattgccagataggacctggatggtcaggtcatgaatgaatgacctcatcaggtaagagctagttattttcagaatgccaaaaaatagtggatgggacccaatttgttttgctttgtttctaagccaacctagagtaatttgacaggtgtatcctaatccttacaatattaacccatatactttctactttctctttgataaaaattctggtgtttttgtcatcatctgctaatatacatattttaggatattggttttaggatcctaaatatgtatatttacaggtgactagcagagtgcaaacattactatgacaatggagcagaggcccggggcggcaccgagccttggtaagagccgacagaaatggcaggtcacaggccgttactgaggagaactgcaatgcggcaacacttatatgacacttaatttgggtcatgtactagtgtggatgctttatttattcatttaactttcaccacatttaacttcaccaactctatatgctgtaaggatttttattatctcccttataaacaatctgaggcacagagaagttacataacttgcccaaggtcacacagaaataactggtagaaccaggattaaaatgaagataatctggctcagaagtcccttacttttaaccttgtaccatactgcctcttaagagtagagatataaaatgtagaccggagcggccgggcgcagtggctcacacctgtaatcccagcactttactttcggaggccaaggtggacgaatcacaaagtcacgagatcgagaccatcctggctaacatggtgaaaccctgtctctactaaaaatacaaaaaaattagccggccgtggtagcgggcacctgtagtcccagctactcaggaggctgaggcaggagaatggcgtgaacccaggaggcggagtttgcagtgagccaagatcatgccaccgcactccagcctgggcgacggagcgagactccgtctcagaaaaatgtagaccagggtgaaaaatctactattagttcgttctccagatttccttaaattattcattttaaatcaggtctagcttgtgaactggcttgaaccccaaggaaatttttaaatgatcaagaaaacttggtcagaaaaagtgagacaatgcaaaccaggtaattgtttgaataaagtagagagatgttgtgtgcaagcagaagagaaggcaacttattatagcaccgaggtcagggaggctgctgaccttcaggagcccagtccaggaaaggaaagatggtatagaaagcccatagcaaccagtagtggagaccaagaaggcagagagtttgactgatgtttacttgcagacactatgggaatgggtaggaagccagtcaaatgctgcattaggttcagcatgaaatctggaagaggaagagttgcatcaacaggagggaaaggctatagaatgtgggtgaaacaattagcaagatagctcatagataaatctgaaaagattgtatatacttagggcagaaagcacatatcacagtggaaaagtactctgaatttactactaatacatgaacaagtctatttgtaaatgttatcacccccaagttttataatacagctaaagttgcaaggagaggtaagtatatctgtgactatagtcctggctcacttgacactaggacttaaccatgctggatgtataacaagtaacacatctttcctaaggtgacaaaaatcaacattttgaaaaattcaagctcaagctctccctctccctctcccgtctcctgctttccacggtcttcccctctccctcgtctccatctctcactttccacggtccccctctgttgccgaggctggactgtactgccgcgatctcggctcactgcaacctccctgcctgattctcctgcctcagcctgccgagtgcctgggattgcaggcgcgcgctgtcacgcctgactggtttttgtattttttggtggagaaggggtttcgccgtgttggcccggctggtctccagctcctgacctcgagtgatctgcccacctcggcctcccgaggcgccgggattgcagacggagtctcgctcactcagtgctcaatgctgcccaggctggagtacagtggtgtgaacctccacctcccagctgcctgccttggcctcccaaagtgcggagattgcagcctctgcccggccaccaccccgtctaggaagtgaggagcgtctctgcctggccgcccatcgtctgggatgtggggagcgcctctgcccggccgccccatctgggaggtgaggagcgcctccgcccggccgccgccccgtctgggaggcagggggcgcccccgcccagcagccgccccatctggaaggcaggggcgcctctgcctggccgccccctctggggggtggggggcccctctgcccagccaccacgtctgggaagtgagaagcccctctgcccggccgccaccccgtctgggaggtgtacccaacagctcattgagaacgggccatgatgacgatggcggttttgtcgaatagaaaagggggaaatgtggggaaaagaaagagagatcagattgttactgtgtctgtgtagaaagaagtaaacataggagactccatttcgttctgtactaagaaaaattcttctgccttgggatgctgttaatatataaccttacccccaaccccatgctctctgaaacatgtgctgtgtcaactcagggttaaatggattaagggcagtgcaagatgtgctttgttaaacagatgcttgaaggcagcatgctcgttaagagtcatcaccaatccctaatctcaagtacccagggacacaaacactggggaaggccacagggtcctctgcctaggaaaaccagagacctttgttcacatgtttatctgctgaccttctctccactattgtcctatgaccctgccaaatccccctctccgagaaacacccaagaatgatcaataaatactaaaaaaaatttaaaaaaaaagaaaaattcaaaagctgatcttttttgctatttatttaaccatgatgtttatatccctatctgtatttatctgttatcagtacaaacactcttgagaactgtttttatagacgctctattcaagttttataaaacagatacaacacacccacagatacacattcatagacacaacttacatgctactttttatacaaaagttttagaactattttttcttggtcataagtaagtctcagatctttcaaaaggtacttttttttttttttaagtctgataaccagcatccaaatttaaccaactaatttcatcacaaagtcaggctttaattttattttaacttttctaaagattttgttttctaaaaaattttctaaagagtttgttttctaaaaaaagcaaaaagaaaaaggagaccttatgttcaattttcaatggttctttcaaataattggtaggatcttttcatcatgacaaatatttcttattttaaaagtttctcaaataatgaaaaaggaagaacaacagtaaaactacaagaagtacctcaaaaggacgattatgagaatttatggatgtgttacgtaccataaaagctttttgtaagaaagttcttatgcaaatctgacaaataaaacaattttatgcctctggtgccacttgtcaagtaataaatgggaatatagaataataaagggcttcatacactgtcgccactcagtccctatggttactcagaagatggcataaaacatggctcaagtacatcagaaaccatagtaaaaaggtatcactcacaaattataggtttgaacgtagaaaactataaaatttatgtaaaccactacacaatattaggcttagcatcctacattttttaaaaggattgtaaaagaaatgcaccaagaggagactcaaaaaacaaattagtaaaacaaaaaaaatcagattattcagcatctttatgataaatagttgaccatatctcaaaagctacagagagaagtggtgatcatacactgtattggaatttgcaattgtgatttgtatcatgaaaagtgggaaatgataaagaaaaaaaacaaatataaatatattcactatataaaaacagaacaccttaaagcagaattgtagtttccctgctcttccaaaactcatctgaaaatttaccgaagtcaaatttcactggcaaggggcatctgcagtctagcctccggtggcatatggtccacagtgaagatgactgcacactgagggggatgctatatgagaacagtggtggctgtcacctcaaagcagtttatcatggcttgatcagatatttacagcaaccattaatcaaaaatacgttctaggtcaggtgcagtggccaaccaacatctgtaatcccaacacttttggaggccaaggtgagaggatcacatgaggccaggaagagaccagcctaggcaacctagagagaccctatcatcatgccactgcactccagcctgagcgaaagagcaagaccctgtctcagaaagaaaaaaaaaaaagaagaaattaaaataactgtaaggtaccattttacctataaaattatatgaaaaacatgtaatggtaataatattcagtgttgtttaagactgtgataaaaccgttttagattgagcattacactgtatattacacaattctttaaaaaaacaatttggctgtattcaaaaatggttgtaagatctcctactttgtggtctcacttctagaaacacattcaagaaataaattcagaaatcaaaaaataaatataaaagctaaaatgtttttgcattgtatgtgcttttatttttattatgaaaaaagtttctgtctgggcatgctggcacatgcctgtagtcccagctacttgggaagctgaagtgggaggatcagttgagcccaggaggttgaggctgcagtgagctatgattgtaccactgcatcccagcctgggctacagaatgagaccctgtctcaaaaaaataaataaatgaataaaaatttcaacataaaaagtagaacgaatagtatagcaaatcctcttgtatctgttacccagcttcaattatcagcacaattagggccaactctattttacccaggagtccatccaacatccctgcccaaacctgggttatttaatagctaagttttcacaagactttgtatgagtgttctaaactctttacatatactatttaatcttcacaacaaccttataaactgctataactttcctcctaccttttacctgtaagactggaggcacacagaggtcccataatttgccggggagtccatgcaacaagcagcagagccaggattcaaacccagggagcccaactccagcggcgtgcccttaactttccatgtgctatctactactgccctatgtttaactacatacacacatgcataaatcacaacaaaaaataaaaaccagagaggaacactttaataccactgacagcaatgaaaactaatctaaatgtccaagaacatggaatttgttagatacactttggtacattatttatatacaagaatatttagtcattaaaagtgtggaagatgatatactaaggaaagggtacgaacttacacagatgctatgattataatggcataaaatgtacagatgcacgcagacagaagaactgaaagaatttagaaaaacaaaagacaaaatagtagcattatggctgattttttggtattattttaagctggtatagtactgaataaagggggaaaaaacaaaatgtaactgagcacttttacttattcttatggaaaaaagattcagctaagacaaactactagcctagactcttccttgctgagcttatacatatatgatagcaacaagtctgataaaaataaaccaagaataagtcaatgtggatgcttcaaagcatgagacacttcaattacactctggctcaatttattgaccattttggtgtcaagcagatatcctgcttgacatttatttccaaggaaaaagtttacttacacccattcattcagcacacttgtgggatacctctcctgtgtcctgagggcacaggtgtaaccaagatgaccaagagggaagggcaaagagaggagcagggaacattggacaccaaacaaatacaaaccaggtgcatgggggaggcaggtgcagagggagcctacaggaagacgtgttcaaaatgcatatagtttacatatattctaatctgggaatgaggtgccttaagtgaggtctcgggataaagaggcaagtctggcagagcctgcaggcaaagaatacatcatctaatgaaaacatttcaatatacttaaattttcttatattttttatcccaaaacattccttatcctttaaaagtaagtaacgtaagtgcaaactgcccaaaagttgctttcctctactttgctagtaagttcttcaagggcaaaaatcagttcaaacatcaaaaaccaaatagcaaaaacaataaaagacaaaactccctagagtagtaatggggaaacattgcttccttttgtgtctctaccatggatattcctcatcaggaaaagtgggggataagtaaggatacctgtcctgcctccctctcagatttactgcaaacaaaaaaataatgtgacaaaatactgaagtgatttgaaatgtataaaggacttcacgaacataaggtagtgataatgcctttgaaagtcacaatgctcacctatttcacacttttaactacaaggaaaccctgcttggagttctatatgggtaacaggtagtaggcaaagaaggaaatgtacttcccaagatatttcctttacttaattacaacaacttcaatttactgcaggcttgctctaagcaaaaaatcatacaggacacttggtcaacaacggattcaacctcacgatgatggggtgttctcaatttatagatgaggacagagaggaggagaccaaggctcaaagaagtacagcagcctgttcaaagctacagaactgataagtggagagcaaggatttcaatccagatctctaactccaaaatctgtgctctttcccccacaggctgtgcctggtatggagctcctgagatcttctatggaaatgcacactgagtgtgtaaaatgacaaagtctttcacaatcagataagaaaagccaaattgttatatatatattctttagacacagtatgtcacaagtctaaaatatattcacagtaagaaatggtaggatactttcacaatagcaaagtgttcaaatggatcagcttatattcactctt

SEQ ID NO: 12242 - DNA, 83343 bp, Human
gtaaccgcaatccagatcccatgaaaaaataagggcccaatgtcaccatgtgttctgaggttttaaaagaagctgaaatgattctggattttgaaatgttggcttggcagggcgtggtggcttacacctgtaatcccagcactttgggcagcttaggggggtggatcacctgagataacgagttcgagaccagcctggccaacatggtgaaacccagtctctactaaaaatacaaaaattaactgggtgtggtgacatgcgcctgtaatcccagctacttgggaggctgaggcaggaaaatcgcttgaaccaaggaggcagaagttgcagtgagctgagatcacgccactgcactccagcctgggcaacaagagcaaaacgtgtcaaaaaaaaaaaaaaaaaaaaaaaaggttggctcaaatttttcatgaacattgagtgcagcaaaaaaaaaacatgcctgtccaccaagctgtctgtgggccatgtttggtttgagaatcctagtttattctcgggtcccttaaggctctctttgatgctcattctgatgacattacactaagatttactgattgagggtacggacacttctccatacacacttgcccaggaacgatctccagttacctgtcctgtctccaagatcttctctctctcatccaatcttgcctatgcagcattctattttcagagtcgtctttgctaatttggggaagtcacttattcaaacaagaaagtggttgacaaatgtttagcaatgaaatctcccgcgagttactactttttaattaggattttcaaccctaagaaagatatagataggaggaataagatagggggaataaggaaactaattttgaggggtttccctgcctcttaggtggggtttatcatattgtgctgaaactgcttattcgtctagttctccagaccctgggccatttatcttacgtatccctatctctgagcgtgtagaaggcgctccataaaactgttggtttgtgtaaatgaccgaaaactacatgcagcgtgagggtggatttccctttgacttcggcttaaggaagaatcgttcccatgatcatcccacaattcatctaaacggagataggcaaggagcaactgctcaaaggcaaagcgctggcagctgaggcacagctccggttcggcaaacgtctcccgagtgccaaacgtccccccaaacgcctaactggtcgtcagggcgcagaaaagaagcttggggggcgcggtcttcgccccagctccacttcggtgcttcacgattccttctctggcctgccttcctgataaatacccggtgaggtcacctaaacgctctcctctctcagttatttgcttctttccaacgtttggcgcccagctcccgccatcggagcgccccgcccgagaccactgatctcctggggcctcgcagccttgcttccgaacgccaaggtcgcggtgcgccggggtagcgaacggccaggcccgaaaccccgccccgcagctaaacgcccggcccgctaccctgcgcccagctccagccgccgggtcccgcctgggcctctcctcctgggaataccgggcaccggtggccccgcccctacctgcgcgccgcatctccgggaacaacagtctccctcccgagcatcacagccagacatggcccagaccagggacccgcgcggcctccaatctccgcacggctttgcgcgcggcgcttagcctgggatacggcagcgaggccgcaaatgcaatcaggcggcgctgagggcagcccgggggcggggcgaacggggcgggggccggggtctggtaaggccccgccggctgagatatccagcggcgcacctgacttcccgggaggcaaggccaacgtggttggaggcggggctgggttggggggcgggggttcaagtctgagagacctaaaggcaccgctagcgtctgggggcgtggccaaccatgcgggaggcggggccttgatgctggacatcaggctgtgctgcgggcagccagtgagaaggccgtcaagatggcggcctcctggaggctgggctgtgatccgcggctgctgcgttatcttgtgggcttccccggccgccgaagcgtagggctggtgaagggggctcttgggtggtctgtaagccgcggagctaattggagatggtttcacagcacgcagtggcttcggggtgagtggccggggctcgctcagcttctctgtgtagctgagtgatgggcctgggacaggggcagttatgattgagggcctgcttttgggtgtgaaggtgcgcgggctccttattccctttcctctttctccggttggggtccgccgacttggcctaatgcatgctgtgaagggctttcttggcagctgagagaactcgactctgccctaggccccctggtttgtatggctttgtgaccttgccttggaatttgggttatttgtgaggcgcagagagggttcccaaactctcctccctcagccccctttccaatcaaggctcaggtttctttagggttgtcaaacgtctcggacgagaaaaagctgcccaaggttgccgagattgaaaagccactgttgggagttcttacttattctctaggcctctctctgttaggaggtgttttcattgaggccagtcgagttttaccccacgccatgactcgtggaagacttaaatttgtaaattcctacggcatcacgatagacaaaggtccaggagaatgtttcaagcaaatattcgcttgaaagagcaaacatttaggagataaatcataccaaaaatttattatagaaaattgttgtttagtaatgatattgatgcagttaacacaattcttgcagtatttaacagtatgcaaaatggcaggccgggtattatttttccttattttgggagaaggttggagggaggcggggatggagaataggactgacgttttttagtgtgacgtattacctgccaatcatcgttcctggcactctacagaatgaattttaatttaaataggtctagtagacgttgccttcatattctgagctaccttaggctcagaaaaaaaaaatcacacaaagtcatatggtaagatgagtgtattggggttcctaaaggttccttaatgggaacaatttatttcatttttggtgtaatgtttcataacatattccttggagcagaggtgctttaacagtgtgtgcagaattccttctcttccctcctccaagtttgttgaaattaaacttttttccagctcctagagattcggtctggtctggtgtggggctcaggaatctgcattttacaaatgttggatgagttttgatgttttattttgacatttaatggaatgagctttgagactcactgccttagaaaatcatggaatattaaaagtttagtattggatataatctaggaagagtgctcttaatcttgtttatcaagcagatccttttgagaatctttgaaaatgttacagactctctgtacagaggaagtaccataaatggtcacacacaaaaatgtgcacgtagtggctcacgcctgtaatcccagcactttgggaggcgaagctggaagattgctagagcccaggagttggagaccagcccgggcaacaaagtgagacccccgtctctacttaaaaaaaaaaaaagaaagaaaaaaagccaggcgtgctggcatcccagctactccaggggctgaggcaggaggatccgttgaacccaggagttagacgtttcattgagctatgatcctgccgctgcactttagcctgggtgacagagtgagaccctgtctcaggagaaaaaaaaaaaaaagtatacataggcccagtttaatgcctttagaaactcagttaggcaagcaatccttatctgcatcctcatgatgcttttttacctattccctatcccctagacatataccatgaacaacttgtctaccccagtttgaataccatctgtcaggaagaaggcatggcatctcaaggaaagccaaattagttttctagtgctgctgcaacaaattaccagaaattagtggcttaaaacaacacaaattcacatctcatagttctagaggtccgaagtccaaaatggatctaactaggctaaaatcaagctattggtaggagctgcattcttttctggaggctcgagaccccattcccttaagttttccagattctagaggtttctaagattctttgactcatgggcttcaaagtcagcaatggctggttcagtctttatcacattacgtcactcttaatactcccctctgccttctgccacttacaaggacccttgtgattacattgggctcatctggatgatcctgaatattttccccatctcaaggttgagtagaaaccttaattccatctttaaccttaattccctcttgccatgtaacagcatattcataggttctgggtattaggacgtgaaccttttgaggcatggcattctgcatgtgaagctgtggaaagtatttggaaatactaagtatttggaagtgttggacttttttcctaataccgagccaaaatatatccgcttctgactttcacctacatacagatttttgttttgccatgccgaaaacacgtggcaatccttgaactatttgttttacaaactgtgaatttacggtggtgttttttctctgagcttggtagaaactgtagttttataaaactaaacaactatttggattactgtaaactatataaattaagtacatttattgaactgtttcgtctttcacacaaatatctttaaaaatttgtcagtcggaactacctttggagttttaatttccttaagaggtgctggcagcatttttatgagctatgacatatgccattttcttagcactttctagaatttctcattcacttctcacataacctagtaaagttggcatcatctgcatttagttggacaaaaacaccaaggcttagagaaattgagtctcctaaagacatgtaactgtgttgatgaactgaagtgcatgtatatatttatatacatatattaatttgtttaacaaatctttaatttgtatcattctctcaacagatttattgagaatgcagagactatcttttttaccacttacattattgaagaatgagtgaagaaattagcatctattaggtgccaggcacatggtaccctgcttgggaagtagtggccagctgaatcaaacagattctcagtatttgccacatggcacatttaatcatacttagctcctggacatgcaatccaaaattctatatagggctgatccttaaggtatttgtagtctctttggggacataaacaataaaggtatgatttcaatagtgtatacagtaagctcagagggggtaagtttgaaatgatcaggaaataatatataaggcagcttcttagaggaagaggtgacagcccttacaggctgaaggaacagcagaaacaaagacccagagaccagagtgatcattatataattgacacagcatctgtaaacagtttttcaacctactctagacagttaacttcagagagtttaaattgtggtcctttcagagtaggtagcatgatttggaatataattggtaagatgttaattaatagtattggttttaagttgtctctgaagaataacatgttgaatttaaaataacctgtgaatagaaaagtaactgaggttcaatcttggtggcgatttgcctagtatataattataggcaatacatattatagatgttcaataaacatatctaaggaagctagtaatctaggaagttataaaagaacactagagcctacagtaggattccaagttggcagccagggaactgacccacattgttttagcagaaaaacttatggcaaaattttaaaatcaggagactttacagagaaatctagatttttgttctctctttaaaattgatagttaaatcctatgtggtgacaattatctaacactgagtaatgattgttctttttaggtaggaaattgcttcctactttgtcactatgccgcctactctgtattacatcttagcaaggctgaatgtcccttggtatttgcatcacctctagttgtcatttttttttcttgtactcttatctctacggaaggcagaagacaaaagaccaagaaaaatgggagaaagcagatattgtgtatatgtgtaaaggaggaaaatgcttatccatttaatatgaaaataaaggatgtcagaatctaaagaaaaaacctgaagatgctagtcctcttctctcacctgcctgttttttgtaggcatctgagtttttgacagcagtgctataaccaggagagagggaacttctttgatagagttaatggtatggtatttctgccaaaacacggatactcttttaggcctggttcttattaagtgcttatacactgataagattgatattctcctttgaattctcatttaactgtggaaacagaaacatgtagaatagctctagtaaaagtaggatttattaaaaggatagaacatcacttataaaatgctgcagggccatggggaaaccataattattccatctatttcttctagggctcatattatttgtcttctttctcttatttactttgttttcctgtacagacttgcaattatcaatctgtttactcctggcttttctttctcagtgtcagcttgccttgcctcagtggtgattcaggcctttatgcacgatgcgctgtcagttttgtttaagtgctcaccatcatttctgtaatctcctttcaaattccttgaatagagaaactgacccaaagtagaccagttgtgctacagggcatgcaaggctgattctttcgaaggctacgatttggacattttctttaagaaagtagttgagaatcaatgattgacatttctgttgctatgaccatctgactaaaataggccagtaatgcagtattttattttattttatttattttaattgtttctgcgctaagtaatgaccaagcaaagtgtatcatctaagcaaagcacttgtaggctactcagctgagatgtttgcccatccaaagaaaataggacaggggtaaatgagatcttactacaggcagcaacaggagggactaagaagatttagatgatcaggaaatactttgtatatgtttaccttgttttaaaggattttattctgtctatgaaagcagggtattagaagtagccatcacatactgagctctcactatatttgcattacttctaaccatcataaaaaccctgcaaaggtttgccaggtttcacgggagaagaaatagactcagagaggttttagcattttacccaaggttagtggataagtggatgaccactttggaactgtgcacgtgatgacatccagaggaagaagagaggacctttcttcttggatgtcttttttgcagaacaagaaacatcttctgttaccacagcagaattttcttatattgtattgaccagaattgggtcgtatgccctttcttaagttaggcactggcttgacttcactgtgtgaaaaatgtatagactttggctaatcaaggggatgggtgtggaatcactaactctgagtacatatgcacaagaaaagtatattgctgaacaaagttgagctaccagcaagaaagaaatttggggataggtttgggaataataagtagcatttgttgagagcttactatatactatgcacccttgtaagcactttacatgaatcagctcatttaatactcacaactaatactatactctggtagatagttcaggtttcaacccagatctgacaccaatgcctgtttccttaaccatagtctacctcagtatcaagtgatagcttgattatagatttcagcagaacagtgtcagcatgctgacgttttaaagttcaccgtgtgtacatcctaaatgaacatttttgctttttttaaaaaaatgaaatcagacatagtaataaccgcattgtagactagcatttctgtgacagcctatcattttagaacaattaaggacaccaaaattcttgactacgtgtaagggtggcaggactatttaagagagttagagtatatattgacttctcctatctgtaaatttctaaggtgatgtactcttaaatataccttcttgttgttgtcttgagcttaatttgccttttacgacaaaatgtgtaaattcccaaagtatcgttgtgtgtgtgtgtgtgtgtgtgtgtgtgtgtgtgtatgtattcttttgctaggctgtaaatggaatggtaatttcttttggctcttctcccaagatggcaaagtaaagtgaacttcatgtagaattttaattttatagtttaataccaagaaggacagtattccaagctgaaatctcttctaaaatgtttggtttatttcattcaaaggaaatgcattctacaccatatgctatctaaaaattctggctaacctcttttctaatgtgccattggatactaagtagaagtataataatatagaatcagcagattctatgaacaagatggggtatatgggtgattcatttttttggtaggcagtacatttactatagctagtgatctgcttgatatctttctgttactgtataaatcaaggactttattatatgaaacattcctagggaaaaattaggatcagcaaatgtataattcaggagagatttcttgggaatatattagccctggtttttggaggggaacaaatctgttaaactataaaagctataccactaacttcttcaggaaagtgcatacatacacaattttatatataattctgagtccagaggactcagatctccctgtaatttgtctgtaaataccacctagtctagagactatttccataaacattttggtcatttcctagcttttttttggataatagccatcctaatagatattaagtaatactagtacagatttttttgttgttgttttccagtgttccatcaggtagaatctcagctctcataattctttgatggtctaatggcatttttatctactactgtctagtacttgtgtatttatcttctcatctaaattttaatccttttgaggtcgagaatctggtttggtctagggctaggataacaagtgttcagtaggcatttgttgaatgcctgatttggcttttagctttggaagtgaatagtatgagcactgaaggtaaaacatttgccagtgattttaatgagaggttggttttcaagtatgaaatgtagttagaatagagatcaagaattagtgtactttagtcatgagaacactgctgaataaggtaaaggagagagtaaaaagggaaccttcaagtttaggctgggaaggtgaaaggaacctgtgaatgcatctctcattactccaagaaggaactgtgatattctacaatattgtgacatcttacaatgtaataggatattgtgatacatctagccagctatctggatgcctccagaatataccctcttaattgtttctatgctgcccatcaaaaataaataactaacatttttgagacttattctttgccaagtcccatgtgttaccttctttctttctttctatttttttagatggagccttactctgtcgcccagactggagtgcagtggggcggtctcggctcactgcaacctctgcctcccggtttcaggcctcccaagtagctgggactataggcatgtgccaccaagcctaatttttgtatttttagtaaagacgggctttcaccatgttgtccaggctggtcttgaacttctgacctaatgtgatccacccgcctcagcctcccaaagtgctgggattacaggcatgagccactgctcccggcctaccttatttctttacaaaaatctatttatggcaccattttagagaagaggaaacagacatagatagaataaataacttgtaggtggtggatctgaaattagagcctaggcagtttgattccagtacctattctctaaatcactgtggtattctgcttctccttgagtttttttaaattaaatatttaaataataaaatatttcatttagcacaatagtacatgcatatagtttaaatagtactgaaaggcttgtaacagtacagtggatctctgccccatctcacccaactttcccagtcttccttagaagtaactagttttgtctcttaactttcttctggcatttgcccatctctctgtttctattttagccgttttctgtggatgactgccggtcagtgccgccctctgttttccctccccagtgaaattattttgtaattcttggtcaaatattcagtgtttacattaaacaaatattatgcacaattgaggattgtcccatattttgtttgttagctttctttttgctgcagttattgctgccctttaaatttttagttagttttttctgtgataatttctaatttatctcacggtatgtaatagcttctccacacagttttctgtaatgtcagccacatcagatactttctcacttaacttatttttgcagtttttatatatcctcagctatgtagattgaacttcaagctcttctttttgccctctgcagagaaaacaagcttcagtcttctgttgaatgagggtagggttgttacctaccactggattaagagaggggatccaggtatctagctacttttcaaacagcagccacccaaatcctccctggcttaggatacagctttctagggtctctttaattgattattacgtatctatttacttttctgcttccaaaattgtatgctgttattccttttctctgtgtccttgtgggtttctgcttaaaattaacaaaagcaaacagcacatttttaaacttagtgttagttaagtttgaaagaggaagtaagattggataaatttattgtagacatgtatgaaaatgtaggttatcagaaataaaagaaataaaaagcccttatagtaatatcactagctagaatgactactattgtcattttggagtatttcatttcaatctttgtatgtgtacaagctgggcaggtagtaattggatgatgccatatacaggtttgagcatctctaatctgaaaatctgacatccaaagctttttgagcactgacatgatgctcagaggtgatgctcaaaggaatgttcattgtagcatttgggattttggactttgagattagggatgctcaaccagtaagaataatgaatgcaaatattccaaaatctgaaaaaatctgaaattaagaactcttatagtcccaaacatttctgataaggcatactcaacctatatattgcttatgggttatcttttttatgtttgttagcatgccaagacctgtaaatgctgttttcacacaaactgttgtgcattcattttctgttgtggtccattgacattttcagtctatttttactccagtaccacaccaaaataactatttgaacaaagaagacttatatgacaaacgatcctttaaaacaaaaaatactataactgcctttattccaagtgttaatattactctgtgcctagtgctgatttttaaattacttttactttattctgccttatttcatccagcctgcagatggcagaattgtttcatttgaacagcaattttgaaggctccgttttatttagtgtgttctgacattggaatgagaagtgattaaatgaacagtctctctccctattagagaagaagcaaattaatgttagagacagggagccacactaagaaagtactggataatttactttttcatttggtctatcttcatttcatgatttttgcatgcttggattataaatgaactagagcctataaatgaactagagcatgatgtttaagctgtaccatatgtaaactgctgaattcccttaattactttagtcagagtaatggagcttaaatctgcttcatattaaccataaagcagtttgttctgcatttgtattttaagagtttgcttgtattaaattttttttttaatctagagaccttttagcattcatgaatcaatcatcaatttaaagctttgatataattgagtttgctgaagtatgagcattttgttcttaggataaaagaaatactttagggaagaagaaactagaattagattagtgtaccatatttgaaattgaagtcagaattatgctgtagaaaaattggaagagcccatttgaggaaatacaggaattgcttagagggattactgtaaaattcagtgattggtaaattgctcatgtagcagaaatggcagggaaaacagcaataagctaagcaaaaaattttaatgtattgtgtcattctgttgatgtaaaaaaagagtaaaatagttatgagtcatgagactttacttttaaaatcagcaagtttaaatataaagtactggaccacatacattacaatagtcatttaaaaatttttaaaaatgttttgtaactgctgtggaagggtagacttcacaagccaattagatataatttgctagctttataagaaggagcagaacactgaagtgactacaaaacgttaaattttaactaaattttgagaactttgtgaatactaattgaaaaacttgtgtaatgagtgcagcaaactacttacctgtagttgtgggaaactaatactaggaaacgtaattggtgcatatcttaaggccttcttaatttgacaagagaatggtagaatgtacagcttactggaataaggagggagtctgcatataagttcaaatgcaaattaattaatattaggtaaaggataaaattccattccaaggagtctagaaaagtctacactatcttagtagagttgacagcagccataaagggcagatattaattatgtgcaggcctgtcacttcaagtttatcttacgattgtgtaattactttcccatcagaaaaatacgtctggaaaagataccatatagtgttctaatcaaaagagggtatgctagaatgaaatatgtacttttattaacacattaatgcttatgaaatgatttttctagcatgaaagcctgaggatagattagttagaataactacaaaatatattgcacatttaactctccgtaataagcgagtgtaatctatcaagagatagtattgaataatggagatgtccaaaatatctttctttggtttttgtcaccttcatttcagagtaaagataatgatctactacagaatttttgtattatcataattcagataagcaatttcaattcatttcatgaagggtgactaaggaacgattatgttctttttatttttaaaatatgaaaatttttgaggttcttgatgtggtaacttgaaagataataataaatgcagaggtttcataatatagtccttaatgtcaagagtaatggaaatgtgaaggtctcttaggtgagagattatagcaggagatagaatcataaaataaatgtgaattgtgtcgtgacaactggaaccaaagcatacaaatattggagagagactttaagagaattaagttagtatttgtcgtaaattggaatctggctatagaagcattgaggtccatttagttgcttctttgaaatggaactctttgatatataaatgtaatatgtatatatttatgaaatattctgttcataatgcctggcttgaactttttgatagaaagaacacattgggacttttttttttttaagcctttgttttcgaaaagaggctggcctcttaccgtggtgctatttaaaagataagagtttttttttgcccacccccctccttttttttttttttccccagaacaagtgagtttgttattctgagcttaacaaaataaatgctgaggctcaggctgacagtacattctttaagcaactgtttttgattttttcatcaagccatgtaaaaaagaaaaaggcagtagacacaccacatagtgtagaggattagaaagctcattctgttatctccaaatgcattcagtgtgttaagctttatgcacgttttaagaattcttgcaattaagtgtaggattgttatggtttggatttggagatgcatcactaatgttataagttttcctgtgtgtaagagagtatgtgtgtatgtgtgttttccaagtgcacttccctaattttagttcactcaagaatttagttctccagcattttatagacaaaacattatggttgtatttagtagtttgcattattttttacctatttaatattttaatcacaaggacttattttactaagtaaaaaatgcaaagattttgaaagctatcttctagttataatttagcatttcaactagaggtagcttgggaattcagtgaaactgtttcagctacagttattgagagtcatggtggactggagttggatggctttgttcttcagtgtcttccaaaataacggtgtttcgtaattaggagttaggaaactcattgtggctatttttcctcctgtttttcatatataatgcacttagagataacctgttctcttatgcatttgaaatattcattgtcagtagtaaaagtggtatttttgttttgtttttctcaggcagagtcttggtctgttgcccatgctggagtgcagtgatcttggctcactgcaaccatctcctcccagattcgagtgattctcatgcctcagccccccaaatagctgggattacaggcgtgtgccatcacgcctggctaatttttaaattttaatagagtggggtttcgccatgttggccaggctggtctcaaactcctggcctcaaatctgcccacctcggcaaaagtggtgttttaatacaagaattctgcatgttcaaggtggggaaaaggcttataaggatatttgattagacatatgaagaatgctcacatggatctgatatgtctggtttgctatatttggatttctgagtgaatataagctatcaataaccattaattaattgatgatccatatttgtaaggaacattgagatgtaaagttagcacagctttgagagtttagcatgaagattcgcatcctgtaatcagtctggattgtggttttctcattgatgaaatgggcgtgtttgacttggactttggtttgggctgtgtcatttttggggcattaggagtgataattctacttttccagccttcttagaatttggtgccagttgagagagagaaagggtaagacagatagagatcaaatgctgatagttacattggattggagaatgtgacttagatctgtggccttctaagactgggcttcttagtacaaccccactttagactttgaactttctgttttagagggagactgtgtgtgtacaaagcaaacacgcatatccgaattgctgcctcatacctggtgggccctgatggcaagaacacagagaggtggggcctgtggagctgcttttgaaaggcagcgccgtgtgtgtctagcacgtggatggaggagctgataggaaactgcaggttgtctatgatcaggaagttcttaaaataaggaagagagtgaggcaggtatgcatgcttgcattctttctccagaccttcagagtgaaggaaaagtggagaggtacagaaactttctcttaaatacttcaaagaggtggaagcgcctttatcacgaagccataggaaatctccatttgaaaatgcagtacaagttattcagcttcccaagagaaatatttattctcatttaacattagtgctcaatttccttgcttttaaccctaaaacatcaggggagacaaaagaagccctgttcttccacatttgaaatatgttagctatgctacagtgttttgcttgtttgggtctggaaagttgagtaatctgaagagagaatagggtctatggaaagctataggggatggacgtatttgttaccatggtattttattagtaaattgtaatctaaaagccatggtgctcttgaatgtaaccctggacggtggattgggaagtgcagccggacaaatacatagtgtttgctttttcgatacctaaggaaaatgtagttatgtttcattgggagatcattctggtttgaggtctacttctctggatccccagttgaattgtggtatgcaacaaaatgtgaggttaatttaaccatttaaattctgatcatccttgacaaggcaaacgtttcctttcatacttattagtaggaacctttgaatcttgaatactataatattagatgaaaataaaaacagccagtttcttaaagtctgatcttgattattctgttgtcgatcatcagaaccgtgtttttgttgttgttgctgttttgttgttgttgttttatttggctttttctttggtcattttacctgtaaatctattttgcagaaacaaaagggaaaggaggaggtgaaacctaaatcaatcctaaatcaatttttctcctttttttttgacttataagcacctggcttgagaagatgcatagaacactggggaattatgaaaacagagtttaaaatatcccaaaaaacacttttgtggttataaaaaattgaattttatgtttccatacaatttactggagacttagtttaccagttgggaatcttttagactttggaataccttctttttcaaattgaatttgacgttaatttacttgaacttatattgatgcctcatgaggtgcattatttgttgtggctcatctttcctttttttcaatttcaggtgatcccattaagatactaatgccatcactgtctcctacaatggaagaaggaaacattgtgaaatggctgaaaaaggaaggtgaggaggtaccttcctaatgtcctgtgtgctttgttatttggttattttgttttgtttttttttttcctaatctgtcctgttatacagtatgtgatataaattaaataaattgtgttcctttggtagttaatgtaagtttggttgaataaaattttcccatgataaagcagcaaaggttttctgggttcagcatatatccttacacaagcacagaatggtaaaaaatattttaaggctttttccccaacttttagtccttatgcctagcttttagtttcaacatcatagttttgacattctccttaatttataactttatcatgattgtgtgtgtgtgtgtgtgtgtgtgtgtgtgtgtgtgtgttctgggaggtaggcaagttcatcataaattttattgaaaagaacaaataagtagaatataaggaaaaccctcaaaagcagatcagcggaggagggttgtagccctgctaattattgaaatatagtattaagcatttctaattaaaactctgggattggtgcttaaaagacagaccagtgcagctgagtagagaataaagaaatagatgcagttgcacatggaatttaagtatataataaaggaagacaatattagatttattctttatgttatgtgaaggataaattacaaatgaattatacacttaatgtataaaaatgaaactatgcaagtcttgaattcctctgaacccggaagtggaataaacaccctaactataactcaaaatccagattataatatgggaaataaaatttgatggtaaaagtactaacttttatatggctaaaaatacaagttaagtaaaaaaagaagtgacaaattggacaagagtatttgcgatttctatcacaaagggttaatatccctaaaaaatcgataagactgtcaactcaacaagaaagtgggcgatacatgaacagatagtttacagaaaaataattgcaaatgactcttacacgtagaaaaagacgcctaacctttcaactggtaagaaatacgcagacactttactgaaatgtcatttcttactgattatattgacagtacttaaaaagttcgacaagctgttctcttgatgatgctgtggagggaagggaagaagcaggactctcagacattgctggaggaaatgctaaatggtgtaaatactagggaagagaatttggcactatatagaaaaattacatttatgtttaccctttggcccagcagctctacttcgagggatttgtctcagtgttacaccagcaaaaataagaatagacacaaacacacactaggctgtttatcacagcactgtttgaaatagcaaaaggtagaaacaatccaaatgttggttagtacaggatttgttgaataacttttactgtatctacacctgtaaaaaggaatgaggaatatctctttatactgctatggggtgatcttcattgaaaaaaagcaaggtacagacaagtgagtatagtatatatcatttatcaaagaaagaggtggcagtgctaatatttaagaaattagaaaggataaaataaaactttaaaaacaacaatagttggttatctacagagtaatggagggaaccgtgtgggggagaaactggaagctggacttctgaatatatcttgttttgtctctttgactttgggacaatatacatatcttgcacaattttaaaacaaaattaaagtgtaaaagagccctaaagattgaaacgagacaggtgattctaattcatttttttctctctctttttctctctctcaatttgcttacataaccatacagagaggcactatttcaaatgtcagatgtttgattatatggccctaatagattataactgaaggataaagcgtctccaaaagtataatcctcaactgttagagtaatcgtattatgcttgttatgttggtattgttattctaaggcttttgtgtgtattttatgggataaagcaaatgactggttaagataatatcattggaaacttggacttttagtgtagtttaaaggagaaacaggtaaaagtttctaaggttaggaacgaccctgtgatggtaaattttctagctctttcccctggcaatgcctggaaacaaggaccaatccagtcgcagtaagcacccctagaacccagactgtctctaaatatcagttcccactaaagtaaatgaaggctccttggagagtagctacttgcaggcctagggcaggagatgtgcagatgagcttttaatatcttgtcagttcagaaagcaaggaagctgtcagaaactcctgagggcatcttaaaggactcaggagccagagatgagatagtttgaggatcactaaggataataaggataatatatttaatatatttcaatacattaaatatatttgaatcctaagttcacagtaatactaaagaaaaaaaattaataataattggttagctttagagggtgctaagaaattaactcattttgaaaacgtaataaatggaaagactcaagcatttttctctacctcttctgctatatgaaccgtagctctgagtaaccaagtaattgatgagaagtttctcattattagcatatcacagttgttaaaagatagaagaatcatagaacatcactgtattgccattttgcaatctctggtaaaatagtatagccagtgatcattaatagctgctaacatcacaaaaagagagataaccagatattacatgtttcccactgtgaagtagtcttgccagaaaattgaaccaaatatgttcaagcctgtagctctatcattttccaggaaatacaggggaaaatataacgtgttcaatgacaccatgagaagtatatcagcaaaagctagactgaggaattctgtatgccagtttcttcaaccaataaatttcagggtggtagggaagagcccgggggaggaaggtgggggaacctatagcatacaagagatttgagaccagtgccaatgtatggacctaattttaattatgattcaagcaaacaaaacacatgcggacatttgaaaactggctggatatttaatgatattatggattttttttttttttttttttttttgagacatggtctcactctgttgcccagcctggagtataatggcgcgatctctgctcactacagcctcagcctcctgggctcagggtgattctcccacctaagcctcttgagtagctgggaccacaggcatgcgccaccatgcctggttagttttttgtatttttttagagacagggtctccctgtgttgcccacgctggttttgaactcctgggctcaagtgattctcctgcctcgacctcccaaagtgctaggattacaggcataagccaccgcacccagcataggaattattaattttaaaggtttaataatattttggttatattttgattattaaaaaaaaaaaatctcacctataagagatgtgagatgaaatacttacgaataaaatgacagtatctctgggattagcttcagaataaccctggttgaggttgagagggtagggaggggtataactgaaacaagatcggtcatgaatcacttggcagttgtataagtgaggtaaaaggtatatgtggcttcattgcctttccttaccacttttgtataattcaaaatttattttttatatataaatttttttaatatattttttaaaggttgtgcatagtgctttcaggatataatttgagatgagaaactagtaccagatgaattggaatgttgatattattaagagaatatttgatacaataccatctataaagctgtattatgtcactgtttctggcaaccattttgccagattttaagtacctaatatggtgcttagaaaataaagactatgaataaaagaggtgagtatgttacagtgcttatacagaaggatagaggaacagttaatgtgaaggaagctgggctttttgtttttctggcagctactttcttttccttttcttttcccctttttcctttgccatgtgtggcggtagagtctcccctccaggtattggccactggataacctcttttagcaccctatgtagctgtctttctctgtgcttgattcattctgtatcaggttaaactattgtggaggaaagaggatgagtctacagtacctattagggattgttagacagaaaaatagagaaattagaggtgactgaatgagtcccccacagccattattatgcgtcatctggagcaatggtgaatcaagtgttaaaaagggaaagaaagaagggaagtgcaagtagagaatgaataacatggtctggggaggacttgtctaattccagagactagccctggcaaggacttccagggtatcctaatgtgatttagtaggcacagatgtcactcatacaaatgttggtattgagtggtccagtctagtgcttgtaaaatagtatcaaaagagtttaggcagtgggcaggacaccagagtctggaagagctgtgttgtgattctagaaggtctagcctttcatagcatcacttttgccactaatgacagatgtggggatcaggaagagggctaacaagtatttacttgagaacactagccaaatgagctggggagtttgggacaagcaaggcctcacttctttgagggagtctggggtgtaaggaaaggcaagaaaaattgctgtgggttgagccactatggaggttaggaggtatggtgcagtgaggttatccaaatgaacattactggtccttgatagacccaaccaagtctgtttgggcatattacttaattctgttcctcagtggggaatatgtctgagtttgttcatgtttgtgcttcccataatgactaacatcgtaattggaatagaactgcagtgctgtaagtggtcagttagtaaaggtaatggcagaggggaaagtaagccaaaagcagggtacatgacagggatccaagaaggctttgcagatgaggtagtatttgaactggtccttgtagaataaatgggctttttaaaaataatgagaaggacattccagctagaaaaacatgggtaaactcttggaagaaagatgtcactgagacatacttttgcaacagcaggtaggtctggctgcattggggacataatggctgtaagatcagatagattattggaaggatcttgaatgccaatctgcagtttatcagtctgtgagggtccttatcctaaagccaaaatagatccacattcatggtttcttaataggaagtggtttcttttcttttcttttcttttcttttttttttttttttttttttgagacagagtctcactctgtcacccaggctgtagtgcagtggcccgatcttgctcactgcaacctccacctcccaggttcacgtgagtcttgtgcctcagcctcccaagtagctgggactacaggcgagcaccaccatgcccagctaatttttatgtttttagtagagacaaggtttcaccatgttggctggtctcgaatttctgacctcaagtgatctgcccaccttggcctcccaaagtgccgggattataggcgtgagccactgtgcctgggcaggaagtggtttctacatacttttctgagccctattagtagcattgcgttgaaaggaacagaccctaagagtaacctggtatgaggagataactgtaggcaatttaaagtagcctccttttcctgctctcatttgaaaagccaacactgagaactcctaatcaatgtgataatctaaacagatggggtaaagcatctgctctctatcggatataatattataagtaaatcttttcaatgttaagtggtgctggaatgcagagaaaggaaatcaccaagtgtccccacatctggagtggtgaatgggagttgaggccatgtgcaccactagggctgagctggaaggctggagttgctgacttttttttttttttttggtggcggggtgggtggaaggagcaaggaagggaaatcaagaatcagattaaaatttgaatatggtaagatttgaaatgcatatgaggcattcaagggaaggtgttcaatagataactgattataggagttgaagttcaggagtgaagtctgacttggagacagaaatttgagagtcatcagcatgtggatggaatttaatgccatgtgataacaggcaaaatgattttgaatctatatggaataagaatgcctactcccctaaagagtcctcctgagggtcaaatttatagaacttgcattttctgggaacccacagatagaagtgaagttgtcctgggctgatcgcctccctgggttacctggtagaagccattattctggaagaatacagcttctaatccaaaccatacagaatttgcagataaagtctcaccaaaagtcacaatcccacatttaataacgtatgtggaagaagtcttttaggagtgaagtcagtaggcataacaagcagcaggactggatcccaagaacttcagttaattggaattacaaaagtccaggcagatttgaaaaggataaacagaacttctagtaatgaaaaatatagtctctcaaattaaaaccccccaaacctcaagggtgggctgaagtgtgattagacaggactgaatgaagaatttgtgaacagaaggacgactagaggaagttaggttgcatgtagcacatagagacagcactggaaaatatgaaagagaagttgacatatgaagggtaaaatgaaaattattcaataacccaataggaatttcagaagaagaaaaaaagagggaaatgggaagaggtaattttcaaagaaaaacatggcagagaattttctagaatttaagaaagatatgtgtaatgtaaatgaaagagccagtaccccattggaaagcatttagagcaattggctctgcatggctgctgctatcttttaaaataattgtcagtatctaagaaagttttacctttataaataatgtaatcagttggaatgtgtttttaggtttcttttctctgatgaattacagagctttggctatttccatattcgatatgacagggtgttggtgtcattaaataatgattcagacacagaacagtcttttagggattattttaaaaagattaactttcttcacactttgagaatttataggtaagcagatgaggggattcttgggccacatttatctttcagacttccagctcactggcaatctaataagttattcacacccgttagaatatgagcagtaagataaagagccagcagacatatggtctcattattctgttcttttttccttttgattacaatatgctattttcatgtaggacaggccaggatgtattttaagtccctggagcatgtttccctgaaggttgctcttaaaattctgtgttctgccaactgaagggaaatttgtttttgccaaaacacagtaaataattgagagcaatcttaatccttggttcttagtggttcactggcttctttttgaagctcatcacctttgtgatttgtgatcttttgagtataattggctgcttttcattaacacttatttactgtatacatgggtgtcaatatatgtttaagtatgcctggttcttggtacatttatgataacttgctccattcattttatattaaaaacaaatttatattctgacagcatacttttcatatattttttctcttattaactgttttttgtttgtttgatttttgagatctttttaaatgtatggtcaccataaaacaatgagtttaaacctttatgcattaagaaaattgatatttttcatgaaaaatgatagtgttgcatcgaattatgaatctagtttacttctaagcgaagactagataagtatttgagaacattcaatggacagcagttcagtcttaaaaaccattaagttttttcaaagatctgagactgattcacagcttcttttactaatggtgtgtgtgtgtgtgtgtgtgtgtgtgtgtgtgtgcacttgcatgcgcgcagcgttttacaccaaggaggtaagggtgcaaagaaaaaactctggcccaggaatcatggtttttcctttggggttcctcctctgccatgaactacctgggagtgagttgaactagctgaaatctaaggtacggaatatcctggatttataattctatgataactcatttttattttctttttttaagtaactgaaatatgcagtattatagcatataaattatttccgtctttgttgaactcatgattctaagaaaataagttttataatgactattagagtacttcatttcagtctgaggattgactaaaaccttatatatcataaaattagtacagaaaatgctctgaaagtgctaggtaacacccacaatttcaaaatcttttgaaaggtcaattgagctatcatttggcatttttattacaagttttttatttggagggggcatgtgcttcagatattttcagtttaaactgcacctagtttattttttcatcaattgaactgtcaaatctgttaaaataacagaaaggaaaaaaaattcttgttctccttttgtaagagaatatttgaggttatgaaaaaccttgttttttttcctcagaatatttgagatttttctgctctgccgtgaagcactatggaacaaaaccaggctaagataattccatcaagcacttagccacacccacagtgcctagaatgtacgtagtaagcatgcttaacagtggtgcttgttgctgcggtattccttatgtcatgagacaagggatttttttgtatttcaaatagtttttgtctaatatactgttactgtataaaattcagaaataaaaccattttgaagaaagccttatcctatatcactagatgccactagagagttatatgggtctctggattctactatagaagacactttggttccgttatttctggcaatatgtatatgtttgtggtgctaaaatggaaaattttgaaaagtccatttcacaaatagcttcctttttttggtgtactatggttttcacagctttattgaggtataatttacataccataacatttacctattttaagtattcaatgatttttaataaatatatggagttgtgcagccatcaccacaatccagttttagaacacatttctgtcaccccaaaaaagatccctgctgcctgattgcagtcatttttttcctcccatctctatccctagacaatccggatctgttttttgtctctaaagttttgccttttgtctatgtttcatataaatagaagcatgtaatgtttggtcttttgtgactagattttttcagatttagcatgattaaggttcatccatgttgtagcatttatcagctgttcattccttttgttactaaattatattccatcattatgcgtttttacatttattgctaaatctttgtattatatcagaatttttaaattagtgaatggaattatagattatagttttattcaatagaagtttctgtggtgatggaaatgttctgtgttaaactgtcgaatacagtagctactagactttaagaagccagagggatgtgtgggtggttgaccttgtctaactgggcccttctcaaactctcctactcatgccttcaccccatagggcaggacctcaactggcctagcaaccaggttgcctcaggtctttggccatgcaaatattatccttctttgtgtgtgtgtgaagtgaaaagggatgacaaacactgactaggggtccctcctctacattcccattctgctgtaggtactaattggatgggattgtcattgcctgcttgttgtactgttcttcaatcagattaggaacttcttgaagcagttctgtcttattttattactatttttatcatagtgtcgcacacagtgtcattcacatgggcagctagtaaatacttgtagagtcaacaattgaattatttttgtttctgattattgttatcattatggttcaacatagcactaagaagaggaatttttctttaatgttcatgttaatctgataacttggtcttacagataaaaactagctctcttccaccaccaccaccacacacatcttttacgtaaagacttttattcttaatttttggcagaacaaaattattttgtgaaagcctcaggacttattctattaataaaataaacatcaccattaactgtgtttgaccaaggctatgcttaatatctagaatttaaaaagagaaagggaagcctccgtatacttcagtcctcagctctggcagctgcccatcggacaaaggaacaggacgatgatgctggcgtcggtgctggggagcggcccccgggtgggcctctgctctggcccctcctggggcccgcactctcgctctgggcccgctcctcttccgccactgccatggaccacgagaagatggtgcaggaacactccagggctgccatctctttcttcaatcagtcagctatgaacctgacagctgagaagccatctgtcatctcacgctgtccaggaccctctatcctagctgctgagtcttttccactcttctccactttaaactctttgtggacagaaccttctctttttgttgttttcatacccagtgcttagtacagtgccttatacattaatgtttgttggatgatctggtagaaatgacagaatatggaataaatgtgtcctgattctggtagaaatgacagaatatggaaaaaaaccgtatcttgattcaggtagacatgacagaatatggaataaatgtgtcttgattcaaaatggttgtatagctaacattttatttttacctagagatgttgtaaagtgttacataaagatgtatgtgaagcattaacacttccagccccatgacttaaaaaatatatatctatacatttaaaattttcctgagagtcagagagattaagtaacttggtcaagatcactagtaactgtcagagcttggaatcaaactcatatttgaattaggagaggttccttgtaactactctgccaaggagtctttctaagttatagcactaaatttttgatcacagctgaaactcagtagatttgaaatattcatggctcattatttgctctcagagttttcttttggcatttacatgatgtttgattattgaaagatagaactttggttttgtgatgagttaggggtaatgcttccatacgtaatattactatgtttttaaaacttccctgtgatttattggtaaagtgttctgtgtttcttttccctacctccctctcttttgtcctctccttttttccttctctctcctcctgcttttctcttctaccctctcccttggcattctcatctagctaacatatatgtctgtgttatgtgaatagatatagttttttaaaaaagaaaaaaaggctatctttttaaatatcagaagcatgctacaaatcaaatgttagaagcaaaagaaatgtaaaagataatttgatgtataccttatgaggaaataaggattcgtgaagttatcatgtttttttctaaagcattttaatctaaaattcattgggtatggtgcattggccatgaaacctgaggaatggggatgggaatataaaacatttaagtgtcctgtccgtattgtgaagaagctcatagtctagtaaatagaggaaatcacaatttaaaaaagtaattagcagtaatataacattttatatgcaatttgtgatttttaaataaattagacctactataggaatctggaatatgaacaaaattatgtaggtcaagttactcagagaaagttatatagctgaagtcgaatctgtagttcttaaagtgtggttggaatttgaatactgatgaacacaaatgatgatatagcatcattttgtttttctgtggctagagtctgttttctaggcatctaagaggtatttaattgctgggtttactagttctatagtttttcccgtgattatagcagaaatctttgagggtgtgctttttttcccttttgaagtgcaatctgttttaaccactaaaacatttaaagaagtatgtaagatgatataatctgacactgtagctttctctatgacatacaaaggtcatttttggtctcttcctgcatatcttaccagcctaatctctcgtcacttctctcgcatactatttgccagtttctctgaagtttcctgttctctctgcctccagggctataagtgtattaccttctacctggatcactgcctgtttacagattgtctcctcctcacctcttcaggctcagaataggtggtcattgtattctaggaagccttttctcaccttacaaaaactgaattagatgcccctcctgaacattcccaaagcatcctgacctcaccttatcctgctgtattttccagtttacttgtcaatggatattaagcaagcttcttgaggtcaggaatcttaaatctttgctgttattactgtccattgctgtatcctcagtgcctacatatgtatatatattttatatgtaatatataaatatataatacaaatatgtgtgtgtgtgtgtatatatatataaaatatatttatataattattattattttttagacagagtttttgctcttgttgcccaggctggagtgaaatggcatgatcttgactcactgcaacccccttctcccaggttcaagtgattcttctgcctcaacctcccgagtagctgggaccacaggtgcctgccacctctcctggctaatttttgtatttttagtagggacggggtttcacaatgttggccaggctggtcttgaacccctggcctcaggtgatccacccacctcggcctcccaaagtgatgggattacaggtgtgagcctacacgcctggccaccccaatacatttttaataaatgtttgttgactagggacatctctttggagttagacaaaggaccttttaggtggtaaataaatatcatctaacatatcaatttatttttaaaaataacttatattagtgtctctgaactatttaacctgaagatataactatcaatttgatcatcttggtacacaatgaagtactttctgtactgtgaacgttcagagcatatttgttaatttagtgttttagattttctttcatattctcttatgatgcttgcctgttaatattgctattccagctatttttggtgtgtgaggaggtgtatttatatgttacatattttttatccccttgttttttattctgtttttgtgttagggctatctcttgtaagctacatttacctagattttattttcatatccattttgataatctctacttttaatgggtgattttaatccatttatatttattgtgattacggatacatggggacttatttctaccattttttgtgcatttttgtttttatcctttgccttttctttccatgtgcctgccctcagttagataatcaacttcttatttttcctctgtttttctaatgctgtagattatatttctgtttttaaattttaaattaaattttgccaataaagtttagtattattcagtatttttctcctattataagttgatgcaaaagtaattggggtttttgaaagtaaggtggtaaaaataaaattacttttgcaccagctgaatatatcaaagttgttagcatgccttaccatctaaacatttccttacctatcttattattttttagagtttgagttttacactttttaaaccctcaaacattactttaaaaatactagtagttaacattttagtaattttcacaataacttgtttcttatagcccatgggttccatctgcttccacttttcttcttgatgaactgcatcttgtaagagctttttaaagagatctttaataggtggtaaaatttcctagcctttatatatctaaagaatacttctctttcattctcaaatgatggtttggcagcatacaaaattctagacagttatttttcctcagttttttgaagatattacttcattgttttctgacctctgttgcagctgctgagaagtgtactctcagtctttccattgaggtaatctgttttttttcccctttgatagatttttaaaagattatgtttttatcgttgatagaatgcggtttctttacattgtatctaatatggattcatgtttatatagtctaatactcttttttctgtttaagtttttatcaaggtataacttgcataaactttaggctcaattaaattttgtatacatgtatacccatgttaccaccacctagatcaagatttagaacattcttagcaagctacacagatccgtatgccccctgctagtcagtacacctatcctaaattcattcaaaactctttgatgatgagagtatacatctccagttctgggaaattctcagccactaattcttcaggtattgcttctccaccagtgcctccagtgtcttccctcagaactccattagcaaacattgcagcctcagtctttgtcacttaactgctcttttctgttttttcgttttgttttgttttttgtttttaatgtttgtatctttttgtctgcctgtatgaaattctgcgtagttcattagtgctacctttcaatttactaattcataccttcactattccctgtctagaatatattctgttgtttctttttatttcaattacttaatttttcatttttaagatttctaattcgtttttttatttctacctgataccatttttttttaatttcttgttcttgtgatggctcttttactttcatttatgtttttggatgtcctcaagtacttattttacaatctttgacagattgcactaaataaattgcttctgaaaagaatttttgttacaattactgattttgtggcttgctttcttagcttttgatttcttcgtgtgtctcagaactttcttgtgcaatttacttttaagtggaaagtttatgttttaatgtcttccctcctacgcagtcccccctcgatccttgccaccatccaaggaattttgcaattgatattggggatattggcagatacagccccggagccagagggtggcttgactttgttcctggtactgaggcagtattctggtccccaccttcctagacccatggttgctgattaaaatcatagtctcagtcaacaggttttgattgtgcattttatcagcctcacattatgagtagaagaaccctgacttagccctagctccaaatagtgaatctgatttgagtcccctatatccaacagactacttttagttccctttaatccccaaaggaaactgttgtacctcttttcccctgtttgctccaaacctgctcctaaatccagaagctagtaagcctggaacttcaggtcttcctccatatttttgagtttccagatattttctgttgcagagaaatgatctgtatttgacttcagttgtgtctttgattttctctttttatgctttatatgctttattcatttatactgtgtgctgccaacaggttttttgaacttgccctaagatgtgaacccagaagtactgttaattgtaaaacttttcttcagggaatatagtcaaaatgtttgaaaaagtaagggggatatggagtctggaattgatttgttcagaggtggatacacatttgttgctgatgtctttaaggttgatttcatttttacatgctcagtaatctttgtaatagcttttttattatcacaagtataatttatgtccattatagagcttttggaaattacagcaaagcatacacatacacacacacacacaaacacccacacataatgagaattacttgtatttccacaacccagaaatagctacggaatattttggtatttatttatgttttattcatacgtacatatatacatagtaatatttatattttaaaaaacaaaacaaacccagtcttgttttgtaggtgaagcggtgagtgctggagatgcattatgtgaaattgagactgacaaagctgtggttaccttagatgcaagtgatgatggaatcttggccaaaatcgtggtaagtttttattttaattttcttcaacaggatgaagatttcttgagtggaaagttcattgtagtaaaattaccttttatttttgcctccttatttttaatgtgtattgtctactacataatacatttttagttcaagtgtttaaaatgttttagagttaaggtctaatagcctatttttctgtattttctaaattttctgtaatgtgcgttatttttataatggaatattagagcttatgtgaaaagtaagtgaaataaaatgcgtagagctacatatggtagaaacatgactatttagcattgtgtggtatattccctgattgagccaaccagcgtgtttgtttcttaacttccagaacctttactaggtagtatggtggagcatctaagactgtggactctggaatcaccccgctgactgattcatgttatatctaaaaagttctgccagttattagttacgtaatgataagcaaattcttcatcccctgtgcctttttcttcatgttaaagtagagatgataataatacctacttcataggacagtagggaagattgagagagtacatatatgctcatctcaagacctgttacccaattgctcaataaatgttacttttcccattattagaactgtttcctcagctcttggtgaccattagtccccaagtcagtctgtatgtttgcctaataatttgtattggttggttgcaactggataataagtatccatttgtgcctctggagttcaatttgtacagatgagctgcatgtctattagcagtcccttgtggatgtgtttttatttctgagccaccagcttacctctgctttgagcatagatgtaacaccttcctttgtatattctattcaaagactacacttcagaatgctatactctaactaggtgcaaatctagagacaattttttatttgtttttctttctagaaaatcctcttttccttttttttttttttttagccacttatgttgtatttttaacttcgaatatgtcaaactcctttacttgtcatctctcatattagatactagatataacattccaggttgaaacatgttgataatacagttaacttccttgtaggaatatgaatcaaagcctaaaatttctgtacatttgtaactaggaaaatataaatattcataccaaaaatagttttcttgactaatttatgcagcatattgaaacagattgcttgaattaccatgtaataaacccagctacattttattatgtgtgcttttggcaaactgtgttcttggccccaattctggattgtttggctgtggaaatcttccagaattgatagcatttttccacttagctgcttagtaatacatttcaaattgctaaccatgtcagtgggtcagcagtgccaattcatctggcccctatgctctgaaaaaggttgggagtgggagtgcatatagttgatagtggctttggtggcacagctattttcttgccaaagaaaagactgtatattttaggcctttgtggctttattattattccacatgctttttggataatatttgggagtctcttcacaacaagatgttgcaattttatcagggacaaactagtaaatctttttttcttctgttttttgtttttgtttttgtttttgtttgagatggagttttgctcttgttgcccaggctggacacgatcttggctcatcacaacctccgcctcctgggttgaaatgattttcctgcctcagcctcccaagtagctgagattacaggcatgtgccaccacactcagctaattttgtatttttagtagagacgggtttctccaatttggtcaggctggttttgaactcctgactcaagtaatctgcccaccttggcctcccaaagtgctaggattataggcgtgaaccaccatgccctgtcaaaactagtaaattttgatacaaaaatacttcagttattatacatttaaagatcagttcatcagcttattcttaaagttagtatttagcaaattgaacagcagctgttttaaatgataaattaataaagtagaatcttaggatgacatatttggagggtttattagaggttctctaatttggcttccagtgtatttggggttgctatataatttggcacaccaattaggatatttgtgaggatgaaaagggtataagatgtcaaaattatttacatttatgtaatgtttgcaatgtatttattgactagcaatatatttattgatagatttttattgatagaccattattcaaaacaattttcaaaagtagaattttttctaaaaaatagcatccatggatattaaaacaaattttttttaaaaaaatggttttttaattgatcatctgaatactaaaaatagcagaataattattctcggtactattcaccttcttcagttggtttcttcactttatctcactcaaatactgtcattggtatttttctaaagaatacatttttaaatattactgtattcgttagataccccttccccacccttattttttcattaagttgcccacaatcccattcaaagttgccttttaatggtttgaaagtttatggttgaaatttgaagttgtagaggcttcaaatgattcttctgtctagaccgtgatatttttaattgagaaaatagcctctcagagctcagagcagttctattaaatggaagatattctcaactctaattttttctttttttaatgtttgtttatttatttatttattttattattattattattattatactttaagttttatggtacatgtgcacaatgtgcaggttagttacatatgtatacatgtgccatgctggtgtgctgcacccattaactcgtcatttagcattaggtatatctcctaatgctatccctcccccttccccccaccccacaacagtccccagagtgtgatgttccctttcctgtgtccatgtgttctcattgttcaattcccatctacgagtgagaacattcggtgtttggttttttgtccttgtgatagtttactgagaatgatgatttccagtttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcagtaaacatacatgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccagcagtgtaaaagtgttcctatttctccacatcctctccagcaccttttgtttcctgactttttttttttttttttttttttttgagacgcagtcttgctctttggcccaggtgggagtgcagtggcgcaatctcggctcactgcaagctccgcctcccgggttcacgccattctcctgcctcagcctcccgagtagctgggactacaggcgcccgccatcacgcccggctaatttttctgtatttttttagtagagacggggtttcaccgtgttagccaggatggtctcgatctcctgacctcatgatccacccgcctcggcctcccaaagtgctgggattacaagcgtgagccaccgcgcccggcctgtttcctgactttttaatgatcgccattctaactggtgtgagatggtatctcattgtggttttgatttgcatttctctgatggccagtgatgatgagcattttttcatgtgtcttttggctgcataaatgtcttcttttgagaagtgtctgttcataccctttgcccactttttgatggggttgtttgtttttttcttgtaaatttgtttgagttcattgtagattctggatattagccctttgtcagatgagtacgttgcggaaattttctcccattttataggttgcctgttcactctgatggtagtttcttttgctgtgcagaagctctttggtttaattagatcccatttgtcaatttttggcttttgttgccattgcttttggtgttttagacatgaagtccttgcccatgcctgtgtcctgaatggtaatgcctaggttttcttctagggtttttatggttttaggtctaacgtttaagtctttaatccaccttgaattaatttttgtatacagtgtaaggaagggatccagtttcagctttctacatatggctagccagttttcctagcaccatttattaaatagggaatcctttccctattgcttgtttttctcaggtttgtcaaagatcaaatagttgtagatatgcggcgttatttctgagggtcaaactaccatcagagaatactacaaacacctctacacaaataaactagaaaatctagaagaaatggataaattcctcgacacatacactctcccaaggctaaaccaggaagaagttgaatctgaatagaccaataacagtatctgaaattgtagcaataatcaatagcttaccaaccaaaaagagtccaggaccagatggattcacagccaaattctaccagaggtacaaggaggaactggtaccattccttctgaaactattccaatcaatagaaaaagagggaatcctccctaactcattttatgaggccagcatcatcctgataccaaagccgggcagagacacaacaaaaaaagagaattttagaccagtatccttggtgaacattgatgcaaaaatcctcaataaaatactggcaaaccgaatccagcagcacatcaaaaagcttatccaccatgaccaagtgggcttcatccctgggatgcaaggctggttcaagatacgcaaatcaataaatgtaatccaacatatacacagaaccaaagacaaaaaccacatgattatctcaatagatgccgaaaaggcctttgacaaaattcaacaacccttcatgctaaaaactctcaataaattaggtattgatgggatgtatctcaaaataataagagctatctatgacaaacccacagccaatatcatactgaatgggcaaaaactggaagcattccctttgaaaacgggcacaagacagggatgccctctctcaccactcctattcaacatagtgttggaagttctggccagggcaattaggcaggagaagtaaataaagggtattcaattaggaaaagaggaagtcaaattgtccctgtttgcagccgacatgattgtatatctagaaaaccccattgtctcagcccaaaatctccttaagctaataagcaacttcagcaaagtctcaggatacaaaatcaatgtacaaaaatcacaggcattctaatacaccaataacagacaaacagagagccaaatcatgagtgaactcccattcacaattgcttcaaagagaataaaatacttaggaatccaacttacgagggacgtgaaggacctcttcaagtagaactacaaaccactgctcaatgaaataaaagaggatacaaacaaatggaaaaatattccatgctcgtgggtaggaagaatcaatattgtgaaaatggccatactgcccaaggtaatttatagattcaatgccatccccatcaagctaccaatgcctttcttcacagaattggaaaaaactactttaaagttcatatggaaccaaaaaagagcctgcatcgccaagtcaatcctaagccaaaagaacaaagctggaggcatcatgctacgtgacttcaaagtatactacaaggctacagtaaccaaaacagcatgctactgctatcaactctaattttttcatattgaaatagttatgacagattgtgaggaaagatagtttatattccccatgaatcaaaagctaaattgttacatccactttataccttttaaacttgtttttttaaaatacagacaccatcttgaggtgctgcatgataattttgatcagttggatataatttacagatttgataaattattgatttggtagcgattatattggataccatctctgatgttagactacatttaaatcctgcctctgctacatacttgtcttgtgatcttgagcaagttacataacctcttcgtgccttaattttctcatctataaatgggaataatgatagtatttacctcagaaggttgttaggattaaatgagttaatgctgtgctggaacagtgcttggcacttgaaagccagacaactgttattcaagggcttaatgaatgtttcttcttcccctctgtattttagcttatcattggtttgttctcattttcagtatttcttatgtacttccttataaaccaaagttcattgttcatataagataaacagtatacattgaagaatcaaaacagttcaaaattgtataatgattcacaccatgatggaaaatcatagtgatgaaccagataagtcagtcacgtgactcaggtcatctccactcactgctgcacatgctctgtcagtagtcactaggtagctttcaaactgctctattttaaagaataaaagtacttaaataattacttaatatattgattttaatatcagaattaaaacagacaatatttacttgtgcctttaatggaatgagccctctcaatttctctgttggacatactgctgtaaatgttttgcatctcatatccctgtgtacacagatgagattaggtgagctgtttgtagcacatttgcaggtgattgattggttaagatgtgagaatgtctctggtacagaagcctcacactagtgacctgggcttgagggatagaattcagcctctgtctgagaattatgaagaaatagtttgtcacagaccttactacccattatcgtatatgttgatgtttgccctttagtgctgccagccacatgctaagcctttaagcatgaatttctaacccataccaaggggtcagtcccctgtagtctaatcttgatccatgttgaatgtattgttttaaaaaatccataatttgaaggaaaacaccacagcaataacaacagcaataataatgcctttaacaatgaaaatgaaaacaagttactagctatcagacactattctaagggccttacatataactcatttattcctcataacaacaatgtgaagtagctactgttatttgcatcttacagctcagaaaacaagcatggtgagataaggaaactttactaaggtcacataactagtaagtggtggagccagcgttgaaactcaggaagtctgtacacaactgggagggaaggctaatatttgaaatgatagactcaacattcaatatttcagtatcgatgagctctaagttgatagagctatgtgtaaaaaccctgcatttaatattaagaaatcattggcagaagagtaagagagggctttggtcaagtaagctgagtgcataagaaaactctggcatttgaggtgtccttagctccagatgctttggtagggcagagtgtatccatggaggtaccatgagctaccatggaggtagctcagagaggaaagggaacagtaacagaggcctgcttggtttttaaacagttttgcaaagagtattatttacgtatttatactaagtctacaccagttttgagtatttgcctactacagtgtaagcaaatgcttacaggaaattagcacacctctgaaagatctctgcaccaaaggaatagaaaaggttgaagaaattatcttaaattcatatagagattttaatgactttaaatggaattataatcaactgtattttatcttctgttatatattcaagttgtatggttgtatatcacttgtccttgtccattgtatttgggtttcatgcttcatggtgtcacttttttaaatagaaaaaaatgtgaatagttaaaaataaattttatttgatatttagataatggtaaaaattgaaatgatgataaatgctgtttattgcctacttgtgaaggtgtcaatgttacgttggtagagtatatatggaatcatttatatgatttacagtaaatgaaacagaaggtgaggtaccactttcagatgtagtacagttgtctgactcagattttagaaatctattgatatttttaaagcaaaacttaaatgctttacatttgaatgatgttctttgtacttggatattgatcctatttctgattcagttttgaaaggaattaacatcaagtggacttcatgtcacttaacagtgcttttttgtatacatttttaaagaaaattagtcattttactttgatttttgagttagcaattcacaagcaggtaattaaacacttttagaagaaaaatattggtctaataataatcttaactcatctttttgacatagtaaagaaaaaggaactctgcagaagcaaaattttttagtatgtggcaaacaactaagcaactagatttttcttggctttcttagtattcttccatagcttgtaattcattaaacattcctattcagctttctatactaatttcatatatatatatatgtattttgcttcatgaaagcattgctgcttttcttcttcatcagtaattagtaaacttagcttcctaaccccttataacttatgccttattaacgatagtgaacataccagtaagcattgaaattagtgttactctgatatgtcaaactcattctagaagttatgcttttccttaccattactgtattagtggacgtcctgcagcctatcattctattgttcattaaatacagctaatgaaccttatttagagtaattgaaagggaataatagaagattttaagggaatgacattttcttccaggagtgaacttataaaatattgttatttgaaggttttctagggacttctttttagtaagtaaattagaattagccctttctttataaattaatgctgctgaaatgcttaaaatatacttaacttttaaaaacattatctttgattttatttaagtgtttaattggcattatctgtggaagaaatgctttattaactgagacaccactgtgtttctgatatacttataaaaaaactcatgaggttttattttatttttcaggttttgtaaatagatatacagggaaataattaaatataaagaagtagactatatttaacattaactggaatagttaaccagttctatctatacattagaatgttcatcttttcagactaagtttactgaaaagattcttgcattaggtaaattttagtagattggactaagttgagggagttaatcccttctgagcttttagaattctaaagccattgcatagaaactctctgggaaagacaaatggttaagatatgtagccacaggctcctgtttggatttgtattgacatcaaaaagaagatgataatgatggatcttacatgtttatttgaaggctctcagaaagaggatacattctagatttatcctttatttcagaaggtagcattagcaagtgggaagaggagaatggtgaaggaaggcataagtgggagaaagtggagaaggtgacaggtggaaggcagaggcaaactgtcttggaagcagcttttagctcaaattaagatatcttaaggggagaattacccaacaaaagaacaaactacttaatgcagtcatggggttttacttctctacagttacttcttttttaaatataggttgaagaaggaagtaaaaatatacggctaggttcactaattggtttgatagtagaagaaggagaagattggaaacatgttgaaattcccaaagacgtaggtcctccaccaccagtttcaaaaccttcagagcctcgcccctcaccagaaccacagatttccatccctgtcaagaaggaacacatacccgggacactacggtgagtatatatttattcaaaggatgatgtaaaaaaaaaaagttatggcagttcttatggaattgtaatcattatcatattcgcacatcgttgtacatcacgtaggaagttgctgttctcagcacactcagaccttagagtgtgtgtttttttttttaaccatcattgttcattcagtaaataaatagttactgaatatctgctatgttccaggtactctaaaagccctgcttgcacaatggaaaaccaaacagtatgtgtccatgttgaggttgaattaggttttagaagtctaaaatggtattcaatataccaaacttgatactctgttcccatttatggagttctaattactgttacaggaattccaagctcaaatgtctatctgatataaaatagaattcatgttttaacatgcattcgttttcaaactagtctgcattatgactttccggcacagactagagctcaattttgtctgttctgtaacaaaacagataacttaatacacatcatttcactttagttttacattgctttaatagaagaactctgtaaattctaacatttcatttatttagtattctatataattatacaacattactttttctttacgagaaaaagatcttcataaagtagacctcttcattcttaaacattttttcctttagtttatcattgtcagaaaagaatccacagtgctttttttaggggggggcgtgcggaggtgggtgacggagttttgatctcattgcccaggctggagtgcaatggtgcaatctcagcttaccgcaacctcggtcttctgggttcaagcgattctcctgcctcagcctcctgagtagctggaattacaggcatgtgccaccatgcctggctaatttttttgtatttttggtagagatggagtttctccatgttggccaggctggtctcgaactcctgacttcatgatccgcctgcctcggcttcccaaagtgctgggattacaggcgtgagccactgcgcctggcctgctttttgaagtactgattttaaattcctagtgcaaagtgtttctgactctgttgccttgactcccatttactgtctcctctttcatttaccctaaaaattggaagacagtctcactgatgctttctaactaatggtcttctgcccttgcaaagataataatagtatgtaccctaattaagatcagtcatcatcagagactcgcatgaatcaggccccactgtgtaggttaaaaacctactgacctgtgaactctgcatactgttgggcacacagtgaatgaaaaaaaaatttttttttggttggttggttactaatcctatataaaaatctaaaatttcagattctcttgaaaaatctaaagatttagtaacattgggcccatatcagagttatttaatacttccctgaaatgcggcaagttccacagttgtttctgtctcttagctttaatttctagatccagcctgttttaatctgtactaatcaggcttattttctttatctgaccatgtagtaatttgtttactactttgcatacaagagatataccattagtcatgtaatctgaggtatcctatatatataataaatatatataattgtgtatacatacaattcaacctcagcaaaacaacccaattaaaaaacaggtgaagaactttaatagcatttctcccaagaagatacatagatggccagcaggcacatgaaaaatatgttcaccgtcactaaccattagggaaatgaaaatcaaaaccacaatgagacaccccttcatacccttcaggatggctagtatcaaaacaaacaaacaaacaaaaaccaaaccagacccagattataacaagtgttggcaaggacatggataatttggaacccttgttgttgcctagtggaagtgtaaaatgctgcagctactgtggaaaacagtatggcagtttcttagaaaattaaaattaccatatcatctagtaggtccacttccagatatatatgcaaaataactgaaagcaaagactggaaagagatatttgtacatctatgttcatagcaacattattcacagtagcaaaatggtagaaacaactcataagtccaaaatgctatgaaatgtgattcagctttttaggaaggaaattctgataaatgctgcatggataaaccttgagaatattatgctcagtaaaataagccagtcacaaaacaaataactgtatgattctacttatgtgagttacctagagtagtcaaattgacagagacaaagagaatggttaccaggggttgggaggaaggaggaatggagagttactgtttaatagatacagagtttcaatttggaaagatgaacatttctggagatagatggtggtgatggttgcacaatagtgtgattgtactaaatgccactcagttgtacacctaaaaatgcttaaaatgataaattttaggtatcatttgccacaatacaaaatatatgaagaaatgatagaacaaaatatacgaaggaaacaattggtagttgtgatgagcacccatgtgaaagtaattagttgaaatagcagctctttcccctaattaatatttattcttattaaaatcatatttagaaatagtaactaaatttttacgaaagtgtttaaagaataaaataaaccaaattggtacagattatttgactgtgaccatctgtgggagtcattttagctttattataagatttttttttaattatttgcgaaactgttgacatttagatctatttgaatcaaatgtaagtgttaattggttctattaaccttcatatttttttcttaggttccgtttaagtccagctgcccgcaatattctggaaaaacactcactggatgctagccagggcacagccactggccctcgggggatattcactaaagagtatgtgtttgctttttgtaataaccagttccattatttattatgatcatgtttttttgaaagaaaataaaaagagcttattcagtcttaagatttaaaaggaggtacactgttcttcttttgtacttttaattgcttttatcattgtaaattgtattctatgcaagagttgttttctgaataattatagcattactgaagaacagctctaatttggtaactaagcaagatccttagaagtggtaataaatgcagaaaattagagcgtagaacagtgaaactttatacagtattaaatatgtgaaatcatgcaataacatttacatttctaaaacaaggaaatatatttttaaaaaattattttcattatccctttgaattttattcacttgtgctgttataaagcaatttccatatacagtttggtctctttttagattttcttttctatttcactgatccatctgtccatgagttagtaccatacttttttagtaccacacttttaattagaaatgttttattgtatgctttaaaatctgataacaatagctttgctctttttttaaatcagttttcttagttcattcttattttattattcttccaaatgaattttaagcagttcgtctagctccatgggtaggagtgaggggtatttttatgggattgtatcacattttaaattaactttgtgagaactgacatctttatcatgatgggtctttctgttctgcaacactggtttaaatgtttgtgtctttccattagtttaaatgtttgtgtctttcaaaacagatggcccctgttctgttgaaacttagtctagtagggtagacaaagattaatcaaataggcttatgaactaatgtaagatttcagtagtgttatgtgctacatttttattggcagtaatagtaaatgtttcaaattgagtttatgttttaaagcaatgtactcattccatatttatctaatattgataggaaataaaaaataatattggccagaatttttgtaagtcgagagagagcaatggttgttaaattataagtggcagtgttgggccaggcaatgttttcttttttccactgggttattttactcttcatgaaagctttggcttactgttgggtgtttattttattgaaagcagtatatagatttaattcttagatatcctcatttatgtgtattacactcttactaatttgttaactgaatgtatgtggttctatcacacacatactgtgaagttcgtgccacactgcatgagttggaaatcagctgtcctgagagctgactgaaaggcaacatcccagaccatgggatttttagttaaaggatttaaaagttacacttagctgtaaaaaattaaaattaagaaccttggttgccagttaatcccagttttttccccacaccaatcctgatttgtgtctactgttggtatcttaatcttgttagtctctaccagtctgtgccttagtagcactctctgtaaaaatgggagaaagcaactatttttataacaaagtagatttgccttgctcataattctgaggattaggaataagagtctgtatttaattcattaatctttgaggatttggtgaaatgtaaaataatgattgctgcaccttagggggatcagttctgcaaatttgtgtaagataaactggagcagaaaaagatgagataaggagataaattaataggctcctaaagtaatccatgtaagaggtaatgaatacttgaatgtggttagaagaactaaaagggagatccctgatacagacaacattgtaaggataaagtccagaagcctttgcagattaaatgtggagtgtaggccagagtagcaacaagtaagggaatgaatttggatctggtctaggtgatgatagtttggtctccataaatagaaataatggatttgggaagcatttgttttggtggagttagtaatgtttgaagcttattgtcaggacttagaagccatgtaggtattgggatcaatgagatgaagatgtatctcaggagatagttggggattagagaggtagatttggtagataataaagcaatagttataattgagatcatcaatagggaaactagaggttaaaatccttgagttggaggatacctgggaaatgtgggaaaagtcaaggatggtaggatctaagaaaagcctcttaaatttggtaatatggtgttcagtagtgtgacagcagtaaaataaagaaataaaggtttcttccttccttttctttccatgtgtgcttaatacatatatgatgcgcaaatatctttttttaaacctgagttgaaagttataatattaatgaaacatttcttaagaacaaaatggtattatctcctgaataccataaggaagcagtattaaagagttaggcttttagtattattgccatcttttctaccctgttacccttttctcttccctgcctttattccttaactctccacgagaaaggcatcagcctttggtcttcaaaataagaactagtacaaaagatttcatgagaaaaatggatcctgaaagcatatattattgaggatttttgcttttctatactgctaaaaatgcctgcattttaagtttatcattaaggtgagctttggaaaaaattttagcctaatgtcgtcttctgctatggttgaaaaattgcaggctttggcatagctgtccccaaaatatcttagcacacttttttattttttaacgttttgaatttttttttctttaagagagagacaggctctcactctgtcacccaggttggggtgctgtggtgtattcatagctcactgcagctttgaactcctaggctgaagtggtcctatcacctcaacctcccaaatagttgggactacaggtgtgccaccatgcctggctaaatttttaaaacagttttgtagagacggtttctcactaggttgcccaggctggtctcaagctcttggcctcaggtgaccctcccacctcagcctctcgaagtgctgggaatgcagacgtgagccactgtgcccagccaacacacgttcttgacacggtgaggacatgctccataccatgtccactaaaagtctgggtagaaaaatcagttccaaatgctgaaggaaatgcctccagcccactgtatttgtgaagaaaatcttgggtatcagggctgctattttaattttgccttaaaacaagcattgctcagaatacatgttgtaccaaagaatatagacttgactttgcttgtacatgtgactgttttaagaaagcagtgtcgaggccacaattagaagcagaacacatttagtttctttgcctgcagccccaatgtctttggtacatctgtgtcctaaatcatagttgtagtaatgtttgtattcatcacacagcatcaaaaattaggtaagtatgacaggcaagtgcctagtgtgttttagtggtattttcaaaatgaattcatgtcacacccaaatgaattgctctctcagggaacccagtagagaaggttgtacctgagttaacttccagagcatcctctgcctatctgcctatttctgccagtggccagaatgaatttgtgtggtatatttttctcctaatttttatagcttttaatgtctacctaatgctccaagtttagtctgattatttaatgtgcagaaatcattaaaaccattttctgcctcacaaaaaactaaatcattggctgttactaaacaataattaagatttatacttcataggtatgtaagtataaaatcagcaataaaaagaccaggtgcagtgactcacacctgtaatcccagtgctttgggagaccaaggctggcgaatcacttgaggccaggagtttgagaccagtctggccaacatggtaaaaccccatctctactaaaaatataaaaattagccaggcgtggtgatgcacacctgtaatctcagctactaaagaggctgaggcatgagaatctcttgaaccctggaggcggtggttgcagtgagctgagatcgcgccactgcactccagcctgggtgacagagtgagactctttaaaaaataaaaaaaaaataaaatcagcaatacaagtttttgtgagcaagaagaagcaattttgttcttgcttctttatgattaacctacccaagaaccttaattactacagagataaaactaaactgctttttaaaaaataaagtagcagtaatagttatgctaaatatgtaatattagcataactaatattagctattagcataactaatattagctagctattagcatattattagcataactaaatattacatattactaaatatgctaataagtaatagttatgctaaaaatgtgtcaatttagtgtcagcaaccttttttttaaatagatgtattcgggcattaacgatacagatttttgcaccccagttagactgttcctgcttgtgttgatattctattattgcataacaagttacagtaaacttaccagcttaaaataatacctgtttgttttctaacagttcaataggttagaagtcctggcatagcatggccaggttctgaactcatggtctcacaaggctgaaatcaaagtgttggccaaggctggggactcatgtgaagcttggggtcctcttccaagctcatgtggttgttgacagaatgcagttccttgggactgtaggactgtggcccttgttttctttctagctctcagccaagaaccactgacagctcccagaggccacgtgcagggccttgccatgcgtggtctccataggcggttcacaacatgcatgtttgcttctcccgggccagcagttttatctctttacttcaagtctcttcttccaggaaggcctaatttcttttaagagattacctgatatatctgccctctccagggtagtttgccttttggttaactcaaatgcaactgatttggagcctcatatatctataaaatgccaccaattttgtcacataataggacctaataatgggagtgacatccatcatattcacaggccagatacagtcaagagggatgatatggggcatgtacaccaggggcaggaatattggggccatctcagaattcttcctaccatgttgccataagtaaaggggtcttctcaaatatgctcaacaggtgctagcttttatctttcatcaaatttttggaaaaataataccaaaatattaactgagaaataatttttccttagattttgtgtcatcctgaagttctttttagattatataaaacaattttttttcttaaattggaaaaaatactttccaaaatacttattggatattaaaatgttccaaaaattattttaagaaaatatattgcctaataccactgtaacttagcatagtgagttgagggcttagcatatttagtaatctaattatatcctcttacaagacaaaaatacctttgttttacagagtaatacaaaggcaagtctgtaactagttatttttcattctaaaagatatcataggttagatttgttatattagattgtactgatggcatattagcaaaattaaaaatggtttgatttcctggtcataaataagctgatttgcactataataaacaatgaataaacaataagtgaacaatgatgtaggaagtatcctggtgaaagccatatttacaataaacttgacactttttgaatgccatgtgaatattatttcatgagtataaaggatgagagtggtttaattaattgttcatctaccaaataacgtccactgcacagaaaaaaagactaatttcctttttaaaaatcactacttatgcccaattttaataacattttaattgtttggcttttgaaaatatgcaaatattagaacgtgacaaataatggtcagcagaccaggtaagagacaggatttaattttctagctcaaattactggtttttaattataaccttgacatctgtatatttctgtatcttttctccacatctcacctgcgttttctgaaagttctgttatattccttattgctaattatggttatctactttgctcttatttccagggatgctctcaaacttgtccagttgaaacaaacgggcaagattaccgagtccagaccaactccagcccccacagccactcccacagcaccttcgcccctacaggccacagctggaccatcttatccccggcctgtgatcccaccagtatcaactcctggacaacccaatgcagtggtagtgttctctaagtggatttttatttctttttcttgtttttctttttttttttgagacagagtcttgcactgtcacccaggctggagtgcaatggcacaatcttggctcactgcagcctctgcctcccaagttcaagtgattctcctgccttagcttcctgagtagctgggattataggcacgcaccaccacacccacctaatttttgtatttttagtagagacggggtttcaccatgttggctaggctggtctcaaactcctgacttcaggtgatccacccgccttggcctcccaaagtgctgggattacaggtgtgaatcaccgcacctggcctagatttttatttttcagattcaagtgtgagagagaaaataagaacaattactatgtgttttaagagtagatttaaaacagattagttttattaatccgtttcaatagtagctaagtgataaggataaaacactccaaatgctttgttttacagatttcctatcagaaaccaaaatttgtttgtgtgttaacttccaaataaacattagaactataattcaatttaaagttaccacaagttccacaacttcagtaacatatatattctctacaatctcatgtttcatgtcttaagtgtgatactaataattagtagctgacactagctcccttttgtggatatgttctactttttaactagggaattgataatctcactatgaagaactatgtagctagtcattctttccttctcagatgcatgcagtataacagcccctttttgttttcaaattactccattttgcctctctgtgcctttcctattcaggttattttcttcctatcagaagaaatgtaggatagcccagtttatttaaaatcgaatgggcacttaaaaaaataaatagataaatgtgtactcctagtggagaactatataccatatgatattttaaaagagttgaaaacagtacaactttcatgggaaacagatttttaaatatccattaatgattaatatactgcatacttgaataacctgctctttaaggacatgcagttggataagatactatgtatattgagtgtatagtccactctttgactatataatgtatatggactatgaaatatgtataattcaatcatatgtcttttaaaagtaggttattcaaggctgggtgtggtggcttacacctgtaatcctagcactttgggaggctgaggtgggaggattgcctgcacctaggcattcaaagaccagcctgggcaacatagtgagacctcatctctacaaaaaaattttaaaatcagctggatgtggtagtgtgtgcctgtagtccaactactcaggcggtggagattggggaatcacttgagactgggaggttgaggctgtagtgagctatgtgcactccagcctgggtaatagaggaagaccctatctcaaaaaaaaaaaaaaaaaagttattcaaattaaggaggtaaaccttactttcaaattcttatggtatgtagagagcatttattctacttgaccaagtactttgctaacataaaatgtttaatttcttaatgatatttgtaaaaatgaaatcagccgcactttcatttgctttgtattatcttgaagtgattgtaatgaaatcccaaaatagagtgaaggacaagaaaggaattagatataatttaaaatctgtcatgcttttttgagagatccaaggaacagaatggaaaaactacagtgaagttataggaatattttattatctcattcatactttctattatgaatctgtaagaaataagatactcatgttatttttaaaaattacaaatccaaatagaaataattgaattgcctgtatagaaggtccctaatcttctaatgtcccttgtgatttctttgatccatgagttgtttataagtgtgaatttaatttcaaaatattggaagacccttcagttacctttcatgatttctagtttaactccactgtgtttagagaatacactttgagacacacttcattttaaaacaatcttctcaaatttattgagatttattttatatttataacatggcctgtcttggtggatgttccatgtgtacttgaaaagatggttcgacttataattttttgacttcacgatggtgtaaaagtgatacacattcagtagaaagcagtgcagtatttccttgcaatgctgggcagtagcggctagccacagctccaagttagccatgtgatcatcagggcaaacaaccactgctctgcagtgtactgtgtagccaggtgattttgcccaactataggctaatgtaaatgttttgagcacatttatggtaggctatgctaaggcttacctgtgatgttcagtatgttaggtgtattaaatgcactttgacttatgatattttaaacttacgatgggttcatcagagtgtcacttcatcataagtcaaagggcaactatatattaatagttggtttgttgatttattggctgttttatttcaggtggttttttttcttttttttttttttcccgaaacaatcttgctctgtcgcccaggctggagtgcagtggcgcgatcttggctcagtgcaacctctgtctccccggttcaagtgattctgctgcctcagcctcctgagtagctgggattacaggcacgcgccaccacactcagctaatttttgtattcttagtagagatggggtttcaccatgttggccaagctggtcttgaactcttgacctcatgatccacctgcctcagcctcccaaagtaatcctgagattacaggtgtgagccaccgtgcccagcccatttcagttttattaagtgatatttgtaacaaaagctgcttacagatggtgtatgtctatgtctgtcttctctctcctctctctctctgtgtatgtatgtacacacacatatattgctccttgtgtgtgtgtggtatgtgtgtgtgtacgtatatatacacacacaaacacacctgtgaaggaattgttcattatttggtaggtttctttcttatcatcttaaatatagtaacataagatatcccattcacaattgaaacatgaattttattacttttttctgtagttatatgctataaaaccaaagcgtctcagattttttatattcttcccttatactaagaattttaatagtgcttttcttgtgttaatctttaattaataagttaggtcattgagaatgaatttcttttcatttataaagttgcttgttttttgttttatttttctattccacttgtggtttaacggacaggttgctgtctttttgcagggcacattcactgaaatccccgccagcaatattcgaagagttattgccaagagattaactgaatctaaaagtactgtacctcatgcatatgctactgctgactgtgaccttggagctgttttaaaagttaggcaagatctggtcaaaggttagtaaaattgaatttacttaatacaaaacacatgctaacttaactttcatgaaatcctttataaaattataaaattaaaagctacattgtgtagcttttaatttcaatttcataatgtacttgcactctactctgggtatatttgtgctagaggaaaaaaattagcaatggtttccttgaaaaagtgaattggttccacagtattaaataaatcacagatgcctttatgcagaaaaaagcattctgttctaccttgcttttatttcctctttgtcatatttgaataatgtacagttagttaacatttatttagcaggcaattactgagttcaattctctgttacatactgagctttaaaaatacaggttgagcaacccaaaaccaaaacttcaaagtgcttcaagatgtgaaactttttgagtgccaacatgaagctcaaaggaagtcctcattggagcttttcagattttggatttttggactagagatgccaaaacagtaaatgtaatattacaaaatctgaataaattttgaaatctgaaacacttctggttccaagtattttggataagggatactgaaatctgaagtactataatttggttggttagtttttttaaaagcaaaagtgggcttaatgttttggtgtgctttagcatttacataggtcaatttttttgtaagaacacatgaatgagttgtgtagaccaaatggttattttttgttttgaatattttttggtatggtatttaaacaaagcagtcaatatttcattaagtttaaaatccaaaacttttaaggatgttttagattataaatatcttatatattcttctttatacaaattttgattttatatttcttgttcagaatgcatttacagattattaaatttgtaatatttcttccaaaaatcaattataaataaggttgctgagagacatacagattttttagcatgaactgatagttttatttctttatttttgacctatatggcctttatattattttcttgtcttattgcactgactaggacctctgtctggtataatgaatatagatggtaaaagcagatatttttgccttgttcttgattttgggggaaaagcattcagtcttttatgttagctataggttttttgtagaatattattttcaggttgaaagaatttccattcctaacttgcagagagttttaaacatgaatagatgttgaattttctcaaatactttttgtgcatcttttcagataacttttcctttttctgtctgttaataaggtgaattacattggttgattttcaaatgttgaatcaactttgtattcctcatataaaatccacttaatgattaaccttctcatatattgtttgattctgtatcctaaaattttgtttagaatctttacacctatgcccatgagaaatgctaacctgtagttttcttttctggagacattttttcagatttgttatcttatctagtggaatgggttggaaaacatgtcctcctcctttattttctggaagagtttggatacaattggtattatttcttttttaattgtttagtagaattcactagtgaatttctttatgggaaggtttttaactatgaattttattttaaaaatgggtgcagctttttttttcttgaatgaattttggtagtttgtgtctttcaagaaatttgtgtcatctaagtcaccagatttattggcataaagttattcaccacattaccttattatactgtcattttatctgaagtaatgtttctgtttttgacattagtaatttgtgtgttttactctctagatcactctgactaaagggttatcagttctgttgatctcgatctcttcaaagaaccagcatttggttttattaacttatctagtatttctgtgatactgatctcattgatttctgttctttattttttttttctctttgctttcagtttactttgctcttttatttctagtttcttaaggtgaaaagttggatcatttatttgagacctttattttttaatataagcatatagtactcttgaattatctttaagcactgctttagctgtatcccacaaatgttgattttttttttttttcttcttgagacagggtcttgctgtgtcacccaggctggagtgcagtggtgcgatctcggttcacttcaaccaccgcctcctgggttcaaatgattctcacgcctcagtgccctgagtagctaggattacaggcacaaaccaccatgcctggctaattgtttgtatttttactagagacggtgttttagcatgttggccacgctggtctcaaactcctggcctcaagtgatccacccacctaggcctcccaaagtgctgaaattacaagtgtgagccaccacgcctggcattatttttccttttattcaattaaaaatgttttctcatttatttattttgtgatttctttgatcgatgagttatttgtaagtgtgcacttaatttcaaaatatttgagaactattcatttctcttttatgatttctagcttaactacattgtgtttagagaacacactttatatgatttcagttttcttaaatttgttgatatttattttatgtttgtagtatggtctgtcttggtatgtgttcttgaaaagaatttttttatttttgcaaaggaatgttctataaatgtcaggccaagctggttaatagtgttgtttatgtcttttgagagcagtgttgatattcctcattataattgtttatttgtggtttctcctttcagctctgtcggtttttgcttcatgtatcctgaagatctattattggccacatacacagttaggaattttgttttcttgaacagaccagttattatgtcatgtccttatctattccttgtaatattccttatcctcaagccttctttatcacatctgtagccactgcagatttctttgactcgtgtttctatagtatatctttttgcatctttttactttttaaatgtaaatatgtttatttaagtaggtttcttgaaggcagcgtgtagttggttcttgctattttatccaattctttagtctcttaagatgtttagaccgctcacatttaatgggatagttggatttaaatctaccattttgttctttctttgcattctctttgtcccacctcttttattcttctttccttatctttttggttacttattttgttatcattctattgtatttattcattttatcttcttttttctcttcttacctgctttgcaatggttttcttagggtttacaatgtaattctttaatttatcacggcctggcttcaaattgtattacaccccactccatgtttaatataagaacctcataactatatacttgcacttcctccctctcatattttgtactgctgttgtcatgttttacttctatatatgatgtaagccccagaatacatgtttaatgttttttgctttagcaaataaactcttttggagttttaaaatgagggaaaaaatgtcttttatatttatctgtactttttttcatttctttgtatagaattaaagtgctgtctgctattatacttcttacccaaagaacttcctttaatgcttcttatagtacagattgactgacaataaattttctcagtttttgtctgaaaaagtctattttgtctttcacattgttcctttttaaaacaattttttaaagtgtagttgaatatataacatgagtcttaccattttccgtgtacagttagttcgttgacattaagtacatttacattgtttgcaaccattgccaccattcatctgcagaacgtttttcatcctgcaaaatggaaactctgtatactcttcattcctctttcccaccacccctgacaatcaccattcttctttctgttcctataaatttgatgattctaagtacatcatattagtgggatcatatagtacttgtccttttgtgactggcttattccacttggcattatgtcttcagggttcatgcatgttgcagaatgtataaaaatttcctttttaaggctgaacagtgttccattgtatgtatctaccctactttgttaattcatgtgttaatggataaatacattaggttgtttttaccttttggctattgtgaataatactgctgtgaacgtggctgtacaaatatctctttgtgtctctgttttcaaatattttaggtatatccccagaagtggaattactggattatatgataattctatttttaattttttaaggagctaccatactgttttccttagtggctgtgccattttgcattcccactaatggcgcaccaatgggtcaggcatgatggctcatccctgtaatcctatcactttgggaggctgaggacaggggttcgagacctgcctgggaaacagaacgagaccctatctctacaaaaaaattgaaaaactagtcgggcagatggcatatgcctgtagtcccagctacttgggagactgaggtgggaggattgcttgagcccaggagttggaggttacagtgagctataattgcaccacttaattccagcctggctcatagagcaagacctgtctccaaaaacaaaaatgaagtgcacaaaggttgaaatttctccacatttttgccaatacttgttattttctggtttttgatagtagtcaccctaatggatatatctttatcatttttaagaattatttttgctggatatagatttttcagttaataggggttttgtttcagttctttaaataaagatactatttctttattttctgtcttagaatgtctgctgccgttcttaatatttgttccattgtatatgatgttttccacctgtctggttgctttcaagattttctgcattaccaatttggctattgtatgcctagatttttttttctattgtatttactgtttgggtttctctcagcttcttagatgtatggtttgttgtcttcctttaattgtgaaaaatttccagttatttttaatgatatcttctgttccatgtggtttctctttggggctccaattttaaatgttagactttttgaattgcccaaagctcttaagtgctctattttttttgttcattcttttttctctttatgtttcatattggataatttttgtttacctagcttcaagttcactgatttcttagctgtgtctgcaaagcttagcaaaatatatattttttatcttggttagcatggattttcccctctggatttccaattgaatgtttttttagtttccatttctctgctgctagtcgccatctgtttatgcatgttgtaccatactctgccctctttactcctgtactctgacagtgggtatttacttcctgtgtttgtctctcctctgagtggattatcactctttggcattcagttcacctgtttgctttgtaacctccgctccctaatgagctcaagaaaagttacgattttgtaatttatcctgctttttctttcaccctgtcaggatgggaacagctttcttttgcaactttctacatcccaggtgaaagcaggacttttatcagtttatatacagagtttcaagatttcatataaagacaacttgagagcttttaaaagttcaaggaactaaatggaaagctattttaaagaaagtgagaagtttctaaaaaatgaaccctggaaacactcctgcagttctcagatcatacttgcttagtcatgatatagaggttaatatgggaatcactttcctgttttcttactctaataaggcagaaaacagtaatatttcagaggagatatggattagtttattatctttgcatggtccagttttggtacaccttggtaattaggaattttcttaaaaatctttacaccccacattatctatcttcactcctctttctcatataaagttacaatacataacattctgtatgcatgcttcacactttgcttttctgtcttgacaatgtgtaaatgagaatgtttgatattaccttacaaactgttttctactcagtaaatgtaacagcatctcctttcaatatgtttggaaaatctccattataaagagttaaaaataaaggaattcaaagagaaacctactttacacatgttagatttgagatgcttgtaagcgatgcaagtagaaatttcatgtgagaagttggatatacaagtctgaagcctcagtatctcagaattagaggtagaatttggaagagtcatcattatataaatggtatcaaaaccttggaattggaactggaacttctagcctggggagatgccaacattgagaggaaaggaataaaaatgagtgagtgggcagaaagtggaagaaaaccaggagagtatagtgacataggagccagtaaaagaatatatttcattcaactcaagaatgttcctaaatgtgggagtatgctgaatacagaattttaagtgaggactgtggacttaggtggtaggtttgggggtcattagctggcagatggttttagaagtcttcactgtgaatacctgtgggtaagtagataaagtgaagagaaagctgagagagccatgaaaggtaagcagagtaagttcatgaactgttacatttgaatttgtacaaaccaaatctttctatgtggttatcattaaaagcttgtaagcactgtaagtccatttatatttctattcctaaaggggttttaagcaaaaatgtttatatatttctggaattctgaattagaggagctttgatactttgcagctgacagttatcgtgacagtttgacagtatttaggtttatggtaattcatctaatccctttctgtagtctccaggatgcctttggaatgagctgttattcacctaaaattccgtgatactttagtaataggataggttttttgccacataccactgactagatctagatcttagagtctttttctataagctcttgcaagaaagaatcaagtgttgtttacattttctaacactgttatacccagtggcaaatgcaaagacataaacaaatactttagttatgatcagctcgtaggaagtgggaggaccccagctttatcttaaaatcattatgtatactggaaagaaattgattcaaatgcattcaccataaaactatggatggagaacctcattttattaatcacactaggacctatgccagcattgcttcatctttggcttttgttatatcctgttttgttaagttaaaaagcagttaaattttttttcacctacaccccattagtaaaaagaaattttcgaacactttcccatatgtgtatatataactgtttatatataaagtacctacatgtatcactgttctagtataatcagtatgttataaagcatacagagaataagggtatttgaaaagaacgaggaagaaaatgaatcatcttgtaaacttcctgactgcacacaccacagagagatcatttgtctttttcgagacataggagttagttctttttttctgattatgcttgtaatgggtccttcaggttcttgtgtatgatatctaagcaatttaaaaaattgataaccaaggcccagaagtaaacttacattcatggttaatattattgatccaggacctcatataatgcaagtttttctaatcatgggaaccttattgactaagcaaacaaaagcttgtaattttttatcattgtttgtcagtacattccataatttacaagtttgaagttgtaatggtcaatgttaaagttatattaggaatactaattttactaaccttatttttctttcagatgacattaaagtatcagtaaatgattttatcatcaaggcagcagctgttacccttaaagtaagtagcagacttcaaatgattttgtcttcttaagtagtttcatgtcgtggaatttttacaatgacaaatagaactcttatttttaaatcacaaaaattttataattgtcttgctaaaaatatcctatcgtttgatctccctcattttacaaatgaagaaactgtaaatcaaaagggctcacaatgaattagagcaggatgaaaaccatttattctaggcattagagatagagcagtaaacaaaagcttacttgatttctgctgtccctggggcttacattctagttggaggagacaaacactattatatgtcagatggtgaaagtgctgaggagaaaaagaaaggataaggggacaaagtaactaggggtgatttttcaaaagggaagcgagggaagcccctctgacaaggcgataatttagatacggcctgagaaaacagagggagtgagccacataggtatgtggtaaaagtgcattccacacagagggaccagcaaacaccaaggctgcaagcagaggatcgcattaaccaaagatgtggtgctgagggtggaatgtgcctagtatggagaggtgggagataagatttaaataacagtgggagagcatgaaggggaacccaaatacatgaggccttgttggacatggtgaggactagggattttattatgggtgagaaggaagcctttggagggttttgaacaaataactaatgtgatctgacttatacttcagaaacgaaaaggagaggctgccctgggtgctgtgtagaatgtagcctgtggagaggcaagggaggagacgatgagctcccctgggaggctttagaagatcacagtggcttggacaaatgtggtagcaaatggagctagggtgaagtggagatttgtgttatgtttcaaaagtagagccaacaggatttgctgatggattggatatggggtgtgagaaagagaaacaagcattttggcccaagcaatgggaggaatgagttttccatgtactaagattgggaaaactgggaggggtatagctttgggttaaggaatctagagtttggttttagacatgttacatttgaggagcctaacagatattccagtggaggtggcaggaaggcaggtgaacatatgagcctgcagttcagtggaggtgatgtaaacctagctggctggagttgtaaatctagaacccaggcttcctgccttcctgcctggcactatttttcatcatgcctcctttctgtaacgaggctattttctgggatcactgcttgttaacagactgtatttaaagtacatttataattaactttttatttcttgaaaaatacattaatgagggttccatggtgtaatggttagcactctgtattctgaaaattacattaatacagaacttaaaaagcatgccctttcagcagtatctaattattcatataacttttctcttttgatgaaatattttgaattatattaatgatttaattaattgactattattgtgattgatatcattaattgtgaatcatttttgcactccttaaataaatctctaatgggcataagctattcgttaatatttcattggataatgtttgtatccagagtcataagtagtggtaatttaaattttgtgccaacattatcagaccttttttccctaatcattggcttcattaaatgaatttggattatttcttcttttctttcctctgtacacatttcaatattataaatttttttatattttctagtttcatagaattcaccagtaaaaatatctgaacctgcttctattttgaggaggggatcttggcagctttccctttttttttttctttcaccataattactgatctgttttaattttcagcttttttaaaaaatcaattttaaaagcttatattttcccagaaaatcactcatttaatttagattcccaaacttactagcctagagtcattttaatttgtttcttataattattttaacatcctcagtgcctggggttattctgacctctatctcacttctattgcatatttatatattcttagcttgtattgttttgttatgtattttttccttcatttccttagattcattttggtcagaactttaatgtgtaattcattttaattttttttaataaggtttaagatagtttcttttttttttttttgagcagcagcaagatttattgtgaagagcaaaagaacaaagcttccacagcatggaaggggacccgagtggattgccctaagataatagatttttaatgcaactttgaccgtgtcccataagtcttctttacattttgtaattaaatttatttgccatatattcttcattcatgagggttttgtttagtttctcttttactttagtgttgtctatgaagaatttcaaatcttctgagggtttgggactttattcttttaacataatgatattgttgaatgagtgaaggaactcagccttgaaagatggaaaaatggaagagcaattgaaaagcaatgtgaaggtagccttgcaatggaaatgagcgtagcatgacagtgagccaagtggaaaattcatctcaggggagtggtcacaagtaaaatgggatagatagagtggaatcaaattgtatattgccatgcttaaatgacataccaggaggcctggatctttttctttagaaaacaaagaatttttgagaacagaaatttgttttcagtttctgtttttcagcatcattttcacctgtgatacagggcaagattattaataggcagggtttccaggcatttcatcatttgatgaaatctttttttttattattattatactttaagttttagggtacatgtgcacaatgtgcaggttagttacatatgtatacatgtgccgtgttggtgtgctgcacccagtaacaagtcatttaacattaggtatatctccaaatgctgtccttcccccctcccccaaccccacaacaggcccgggtgtgtgatgttccctttccctgtgtccatgtgttcccattgttcaattcccacctatgagtgacaacatgcggtgtttggttttttgtccttgaggtagtttgccgagaatgatggtttccagcttcatccatgtccctacaaaggacatgaactcatcattttttatggctgcatagtattccatggtgtatatgtgccacattttcttaatccagtctatcattgttggacatttgggttggttccaagtctttgctattgtgaatagtgccacaataaacatatgtgtgcatgtgtctttatagcagcatgatttataatcttttgggtatatacccagtaaagggattgctgggtcaaatggtatttctagttctagatccctgaggaatcgccacactgacttccacaatggttgaactagtttacagtcccaccagcagtgtaaaagtgttcctatttctccacatcctctccagcacctgttgtttcctgactttttaatgattgccattctaactggtgtgagatggtatctcagtgtggttttgatttgcatttctttgatgactagtgatgatgagcattttttcatgtgtcttttggctgcataaatgtcttcttttgagaagtgtctgttcatatccctcgcccacttgttgatagggttgtttgtttttttcttgtaaatttgtttgagttcattgtagattctggatattagccctttgtcagatgagtagattgcaaaaatgttttcccattctgtaggttgcctgttcactctgatggtagtttcttttgctgtgcagaagctctttagtttaatgagatcccatttgtcaattttggcttttgttgccattgcttttggtgttttagacatgaagtccttgcacatgcctgtgttctgaatggtattgcctaggttttcttctagggtttttatggttttaggtctaacatttaagtctttaatccatcttgaattaatttttgtataaggtgtaaggaagagttccagtttcagctttctacatatggctagccagttttcccagcaccatttattaaatagggaatcgtttccccatttcttgtttttgtcaggtttgtcaaagatcagatggttgtagatatgccgcattattaaaattgacaccctaacattataactaaaagaactagagaagcaagagcaaacaaattcaaaagctagcagaaggcaagaaataactaagatcagagcagaactgaagggaatagagacacaaaaaaaccttcaaaaaatccatgaatccgggagctggtttttttgaaaagatcaacaaaattgatagactgctagcaagactaataaagaagaaaagagagaagaatcaaatagacgcaataaaaaatgataaaggcgatatcaccaccgatcccacagaaatgcaaactaccgtcagagaatactataaacacctctacgtaaataaaccagaaaatctagaagaaatggataaattcctcgacacatacaccctcccaagactaaaccaggaagaacttgaatctctgaataaaccaataacaggctctgaaattgaggcaataattaatagcttaccaactaaaaaaagtccaggaccagatggattcacagccgaattctaccagaggtacaaggaggagctgttaccattccttctgaaactattccaatcaatagaaaaagagggaatcctccctaactcattttatgaggccagcatcatcctgataccaaagccgggcagagacacaacaaaaaaagagaattttagaccaatatccctgatgaacatcgatgcaaacatcctcaataacatactggcaaaccaaatccagcagcacatcaaaaagcttatccaccacgacgaagttggcttcatccctgggatgcaagggtggttcaacatacgaaaatcaataaacttaatcccgcatgtaaacagaaccaaagacaaaaaccacatggttatctcagtagatgcagaaaaggcctttgacaaaattcaacaacacttcatgctaaaaactctcaataaattaggtattgatgggacgtatctcaaaataataagacctatttttgacaaacccacagctgatatcatactgaataggcaaaaactggaagcattgcctttgaaaactggcacaaggcagagatgctctctctcaccactcctattcaacatagtgttggaagttctggcgagggcaatcaggcaggagaaagaaataaagggtattcaattaggaaaagaagaagtcaaattgtccctgtttgcagatgacatgattgtatatctagaaaaccccattgtctcagcccaaaatctccttaagctgataggcaacttcagcaaagtctcagaatacacaatcaatgtgcaaaaatcacaatcattcttatacaccaataacagacaaacagagagccaaatcatgagtgaactcccattcacaattgcttcaaagagaataaaatacctaggaatccaacttacaagggaggtgaaggacttcttcaaggagaactacaaaccactgctcgatgaaataaaagagaatacaaacaaatggaagaacattccatggtcatgggtaggaagaatcgatattgtgaaaatggctatactgcccaaggtaatttatagattcaatgccatccccatcaagctaccaatgagtttcttcaaagaattggaaaaaactattttaaagttcatatggaaccaaaaaagaacccgcattgccaagtcaatcctaagccaaaagaacaaagctggaggcatcacgctacctgacttcaaactatagtacaaggctacagtaaccaaaacagcatggtactggtaccaaaacagagatatagaccaatggaacagatatctcttttaaatagggatgtcatgtattgagggcctgctgatatatatcccagagctgggctagaaagtaaggaataatgtgatctaatattattacctgtttccactctcctcctcccctcaagatcatgttcgttatcatatgaggtaggaagtacaacagacattaaataacttcttgcaatcaggaaagaaagccctttttccccaccatgatataaaggatcaaaacatgtacctcatcagaatttcttcaaacttgcttcaaaaaggtggtatgtttaattattcttggcaaacataaaagataattgacacagaactccataccattttttcaaacgaaatttttatttattttctcttatctagctatgttcactttggaaaatgcacaatgattttatttttctgtaaccgccttggtctaaagctgcttttttagtaacatttttctttttctatttctagcaaatgccagatgttaatgtaagctgggatggagagggcccaaagcaactgccatttattgacatttcagtggctgtggcaacagataaaggcttacttactccaatcataaaagatgctgctgctaaaggtatccaggaaattgctgactctgtaaaggtatgtcttaagaaagagtgtgctttcaaaatgttagcatatacttttggataattactttctgataaagttgtgacgtaatctagtcagactgtgatttttgtgtgtgtgaaggggagagttatttcatcaagtgattgtcacatatatataggtttttaaagtttttatccaagtatgacccattgtaagaaaatttaatattcaaaaattaagagataatatataaacaaattagggaacaacttcatgctaaagacaagctttattttccaaagtccagaattcagccataaagatgctatatcaggtaggttttaaagttgaagttaagctgaaactgtatttctatggacctcaatattaataacattttattcttaaagtgtatttacttcttctctaaaattgagaccattaaaagaacttagcggccaggcgcggtgtctcacgcctgtaatgccagcgctttgggaggccgaggtgggtggatcccgaggtcaggagattgagaccaacctggccaacgtggtgtaaccccatctctactaaaaatacgaaaattagctgagtgtggtggcgcgtgcctgtaattccagctactcgggaggctgaggaacaagaatcacttgaacccaggaggcagaggttgcagtgagccgagattgcgccaccgtactccagcctggcaacagaatgagactccatctcaaaaaagaaatggacgtaatgttccagaggcaaagttactttattttttcaggatttcttgaaaagcagtttttgtaactccaatgtgtaggaatcttatttcaccaaaaaatagtacatcgaataggcaagaacacaggcagtagggcagctttgacagcctcagtaatttccaagggtattttttgacagaagtatcacaagtcttaaagtgattgcatcgaaaatttctgattcatttgggtaagtgattatctttccatttgccaaggacctgttgtatgtatagtggtagaacaatttgtatatttataagggagatatgaggtagaacgtaagacttctttggggagccgacagtacataaatgtgtagaccttcttgctcaaaagaaataagtgcaagttaatctggttttaaaagcatacccataaatactgagtttacttggaattttagaggtagatataattaaaggtgaacctactagaatcaatatttttaggtctttcttccctcctctttgaaaagatttgcagaaagtgtttgatcgataaaaatgcaattgttaattgaaaaatgaggctgcacatggtggctcatgcccgtaatcccaacactttgggaggctgaggcaggcagatcacttgaggtcaggaatttgagaccagcctggccaacatggcgaaaccccatttctactaaaaatacaaaaattagctgggcatggtggcacacacctattatctgaactattcgcgtgacggaggcatgagaattgcttgaacctgggaggcagaggttgcagtgagctgagattgtgccatttgcactgcagcctggatgacagagcaagacactgtatctcaaaaaaaaaaaaaaaaaaagaaaggtagcgtttatttggtcagttcaaaagtcaaagtaatagagattggtttactgagatatagtatgttccttgtgtttatcaagggttttcagcgacaatgagaatatttgtgtctgtgtttttgtgaaggttaaatgagattaagtgttgaaacaacctgtaaaatataaagtactattataatgttatggaactttattgtagagctagaatttccttatttttatatacattaaattttaaaaattaaccattataggaagatttccttgattctgagcaatttaccaaatttactgctataatacataagtcgtaagtagttatgttagctttctctattccttgcatcctgaagactctaagtttaagaggtaagaacgcagtctcaccagcctctcagttgggcctcacagcaatgggaagggcagtcataccactttggagtgtagtggtctctggcgggccttgggcatttcctgtaacccccaacagggactcagggtttgctgagctatggctgcccgttagcttctcattctacctgcttctctttcccaccctgctctcttcactcttgttcttacgctatgccaggcactgggctaagtgcttcatttaatcctattaacccagtacaattggaaccttaacttctccatgaaattgaggagattcagttttagcaactttgataaatttgcccaaggcaatacagctagaaagcagtggcaatgaggactagttaacccaggcagtttgattctagagccactgcttaatgagctttctattataccacctctctccttgcttttactgtttacctttcttttttcctgtctaatcattcacttctttacctcccctttgtctttttctcccgcaaagttaccagaaaggagggtttggtttggtcctcaagtagtactttcttgtatgaagtactcttgctgggcaggtctgtcatgccaggccagtgtgtcacatggtacagagcataacaacctgatgaatataatcacctttggttgtactcggaaaaaataaggggacattgaagcacactgaggcctctcatgagaaacaggcaccttgcatggcctatttaacataatagttctgtagtttacaggagagagagagagcaaaagagaaagaaagtttatgtgtgtgtgtgtatgtgtaagagagagagatctgagctcctgcaaaattagttttttgttgaagtggtttatcttgtaagcatgattatcttaaaaacttaaatgttggattgtttaaacggtggcttaaaaactaaatattttagataggctctatagagatatgttcatttagctgctgtggatgaataggcattaaaaataagtatgcaccaagtagaaaccctgagtgtgtgtgtgtgtgtgtgtatgtgtgtgtgtgttcttcacgtccaatatagattttgactcaattccaagttaagcaagattatattgaattcagctttactgtgcaaaaaacagcatctgcctgagtgtccacgtatagtagtgagtcacctttggtaataaatgcattttctgtcctgtgctttaatgtggttatattttaccgcatcccccaaaaagggtagacagtaaatgttacatttatggaatagtagtgccattttatacagtttgagtctcgtcagtatttctacatcaagctttgtactatggcttatttaaaaagtagaatgtttatgtatttaaacagataaaatttagaatgattttaattccagggtaaaatctgctccgaccagagagaaaaaactaattcatatatgaatatagtatttgtaatcctcttgtttaaagacatgcaagttctagaagtatttgtactgcttaatgttttaacaactctaacaataatagcagcgggcatactttgtaccagtttttgctgtaagccttttatatatattaatcctctttaaaaccaccctatcaagtacaagataataatttgatatggttgatgaagcaactgatgggaaaaaagagaggttaaataatttgccccaaatcttattaagtgatgtagccagcatctgaacccaatcagactgtagactagagcctcctcccaaccactcagctttgctgcttcccacatactagttacataactactgtatgactatagaggtcaggttatcagccttctagaatcagtaatgttttctgtcaaaaaaaaaaaaaaaaagaaacttgagaagcagctcctggattttcagaaattaacaagaagaatagctaaggactcaacagttataccaaatgcaccataattagttgattcaccaggtagaagaaaaggagtacaatcattggttttctgtgtctgtaagaccaatcttttggtttggaatttgaaatattggagttctctcttatccaaggtttcactttgtgtggtttcagttacccgtggtcaaccacagttgaaaatagatgagtactgtacaagctattttgagagagaccacattcacatgatttttagagttataattgttctgttttattattagttattgttaatctcttaccatgcttaatttttaaattaaactttatcataattgtgtatgagtaggaaaaaatagtacagtcatgcatcacagcagggatacattctgagaaatgcatggttaggcgattttgtcattgtgtgaacaccatagagtgtgcttacacaaacctagatgggatagcctgctacacgcctaggctttgtatggtacaaacctgcagtacagcctattactgtactgaatagtataaggaaatagtgatacaatggtacgtatttgtgtgataggaatttttcagctccattttaatcttatgggaccactgtcatatatttatgtctttgtcttaagtgtccttatgcggcacatgactgcatgtatagagttcagtactatctgccatttcaggcacctactgtgggtctttgaagtatcccctgcagataaggggggactactgtatgcaactgggagaaaaaaagggttaagaaagaagagacctgagtcaaacgggagagtactctgccaaagaagcagtgaagattccccgaggaatgtgaggttgtggtcttagcaagtaggcagtggataagagaacctgcagcaaagaaaccaaggctctctacctggtgaggcaggagtagtctttttgaaaagactgtgggatcatggacaggttgagctctggattctcactaagagacatactatccagtacacacttccctctgatcgtcacttggctggctttttttcatcattggtttctcagttcagttgctaatttcttaggccttctgcagcttctgtagctgaaatagtttcctaacactctttatctcattaccctgttttattgtcttcatatggtttattagtctttgaaattaccttgtttatttatttgttcacccttctgtgttccctactgtctgatgttcactgtccattgccatttatctaattctagaagagtgcttgggatacagtagttgcttggtgaatttattttaaaacaaatttcagtaaaacttgtttcattgaaattaatttttcaagagtttgtggctctctgcagattcatccatgaaccccaagttaagaatatctgtactacgcatttacttcttgaccctctgtaatcccaaggatgccactgtgggggctgtaggcataccccagccaagttcaagttggtattccttgaataaagtaatgtagtgacacaccttggatcctgtgttattcttaattcttcattacttataacagtattaaaaggcagaggcatagtttaccttataagtacccagtaaatttttttaatgaatagcaaggcattcgatgtattgtagaaatatttagtggtcattttttattctttcagctggatgcttcaggtaacatgtactttgattttgagtccacattgccaggagatcccagtgatgattacaaatttataaaaccaacgatccttctcagattccatacctatttcagacttactagagttcactgacaggaatttcctgttgatgtatttaggatctacagagtttttgtttttagtatgtgtgcgtgcaatctacttattaaagtgagtttttttcatttgtggtaattgtgtggtagttcatcaggatatgttgagatcatctgcctttaaaaaatgccttttaaagttcatatatgtgtcttttcaaatcatgtgaacaattacattgcttaagggaggaaaaatgcttttatagattattctctctcccgttattccaagaactgtataagtcaaaattcatctcattttttaccttgaatccaaatagttttataaataaccacatccaaatagcatacacctgtaattgtttctgttggcagtacgttacagtaatgtgtttttagatttttgatatttttaaagactttcaattttaaaaaattaaatcatctatgaattaaagttagttatcaactgtgattgtaatagtgcctatgttgcctatgtaatacaaaatattaagtaaattccacatttattttatctacccaaatgacagtgacctcatttttctgtacccttcctcttaagttaattcgttattaattttttatatatgatgactcaacctctgttcccttgcttttaagcactgaaaaataaaaattaacagaaatgtggttaattccaagtacaagtgagaggaaaatttaactaatatgtcatctgtcttgtcttctgtaagatttttagaaatcgctgtggtcaagagtgatatgaatcaagtacatccttatattccttgtggcagtgtaaattggactagctcattcaggaaatgatttagctataggatcaagaaccaaaagaagtctattctctagggcactataattccacttctgaaaatttacctgaaataattcagaagaaaccgtgaaccaaattataacactgggaaataaccaagtaaattaggcaggtgcagtctttaggaacaaacattaaaaaatcatttctgaaggctgacaacacagaagatacatataatattgaacaattaaatataaaatttattttttataaccattgtgtggggttgagattgtggataaagatgaagcaaactctgaaagataaaaacggaatgttggttgtgggattgtgggtatactactttggttgccattggataatttatttaaaacacacagattggccaggcatggtggctcatacctgtaatcccaccactttgggaggccgaggtgggtggatcacttgagttcaggagttggagaccagcctgaccaacatggtgaaaccccatctctactaaaaatataaaaaattagctgggcgtggcggtgggtgcctgaaatctcagctactcaggacgctgaggcaagagaattgcttgaacctgggagatggaggttgcaataggccataatcacaccactgcactccagccagggcaacagagtgagacttctcaaaaaaaaaaaaaaaaaaaaaactaaaaaacactagattgaccagaatggattcttgtattttttttcttaccataaagttttataggcaaaatagaaaatttcattttgcatataggaaactctaaagcattttgcataataattgatggtacacagggtaattcccacatttgaaaaattgttaaaggaagtgatttttctagagttttgattaacagctttagtttcttgaattatctgtgctcttgtttgttcttataattagagaaaattatttttatataggtaacaaaatcaaatcaaggcatatcagagatgagagtatatgatgtacaaatatttcaagtgacaagatcaactgtataacattttgttggttgtcctattctgtttgtatttttctcaggctctatcaaagaaagcaagagatggaaaattgttgcctgaagaataccaaggaggatcttttaggtaaaatttaaactcttaattatccatagcatcaaacagatagatgtaagacttataaagtccctgtcagcctttcatttatctgaaatattttttaaaatttaagctaaaaatactttatttagacaatagaatatctgaaaaaattcttcagactagtcaggctttcatattaaagctagtaggaacctattagtgttgaactaaacgttcgttggacattgactaacatggaatgataaatattatgtattctttagtatctgacccacccccaatattaatgtctgtaatattatattgctatgtgaaacaaccacttatttattattgcagcatataatattctattgtataaatataccagaattcattttactgttggtgggcatttgcgttgcttccagttcggggctattacaaattatggtgctatgaacattcttattagtgtcttatagtgaatgtatgtacattttttgttgtatagacctaaaagtagaattcctaagttagaagctttagcagctactaccaaacaattttccaaatggttatacaaatttacacctccaccaacggtcctgagaattcccattgctccacattcttgccactatttaataatgttaggttttaaattttaacaattcttggggtgtgtagtggtactctttgtaggaaaatgcaaattagtgatgttgagtacttttcactcatcagccgtttgggtatctggtaattcatgagataaagtacccactgcaatctggtgtccatttaaaaaaatgatgtatagttcttatttctggatatacagacctttataggatatatattgtttcaaatagctttcacactctgtgacttgcctttgggactctctcggtgatttttttaaatgaacggaagttctgagttttaatgaattcctatttatcagtatttttctttgtagttggtactgttcattttctgttaggaatttttgcctatctcagagtcatgaagttactcttctgtgttatcttctaaaagcatttacgttacttttcacatgtagatcacaattcaactgaaattggattttgtatataatgtgaagtttcaagtgctcttttttccccatatggatactaaatttacacagcatcatgtattgaatattgatttctcctttttcatagcattgaaaaggtgattatatatgtgttggtctagttctgtgctattttttttccactggcctgtttgtctatcctttgtttactaccaccaagctataactcttgatagctggtaatgaagtcttccaattttgttcaccctcaagattgtcttctggcttttcgtatttccaaataaattgtaaaattgatttgccatttttcacacacacaccccttgctggtttcttgattgggattgcattaagtcttttgatgatttgagaattgacatccttacagtattgagtattctaacctgtgaatatggtagaaaccattgtgtattcagttatttgatttctttcagttatgttttataattttctgtgtagaggtcttgtatatgtttcattagatttattctttggtatttgttttttgatactattataaatggtattgttttaaatttttattttctaattatagcaacttgtatgtagagtcatgtgccactttatgatggggatatgagaaatgcattgttaggcagtttcatcatgcaaacatcatagagtgtacttacgcaaatcatgcaaacatcatagagtgtacttacacaaacctaaatggtacatgctgctacacaccttagctgtatgatatagccagttgctcctagactgcaaacctatacagcatgttactctactgaataccgtaagcagttgtgacacaatgatgagtatttgggtatctaaacatatctaagcatttttaaaatgtacagtaaaaatgtaaaaagtaaaacatggtacacctgtttagggcacttaccgtgaatggagcttgcaagactagaagttgctctggaagaatcagtgaatgagtgaatgcttaggacatcactatacactactgtagactttataaacactgcacacttaggctacactaaatttatttttaaaataaagtaattgcaatatgatgttatgacagctatgatgccactaggcagcagaaattcctgagctccattataatcttataagaccaccgttgtatatgtgatccttcgttatgtgggacatgactcgatataaaatggattgttatattgaccttttatctgatgacttaactaaatttacttattaattttactagttatctatagtctcatttttcctgtgtacacaattaatttatttgtaaatactaaatgtttccttttttcattactcatatatttttttcttgccttactacactgcctagtaaaatatataaaatatgtgcttcacggaaaggggactttgattaaggacatgcctccttcagagctttttcttttccccctagtatttccaacttggggatgtttggcatcgacgaatttactgcagtgattaaccctcctcaggcctgcattttggcggttgggaggttccgacctgtgctgaagctcactgaggatgaagagggaaatgccaaactgcagcagcgccagctcataacagtcacaatgtcaagtgacagtcgagtggttgatgacgaactggcaaccaggtttcttaaaagttttaaagcaaacctagagaatcctatccgacttgcctagtcctcaaagataagaagttggtgttcagcttagttgattcagtagttgttaccaagaaacatatgttataggaaaacaacttggtatttaagtatgaagtggatgaaatgtttatttatttaaggtgaaagcatttgacccagggtgtcttcatcttcaatttgggtttaatgttatagaaataaatgatgataaactctaactaataaaggaaagagaatatttggttactcagatccatttttaacctctggtgctgtataaagggaatattaaactagatgtaaatcaaagtatatgtttggctcatttgagcattttggaatatttgagaatgtatgatacatgtaaaattaaaaaaactattagaactgtaccataattatgttgaaggtagaagtgatcttcaaagagatggccattaacttagcagtgggacctcacttttacaagcactgctctagatatacttgaagaatttaataggtacagaagtttattctggataataaataaataaggatcacactgtattaggggttatggcaacattattgaattttttatgtacataaagccatatgtttagggtggtttctatctgtcttgtttttcacttatataacactgtgaacttctaaagcaagaggataaaagaagcatgaatgaaaagaatgacatttcaaaaaaatggttcaatgaaaaactatagctaaaatatgtaaacctttctaggtaaaccgcttgccttcatcttgagtcggaatatatttaaataaattgtgttatctcttgccaaacattttgttagtgtttatttaaaaacaaaatgttgtttcttaatgcatttaaatcagttttgtattgtgcagtaaaatgtgagaaaatataaacatttctattgtattttaaatgttaaaacacaaaagttcaataaaccttgaagttgattagtagtttttctagaacacctttaaaagggctctacaggagaaaagacggaatttaaaattagtatgacattaggaaagtaactgataggaaatgtaaaactttggaaagagaatagaagacttatgaagccaaacagatgagaactatcctttttatttcactaatatgaaattttcactaattattataaagtttagaagagtttgtttctctcttttggcagctctgctataactgtcaagataactatatttaagttggatggtaatgaatggtaatttaattaacttgtcacaaaaaggtttatgttagtgtcagctgacatgaatcaatagaagaaaggctaatatagtacaagttgtatggtatgacatgatgaattataaaccctaacagaagagccttctaaaataattagcaccctggtgtattaattgttaagaaaatgcttaatccaactatccaactcagtttaacaagccatttaaaaaaaatagtcttcaaaacttttgtcatattaacagttacactgaaaattataaccaaaggctattttcaaaataatttttatgttacattatttccaaggtcagttttaatcgaaattattattattattactactttttcttgagatggggtcttgctctgtggcccaggctgtagtgcagtgctgggatcacagatcactgcaacctcgacctcctaggctcaagtgatcctcctccctcagcctcccgagtagctaaggactaaaggcatgcaccatcatgcctggctaatttttctattttttttttttagagacagggtcttgccatgttgctcaggctggtcccaaactcctgggctcaagtagtcgacccaccttggcctcgcaaagtgctgggattacacaggcatgagctactgtgctaggccgttgtttttgttgtggttgttgtttgtttgttcattttaatttttatatctgaggaacagaacatgatgaggcagccataaataagcctgactcagagttctgcttttcatgaactgacgtacataagcagtagtgcatctgtttccctataggtgaaatgggcattaatatttactcagcctgccttagagagttgaactgtacaagggaaatcgctgtataaatttaagatgttttaattcatggacctcacaaccaggcttttcatataatcacctgcctctcatggtttgacttctcagcttctggtacaaatgcttgttcattctgaccaaaaatattgtctctggtatttctatactgatgaggtggtttagattaaggaagttttcatttctaaaaagaattttgttgtagtttgagatcaaagaataacactgagaaaggagtatggtatacttggtttgaactgtgtgctacactaccaggccccttccacattatactactaatttatttaaaatagataggtatcacactgagaggatataaaaaaaatttctgcctcttcatttttgtttcttgtttgaacagaaaaaatgaccaaaatattgggagtacttctaaggaaaaggcaacacacattccagttaacacttggatgtgaaaatatcaatgaatattagaatttataagtcaaactggctctgctcgctgattgcaatttttagttacattcactattttgtgctaaatttaagtcattggtatacgactggccagagtccttggttttaaacattactgagaactttatatatactcttaatgggtattttatataatgtcgaatgaaacttttatttttagatttttaaaaaatattttgcactttggacttaattttacactaaattgtat

SEQ ID NO: 12243 - DNA, 101558 bp, Human
  misc_feature (1)...(101558): n = A,T,C or G
gctgagttttgacaagtgcatacacctgaataactgaagtccctaccacaatatagaacattacatcaccccagaaagtcgaaggaagactacttttgattgtattatttttagcaccttctgaattttgtattatgtgcctgcgctatttttaagaaataaatatttaagcattttaaatatttaaacatttttataacagtgggccgattctaaattggatgagaaagagtgaaaacaggagatggcagataacaggtggggtcaatggaatggagaacttattgaagtcagagttgtagcagtggtgtttccagaacaagtgagttaggaaaattggaatgcttcggttgacagtaggacgctgaaatcaagctctcaaaagttgtcttaaggttcagttaagcataagcaaagggtggcttgggtagatggagattaggatactagtttcctttcccttcctacgctctcaagtgcacactgtatttttttgtttgtagtttttttttgttttttttttgagacaagagtctcgctctgtcgtccaggctggagtgcaatagcgcgatctcggctcactgcaatctccaccttcagggttcaagcgattctcctgcttcagcctcccgagtagctgggattacaggtgcccgccaccatgcccggctaatttgtgtatttttagtagagacaggggttcaccatgttggccaggctggtcgcggactcctgaccgcaggtgtctcggcctcccaaagtgccgattataggcgtgagccacggggccctatagggattataggcgtgagccactgcgcccggcctctttgcaatatttatcacaactcccactaagtaatatttgacttgtgtagccatccttaacatttggctaccttattaggccataaactccaaacgagcaggggtcttctcttttatttaatcctgtatttcctgtgcctagtatatacaagtgctcaaacaagtattaactacttgattggattctttaagtaggcccatccctcttctcttagtccagagctcttacttatttctacgcattatggccgtatgaaggctgtttgtaaacctgcaaaatacaataccaggtatcctgcaggttccacatgtaaattatattatctcattggccagtggtgtgtggtctgaaggggtaaaacccggaggcttatggtttaggatcttctaggataatgtgccttcagaaaatcgaagattaatattcattctctaaacaatctttttttttttttttcaaacttttttgtaatgacgagggtgttgaactggcctcaagtgatcctcccccttcggcctcccaaagcactgaacaatattttatctaagtgccaagcattcctgaatagaaatattaagagtcatcacgcttgtgcagtcaacacatatttactgggcgcattctatgcacgagttattgaagacagctgttgtaagcatttcaggacaatgcacctcccttaacaccgagtccgggatttggggcggggtgccggaaaacgccaggtcccgccagcagagggcacggtcccggcctcgctgcagcctcgggacccaccgaggcttccaggctcccacgctcgctcccgagcgcgtccccgccctcgcgtcacgtgacgtggccgcggaacctgagctgcggggcctaagccgagctaaattcgttgcaggtggccgcggcgggtgcaaccacaaaggctaatccgaaggagtcggggaggctcgtggagtcgatgcttcctcttccaagtcaggtcggctcccgttaccttctcagcattcgccgttccggtcttcctgagcgcgtgcatgaggtctttcgcgtggggaagctccggtgaccatgtaggggacaagagtgaggaagctcctggtgcttgggacgaggtcagcgctgtcggcgcgctgctccagcgcccaccacaccctggtgcgggccgacgggccctgggccctggtgggagctccggcctccggtcaaggcctggccgggagcgccacgaattctcgcgtcgtctcgcgagagtccaagttaaagaacatggcgacgtctaatctgttaaaggtaagaccctcactccagcttgggttttactgtgtggccgccgggttcggctctttgggaaaggcacggctcaggttcagctgcgaagtgtgggagtgttcaggggttgtccactggcagggaagccgcggtggcagccggcgagtaccggaacgcgggtctgtggccttggggtcgacaggctctggtggtcgctcccgccgactggccgctgggagaaaagcctggctgagcgctggcgaggagcgatgctttcaagggaccagctctggccgggagcgggagatgaatggtcgtgcggtgtcctgaccagctgggccgttagtactgttaggtctcagtttcttgtaaagcaatgtctaagacgcatcaaaggaaaaaccaagaaaatgctgcctaacaggtttcagtgactcgaccccccacttcttccatttctgttctcgttctgtctgcacgaaattccgagtcagaccagcagtgcctcccactccaccccccttcctcccttttctgcgtgttacaccttccctcctaattctcccattcttgagttcatctttttccttaggaaactgctttctaacccccacccagttacaggacacaaccagatgacaactgatgaagcgataccatcgttttagggcgcaggaaagttaccttgtcaaagacagtatttaaagttagttttatatagcaagggagatctaggcccacaggggcagattctccaccagttaaaaagtttggagaagaatgaggaagacttagaactagtctgttctgtgtatgtgtctgtagtagttaatcatttgccttaaaagtacggacagaaatgggggtagtgaatagctcagggaacataatattaatggcaaaaaccgcagtcacttttgcaccagcctaatacaaaggatgaaccacttcttcctgaggcctctcatgccttcaggcaatgtggatgaatactagaaaataatagaaaatatacaggaacctaaccatcatgtcttctttagaccactgatatttgattgtctaatagatgggactgtctcataaaatgaagaacaaattttactaagaggcagtactgtatatcaccttttaaaagggagaggggccctagaattagactccctgaatagccaccacttaaaagctgtatgactttgggcaagtttccttatgagtaggacagcattatcagtagcgcctgtatcataggaacattgtgaagattaaattagttaatatatctataatgcttaaaacagtgcctggcacttaattagtataatacaataaattactataactactccccctctttctttaagaaaactaattcggggaattgagtaacccatcccactctgcttttctcttttataatggtatagcaaatttctcatgctttacttcagaaagaaaatttgtgggctgggcacagtggctcactcctgtaatctcagctctttgagaggccaaggtgggaggattgttttagatacattaatttaatcttcacagtgttcctacaatataggtgctattgataattctgagttagaggttatagttaactatgatcacgccactgctctgtgagactctaaatgaaaaaagaaaaggaaagaaaatttgttttatttctgaagactcctattaatgcatctgtgtgtttacataaacagtatgctattaattgaaacgtgtttaagaagtaattttgtccgtgattctggaaaattttgacttgttgattacctggatataaagcaaggtctttttctccccaaaaataactctcagaaaagagtaagtcactgttctacttacaaaacctcacaaaggattgtttggaggagaagctactttggtctatattagttaagtacttacctgtggaagctattttggttcatattagttaagtacttacctgtggaagctactttggttcatattagttaagtacttgtggaaattctgaatctacatccacagcacagacctgtgaatgggaaaactgcctgaatatacagaaaacggggtacttagggtttaggtttaaaagctcacaagaatttaaaaagtgttttaacttgaacatttacaaataaagggaaggtgataatattttgaaaaaaagtaagtgactcagtgactctagtgaactttcttgatgtgtaacttagaagttagaagccaatgtcataaaaaaaaccaccagcttttctttctttttaatttttttttttttggagggggacggagtctcgctctgttgccaggctggagttcagtggtgcgatcttggttcactgcaacttccgcctcccgggttcaagcgattcttctgcctcagcgtcccgagtagctgggactacaggcgcacgccaccacgcccagctaatttttgtatttttagtagagacagggtttcaccatgttggctaggatggtctccatctcttgacctcatgatccaccctcctcgacctctcaaagtgctgggattataggcgtgagccaccatgtctagctgcttttcttttttaatattggaatttgactctaataattttattgtctgtttaaagcaagtggactattgctggatcttagaagtctttcagctatgtaaagatttgtgtagcacattttgacatatacagttaactgcttaggggttttgtatctctgaaaacctttccatgtaactactttatctttgttgtttttccttacagagtgagtctgtagaacatttgtagggatctgatattataattttatcttctgttttagattactttgaacatgtaattgtgattgttccttttcttttgcaattatcatctgggcccttagtgctcatttttttcatttccagtttattgttccaccccaaacagcaattgtttaaaccttttcttgctgagcctcacccctcttaattcttagtacattactttacccagctatttgaagtgcccttaacttccttggtcgataccaaacatttttcttgtttctcctatgttcttctctgttccatgctacctcccaaattgtctcattctgcttgttctttttcagtcctcatcttccccccaggacttggtggtatgtcccctcttacttttttttttttttttcagtttcccttttttctcctatgcctataagaaagttcatatgtcgcgtcatataaacttttcttttttttggagatggagtttcgctcttgttgcccaggctggagtgcagtggtgtggatctccactcactgcaacctccgcctcccaggttcaagcaattctcctgcctcaacctcctgagtagctgggattacaggcacacgccaccacacccagcttatttttgtatttttagtagagacgggattttaccatattggccaggatggtctcaaactcctgacctcaagcgatccgcctacctcggccacccaaagtgttgggattacaggcgtgagccactgcactctgcctcctcatacaaacttgtactctgcctctgcctcaaacttctgtttctcactgtcacagttcttggaaaagcagcccccatttgctgcctttataattctttgccctttaacttaatgatatggcttactcttctctcccacccaattgtatagaacctgtcagtcataaaagtattagcaacctcctgattatcaaatgagattcttctctgataatatttatcctcttttctggtattattgctcatttcctctgcttctcttttggtttttatgacattccctccttggtcttctctctctcaaatcacgtttgtttttcactgacttccctcccctgtccccaatagaattatttctcaggattttatcttcagcccttttctatctttgtatatttttttctgggacagtcttaactcccatgatttcactatttttatctcttagctctgatctgagctctagatcaaaatgcagttctcaccatatcactttcctgttcagatacctttgatgattcaaattatttgagatctttccagctgggtcttctcctgataactagtattctctctctctgtctcttgtctctctctctcatacatgtgtgcgtacacacccctacttagctggttacttgttggctcactagcatgccagaggtcgtcatctccctaataactaactcttaactttcattctctctccttctgattggatctagtgagatggaggcacaagaaggcagtagtatataaccgaaccacaagataaatcaaactttaaactgaaatatgattcatactacttttctcagtggacttttttttatcctttaagaggaaagaaaatggaaatgtaaagcagtgattcagagtgtctatagaggccgggcatggtggctcatgcctgtaatcccagcactttgggaggatgaggtgagaggattacctgaggccgacctgggcaatgtagcaagaccctgtctctataaaacaacaacaataaaaagtgcctgtaaaagttattcattattaaaataactttattgacatccatatgcaaggtaccatggagaatgcaaagatatgtagaacaatgtccatgctctttgggaatttaccatatgctaaaggagagtaaaaggtactaatgatttatgataaggcaaaagtttcagatgtgttaccaactgctctatgctccctcacagattgaggaaataatttctggtgggatgatcagtgaaaattttatggagaaagtgttggagctggattttgaataaagtgttggagctggattttgaataatgggtaagctttttgtattggtaattaggagaaaatttggtaggaatctaggctagatcagtgtggctgcagtgtaagcagggctgcatgctgtgttagatattctatatgaatagtgttccttgggattgttgcagcatagaaacccagaatacagggaaacaacaagagggataggagtgaaagggaagtcgggtcagattacaaagggccttcagtgctaggcaaggggtttgaaataaagttctatagttactgaggaatatttgaaaaatatgtgggcagagatactctcaagccctcaatctatttttggcttttacacataaataaaagttattatattttctgtatatttataatctgcttgtgagattggccatggatgaggggcatttgtgccagtgacatcttgttcattgaaaccgtaaccatagcaggagtaattaagtctatgggaaatacatttattcattgaacgagaatttagtatttcctaattctaactagataatgatgaactaggcagacagctcctgcccttgtataatttacatttttgttgggaagagagacaataaacataaacagtgaaatacatactgtaagtcaagttgtgataggtactatgaataaaaacaaccagggtaaaagagagagtgctcggtgctcttattattattattatttttatttttatttttgagacggggtctcactctcttgcccaggctggagtgcagtggcacgatcttggctcactgcaacctccacctcctgggttcaagcaattctccttcctcagcctcccgagtagttgggattaccggtgaccaccaccatgctcggctgatttttgcatttttagtagagatggggtttcaccatgttggccaggctagtgttgaactcctgaccttaagtgatcctcccacctcagcctcccaaagtgctgggattacaggcatgagccatcacagctggcttatttttgataagatagtgagggaatgcctctgaggagataatagttgaggtaaaaccagaatgaagcaagggagcaagtcatgtacatatttagaagagttccttgtagagggaacagccagtgtgaaagcacagagtcaggatcatgcttggcaaggaatatggatgtgatacgaagatttgaatatcatcggtgaatgtggttaaggtgcataaccagagaattctttttaatatgtctagttaaacataaatgagaaccttattaagaacttgtcaatttttcattgggttgatagaaattgccctcttgaaacgtatatctaagagggacatgggccttagagcggccttcccctccttcagtgtactgtcctagagagatggttgcattcgacacagcctagggaggaaacaaatttcaagggtgtctgtgttggtcatgggtaggaatgggagagggaatagtggactaatcagtaactgtaaaactttgtgatacatgtaaatggtagaatctttcatgttctatgaaaataaatgattgaacaattaccataatctggaggtgatgtatgttaattaaaacttctaaaaggaagtggcagctcagggtaaattttgatcagtcatttttcagtagattagaggaggggaattttagactgctggaaggtagaaagaggatactaggcatctttctagtaaaaagagaggttttgtttttgtttttgtttgttttgagaggaggtctcactctcacacaagctgcagtgcagtggcatgatcatggctcactgcagtcttgatctcccaggatcaagcgatcctcccactttagcctcctgagtggctgagactacaggcacataccaccctaggtctggctaattttttatagagatgggatctcaccatattgcccagactggtctccactcctgagctccagtgatcttcctgcgtaggcctcccaaagtgctgggattacaggaatgagcaaaagagctagtcagccagagaggtttttcttttctcttctcttctcttctcgtcttctcttctcttctcttttcttttctgttgagacagggtctcactctgtcccccagtctggagtacagtggcgcagtcacagctccctacagccttgacctcctcaggctcaggtaatcctcccacctcatcctcccacaggtgcaacaccagcattcccagctcatttaaaaaaatgtttagagacagggttttgccatgttgtccaggctagtctggaattcctgggctcaagcaatctgccctgtccttccaaagtgctgggattactggcgtgagctaccacccctacttgaggtttctcttaataaatattttgcttagtgtcctggtgaacccagttgtcagtaagagccatttgcctcctgccttggttagtaggtggaggaaatagatgcctcatatgctctgtaaggaaagcagggctgggtgcagtaactcacacctgtaatcccagtgatttgggaggccaaggtgagagtattgcttgaggccaggagtttgataccagcctgggcaaccccatttgtacaaaaacaaacaaaaaaaaacaaacaaaaagcaggatacagctcaggttaaaactttggtcagaggctggatgcagtggctcatgcccaacactttggaaagcagaggcaggaggatcatttgaggccaggagttggagactagattgggcagcatagcaagacctaccacctctacaaaaataaaaattagaaaacattggtcaaatccatggagtacatacaaataatatcaaaggtaattgatctgtgtagctgtggtttgttcattccataaaaatctgagcatttatgctgtactggataccattttaaatttcaggctgggcacagtggctcacacctgtaatccaagcactttgggagattgaggtgggtggattacctgagcccaggaattttagcccaccctgaacagcatggtgaaactcgtctctacaaaaaataaaaaataaatacctgggggtggtggtgtacggttttagttctagctactcaggaagctgagttgggaggcttgcttgagcccaggaggttgaggctgcagtgaattgagatcgcaccactgcactccagactgggcgacaaagcaagaccctgtctcaaaaaaaaaaaaaaaaaaaaagtatcagtgatacaatagtgaatatgacaaagttcttagactttggggcttatatcctgatggatgaatactgacactaaagacataaagaatacacttgcatagtttttactggtaattagggcggtagcgaaaacaacgtgataagaatgttcaaggccggatgcggaggctcacgcctgtaattgcagcactttgagaagcccaggtgggaagatcgcttgagcccaggagttcaagaccagtctgggcaacatagtaagacctcatctctacaaaaaatttaataattatccaggcatgttagtgcatgcctgtaatctcagctacatgggaggctgaggcaggaggattgcttgagcacagatcaaggctgcagtgagcaatgtttatgctgctgcactctagcctggacgacagagtgagaccctgtctcaaaaaaaaaaagtgttcggaaggtggagccactattttactcacttatttacaacagaaaataatttttccccaaaaaactgcttttgactattttttgttgaatgttctttttcttcctcatgttgacatttcagccagatcctatagctttcctgggcttttcttaaaagtctggttattccaaattaaaatttcagtctcatagccaatcagagtgtctcttgtaccatctcaagactttgtctctggatgtgcagagaggaatggaggaagggcatttttcttaggttggtttgggaggcctgaggtggcattggagctgagacctgaatgatctgcattctaaggcaaaggtcttgaggtgcagtgatgagcttggcctgtttgaggaacacctttaaaaggttgctgtggctggaacatagaattgcagtagtaagaattactggtattcaaatatatacaatcagccctcagtattcatgagttccatgtctgtggattcaaccaaccaaagattaaaaatactcagaaaaggctgggggtgatggcgcatgcctataatcccagcactttgggaggctgaggcaggcggatcatgtgaggtcaggagttcaagaccatcctggccaacatggtgaaaccccatctctactaaaaaaaaaaaaatacaaaaattagctgagtgtggtggcacatgccagtagtcccagctactcaggaggctgaggcaggagaatcacttgaacccacgaggcagaggttgcagggagccgagatcacgccattgcactccagcctgggtgacggagtgagactgtgtcttaaaaaaaaaagagagagagaaacatcacatatatgcacttaatgtggcacccgcacacatttatttttattaagccacctcacttttgttgagataagaaagattttatgaatcccctatagatgcaagtagtgtacttgcaatgtaacaatggttatgagctcagcctctgcagccacactgcttgggttggcctccaggttctgccatttgctagctgtgtggtattgggcaagttacttaacatctctgtgcctcagtttctatatctataaatagcagtgatctcaaaaaaacctcagaaaaaaattgcgtctgtattgaatatgtacagacctttttttcttataattccctaaacagtacagtatagcagctgttagcatttacattatagtaggtattgtaagtaatttagagatggtttaaagtgtatgggaggatgtgcatgggtaataagcaaatgctatgccattttctatcaaggacttgaacatgtatgggttttggtatcccgatgggtgggggtgggggtggggtggggtggatcctggaatcatttccccacagataccaagggacaactgtacagtagtttgattcttttggttagtggggattggcaaatggggttttaaaatcacataactgggagcaatagtggcttcataaacagtaagggaacccacacattcaaataactaacctcataattcacatgaattatctaaaatacgacaactgagttcctttggtaaagttattagagtgccattaattggatatacagtcatttactgcatattgatgttttggtcaacaacggatcacatatataatggtggtcttataggattataatgggagctaaaaaattcctattgtctggcaatgtttattgtagcccttgtaacgtagtagtgcaataacacatcactcgtgtctgtggcgatgctggtgtacataaaactattgtgctgtcactcttataaaagtctagcacatataattgtatacagtacataatccttggataataggataataaaattattatcctaataataataagtgactgtgttactggtttatgtatatcttagtccatttgtgttgctataaaggaatacctgagactgggtaatttataaagaaaaggtttatttggcccacagttctgtaggctggtgaggtcctcagcctgcttctactcatggcagaaggtgaaagggatcctgtgtgtgtagagatcacacggcaagaaaggaagcaagagagtggggagaggtaccaggctctttttaacaaccaactctcagggaactaacagtgagaactcactcactgctcaccaccctgcccccacccccactggcattcatctgtacatgagggatccaccaccatgacccaacacttttcattaggcccacttacaacattggggatcaaatttcaacatgaggcttggtggacaaacatccaaactgtagcagtacatttactgttatatacttgtttttgtttttagtgtgtgtaccctctaataaatttaaaagttaactgtaaaatagcctcagtcaggtcctttaggaggcattccagaagaaggcgttgttaccataggagatgacagccccattcaggttagcgttcccgaagactttccagtgggacaagatgtgaaggttgaagacagtgatgatgatcctgaccctgtggaggcctaggctagtgtgtatgtgtgtcttagtttttaatgaaaaagattgagaataaaaaacctttttttaatagaaaagtttatagaataaggatataaagaaagtaaatatgtttgtgcagctgaatgtgtttgtgatttttttttttttgttttttgtttaaaatagagacagggtctcaccacgttgcccaggctggtctcaaactcctgagctcaagtgatctttgcacctcagcctcccagagggctaggattagaggcgtgagccactgtgcctggccttgtgtttgtgtttcacgataagtgttatttacaaaaaagtcaaagtttcccaaaaagaggaaaggtttttaaagtaaaaaagttacaatgagcttatattaatttattattgaagaaaaatatttttggataatttagcatagcctaagtgtttataaagtgtacagtaatgtcctagaccttcacattcactcactactcactcactgactcacctagagcatcttccagtcctgcaggctccattcatggtgagtgcccaatttaggtctaccattttttatctttcatactgtatttttactgtaccttttctatgtttagatacacaaattcttaccactttgtcctaattgcctccagcttcagtacagttacatgctatataggttggtagcctaggataatagactataccatttagcctaagtgtatagtaagtagtctctaccattagatttgtgtaagtacatgctgttattttcacacaacgatgaaattgcttaacgatgcatttctcagaatgtcattaagtgacacatggctctaatccacaatcagtatggcgggaacttcacaaatcttaaaacaactaaactggttgtgtggtgttcaaaatgttatgggcgtgtaaaagtaaggtgataaaaaaattgccattaattctatggatgccattatttcttgctcttccttcagcttgtcttttcatcttagcttttcttacacctttgtcctaagcaagatgtagcaagatatacagcaataataacaaattctttgtttccttgtattatttttaaattttattcattttttagagacagggtcttactctgtcactcagactggagtgcagtgggattatcataggtcactgcagccttgaattcccgagcttaagcagtgctcttgcctcaacctctggagtagctgttgggactactggtgtgcaccaccacacccagttaatattttattttattttttattattttattttattttgtttttgtagagatggggtctcaccatgttgcccaggctagtttcaaactcgtggcctcaagtgattgtcctgccttgacctcccacagtaatgggattataggcatgagccacaccgcccagtttatttatttatttttcagagacagggtctcactttgttcctcaggctggaatgcagtggcatgatcatagctcactgcagcctcgaactcctgggcccaagcagttgtcccgcctcagcctctggagtagctaggactgcaagtgtgccccaccatgcccatctatctatctgtatctatctacctatctatccatcgatccatccattcttagagatggggtctttctttgatgcccaggctggtcttgaaatcctagcctcaagtgatcctcccaccgtgctggaattataggcatgagccctctctgttttcttttaaatgcaacatttgacatcattaaaatattgccataatattgtttctataatttgatgtggtatgttttgtcccaggcgttatgtagggatttctgggtgttttcggggcgaaccagtaggtcaacatttgtattattttgttgtaaagtaagtgaattatttaaaaatgattctattgaatcattttgcaagccagtggatttttctatttttgtttacattcttgtgtttaaacatttttattttttaacatgataacaaatactgtatttctacaccattatatatctgctcctttactcatgacctagtaaagtgggattgttacagatacgctaattgcttgaaaatgcactcctaaatttcagtgggggatatgcattttttttaagcagtgatatgttctagaaagatctatgtaacatcttatatttctggctgataacacttacccccagcccaaacacattttctttttcctaagccaattaacacaggacccaaacgcatttttaaaaattaagttattcttctgtaatccaccctccctccttggtctgggcaaatgatggtacagtatttaggcctgaagccttagctgtgtgcttttgagatataaattttttaactttctctgagccggtggttcaagactacagtgagcagtgatggtgccactgcactccagcctaggtgacagcaagaccccatctctaaaaaaaagtcaattataaaattgagttgttttgcttttcttatggactttttagttctttacatattctggatgagagcctttcttggatatacatattagaaatatcctttcctggcccagcgtggtggctcacgcctgtaatcctagcactttgggaggccaaggcaggtggatcacctgaggtcaggagttcgagaccagcctaaccaacatggtgaaaccccacctctactaaaaaaattagccgggcatggtggcacatgcctgtaatcccagctacctgggaggctgaggcaggagaatgagaatcacttgaaccagggaggcagaggttgtagtgagccacgatcttgccattgcactccagcctgggcaacaaacaaaactctgtatcaaaaacaaaacaaacaaaaaaaacgcagtatcttctccactctgtgggctgccttttcactccctgaatggtgtcttttaatggctaaagttaattttaatacagtgcaatttatacatttttttccctttatggttaatgcttggttttaaggtcatatgagtagttcagatttctacttgtattaatattttgttagatttttaaaaacgaaaacaaaattttaaaattccttttatagattgagtcttaagaatgtatcctgggtgtctggttgaagttgttgtttgaaaaaagaaaaaaaacaaagaatatatcctgggacccttcgggagtccatgtactacagtttaaggaacactatactagaatgtgaattgcttgaggacttttcatttatgtgccccaatgcacagtagagtctcagatgtttgttcaatgaataaatgtaataaatgacaagctccccaaaataagtttaaactcttctgtcagttttattattcttgctttttccttaaaattatttgtttgggtttcaaaaaatacaagtattgctagaatttgtttgaaatttttttcttttataaaaggaacctaaaagtttaaacagagtgtggtatgaaattttttatttcagtggaaagagatatttaacttcttggaaaacagtgtcctcttcctcctcctccaccatgtttgaaaagaaatgtcttttacgtagtgatgtttccgccgtatggtttctagataattgtcactaaatttttataatcatagatctttgcagtttactctctaagcctgatgaaattaagccaagggctggatctggcccatggattagaagcccattcattccttatccaggaaaggaccagagaatagttaattaagaatgtggctttaacagagctaaactgcttggatttgatttcctgccctgccacttactgcctataatttttgacaaataatctaacttaatctcaggttgtacagtgtgcataaaatgggaataggccaggcacagtgatcatgcctgtaatcctagcagtttgggaggctgaggcaggagggccacttgatcacttgaggccaagagtttgaacatgcagtgagctatgattatgccactgcactcttgcctaggcaacagagcaaaatcttgtctcaaaaaataataataataataataaaggaataatatcactgaacacataggatagttgtgaagattaattcatacttgtaaagtgtttggaacagtacagcacctaacatgtaacagtcagatattataaagtaaaataatcacagtgattcagtgatttacacatctacgctgaagattatagtgaagttaatagaagatacaaatgctgaactaaaatttatttacagatgtcagatattcaaaccattcgtggaaatgtaaggaaaatcaaaagaagtcttttgtacaacagataccacattacaaaatttgttggcctttataatccccaattagtgaaatgccatatatttgcaataaaaaaaaatagtagaaaatcttggagtggaatgattaaacaaagacagtagaaatgagaaatttttgctaaattccatccttccataatctcaatttcaagcatcctacttgattacctgttaccaccctgtctttctgactctctctagtgcttttattccaacagtccacctccactactaaagccttcagttcagtgactctgctacctcattgtttaatgtcttatatctgtggtttatagtttttatcaaattagaaaacatttttgcatttttcttcaaatactctctacacccttacatcaagattccaattatgtgtacgttaggtcatttgatgttccacagcttactgatactcatttaaaaaatatttctatgatgttcatgccatcccatacctttttggtcatatagaatatgtatagtagctgacttaatgtccttgtttactgaatgtaacacctgtgtcatttctgggtcagcttcttttggtgattttttttgtcttggtgatagtttatattttcctgtttctttgcatgcttggtagtttttaactggatgtcagacattgtgagtatatgttttaggggcttgattttaaaatttttctctaaatagttttggatttggctgtgatgcagttaggtaacttggaatcagtttgatccttttgaagcttacctttaagtttcgttagagtgtgtccagaatatcactcggggtagggctactttggctccactatagactcaataactttctgtggactctacccaatgcctggcactttaaagggtgtttccactctggctggtagcaacactaactgtttctggccctgtgtgcactctgctgattgttctgcccattcccattccttcctaatggttctttccccagtctcttacagttttctcacacccaggtacaggttagtactcagccacaggcctcagggaccttctgtatagatacccagagctcccttgatgccacaaattctagtcacctcagccttttcaaactctgaactctgcctcttaaatgtagtgaaacccctagcggctgtttgggtttcccctccttgtgatgaggcctggagacactctctaggcagtatgtttggacatttgtagcgctcacctcatttgtttttcttttctcaggaagcgctgtcctgcactgcttttggttttctagtttgtttaggcaggagggaaaatctggttcctgttattctgtcatgatgggaagcagaagtctctttctcttttcaccttgaagtccattttctccgccttacccaacataaattctcttctcaatcattatagttgttcccttcaatacactttttgcttccttgcccctgtcttgttctgcttgggaaaagtgtacaaccctggttaaatctgtctcttcacttttcagtgccagtacctgtgcagctgaatgtcactcgagaaaaagacacaaccgtgctatttgcaccttaaatccatgaccacaatgaggccagtcatactgcatttccagagtcacttattcttccactttcctagatgtatttttcacatcttttctgtcaacattctaacatttcctccccgatcttctcagacattgtcgttatttccacatcactgggaaattaaagcaataaaatatgaacttctcagagtcgtacgacatctatccttgtaccagcacctacatgtacattcttttgccttctcctcttagcctgtagtcacttcctccacatatgcgctagatcccattccctcttgcctatccagtgcaatttaaattcactagcagtttctctccctttccccacatcatcaacatttcatatcctggaatgttcctgtcagcatacaatcatactgtatcctagctttaaaaaattatttggccaggcgcagtggctcacgtttgtaatcccagcactttgggaggctgaggtgggcggatcacgaggtcaggagttcgagaccaccctggccaatgtggcgaaaccccatctctactaaaaatagaaaaattggctgggcatggtggcgggcacctgtattcccagctactcgggaggctgaggcaggaaaaccacttgaacttgggaggcggaggttgcagtgagcagagatcacgccactgcactccagcctgaaagacagagtgagactccgtctcaaaaaaaaaaaaaaaaaattattattttttcacttcctctcaccctatcaattaccatgccatttctttactctcttatacaggaaaaattgtgaagggttgtctgtactctttctagttttcttcttatttatttttgtttttatttactatttgttttttgagatagggtctcactgtcgctgtcgcctaggctggagtgcagtggcgccatcatggctcactgcaacctccgcctccaggccttagtagctgggattataggcgccaccatgcccagctaattttttttttttttctttgagacagtctccccctgctgtccaggctggagtgcagtggcacaatcttggctcactgcaaactccgcctcccaggttcaagcaattctcccacctcagcctcctgagtagccgggattactggggcctaccaccacacccagctgatttttgtattttcagtagagacagggtttcaccatgtaggtcaggctggtctcgaactcctgatgtcaagtcatccacccaccccggcctcccaaagtgctgggattacatgtgtgagccaccgtgcccagccaaattttttgtatttttagtagagacaggctttttccatgttgcccaggctggtctcgaactcctgggctcaagtgacccgcccgcctcagcctcccagtgttgggattacaagcatgaactattgcgcctggctcctcgtttctcttaattccactcttcattccactctaatctggtatttgtccttactactctgcaaaaacttctgtggacaaagtttcagtaacttccatattgctgtttcagtggttatcttacctgatctgtcaggagaaattcttaaaattgattattctgtctttctgacacactttatttactttttgtccagaataccatactcttggttttcttgccacctgtgctctggttgctctctttgtctcctttgctagttcttactcctctctccgcctcttaatgttggatatctaaaacctcaggcttgggtctccatctttatgtatcacttctctcacagtgatctcatccaataacaggttttaaaacccatctgtattctgatgacttcaagtttttattttctgataggccttttaaattctagatttccatattggactgcctattcaacattttcatatgaatgtataatagatatgttaaatgtaatacatctaaaaccagtctcacaagctttccttaataagcctgtcaaatcttcttttattctagttgatggtagtgccacacttactggacaaaagccttaaagtcatgctttactcccattttctcatatctcagatgcttactgttaggaagtcctgttagtaccaccttttgggcatctaaaattgaaccacttctcatacctcctacctccattgctatcacctcagtccaagtcaccatcagtgcttcctaatcctacacccagttttaacccttgccccttataatatattctcaacatagtaatgagggagattttaaaatgtaaataagattatgacacttcaggccaggtgcggtggatcacacctgtaatcacagcactttgggaggccgaagcgggcggatcacaaggtcacgagttagagaccagcctggccgacatggtgaaaccccgtctctactaaaatacaaaaattagctgagcgtggtggtgcacacctgtaatcccagctagggcaggagaattgcttgaacccaggaggcagaggttgcagtgagccgagatcgccccattgtactccagcctgggcagtagagtaagactccatctcaaaaaaaataaaaaataaaaaagattatgacacttcttgctcagaatcttttaatggctcttcatctcacttatagtagaaaccaaagtctttataatggccttcagggtcctacaagatccagctcagtaagatccagtaagctaagttacttctatgaccttatctgctctctccactttgtttactttgctctaccttgaatacattaagcatgtttctatcttatgttctttgcattggctgctttctctgcctagaataccctttttccaggtattcccccattgtcaactccctgttggcttccccacggcccatttgtgtgagaagaagagtgcctgtgaagggattagttgtgctgtaaggagtgaaggatagaatacctttttccaggtattcccccattgtcaactccctgttggcttccccacggcccatttgtgtgagaagaagagtgcctgtgaagggattagttgtgctgtaaggagtgaaggatagaggggcaggagtatggcaaatgttgtagttctctgaagagccagtgaatgagagaattgtagacctactagcaactgttgagtccagcttatttgctattctgaatagtaatgaaagaattcaagaggctttgtagcaagttaatagagatgaggcagccttcagtcagtcagtgaaaacgtacataaatcaaggttcatagtctgaagattctttttcttattaataaggcattctgttttgtagatagtggatttggtgtcctgccacttagttatgatttaatgatatgctcttcagtttaatagagaataggtcaaggaactacttgagcatcatttttggaatctattataaaagtttaatagaaaacaattaattattaaattccttttaaaattgagtattagggaaacgtgtttattatgtgttccatcaaaaaggagagcaaaaatatgtttcctggtacttaacaatgtctattaggagatttcagagcctaaccagtgtttaatttatctccagtacctgtctactctggtactctgcaccttttatttttaattgcaggacttacactatatttaattttataaattagcaaaagtgcttgtggaaatagacttaattgaaattagaaagtatcctcttgttaagaaggtattcttttttccatgtcagtcaagaaaagtgttctttctatggttctttcatatttgtttatttgcacacctcttcctcatagggaagaataaaagaagaaaatgagagttacaggaaaataataaaaagtagaaaaagtaatgtgaggccaggcataaagttattgtacaaagtatatgccgcagcatcacaattctgactctgaatttcccagtagccaacactaagaggagtgcgaagttacttacgtgattcatttaagtccataaggtaaaaagaaactagttgttcaggagagaagcgtagctaatcccagtactaagtttttagtggatatctcccatgggtccttatgataagaatacagtggctgggtgcggtggctcacgcctgtaatcctagcactttgggaggctgacgtgggcagatcacctgaggtcgggagtttgagaccagcctgatgaacacagagaaaccccgtctctacaaaaaatacaaaattagccaggcttggtggcgcatgcctttaatcccagttactcgggaagctgaggcaggagaatcgcttgaacccgggaggcggaggttgcggtgagctgagatcgtgccaccgcgctccagcttgggcaacaagagtgaaactctgtctcaaaaacaaaaagaaaaaagaatacagtgtgatagaagcaggcatctggagcaagacagtatattaacttttaggatgaactatgttcgtgaatataagcaggatttataagagtatgatgttaatttgtggttcttaacctagtttgggtcatagaccatctaacattatttttatgtaattttatcatgaatttgataaacatgcagattgtggactaacttcaagagattccgatccagtaggcctgaggtaggttttaggaatctgtatgtgtaatcaccacctcagatgattttcacgtaggttgttgtcagatcatatgttgacaaactgtttcagtgttataatttcagggagtttgcatattccatacaatcactgtatgcatctcaggttcttaacctgagcaatatcaacagatttgtataactgaaaaataatcatgagtctgggcctggtggctcatgcctgtaattctagcactttggaaggctgaggagggtggatcatatgaatccaggagttcgagaccagcctgggcaacatggcgaaaccccgtctctactgaaaatacaaaaattagccaggtgtggtggtgcgtgtctaatctcagctactcggaggctgaggcatgaaaatcacctgaccctgggaggtagaggctatagtgagccaagattatgccactgcactccagcctgggcaacagaacgagactctgtctcaaaaaaaaaaaaaaatcatgagtttcatagggtgtttggtgctggtgtactagaaagttaggttttacatttaagtctttaatccatcttgagttaatttttgcatatggtataagaaaggggtctggttttacttttctgcatatggctagccagttatcccagcaccatttattgaacagggagtcctttctcttttgcttttgtcaggtttgttgaagatcagatagttgtaggtgtgtggtcttatttctgggctctattctgttccattggtctttgtatatgttcttatatcagtaccatgatgttttttggttactacagtgctgtcgtataaagacacatgcacacatatgttcatcacagcactgttcactctaacaaagacgtgaaatcacccccaatgcccatcaatgatagactggataaagaaaatgtggtacatatacaccatggaatactatgcagccataaaaaagaacaagatcatgtcctttgcagggacatggatggagctggaggccattttccttagcaaactaatgcaggaacagaaaaccaaatattgcatgttctcacttataagtgggagctaaatgatgagaacacatgaacacataaaggggaacaacacacactggggcctaccagagggtgaagggtgggaggagggagaggatcaggaaaaataactaattgcttaatcctggataatgaaataatctgtacaacaaatccccatgacacaagtttacctttgtaacaaacctgcacatcctacacatgtaccccaaacttaaaagttaaagaaaatcgtgacttttgttgaaatttactggccaaaacaaaccagatggtcctagttcagtggcttactgctataacctcagcattttgggagactcaggtgagtgcatcagttgagcccaggagttcaagaccagcctgggaaatataacaagaccccatctctacaaaaaaatacaacaattagctgggcatggtggtgcgcacgtgtagtcccagctacttgggaggatcaggcaggagaattgcttgagcccaggggatcaaggctacagttagctatgatcactccactgccctccagcctgggtgacagagcaagaccctgtcttaaaaacaaacaaaaaacaaatcacatggtcacatttaacttgaaaaggagtactaatgactaacacatatggggtctctctctctctctctctctgtttttggcaatgtaattgatcattatttttcctaatattgcactacttttacattccagagataaactgtatgattatgaggtctgattgttttgatatgacacttgtttgatttgataatatttatttagatttttgcatctttgttctctggtaagattggcctggagtttccatttcttacgcttttctcagcagttcagtgtcagggttttttgttagcattataaaaggagatgagtatttttctgttttttttttctcctcagttttcagagtttacatagatttccaatatactttttgtgagtttaggacaactacaaaattagatgatacagtctccatataagactattctcacttctgacaccaactgtaagcttgggggattcccaaaaccactctcaggtttgataattcattagaaaggctcatagcatttagtgaaagctgttgtacccatagttatgatttgttatagggaaaggattcagataaaatcagccaaaggaagagactcatagggctaagtttaggagagttccaaatgcgagcttatcttgccctctccccatgtggtcaggacacatttctctcccggcatcaatgtatgacagtatgcacgagtaccatcaaatagggaagctcacccaacctttactgttgagttttgatggagcttattcacataggtgtgattgattacttgctcacagggatttcagtctccgtgttgagtgaccccctgtgaccccaaacccgtatctcaagttgtattgttcgtcttcccagttggtgagcctctacataggattatataggtgtggacagtcccctccctgaattgcattattagccaatccagtatgacccaaggcctcccaaagacatactttttagacgtaactttctaagtgtccagagattatctactagaagccaagaagaaagaccagactgtctccttggacaaggccaaattcttcactaaacacatttgtacaatttttctcttttatgattgtcttcctgtgattcctcaataacggattaagcctgtagggattccattatggaaaactggttcatttaaatttgagcccttcatttctctagctgtctcataaaaattacaggatactttttatttaactgcatttaaattaaactcccttttatctttttttttttcaagaataaaggttctcttcagtttgaagacaaatgggattttatgcgcccgattgttttgaagcttttacgccaggaatctgttacaaaacagcagtggtttgatctgttttcgtaagtaccccactaattctgtttgctagcataaaggaaattttagtgatgtctttccatacccaaatggaatgtgtaactctaagtttatctgtttacctattaaaaagtattactagttacattgagggtctccaagacctctcccaggtatgatgatttgctagggggctcacaggactgaacatacaatcatactcacagctttgagtcattacagtgaagggatccaaagcaaaatcagcaaagggaaaaggtacatggggtgaagtgcaggaaaaaacaagcacatgcttccaagaagagtcctttcccaggggagtcacacaggacacacttaatttttccagcaatgattgacagcgtgtgatatgttgtctaccagagaagcttattggagactcagtactcaggatttttatgggggctggtcacataggcagtctctctcaacatgtaccaaaatcagtgtaaaccatattgtttatataaacagtttaggtacagtgagccactgttatttcaggaaagtgtaggaaactgttgaccattcaagttctcagatgccagccaaaggctaatcttacaagcaggcatttctaggggatgcagtctcaggggtgctggtagttggtgctgttaggtatgattgtaagttcagcagtcaggttgaattaaaaggactcatggcagcttggaaagggaaccctgagagatttcctttaggaaaagggggaaagctttcaggactagttgtgaaaagcaaaaatcattaatgtcctcctcctccgctgtctcttcccagctgctgtgttttgttttttcttcctaataaaatcagtgtatccctttcagtaatgaaaatttcatgtcttctcaatcatccagacctgcatgagggacaaaagtctttttcactaaaaaacatttttagacaacttaattagaaagacatattatatttaggaattggtcaggatgaaatcctgaatttttaaaacttttcaaaatgggcttatgttatctcccaccccttttgtcctgatcatttatctagtgggtagcctagaaaacatcagttcctttctggggacagctgcatttaataaccagactgacttactgaggtgtgtgtgtaccaggaggggtgacaggaaagagagaactagagtcaggttattaaatctgttgttgcaaactgtaaccaatccagaaaggcaaacacaagtcagtagcagtgagacatctcaagaaggggtcaaaatctaatctgtaagaagtgggcgaaggggctacactctttgtgatgtgccccctcccaactacagcttttggtaggaaccaccagttgggaatactgttaatctccatatcagatacataagaccaatcagcagcttgattttggatagtcccatcagagaataagcctttttctttggttatctgtgagtggttgaggtggtccagccagaatccatgatgttttcatagtttctggctccacaggaggatatcttttaaatattcagtaatctttgacggccagacaaagtggcttacgcctgtaatcccagaactttgggaggccaagacagggtgatcgcttgagcccaggagttcaagaccagcctgggcaacatagtgtgagaccctgtctcttaaaaaaaaaaaaaaaattatctgggtgtggtggcacatgcctgtagtcccatctaattgggagctgaggtgggaggattgcttgagccctcaagcagattgcttgctgcattgaggctgcagcaagccgtgactgtgccactacactccaggctgggtgacagcaagaccttgtctcaaaaaaaaaaaaaaattgaggcaaagtcctgtttattgagtatatgcctgcttttggttcagcacagcttgtgttgaggttgaaatagcccagtagcagagtgtcaggtttcagcctagcctcagatccaggtaattgagatctgtgatttcaggattccaaaacagttagtgtcttgtctttggcagcagtaaagccaagatactgcaggctcgcagccatatttcaagtccgagtgatcagcgagactgtcctaagtcctttttaccttgtcttaggatccaacttgatctgctcaaaaatatgcacatcaggctggaaaatcatcagcttctaagggtcagacatctaatttcacaagaattcaatagcaatgaaaaactgcatttaaaattccaaaagtgtatttcttccatctggagatttcgtttgttttcatgttgtctctctttttccagggtcatcagtagttaaaaaagtcatagtaaatatcatccattgtggagatttattctgctcccaatactcagagagtttaaattccagtcccttcagcagaaaaaagcaagaaattttgtctcactaactcttcctgattgggacaatccctctagcatttatgaaatgactagcagcatattacatattatgtcagttttgattatacatctagatgcaatagctgcaaagtacaaagtcatctttcaaccccccactttactttaaatttatttatttattattgagacagagtcttgctttgttgcccaggctggaatgcagtggcacaatctcagctcactgcaacctccacctcccaggttcaagtgatactcctgccttgcctcttgagtagctgggactacaggtacccaccactgtgccaggctaatttttgtattttcattagagacaggttttcaccatgttggccgggatggtctcgaactcttgacctcaaagttacctgcccaccttggcctcccaaagtgttgggattacaggcgtgagccacggtgcccagccatccttattccttattttaaatttaatcaacccccagcagtaaattcagtgtttataagagtaacacattacagctgctgggaaatcctgactggaatgcaaggtgtagggaggaactgcaggcagcagcagctagtctgaagaaacagctggagtggttcactctccccactcctgtttctcccctagtttatctaaagctttgctccagccctgggctctgatcttgctattattttttcctatttagaggagagagcatacaaacttttaacatttttggtccacccaaaactcacctttgggaacttttgggcctcttcccacctggaggcaagaaaaaaaaaacaaaaacagagacatcatccagactctgttttttctctcttcactttagtcagcatggccagaaactgccaggggaatgaggtagccaattttcctggtttagagctatcattttcaaatttcataggtaatttttacctgtcacaacagacagaagctcagctgctgtttcatactgtgaatgattttatagccacccaagcagcaaatgtttgtcatcctactgcttcttccctcttcatgagtccaacttctaacaccagctgtgttggcaatcccaaggtcacccctaggctcagtgattgctgggagtattcatgggacttaccatgtagttgtattcatggctatgaattattacagtgaaggaagcaaagcaaaatcaacaaagggaaaaagtgtgtgtggcaaagtccaggagaaacgaaatccaaacttccaaatgtcttctcgcagaggagtcacacattaagcttaatcctccagcaactgacagtgacaacacatataaaatattgtctaccagggaagctaattaggggctcagcacccaaactttctactgggggctcgtcatgtaagcagcttctgcctggcacataccaaaattcgagactggcagaagaaaaggaagtgttcaacgtaagtcacactgtttgtgtaaacagtttggaaatgtaaaacattctcattaaggaatgatgggaatcctcccaaaaatccaaattgccacatcctagccaaaggccagtcttgcacacgggtctgtcttaggatagcagtctcagacacactattaaaatgctgtatcaatgaattatagatgtataattgcataagctgtacacattgggctattgtaatcgttttctctctttatcacttaaaatattctaatttccgaaatgatgtaggaccttgctgcatactatcaattaacttatacttcttgcctttgggaaattaaagtttagtaagaaacagctgaggccttttaaagctttattacattcatgtatacatatattttttgtaaattattcaattaaactattttatgaatgatatgttgggtgtggtggggtgttttgttgttaatgttgtttttgccagtctgtgttgataagatttattattgagaatagtgcttgttctctgagtactcctgacttagaaaaggagcatagccctactaaaggggacttcaaagtagaaatcgtcaataaccttttacttgctacagttagtggcctcaacatgatgtttttaaagatcttttggccaggtgtggtggctcacacctgtaatcccagcactttgggaggctgaggtgggtggattacctgaggtcaggagttcgagaccagcctggccaacatgtctactaaaaatacaaaaattacctgagtgcggtggtgggcctcagtaattccagctacttgggaggctgaggcaggataatcacttgaatccggcaggcagaggttgcagtgagccaagattgcaccattccactccagcctgggaaacaagagcaaaactccatctcagaaaaaaaaaaaaaaaagatctttcatctccttggagtacctaaagcagttcagtgtatcgtccttttaggtaaagggatttctgactgacaataattaaaacccttgtaaattttagccatattttggccatgttaatcgttaacatttaggttgcttatatctttctaaatcttagttactaaataatgtattgatgttaaggtacattgactgagattttccccccttttctcctaatctatattctttctctattgaagtactcttggtattttgggtggtataagagattgttctgcatgttgtgcaatatttatcacttctgtccttcactcttttttttttttctttttaaattgagatagagtttcattcttgttgcccaggctggagtgcaatggcgcaatctcggctcactgcaacctctgcctcccaggttcaagcaattctcttgcttcagcctcccaagtagctgggattacaggcatgcaccaccacacctggctaattttttgtatttagtagagatggggtttcttcatgttgatcagactggtcttgaactgctgacctcaggtgatccactcaccttggcctcccaaagtgctgggattacaggcatgagccactgtgcccggcctgtccatgcttatgaactccagtcatgaacactccttctgtgtctttctcctcacccttctgtgtctttctccccaccttgcattataaaaacaaagattctcacatgtttccagatacccttctaggggaacaataccttccttagttgagaactgctgctctagatccatttacaattttacccatttttaagtgtacaattcagtggcattaattatattcacaatgttttgcaaacatcaacacagtccattccccaaacgcttcatcatcagaaacagaagctctgtacccattaaacaataattcttcattcttcctctcctcagctccattttagtttccatctatgaatttgcttatctagataactcatataaatggaatcgtatagtatttgtcgtttggaaagacatactgttttttaatgggcttggttattcagttcaggtttaatgttatgactgatattcttgcttttgttgcttctataactttatcatggatctgatgttattgtttcttcattttccctttgtttttattaattttaaagtttatttccattagtggttgccttcgtgtttcttggtcttagttagaagcatgtgattgtcctactacttggaaacaaaatacatatcattttatcacaccagggtcacactatttcttgttctcttctacacaaggaaatcaaaacctctggaatagtttttacttcttgctgcttttcctgtcgcttctgtctgcctccttaagacttttgagaagcttctatttcctccctctcctatttcccaactcctagatttttctaataaagtttttaaaaagatttaccttatagcatgttcccttttaaaagcactttggggctggatgtgatggctcatgcctgtaatcccaacactttgggaggccgaggctggaggattgcttgaggccagagttcgagaccagcctgggaaacacagtgagattccatttctacaaaaaattagccaaggctgggtgtggtggctcatgccggtaatcccagcactttgggaggcgaaggcaggtggatcacctgaggtcaggagttcgataccaccctggtcaacatggtaaaaccctgtctttactaaaaatacaaaaatcggctgggtgtggtgttgtgcacctgtaatcccagctacttggccagctgaggcacgagaattgcctgaacttgggaagcagaggttgcagtgagccacgattgtgccactgcactccagcctggctgacagagtgagactccgtctcaaaaaaaaaaaaaaaaaaaaaaaattagccagtcgtggtggcacgtgcctgtagtcccaactactcaggaggctgaggcagaaagatccttgagcacaggagttttaagttacgagcttatcatgccactgcactccaggcagggtgacagggagagaccctgtctcaacaaaaaaaaaagtacattgagaacattcttccctgatacagcaaggcagagaagtaactggtgattgagaaaagagagctggagaagatgtaccaaatcccttctaaatttgactcttcttttgataagatttctagggaattatctaactccacccccttttaccacaccattccctgttatcctatgagactcaagtcctgtttgaacctttctgacatatatgcaaaagtgatttgagtacggcagggttacaaaggtaggtttgtttttgggatgcacaggtctcctctgatgggtgactttggctccagaattcttcaacagccttaccaacctttcttagaactgtgctgattcttactgctcaagcttcctttcttgtctcctctacagggatcacacctacacccagctttctgtagcccattttccttcacaggtgttcccttagtaaatctcttatattaataatctcattagcttcttttgtttctgttttttcttttttttttttttgagacggagtctctgttgcccaggctggagtgcagtggcatgatctcggctcattgcaacctctgcctcccaggctcaagcgattctcctgcctcagcctcccaagtagctgggattataggtgcctgccaccgtgctggccaatttttgtatttttggtagagacggggtttcactatgttgaccagactggtcgcgaactcctgacctcaggtgatccacccacctcagcatcccaaaatgctgggattacaggtagagccaccatgcccacacccggcctggttttttctttcttttttcttttttagacaaagttttgctcttgttgcctaggctggagtgcagtagcgtgatctcggctcactgcaacctctgcctcctgagttcaagcgattctcctgcctcagcctcccaagtatctgggattacaggcacctgccatcaagcctggctaatttttcgtatttttagtggagatggggtttcatcatgttggccaggctggtctcgaactcctaacctcaggtgatccacctgcctcggcctcccaaagtgctgggattataggcgtgaaccaccgcaccaggccccatcagcttcttaaaaggcttcttaaactaacaccagtcaatgtggaatgtctggcacatagtaagcagttaatacatgttacttttgttatagtaaactaaataaaagatgatggggactatcatggtaatgggagggaaacgtccacattagagagacatttgcatgataaatataataggactgtgattgaatataagggataaaagggggttagtttgcccaatttttttcttatcacttcacattttcacattttactttacagggtagccacattgatgtgcttatagtccactgcagttaccttagtcatccacaattctttttttttttttttttttgagacagagtcttgctctgttgtccaggctgcagcgcagtggtgcagtctcggctcactgcaacctccacccccgggttcaagcaattctcatgcctcagcctcccaaattgctgggacaacaggcgtgcctcaccacaccaggctaatttttgtattttttttagtagagacggggtttcaccatgttgtctaggctggtcctgaacacctggcctccagtgatccaccaactttggcttccctaagagctgggattgcaagcttgagccactgcacctggcccacaattctatatactgtcgattttttttgataaaatatcctctctcctatttttgtacacctttgcctggcaaactcctatttttggagattaagctcaggaaccaactattccaggaagcctttccttttcctctctacctctcactcacccttaccctgtccttgagttcctaaaccatcttttgtttatatgcataaaatagttgtaaacatattataatcaatttttctatcagtttctttttttttcttttttgagacagagtcttgccctgttgcccaggctggagtgcagaagtgcagtcttcgctcactgcaacctccgcttccagggttcaagcgattcccttgccttagcctcttgagtacctgggactacaggagcgcaccaccacgcctggctaatttttgtatttttagtagagatggagtttcgctatgttggccaggttggttgcgaactcctggcctcaagtgatgtgtccacctcggcctcccaaaatgctaggattaaaggcatgagccgccatgcccggcctgtttcttttttaaaaaaattgtttttagaggcagggcattactctgtcgctcaggctggagtgcagtggcacaattgtagctcattgtaaccttgaacttctgagttcaagtgatcttccctcagcctcctgaaaagctaggactacaggcatgtgccaccatgcccaactaattattttattttatttttgtatagatgtggtcttgccatgtggcctaggctaatctcgaacttctggcctcaaatgatcctcctgccttggcctccaagagtgctaggattacagacatgagccaatatgcctggcccagtctcttcttttagactctagattcttttagtcattagatgagactgtataggtatgcaggagtcatttaatcattttgtaatttattctaagagtattgggaaaccattagaggatttaagtatggggtaatatgatgtgacttgagttttgtaaagatcactttagcttcttgtttaatagattggagggtttcaagagtagatttggtttagtgtgagttctggagcctgatttcctggctccaccataaacttaactgtataatcttggattgtttttccttcaatttccccatctgtaaaataaggataaaatagtagtactttagaattgctatgaagataaaataagttaaaagaacttagaatagtatctggctggtgcctcatgcctgtaatccagcactttgggaggccaaggcaggtggatcacctgaggtcaggagttcgagaccagcctgaccaacatggcaaaactccatttctactgaaaataaaaaaattagccagtggtgcatgcctgtaatcccagctacttgggaggctgaggcaggagaatcatttgaacccaggaggcggaggttgcagtgagccaaggtggcgccattgcacttcagcctgggcaacaagagtgaaactccatctctaaataaataaataaatagtatctggcacatgataagcagtcaggtgttaccttttatattgttatttaacaaatatttgtgtgcttatagcatcctaggcactggaccagataccattatcaagctgaattgaaccagtgaaaaaagcattcaaattaatatggagacaaaactttgggctctactagtgtctctaaaaattggaatataggccaaccccagtggctcatgcctatatgctggccctttgtgaggctgaggcgggtggatcacttgagttcaggggttcatgatcagtccagacaacatagggagaccgtgtctctacaaaaaataaaaaattagccagacatggtggcacatacctgtggtcccagctagtcgggaggctgaggcagggttgagcccaggaggttgaggctgcagtgagctgtgttcatgccactacacctcagactgggcaacagagtgagacagtgtctcaaaaaaaaaaaaattagaatataaaacaatttgattattgacatgttgtaattctggagttgttttatttggatttctttgactttttttaatactagaggctccattatgaattgaatgaatcactggggaacattttttgaatgaatgattcttcactatgaccctgtcctttcgttgtttctctgatttacaacttggtcatttgatttacaacttggtaatttttttacttttttttttatattttaatttattattattatttttttgagacacagtttcactctgttgcccaggctggagttcattggtgccatcttggctcactgcaacctccgcctcccgggttcaagtgattctcatgcttcagcctcccaagtagctgggattacaggtgcacaccaccacgcctggctaatttttgtattattagtagagatgggggttttaccatgttggccaggctggtcttgaactcctgacctcaagtgatctgcccacctcagcctccccagtgcttggattacaggcttgagccactgcccctggcctacaactaggtaattaagaaattaattttctgaacatgctgtactagtattaaatatatttctataatgaagaacttttttgtaaactatgtcagctttataagttctgagtttttgtatatcaatttatgatagcttttgtttttgtttttttgtttaaaggagaaacagtaattgatgtgtaaatgggtaatatatggggaagctaggagatatgctttattgtgatttaagtgactaatttttttaaaaagacaaaataggctggcccacaatcccaccattttgggaggctgaggcaggagaattgcttgaggatttgagttcaagcccagactgggcaacatagcaaaaccccatctctaccaaaaatttaaaaaactagacaggtgcatgcttgtagtcccagctactcaggaggctgaggcagggggatcccttgagcacaggagtttgagactgcagtgagctatggttgtggcactgcactccagcctgggtgacagagtatataacaaagctgggcatggtggctaacacttttaattccagcactttggagactgaggcaggaggatcccttgaaacaaggagttcaagaccagcctggacaacatagcaagactgtttctacaacaaaatttaaaaaaaaattaggcgtggtggcatgctcctatagtaccagctcttagaaggctgaggagggaggatcgcctcaacccaggaggtcaaggctgcagtgagccgtgattgtgccagtgcacactagcctgggcaacatagtgagaccctgtctctaaaaaataaaaataaaaaaatttttaaaaataattaaaaaggacaaaatagtatacatctattgtgttaaagaattaaaaggatttgtagttgtttttgcacaggaaaatattaatagcagttaactttgggcagtgacattgggagatggagacatgctttcataactaaattttatgtggtaagtagcagagaattaaagaggaaaacaatggctaaagaaaataaaaatagaaacaaatgtgtatgtgaggcaattacaagcgtacttggtttatatgagtgaattcagacaccatttacttggttctaatatggcccatggaaactgtactgaaatagaatttaagatgttttgttcagttcttgtttcattattaatgtttgtttacctactttatattcacagggatgtgcatgcagtctgtctttgggatgataaaggcccagcaaaaattcatcaggctttaaaagaagatattcttgagtttattaagcaagcacaggcagtaagttctacatgcttattttagacttgttttaaaactactcagataatatcatattttattattttgaaagtagaacttcttgaagtaatttcaaaatattgcattgacttttgacacatttgttaaataaatttattaatgaaatgatcgtcattagttggattatttttttcccacagtgatacttctgtcaagagagtacatattatatttaattaaaagatgctatagcgaattcagttttttatattttttgggagtccccaccaccattattttttggctacacatcagtccacacagatctttttttttctctcatgactaatacctcttctcaagttgacagtaatttcttcaattccagatccttctccaattgtaatttatttagactgtcctttgtattgctgttgctgagctgaaattcagcactcttacattgctgttatgtataaatcaaaaattttgatcaaaaatcaaaagctcatttaggcattagatcagtaatgcaagagttagttttgttttgttttttttctgtgacaccttgtaatgttgtttcaaatcagccacggcctctcttatgaataaatcccttatcattttgaggaggaccctaaggacgtgagattattttcctttctataacatgaggtctgggacagggcacagtagctcaggcctgtaatcccagcactttgggaggctgaggcaggcaaattgcttgagtcaaagagtttgataccagcctgggaaacatggtgagaccttgcctctatacaaaataaaaaattacccaagcatgatggtgcacacctgtggttgcagccactcgagaggctgaggcaggagaattgtgtgagcctggaagattgaggctgccgtgagccgtgatcatgccattgcactcagcttgggcagcagagtgagaccctgtctcaaaaaaaggcaaaaaaacaaaaaggtctggtctgatggctagaaggctaggctagaatttcttattttttagttggatcattccattaatgtcttgtacaacattagtaaaagttgtttgttaaatcgtgttattaaatactaaaaggtgcttagcagttgaaaattaaaactgagttttttctatgtatgacttaagatattgaaatcaagtatatgattggcatatattttaattttgctagtagccactaccatgatggagtaagactaatctattggatattacttaagaaattaagtgttttattgatagtttcttgacaaattttttaaattgtagttttataggaagttatcttttaatgaaaatctgttttcaagcacttagaaaattaaatgtttcagtatcaatttaaaactattttcttagaactaatttagagatacagtttctacttgcattgggaaatgtaccacgttttctttttatgacttgataaagataaattatgtttatttcagatagatagagctttattcttcagtttctggaaataaacttatgaagaattaccttggatgttcttaacagatgttaaaaaatatgctgaacactggcaaaaaaaagtaggggagggtttcacggtaacatgactgaataaagtctggaaatgtagacctcagcaagaacccaagaatgggatttagcaccactaattctgagcagttaataggagtagcaatgccagacatgggtcttaaaaagacccatcttaaaaagatttttaaacgcttaagaaatttttttttttttttcatgaatcattttacttaggcaatcttcagttgaacataccttgttaggaaggaccaaatctcccagatggttgaaaggcaatatgcattgaaatgtttataacattttttaaagaacaaaaaaaaaagtaaaaataataaacataggtggagtcttttttgtttaacctagattaacacaactgttttatttgttcacaattctgtggcttagcaatttgggctggtctcagctgaatttgcctaagcttattaatgcagcagcagtgggctgttggacatggtggtctaagagagcattaaaactcatatatggtttttgatgtggctttcttttcactgtgtggtttgtcattctcaaggagaccagcctttgagatgaaagtggaatctacaatacctattcatggatagactgagaaatctttcactgttacatcggtggcattctgttggtcaaagtaaatcacaggaccagcccaaactctaatagtggggaaatagactccaccacctttttttttttttttttttgaggtggattctcactttgtcgcccaggctgcagtgcagtagcgcgatctcggctcactacaacctccgcctcctggattcaagcgattctcctgcctcagcctcccgagcagctgagattacaggcgcatgccaccatgcctggctaatttttgtatttttagtagagatggggtttcaccatgttggtcaagctggtctcaaactcatgacctcgtgatctgcccgccttagcctcccaaagtgctgggattacaggcatgagccaccgcacctgccgtgactccaccaccttttaaaaacttgagatataattaatataccataaaatttactctcttaaaggatatgattcagtgggttgtagtatatttcataaaattgtgcaaccatcacccaataatcccagaatattttcatcaccctaaaaagaaatcctatacctatgaacagtcactcccttctcccaacccactaaatcactaatctgttgtccctatggatatgtctatatttgacattttctgtaattggaatcataatatgtggccttttgtgactagttttctttcacaatatttgtttctctttatggctgaataatatctattgtttggatataccatatattgtggggttttttggtttcttttttcatttgtttagttttttttcaagccagggtattgctctgtcgcccaggccagagtgcagtggtgcaatcatggctcactgtagcctcaactgctggggctcaagcaatcctcccacctcaacctcctaagtagctgggaccacaggcacgcaccaacacacccagctaattttttgtattatttgtggagatgaggtcttgctatgttgcccaggttggtctcaaattcctgagctcaagcaatcctcccgcctcagcctcccaaagtgctgggactactgtatgagccaccacgcctggcccatatattgtttatccgtatttcagctaatggatatttgggttgtttctattttttatctattttgaataatgctgctgtgaacattcgtgtacaagtttttttgtgaacatgttttaatttcttttggatataagagcttgtacaataatttaaaaattatgtacaatttaaattttggcatgaatatgttcttaatttttcaaagcaactgcatttatttcaaattggtacacctctttttttcagcgagtactgagccatcaagatgatacggctttgctaaaagcatatattgttgaatggcgaaagttctttacacaatgtgatattttaccaaaacctttttgtcaactagagattactttaatgggtaaacagggcagcaataaaaaatcaaatgtggaagacagtattgttcgaaaggtaagactatttttctccttgttttcctaatattcttcagaaagagggtaatttggaagcatttgaaagtaatttgaacttttaagtgggtttttctacttcacatgtcaattgcttttcagctcttaactagattttattgaataatattcttttttgtctttagcttcaatcttctttcatctttttatgtggtcttaagctatagatctgcatcttcaaccattatctcctttacttttcctttttactttctccttctcctggtattcagtattttatttctctattctttctttgtactctttttttttttttaaactggagtgtcactctgtcgcctaggctggagtgtgcagtggcgcagtctgctcactgcaacctccgcctcctgtgttcaagcaattctcctgcctcagcctcctgagtagctgggactacaggcacgtgctaccacacccggctattttattgtatttttagtggagaccaggtttcaccatgttggccaggctcgtctcgaactcctgacctcaggtgatctgcctgcctcagcctccgaaactgttggaattacaggcgtgagccactgcacccaacctatacccttactagaaattaaattacttttctccctgtctcaaaaatccccttttattaggttaccttctgatatctttatgtttaattgtggctaaactgctatctttataatttcccttttacttaactcttctattataaattcagtatatactgtgcttattttctatttaaaaattgtgtcaagtaaccagtcatgatttaatggaaagaactcagtgctgaatatgaagggtcctaggtttccctttcagctcttcaaactccgtcctcattttccatatatctttccacttgtaagaataaaatgggaccgtagatttgaaaagtaaaaaatgccatttgaactttagtcaatttactgtttactgtgatggttacagtaaaacactcaggcattacaatagtgtaacctgggcattgttgccccatcccagccttaaaatttgatctgatgttgacagggatactgtaaatttagatacccagtggttcttcagtgatagaaatcactgcaatatgggaaatttgtgccaagggaaaaaaaaaagtgaaaaacacttctggctgcgatttaatttgtagtctcataatcttgtcctctttttttggccattctattggttgtgggaagcagcatccacttagtgattaagtgtatcaattctggggccacagtttttggattcaaatctcagtgttgccactgatgaggtgcataaatgtggaaagttagctttgctatctgtaccccaggtttcacatatctaaaggggggataatcatagtacctatatcaagattatgaggattaaatgagttacatgcagacaatacatagagcagtcccaggtatagaatgagtgttataaaactgttaactcttgttgttattgttgctgtcattaatgtatctcctacatctgaccaagtttcttggagtactgatataatcaccaatgtttatataccatttttatcattttaatggaacatctaaacagtagatttgcagaccttttataaggtccagtatcagattttcagttggtcctttttacattttttatgtgtctttacaaacatatgcatatgtctatttcaaacacaccaatatatctgaaattcaaccatggaactataggagaataaacattttccatgtattatcatagttaatttttacaaccactgaaatttgcactattattttgaccattttatacataagaaagcagataaataagtaacagctgggattcaaatccagttggattctgaaacacttgttctttatttacttttgttttgtttgaaatgggctcttgctgtgttgcccaggctagagtggaatagtgtgatcttggcttgctgcagccttgccctcctggacttaagtgatcctcccacctcagcctcccaagtagctgggactacaggcacatgccagcatgcctagcaaatttttgtattttttgttgttgttgagatgggtcttactgtgttgccgaggctggtctcaaactcctggcctcaagtgatcctcccaccttggcctcccaaggttttgggattagaccacgcgcagtcgacccttctttaccattatgctaaatatactgcttccccgaagtattcaagtgaatgcaacctaagttattttgagacagggtcttactctgtcacccaggctggagggcagtggcgtggtctcggctcactgggactacaggcgtgcaccaccacactgggctattttttttgtatttttttgtagagacaggattttgccctgctgcccaggctggtcttgaactcatagactccagcgatccacctgcctcggcctcccaaattgttgggactacaggcgtgagccactgcacctggcccaggcctacaaatttgatttccttttttggtgtttgtacatgatactttgtatattaataattgaaaattatgttacaatttgttcttgttttcctagcttatgcttgatacatggaatgagtcaatcttttcaaacataaaaaacagactccaagatagtgcaatgaagctggtacatgctgagagattgggagaagcttttgattctcagctggttattggagtaagagaatcctatggtatgttctgaacttttatgatcataatttctgtttcatggaaattgtagaacaattatggaatagcacaatcaaagttaagtttattggcatacaaagttacatctactttttgtactagatactttttttgagagtaagcaaatgataattctgcttaaaagaatgtataaaaattcatattaatgtggttaatattttcttcatgccattaatttcttggcaagtcgttttagtgaactaaattagatatataaatttgaatgtgtagctcataaaaggtaactagttcattaaaaggttaggtatttatgttttcaggaagtaagttacttccatgaaaaggagagcatgtaggagtacattctctcttacttctaatttgtttcctgtgacttagagtatgcttcttccccacgcttcatcctcctcctggaggcctttcttaattcccagagtaagttaacttctctcatttagtgcttcacagtacctgtgcctccttggcatagtacttttgtttaattgtgttgttagcaccatgtctttactgaacatagaatgcatggcacaaaatcactctaggtaggtatttattgagttaatgaacctatagagttacttttgactggcttttcttcatggcccccatattcttttagttatcaagcctttagattttcattagcagtgctcctgaaatttgtttttaattgaactgccaccagacattaaacttcacatgcagagttttgaaatagtcgtcttataatcatcttattgctgttgtttaacccatatggtgttcataagattaatgtttaagcactattttattggtattttttctacttaccccttaagtggtataccatgctttttttttttttttttaagagatggggttttgctctgttgcccaagctggagtgcagtggcgtgatcatggctcattgagcctccacctctcaggcttaagcagtcctcctatctcagtgtcctgagtagctgggactgcaggcatgcaccaccacacctggctaatttgtttctttttttttctttttttgagacagagtctcactctgtcacccaggctgaagtgcagtggcatgctcgctgcaacctccacttcccaagttcaagcaattttcatacctcagcctccagaatagctgagattacaggtgtgtgccatcactcccagctaatgtttgtatttttagtagagacggggttttgccatagtggccaggctggtcttgaactcctgacctcaagtaatctgcccaccttggcctcccgcagtgctgggattacaagtgtgagccattgtgtgcaggcttaatttttctgtagacacatgattttactatgttgcccagggcatcttcacaaccatttgtaatttaccattctaccttaccttctattaaccttgcaatccacttagacaacctagtcatattttcttgtgcttttctgcttctgaatatttacttaccttactaatctccgtttatgcaaattctagtttattctttaagattcagtttaaatcccattgcttctgtgaatgttttcttgattattcagttagaagtcagtttcttacctatgcaaaaatagtctatattatctgtattatttatttgttactttactgctttatgctgttatctttataagtttcttatggagaaggattttgtcttatataattatatgttctcttgagcattgttaccttgcacataatgactcctcaatatttatttcatttattatactcaaaatactgattttgatcataattggagtaatactttattttctgtttttcagttaacctttgttctaatcctgaggataaacttcaaatttatagggacaattttgagaaggcatacttggattcaacagagagattttatagaacacaagcaccctcgtatttacaacaaaatggtgtacagaattatatgaaatatgtaagttagaacttagtatatgtgataatttgagcaattcccttgatattcttaaaatgattgctattttgcttctggacaggcagatgctaaattaaaagaagaagaaaaacgagcactacgttatttagaaacaagacgagaatgtaactccgttgaagcagtaagtaattttgtaattgtacattttatgggattatttgaaatacggaagcataggaatggcaaataaacaacataaataatattatttaacaaccaacattgttaattgattttagttctttttgcctatgagccatagcacaactttgtaggaggtatcttgtttagaacacattgtcctttggagctggtatgcaagatcaaatctatttgccatacctgttctagactttatttaatataattaatttttggtaagttttcttttattatgttttatgcatatctaaagttagccattttgtgattttcatgttgcaagtaatatatgctcccttagggatacagttgactctctttttttgtaccggttatgttctctgaagtggctgcaaacaccaaattagtgaataatgaatcatttattcctaggggatatttcttctccttctgggaagatgtttcaaacttcatttgtcatgaggtaaaaatattaattattattatttttagaaacaaagtcttgctctgttgcctagggtggagtgcagtggtgcaattatacctcactgtaactcctgggcataagggcccctcctgcctcagcctcctaagtagctgggactacaggcacacgtcaccctgcctgactaataaatatatatatatatatactttatcttttttttttgagacaagggctctctctgttgcccaggctggagtgcagtggtgcaatctcggctcactgcaacctctgcctctcaggctcaagcagttctcctgcctcagcctcccaagtagctgggactacaagcgcatgccaccatgcctggctaatttttttatttttagtagagatggggtttcaccttgctgcccaggctgatcttgaacgcctaagctcaggtgatccacctgccttggcctcccagagtgttgggattacaggcgtgagccactgcacccggccacctggctaatttttttattttatttttcatagagagcaggtcttgctatgtagcccaggctggttttgaactcctggcctcaagcaatccttcttgctcagcctcccaaaatgctgggattatgggcatgagccacaatacctggcctcaaaatattaaaaaacaaaaaactagtcagtgacagtaccatggtaggtgttttcttttacgtggaggactgaccttagggtgcttcagtataaggaaagttagaatctagttgggacagtcttggaattgttgaaacacaacaatagtatttcctctggttcctttcagtctttggagccttgatttagatttgcattctcaggaataacattctagcttgcccataatcaaatatttttcaactctgaatgggatttaaaatttttttttacttttgacttttctttggctttgtccatcttaagtggtagtcgtgtttattttattctttgttcagaaatcacaccgagttggatgtcttttccctttggttcttttagtttttgttttgcttgtccttgatttgcagtatgtatcctctttggttgaaatagttttgatattggcaaaaggaaggataatttagtggttatttatagaagttctttatagtgatataaattcaggtttgggctacattcagaaggccgggaaggctgttgactttttttttaaacaggtgggccacagagttgtcccttaggaagattaatctggtgacaggaaagatggaagactggaatggggaggagctgggaataagaagtagaaagcatttgcagtaattcaggcaaggtattaggcagaccaagtagagttacagaagtgggaatggaaaagacaagggaagagagaaacttcttagaggtggaacattgtatcacatggatggggctagatatcacagagaatcaagccaataatgttctgaggtttcagccaaggagaactgtgctgctactgagagattaggtataaaaataagtcttagtgagggagaaaggatgagttcattttggaggatttgggtatttgttgtagattgacgtacatttagcacctggatgggaatgttacagttttataaggtgaaattgttctgatctcctactgcaatttgtatgttagtcatatcatagccacattaaacttatgaactttcaactgtaaaaggccaactaaaagaataagtccagagtagctgggactacaggtacgtgccactacacctggctaattttttattttttgagatcacgtctcactatgttggtaaggcttgtctcaaactcctgggctcgagcagttctcccacctcgacctcccagagtgctaggattacaggcacgagccacggcacttggcagtaacggtcaaaagtttgaaatgaaataggatatttgcatagtttcaaagtatcgtccccaagatatttactaaaggagaagcctgaagacaccatcttaattaagtgatcaaggtgaacatcaccagtagtaggacatgctgacataccccgtgatatgatgcactaagaagaatacaatattatttctgttttactcttgccaaaaatgtgtaatcttactgtaataatgaggaaagattaaacaatcgcaaattgatagcctacaaaatgactaatattcttcaaggtgtcaagactgtaacagactgaaggacaaaggaactgccacagattgtatgagagtaggagaaattacaactatatgcaacatgggcttgtggataggatcctggaataggagaaggatattagtggaaaaactggtgaaatgaataagacctagagttaaattgatagtatcgtaccaatactattttcctggttttgatagttgtactatagttatgtaagatgttaatgttgggagaagtgaggtgctatttttctgctaacttttctgtaatcattaatcaaagaagttgaaaaaataaagaatattggctgggtgcagtggctcacgcctgtaatcccagcactttgggaggccaaggcaggcagatcatgtggtcaggagttcaagaccagcctgacctacatggtgaaaccctgtctctactaaaaatacaaaaattagccggacgtggtggcgtgcacctgtaatcccagctactcaggaggctgaggcaggagaatctcttgaacctgggaggcagaggttgcagtgagccgagattgcgccaccacactccagcctgggcgatagagcaagactctgtctcaaaaaaaaaaaaaaaaagaatattatgaagagtgccttttttttttttttttttttggaacatagccctgatgtgtcacccaggctagagtgcagtagtgccagtctccgctcactgcaacctctgcttcccaggttcatgtgattctcatgcctcagcctcccgagtagctgggactacaggtgcccaccaccacacccggctaattttttgtatttttagtagagacagggtttcaccgtgttagccaggatggtcttgatctcctgacttcgtgatctgcccgcggcggcctcccaaagtgctgggattacagacgtgagcccctgcacccggccaaaagtgatttttttttttttaaatgaagtaagagtaatactatagagtgtattggtggtggtaatgcttctcctgctgcttttactttatggaatatggtcagaaaagatctctgagggaatgatattggagttaagacctgaatgatagggaactagccttgtgaagatctgagacagttaagtgttgcattagatgtctgaagccctactcttacagttttatttttacttataggagagccacttagaccctacttagatctgattttacatacaattctaataagcttgattatcactcgctgggcctatagcagatgaacagaaatgtattgaatgtatttaatgtaaaacaaggtaagaggcttccgagctgtgctgctgaacaggcatgttgacagcaaaaagtaacacaaccataagaaaagagcaagaaaaaaaattaagccaaatgccttttgtgttttaagaggcagagtctcgctatgttgcccaggctggagtgcagtggctgttcacaggtttgatcatagtgcactgcattctcgaattcctggccttcagcagtcttcccacctcagcctcctgagttgctgggacagtaggcgcatgcaaccacacccagctttaagccaaaatgacttaaaatttgtgtttggtttttagtttttaggtgatagtcctgcataccttagtatttcctggggaaattcaattagtatttattatatacccacagtgtgtcaggcattatgctagttggggataataagatagacctagtccctatcctcaggatgacactagaataaaatggattgtttatacaatagaggaatagaaaagtgaattggtagtgtaagtcttgatcacttcagaatgaccagggcaccgatagggagggagtgtattacagtggttagggtcatacatgttggaattagatgaggatttgaatcccacagatgttattttaccagctgtctgcgttttggcaagttattcaacctttgtagtctctcttttcctaactataaaatggaataggccgggcgcggtggctcacgcctgcaatcccagcacttagggaggccgagatgggtggatcatgaggtcaggagttcaagaccagcctggccaacacggtgaaaccctgtctctactaaaaaaaaaatacaaaaaaattagttgggcgtggtggcacgcacctgtaatctcagctactcgggaggctgaggcaggagaatcgcttgaacccaggaggcggaggttgcagtaaggagagatcacaccattgcgctccagcctgggtgacagagcgagactctgtctaaaaaaaaaaaaaaaattgaataatacccttttgtattagcagaattaaatgaaatatgttacattaagcatttgagcactgtgcctggcatgatagcttttactgttaggcactggttcagagaaaactgcttactaattctaagacaagtaaaaactattttaccatctgtgcaaaactgatttaaaaagctgaataagcaactaggtcacaagttataaattattaacattaaaataagcacttattaaccttcagtattttggtatttcaggcatggtatcctctccacagaggaggtctaaaattaaaaaaaaaaattaagcttggtgttcaaaaagacaaggtgatccagacttttgtagtgccactaatgatagtagtacagaaagaatcttagtcaaactagaaaggccaggaaattaattattgaatacattacagatatccttgtatggttaagggcctgataatgatagagtagaatcataaagtgggggaacttaagataatttttagttcaactcttacgttgtagctgaggcaaagcaaactattccttatacagagctatataactaatgaaaatcagaaatgcttttttttttaaacgaaatttgagcgaggtagaaataattatgcaaattgaataccactaaaagaagaatctggctggatgccgtggcccacgcctctaatcccagcactttaggaggccgaggcgggtggatcacctgaggtcaggagttcaagaccagcctggctaacatggtaaagccctgtttctactaaaaatacaaaaaattacccgggcatggtggtgcgtgcctgtaatctcagctactcgggaggctgaggcaggagaatcgcttgaacccgggaggcggaggttgcagtgagatcgcgccattgcactccagcttgggcaacgagtgaaactgtctcaaaaaaaaaaagaataagaatctaccatgtctcgtagcctacctgtctcacctttcattttccagacctatgaattcattcattcaacaggtacttattggagtgcctgctgtgttttatagcaggcattatttttgaagagtttatagtcttgctgtagaggaggttaaaacatcaagcacattgatagttaaagtgtttcaccttgcagacctctggggagagattgctatggatttagaagttgtgctcatctcaggcaaacatacaggagttgatggcatatggcaaaaagtttttttcttcacggaatctagcaaaaggagacagaaagggaatacaaggtgagagagatggcttatcactatactttccattcaagatgtattttcaaataacaagttatatatttaggatcaactatgtatatagtaatttggtaaatgggaagaaatacaaaagaggaataacatgatctctgtcctcaagaaactgactctcttaggacaagactcatttgaaataaggagagaattctatctagcaatctccctactttttgcctaggtaaaataattttctggaggattttttaatatatagaaatctataccataattgttctcttcattttttaaaaaagctttgtaatgaaagttttaaaatatttacacaagtagagaaaatactataatgaacgctacccccatacccagtcttccagattcaacagttatcattattttgtcatgcttgttttgttgatccttctgtttgttttcctttcttttccattccttcctctctatttccctccccgttttgcctcccttccctcctgcattcctatatttaaaaataaatttatgatgttgctcatttttactccacacacattgtattagtccattttcacactgctataaagataactacctgagactgagtaatttgtaaaggaaagaggtttagttgaaccagttccacatggcctgggagtcctcaggaaacttaaaatcatggcagaaggcaaaggggaggcaaggcacatcttatgtggcagcaggagagagagagagagagagagaatgtgcaggagaaactgccacttttaaaaccatcagattttgagaattccctgtcacaagaacagcatgggggaaaccttgctgatccaatcacctcccaccaggtccctgtctcaacacgtgggaattacaattcgagatgaaatttggctggggatacagagccaaagcatatcacaatctatattataatgtaacctatatgcactgtagtattactaaccagttctctaatgatgaccattttcattgtttatagtttatttcttataaatagtgctttctggaatatccttaaatacctctatctttttaacatccttgtgtatacatcttttctcacacttggcttcctcttggaatagaatctcctggaaattagatagctgaggtaaaagtccctgaaccttttacaaattgctacacaataaataccaaactgactttcaggaatgtagtcccatcaacagtgtgcttgtttatccatatcgttgctgatctgagttttgtcagtctattgattcctaccaatctgccagtatcatagattttaaaatattttttgtgtgcatttaaaaattaatgaatattaataattgtaaatattaaatataattataaatatataaaattataaataattaaatatttattttataaatataaaatattttgtgcatacatacatggtgtatgtagttgtatgtatttatgggttacatgagacattttgatacaggcatgcaacgcatgataatcacatcagggcaaatggtatcaatcacctcaggcatttatcctttgtgttacagacaatccaattatattcttttattatttttaaacataaaattaaattattttttactgtagtcaccctgttatgttatcaaatactatgttttattcattctgtttttgtttttgtttttgttttgttttgagacggagttttgctcttgttgcccacccaggctggagtgctgtggcgggatctcagctcaccgcaacctccgcctcctgggttcaagtgattcttctgcctcagcctcccaagtagctgggattacaggcatgcaccaccacgcccggctaattttgtatttttagtagagatggggtttctccatgttggtcaggctggtctcgaactcctgacctcaggcaatccacctggctcagcctcccaaagtgctgggattacaggtgtgagccactgcacccgactattcattctggtttttttgtacccattaaccatccctatttctcccccaccacctcactaccctacccagcatctggcaactatcctttactctctatttccatgagttcaattgttttaatttttagcttccacaaatgagtgagatcgtgtgaagttcgtctttctgttcctggcttatttcacctaacacagtgttctccagtttcatccatgttgttgcaaatggcaggatctcattctttttttatggctgaatagtactccattgtgtttatgtacattttcattatccattcatttgttggtggacagtaaggttccttccaaatcttgattataagtagtgctgcaatacatgtatacatatgtaacaaacctgcacgttgtgcacatgtaccctaaaacttaaagtataataataataaaatttaatgttaattttataataataataaaatttaaagtataatgataataaaatttaataaataataaaattaataaaattaaaaaaaataaataaataaatagtgctgcagtaaacgtggaagtgcatctatctcttcctttcttcctatgctcatttccattctttttggtatatagccagcagtgggattgctggatcataaggtagctctgtattagttttttgaggaacctccaaactgctccatagtgcttgtactaatattacattcccaccatcattatacgagggttcctttttctacacattctcaccaatatttgttattgcctgtcttatagataaaagctactttaactgggatgagatgatgtctcgttgtaggtaatatcatctgcaaacaagcgtagtttgacatcttcctttccaatttggatgctctttctttctcttgtctgattcctctaactacaacttccagtattattttgaataaaagtggtgacagtgggcatccttgtcatgtttgagatcttagaagaaagatttttagtttttctccattcagtatgatactagctacgggtctctcatgtggcttttattatgttgaggtatgttcgttctatacccagtgttttgatggtttgtatcatgcaggaatgttgaattttatcagatgctttttcagcatcaattgaaatgaacatacggattttgtctgccattctgttgatgtgatgtatcatttgatcaatttgtgtatgttgaaccatccttgcatccacggataaatcccacttggtcatgatgaatgatttctttaaggtgttggtaaatttggtttgctagtctgggctcagtggctcacgcctgtaatcccagcacattaggaggccaaggcaggtggatcacttgaggtcagaagtttgagaccagcctggccaacatggtgaaaccccatctctactaaaaaaaatacaaaaattagcgggcgaggtgtcaggtgcccgtaatcccagctactcgggaggctaaggcaggagagttgcttgaacttgggaggtggagcttgcagtgagccaagatcatgccactgcattgcagcctgggcaacagagtgatactctgtctcaaaaaacaaaaacaaaacaaaacaaaaatttggtttgctagtattttgttgaggatttttgcatcaatattcatcagtgatattggcctgtagttttctttttaaaatgtgtctttgtctgcttttggtattagggcaatactggcctcatagaatgagtttggaagtattccctcctcctctatttttcagacagtttgagtagaattgatattagttctacttgaaatatttggtaggattcagcagtgaagccatcaggtgccaggcttttctttgttgggagaaattttatttcattttatttatttaattaattaattaatttttttttgagacggagtcttgctctgtcacccaggctggagtgcagtggcatgatctcggctcactgcaagctccgcctcctgggttcacaccattttcctgcctcagcctcccaagtagctgggactacaggcgcccgccaccacacccggctaattttttgtatttttagtagagatggggtttcaccatgttagccaggatggtctctctcctgacctcatgatctgcccacctctgcctggcaaagtgctgggattacaggcatgagccactgcacctgttgggagaaattttattatggcttctatctcattatttgttattgcttgcctagaagttacagtccttgtggcctagactgcctttcaagtttatttggagccccagagtactttagcttatagtgcgaggcttgctagaactcaagtccttaccactggaatgggcgattcccctctgtctagggctggtctaaatgctccctccatgggcatgtgtcagctgagttcatcctacttttgctttctgctgtgaaagggtggtggtgagttcaatgcagtatctcacagttgctgctctctccctctcccaagcacacagattctccatgccatacagctgctgctgggggatgagggaggggtaacattggcgattcaagactatctttcctaccctcttcagtgcctcttgcagtgacatgaagttaaaaccaggtactatgagtgcccacctgatttttggttcttatgaaggtgtttttttgtgtgtagatagttgttaaatttggtgttcctgcaggaggaatgatcggtggaagcttctatttggccatcttgctccactcctctattttttattattttttttagaaacagggtctcactatgttgtccagcctggtctgcatatttattcttattcctgaccatttgtatttattcttttgtgaattcaggataatctttcataaacatcacttttattgttttacttttctattcaaaaactagagtactggctggccgtggtggctcacgcctctaatcccagcactttgggaggctgaggcaggcagatcacaaggtcaggagatcaagaccatcctggctaacacggtgaaaccctgtttctactaaaaatacaaaaacaaacttagccaggcgtggtggtggatgcctgctgtcccagtactcaggaggctgaggcgggagaaatggtgtgaacccaggaggcagagcttgcagtgagccaagatcacgccactgcactccagcctgggcgacagagcgagactctgtctcaaaaaaaaaaccagagtatcattatttcatacccctgatttttaagacccttcataatttgaccctaacctatttttctaacttaatattgtccagcaagagtcactctactccaataagaaatatttttttattcatacaactcactctgttacttttttttttggattcattttagcagtgttttcttctgcctacccaaaatcttgcaaggattcttttaactcaccttgtaataaaattgtaataaagtagctcagatcatctagccttcatcagtttcttcctatttgaattcccgtggtaactattgtttctaccactaggtttaggagcaaattatagactgccttgtatttcttatcaagcaccagctgtgtgccaggacacagcacagtctttatagctgtggacagagcacaatctttgtccttaagtttatagtatagtaatgatgcattttccagttatttgcttattagtgaagatcttcttttcatacacatctgtacatatgaaccatacacatgtttttaggtatatagtttatgggtttccaactggattgtaagatcattgagggcatgaaccatgtttatacttctctattccttaaaacacgtaactcagttctgagcatgtagccatcactaagtatgtacatgctctacttctgtagtaagaaaagttggaggctatggagatacatacctggcctcaaattataactcaagaccttatgaaccaactgtgcaacatttggaagttatgtggctactctcagtctatgtcctcataaagtaagtatctgcctcatgaggttgccatgtgggttaaatgagatctatatgtaaagcatttagcataatgcctggtacaaagtaagtgcccattaaaggatacctgttataataatttgtttaacctctcaagctagaaatggattcaacatccttttatttccctaatccctttcatttaagcatttaccaaattcttctcagtttactttaattatgttgtcaatttagctctccttttaatcctcgttgtaacccaccataagaaatacattttatattgtggcttagaatatactgtttatttgtacatatctgaaacaaaagtcttatgaaataatattcattgttacaatatgtgatacactctgatattttttgttctgtcctatgtacattttttttttttttaaacctggtcacagccattaaaactgatttcacaacatacagtctgaaacacactggtctggatttttagaatctgcaaaatttcaactaccactgaacaggataatgttcaagtgaaagttttcaatgaaatagaaaacacagagcttagagtttattaggattccactttgtctttgttctctattagttatatattgttagatttacctatgctcaatctggtttcactgcttaaggtggaagtgtttagttgggcctattccagtgatgttatagaataagattactcagcagttggggcagagatttccaccttgcaaggaaagagtttcttaaccattttatatgtgtagtcttttctttatttttcttttttttttccttttttgagacggagttttgctcttgttgcccaggctggagtgcaatggcacgatctcggctcactgcaatctctgcctcccaggtttaagcaattctcctgcctcagcctcccgagtagctgggattacaggcacccaccatgcccggctaatttttagtagagatggggtttctctgtgttggtcaggctggtcttgaactcctgacctcaggtgatccgcccgccttagcctcccaaagtgctgggattataggctatgagccaccacgcccagccatgtgtattattttcttaggacagaaatatacatggatatatgcatttaaaagtcatcagcatcattcttgtagaggagcctgaaaaaacctttttttttgttttgttttgttttgttttgtgacagtcttgctctgtcgcccagactacactgcagtgacatgatcaaggcttactgcagccttgacctcctgagcttaactgaccctcccacctcagccccccaactcgcagggaccacagaaaattctttattcggaaaattttaagcatttttacaatgtaggaagaacagtataatgaatccccattacctaaattcagctttagtagttaccaacattatgtcaattccaaaggaatttttaataaaaaatttttaagggacacataattgcctcccttaatttacagatagatgatttgtttttcagaagaaatatatcagccttattgtacttaactttagtcctcacaacctattaatttcatctgatccccaaaagagaagtaaataattacatgacacgagggagcagagatgacatgatatcttctgcctcatttagattttcctgatggcctcctagagcactagacccttgctatcttacctgaaatagttcaacagcctcgttaccatatcccaaccacccactccttaccacctgccttactaccattatactgatctttaataatgacttgaggagaggagaatctcattacatttatcctctgtttaaaacttccttggggccaggcctgatggttcacacctgtaatcccacactttgggagactgacagggggatcatttgagaccaggagtttgtgaccagcctggggaacatagcaagacatcatctctacagaaaagtttaaaaaattaaccagacttgatagtacatccctgtagtcctagctactcaagaggctgaggcaggaggatcacttgagcctaggagttcaaggctgtagtgaggtatgatagtagctatgtagtaatgccactgtactccagcttgggcagcagagcaagactctgtctcttaaacaaacaaaaaaaccttcctttgttcttccttccctacctatgaaataaaaccccaaatcatagattttcattcataatctggttgcagcctatctttctagccttctcttccactgtctgtttcttctctaccattttaagcttcctggtattcctagaatacgtaacctattttagggcttgtacttactttacaggatcccatttagataccaacttgtggatgaggccattttaactaccctagaaaaaagtagtttctaagtttttttttattttgtgtgtgtttgtgtatgtgtgtgatgccacttaactgagttatatttagttagcagtgtaggtttactgccctcctcactctcaattagacagtgatctcttcgagagcaggaattatatcttattcttgtctcttaaatacttccttagtgcctgcacgtagtaggcatccaataatggtttgttgaatgaatgtattcacacttctagaattttataacctaattttaaaacaggttctctccagacaggaagagttaatcaaagtttggttttgtatatttttctctcccctccttgaggacttttgttaaaatttctaaagagagtctagttctatagtttttttccttaggggaaaatacactttggtaaactagtatagcatatccatcttcaataatcctatagttaaggtaagtgaaatctactttcagtataattttttttttgttgaacaatattgttttattttgtgagttagaatagatttgtgctatacagcttatagtagccttgactaatttttgatatatttcagctcatggaatgctgtgtaaatgccctggtgacatcatttaaagagactatcttagctgagtgccaaggcatgatcaagagaaatgaaactgaaagtaggtaaaacatcacataaagttatcataatcttctaagagggtatctttgaaacaaatcacttactaagttgctcttagttaattcttttccacataggtatatgtggaactgttagagtgaactatacttaaggaaatagataaaatatttaacacagaggcactgctaagagtatataaacttaaattttaagcattttccctcttagctatcaacatctgtgtatgtgtatggtgaatttctacttttttctcaaaagcaagacactgcttttaaaggccagtttaaactggaaacatatgttatagattagaaccaggtatttgacttttgtgtggaaccttgtgatgaatctttttagaatgtaataaaacactccctgttaatagtcatctctgtccccaaaaatactttataagatttctaaaggattttttttattacttcaatgttttcttaaaaagatgtgttttgagaggtagcaagtatataacaaactaaaaaaaaaaattgtacatatacctactaccccagtaaaactgcttttaacatttttttgcttttgttttttaaataacgtacttctactgagtttccaggttttattatatctaactgcaaggtcctgtttaatctctagttgcatttaaagtgcatatttcaattcacttaagttcatacactttttaggagtaattcagtagtaaaaagcaagctgctttattggcgtaaacaaaatacttgtattctgtgtgccagtctaattagagttatgtctgatctatgttgcactcttttcaaaaggatttatttagtggtaatcagtaccgtgaggtagggtttttgtgaaggtcaataaaatggcataacatgaaaaagtgctttgtaaattgaaaaattatttatgaatacagttttatattctaatctctaatatagttgctttcgtaattattactcatgttttttaccttttgatgatatggctgtatatgtagtattacaactaccttatgaaataaactaatcttgtgtgtaaataaatattcctttgcattgaaaaccaaatgactcaccttttcttttgagactgggtctcgctgtgttgcccaacctggaattcgatggcacgatcacaattcactgtagccttgacctcctgggctcaagcgatcctcccacctcccagcccactgagtagctgggactacagccgtgtaccaccatgcctggctaatttttgtattttttgtagaggcagagccccaccttgttgcccaggctgatctccactgcttctggccaaatgactgaccttttaaagaaaggagttgggttttgcagtatttgatcactttttttatttttattttttgagaccgtcttgccctgtcacccaggctgagtgcaatggtgcaatcacggctcactgcagcctcagcctcctgggcttaggcattcctcacacttcagcctcccaagtatctgggaccaaagacatgcaccaccacacccagctaattttgtttgtttgtttttgtgtaacgatgggttttgccatgttgccctgactggtctttttaactcctgggctcaaatgatcctcccaccttggcctcccaaagtgctggagttacaagcgtgaaccaccacacccagcctgatcacttttaattcgatttttttttaaacataatttttagactaagtacagtggctcatacctatgatcccagcactttgagagaccaaggcgagaggattgtgtgagccccgaagtttgagaccagcttgggcaacattgggagaccctgtctctacaaaattacaaaaaacattagccaggcatggtgacatgtgcctgtggtcccagctactcaggaggctgagatgggaggattgcttgcgcccaagaggtcaaggctgcagtgagccgtgatcgagccactgtactccagcttgggtgacagactgggaccctgtctcaaaaacaaaaaaacaacaacaaaaaaacgaacaactactcctaatggcattgtatccacagaatactattaacattacaaacttaactaatgtttctctaaactcttactctagtaaatgaaatgattacatgaatgtgttctctccttccagaattacatttaatgttttcattgatggacaaagttcctaatggtatagagccaatgttgaaagacttggaggaacatatcattagtgctggcctggcagatatggtagcagctgctgaaactattactactgtaagttttttttcaatggcaatgatagatatatatcaaggctattttttaaatgtaggattattgaaaatagtgagcggttaccagaggctgggggttgggggagcagaagaggttggttagtggggtataaagttatagttcaataggaagaataagttttggtgttctattacccattagggcggatatagcaagtaacaatgtagtgtatatttcaagatagaagagattttttatgttgttaccacaaagaaattataaatgtttgaagtgatggatatagtagttaccccaatttgatcattatagtatatacatgcattgaaatataacattgtaccccataatatgtaccattatgtgttgattacaaataaaaacattaaatttttaaaaatacagaattgaaaattgaaaatagtaattgaaattactattttctctgtaaaacagggagctgggcaaggtggctcacgcctgtaatcccagcactttgggaggccgaggtgggcagatcacaaggtcaggagatcgagactatcctggctaacatggtgaaacccctctctactaaaaatacaaaaaaaatagccaggcggggtggcgggcgcctatagtcccagctacttgggagggtgaggcaggagaatggcgtgaacccaggaagtggagcttgcagtgagccgagaaggtgccactgcactccagcctgggcgacagatcgagactccgtctcaaaaaaaaaaaaaggaagaaagaaaaaagaagtggcaaaacagtaatattggaacaccttttagttttatttttaagaaaaaatatccccagttttaaatgagttttattaaaattatgtttattttctcatttttttgtgttattctttttcttttaaaaacttaatgtaaaaccttttgtttctaggactctgagaaatacgttgagcagttacttacactatttaatagatttagtaaactcgtcaaagaagcttttcaagatgatccacgatttcttactgcaagagataaggtatatattcctatatatataaaaaacacttttaaaagttttattctcataatttacttctaataatcaatttgcattatttttctattaattataaacttaaaaacctagcaactgttatttttcatcagtggagaacaactatattcgttttgtcttggctgtaagcatttgttaaacattagatagccttgtgaattagaatttagttagaaagttgcttttttctcatttttccaagaatgtttttctgtttttgaatattactgatctattgaattcctattcatccttccattaagacccagctcaaagaatacttcccctggagcttccttgatgtcctgcctccctccacagctcatcaccagcagagttgattcctccatcctccgtcctttcatgggactccttcgggagttatgttatacttatccttgtttcccagggaagcatttgtattgcataccatctttttccatcctcactagtataggataatgataataaaacaccatactgtccttagcattgtatcttttttagtgtaataaacctataacaagaaattgctgttagttttttctcttctttgactacctttcgttacttcccaagtttgaatgattctaaaaagacaactttctccattctccagtaggatttttttctcactctttttgtctattttaatttttttttttttttttttttgagactgagtttcgctcttgttgcccaggcttgagtgcaatggcatgatcttggctcactgcaacttctgcctcccaggttcaagcgattctcctgcctcagcctctcgagtagctgggattacagggaccaaccaccatgcccggctaatttttgtatttttactacagacggggtttcactgtgttggccaggctggtctcgaactcctgacctcaggtgatgggcccgcctcggcctcccaaagtgctgggattacaggcctgagctactgtgcccagactctttttgtctattttaaaacaagtaaataggccaggtgcagtggctcacgcctgtaaccagcactttgggaggccagggcgggtggatcacctgaggtcgggagttcgagatcagcctgatcaacatggagaaaccccatctctactaaaaatacgaaaaattagctggacgtggtggtacatgcgtgtaattccagctacttaggagactgaggcaggagaattgcttgaacccaggaggtggaggttgtggtgagctgagatcgtgccattgcactccagcctgggcaacaagagcgaaactctgtctcaaaaaataaataaataaaaataaaacaaataagtaggtaaagtaggaaaggagttaagggagtatagacatggtgggcgtggtgtgaagtcttaaattgagtagcctgcaaaggcttcataggaagccagatcatgtaagactctgagccatgggaaggagttagtttttactgtgagtaggatgggaagtcatttaaaaattttaaacagaatggtagaatgtgatttatgtattaacaggatcattctggctgttgtaaaaaatatactgaagggaagaaggaagaaagaataccagttaagaacttatttaaataattcaattaagtgatgatggaggcttgtcccagagtgatggtagaggtggtcaaaagtagttcgataattttttttttttttaatgcaagtagcttatttgggaaatgcagggacgatagcgtggcgtattagtaagtcagatctacagtgagctacttgaacttaattctgcaaggaaacttatttaaaaccctgctcaaaattacctcacctatcaagtgttgagttcttgaagtttcctgcctgccacttgcataggcaacacatatttctgcagttttaggaaaaaacagctctttgggtgcatgtgcagatactaatagtgggaaaagtataagggatgtgggaaggtttgacagcatttgttacaccaggtatgtggcttggaattggaaaataaaaatgacagcaggctctagaagtgacttgtcagggaagttcgctgtgtcgcccagtctggagtgcagtggtgcaatcatagctgactgcagccttgaactcctgggctcaagcaatcctcccgcctcagccacctgagtttctgggactgtgagcacataccaccacacctggctaggtttttaaagtttttctatagagacaacatctagctatgttgtttgggctggtcttgaactcctgccttagccttccaaagttctgggattatagacgtgagccaccacccctggccccctttccctttaaatcatgttctttgagaactcttcacccgcactgatgttgtctcagccctgtcatctcactggtgaaggaaataaagatatccaccatctgacatagttactcattttcttgttttgttttgtttttgtggcaagagcacccaaagtctacttagcatgaatccaatatacagtataatttgaatttgttttgttttatttatttatttattttgagacagagtcttgctctgtcacccaggctggagagagtgcagtggcacaacatggctcactggagcttcgacccctctgggctcaggtgatcttcccacctcagcctcccgagtagctgggactacaggcatgcaccactatgtttggctaatttgtaattttttttgtagagatgagttctcagtatgttgcccaggctgttcttgaactcctgggctcaagcgatccatccaccacagcctcccaaagtgctgggattacaggcatgagccaccatgcccagcccagtataattttactacctatagttctcatgctgtacattagctctctagactttttccatcttgtgtgtctgctactttgtatcatgtcacctacatttccttgtttctttcccacccattttgccactggtactactctttcattcctctttctgtatatttgaattttttttaggttctacctataagtgagatcatgcagtatttttcttcctgtgtctggcttatttttaaggtcttccaggcttccgtcatatatatgtaccagtttctttatccattgatggacgctgaggttgtgtccatatttttgctattgttaataatgcagtgaatgtgggagtgcagttatctttgtgaagtggtgatttcatttcctttgggtatatgcctagaagagggattgctgggattatgattacattatgaagatagactattcaggatttgctattgaatcagaagtagaatgtgatagagactagtcagggatgacactcagattcgtgttctgatcaattagaaggatatgttcactgcgatagggaagactgtaagagaaatagtttttggagagatggttgcagagagatcagaaactcggtattgaataagttaactttgaaatatctgttaaacatccatatggtaatgttgagtctggagcttaagagaaagaatggagctggaaaaatatgtttggcagcttcagcatataagtggtttttaaagcactgacacaggctctaatcaccaaagtaatgattggagatagaaaagaggacagatccaaggattggcctagggcattctgatatttcattgttagaaaaatgaggagtcgtctttcatgagaagggagaaatgatccaagagaatgttatgtgctagaagacaagtgaaaaaagtactttcaggaggagggtgtgatccgctgtttttaaatgctgataataaataagatggagataaaccattgtcttcagcaacatggaggttgccagtgactttaacaagaacagttgtgtaggctgggtgtggtggcttacgcctgtaatccagcactttgagaggctgagacaggtggatcacttgaggtcaggagtcaacatgatgaaaccctgtctctattaaaaatacaaaaattagccaggcacggtggtgcgcacctgtaattccagctactcaggaggctgaggcaggagaatcgcttgaacccaggaggtggtggttgcagtgatctgagatcagcaccactgcactgcagcctgggcaacgagtgaaactctgtctccaaaaaaaaaaaaagaaaaaaaatctcacttgaggccaggcatggtggctcacccctgtaatcccagcactttgggagaccaaggcaggcagatcacctgaggtgaggagtttgagaccagcctggccaacatggtgaaactccgtctctactaaaaatacaaaagttagcctgatgtagtggtgggcacctataatcccagctacccaggaggccagctaagacaggagaatcacttgaacccaggaggcggaggttgcagtgagtggagatcatgccactgcactccagcctggtcgacagagtgagacttcatctcaaaaaaacaaaaccaaaccaacaacaacaaaaaaacctcacttgagaatattgataattataatatgacaaagaacttgctaaagtctttgactaggcaaattctgtttggccagatataccattagaaataaaaactaacatatttttatgtgttttgggatgtataaaaatttatctgtatattttcaatattaaaaatattttattccaaattattttttgcaggcgtataaagcagttgttaatgatgctaccatatttaaacttgaattacctttgaagcagaaggggtaagttttttaaaaccatactttaaaaatacttaaattttctttagtgtaataggggttaactaggtatacaaagtaccctgttaggtttatttttgttattgttagttttgtgacttttgcagcttttggctattaaagttcatttataattttttattaaattattttacaatacaaaaattgactttattttttcaggtaaaaaaaaaatattcctaatcttttaggatctctacttgtttttccctcattagtcactaaaagtattctattacccatagaagcagagaaaatgactcaatttaccataatgttataaaaagaactcagtttaaatgtaaattttcctattaccgttttaaaaaattgttctataattggtaagatgaatatgcctgtgctaagcctagcttatagaaaatctgacaactggaatctgagctagttatagcactttcagagtagtactaaatagcaataaaggttagttaaaaaaagtcttttgatgtgcttctagctaagaattaccattttaaagaaattttatatataatgctaaaatatttgaaaaatactgaaaaataacgtttcttaagaaggaaaaataatcaggtatttttcatttagtgttttcattttgtcttttctgagcagtgtatgttgcttgagtaatattacagtggaagacatctgagtcataccatattataatattgatatattttagaagggaatatgttctcttttataaactgtgaaatatgtgaaacatatagcactgcatcttggccatctcttcacatgagtagatagatcttcttctctttcaccctagcattttttgtattatttattaattttaatttatttatttattcgagacagggtctcactctgtcacccaggctggagtgcagtggtacgacctcagctcactgcaacctttacctcccggattcaagcaattcttctgcctcagcctcccgagtagctgggattacaggcacacaccaccatgcctggctaatttttttgtatttttaatggagacggggtttcgccatattggccaggctggtcttgaactcctgacctcaagtgatccgcccacctcagcctcccaaagtgctgggattacaggcgtgagccaccgcacccagtcccaagcattttttttaatgaaaatgttcaaacttacaatagagttactatggttgctttatcaaatatgttatctccttatatacattcgtcagtcaactttttaagtgtatttctaaagaagttgcaggcatcagtaacctttagtccctaaacacttcagcatacagtcatttattgaatttaatgtttatgtttttaggcaaaatttatatactgtcccatgcataaatcttaagtgtacatttgagtcagatttgacaaatgcctatacccctattaacatgtatgatgtctttatcatcgtacaaagttacttcatgtctattcccagtcggtcccaccccacctccttccagaggcatctgctgtcctgattaattccctcaatatagattagttttgcctaatctaggactttgtataaataggatcatacactgtgtacttcttgtgtaaagcttctttcattctgcattgtgtttttgaaattcttttatgttttggcatgtaacagtagtttgctttccaaagtggttattctcttttacacttccaccaatagagtatgagagtaccagctgaccctcattctcaccaatgtttagtgttcttttaactttagtcatttgggatgtatgtagtagtatcttaatgttttaattcccgtctccctcatgactcttgatgttgagcaatttttcatcttttttttttttttttccggtattcgtatattttcctttatgaagggtgatcatagctcactgcagcctccacctcctgggcttaagcagtcctcctggttcagcctcctgagtagctgggactataagcacacaccaccatactttactaatttcttttagagatgaggtcttgctgcgttgctcaggctggtgtcgaactcctggcctcaagagatgctcctgcctcagcctcccaaagtgttgagcttacaggcatgagctaccatgcccaggccttttgcccattttttttggttgtttgagacggggccttgctctatctccaggctggagtgcagtggtctgatcttgtcttactgcaacatccacctcgtgggttcaagtgattctcttgcctcagcctcctgagtagctgggactacaggtgtgtgccaccacgcccagctaatttttgtatttttagtagagatggagtttcaccatgttgaccaggatggtctcaatctcttgacctcgtgatttgcccgcctcggcatcccaaagtgctgggattacaggcatgagccaccatgcctggcccttttggccatttttaattggattctttctctttgttgttgagttgtaagagttctttatatattctggtactggatccgtatcagatagatgatgtgctaatattttctcccattctgtaagttgtcttttcattttcttgatactatcctttgatgcacaaaagcttttaattttgattaagttcagtttacctatttttttcttttgttgcttttgcttttggtttggtttcatatttagatcatgaagatttatcattatttatttatttatttatttatttatttatttatttgagagttttatagggccgggcacagtggctcacgcctgtaatcccagcactttgggaggccaaagcgggtggatcacttgaggtcaggagttcaagaccagcctggccaagatggtgaaaccctgtctctactaaaaatacaacaaattagccaggcgtggtggctcatgcctgtgatcccagctacttgggaggctgagacaggagaatcgtcagaatctgggaggtggaggtcgcagtgagccgagatcgtgccattacactccagcctgggtgacagagtgagacttcgtctcaacaacaacaacaagaaagagttttatagttttgacttttacatttaagtcattgatccattttgagttagcttttgtatatggtgtgagatacagctctaacttcatatttttgcatgtggatacccaattgttccagcattcattgaacagtcttttctccattatcaaaaatcggttggctgccaggcgtggtggctcacacctgtaatcccagcacttagggaggccgaggcgggcagatcacaaggtcaggagatcgagaccatcctggctaacatggtgaaaccctgtctctactaaaaatacaaaaaattagccaggcgtggtggcgggcacctgtagtcccagctactcgggaggctgaggcaggagaatggtgtgaacctgggaggcagagcttgcagtgagctgagatggcgctactgcactccagcctgggtgagagtgcgagtctccgtctcaagaaaaaaatcagttggctatgatgtatgtgtttatttttgaatgcttagttcagttctattggtttatatatttgtccttatgctggtgccacatcgttgtgatttactgtagccttgcgataagctttaaaagcaagatgtgtgcatgtttcaagttggttctttttcaagatcattctggctatttgggttcccttctaattccatatgaatttgagaatcagcttttccatttttgtgaaaaagacctttggaattttgataggaaatgcattgaattgtattaatgttatgtctcccaattatgaaaatggaatttctttttatttgttttttgtttttctttcagcagtgttttacagctttcagtgtacaagtcttccacattcttggttaaatttattccttggtattttctttggatgctgttgtaaattgaattgctcttccttcctccctctttcctttcttttccttccccttccccttccctccctttcccttccccttccttcttctctctttctttctgtttttttttttttaagacagggtccactgtgtcaccgaggctggagtgcagtggcgcaatcatggctcactgcagtgttgccctcctgagctcgagtaatcctcccacctcagccacctgagtagctaggaccacaggttcaggccaccacacctggctatattattttttgtagagacagtctctcactgtgttgaccaggctggtcttgaactcctgggctcaagtggttctcccaccttagcccctcaaagtgctaggattacgggcaggagctaccatgcccagcctggaattgttttcttaattttcttctggattgttccttgctggtgtataaaaacacaactgatttttttttctgtttcttttttttcagacagggtttcactctgtcacctaggctggaatgcaatggcatgatcacagctcactgcagccttcgcctcctgggctcaagcctccaccttctgagtacctgggactaagggccataccaccatgcccggctaatttttttttttgagacagggtcttgctgtgttgcccagtctggtcttgaattcctgggttcaagtgagcctcctgcctctgcctctcaaagtgccagaattacaggcatgagctaccatgcccaaccacaaataatttttatgtgttgattttgtactttgcagctttcctcagtttatttattggctcagataccttttttgtagattctttcagcttttctgtatataagatcatgacatctgcaaatagaaatacttttacttcttcctttccagtttggttctattttcttttctctgactaattgctctgaccggaacgtctactacagtaacaaatggcaggggtgaattcaggcatccttgtcttattcctgattttagggtgctcactcttagtcttttgccattatattgttttatgttggttttccataacctcactatgctgaatagcagtttggcactctgtctggtagatatactatagcttatttaactggtcctttactgctgcattaagtagtttccgatgtgttgctattactgttagtgctacagaggataatattgtacattgaatatttgtgaatctttatctacaagatagagtcccagaagtgaggattgctgggtttctcttagttttctgattctaaggtgactatgtcctacttttagctccacattaaagtagaacatttctaggctgggtgccatggctcatgcctgtcatctcagcactttggtaagccaaggtgggaggattgtttaaggccacgagtttaagaccagtcagggcaatgtagtgagacccatctctacaaaatgttttaaaaattagacgagcatgatggtgcgtgcctgtagtcctagctattcaggaggattgtttgaacccaggaggtcaaggctgcagtgagctatgatggcaccactgtactccagtctgggcaacagagtgataccctgtctcaaagtagaaaatttctgtggagtagagtaagtatcattagctgatccaggcagtagaataggtggtgtggctattggaggtgtggaggaggtgatgttctagaacaagcttgtccaaccctgcgggctgcatgcggcccaggacggctttgaacgtggcccaacacacacatttgtaaacttccgtaaaacattatgagattttttggcgattttttttctttagctcatcatctgtcattagtgttagtgtattttatgtatggcccaagacagtccttcttccagtgtggcccagggaagccaaaagattggacacccctgctttagaagaataaactgatagtagcatccaagttatttgggagacttgcttctgaggaggagtggagtagtttgtggtagaccagtgctgctgctgagaacaactagaaaatcaggtaaatgtaaaaaatagtaatttcatgttatttaagagctatagaaacagctatgacgaaggattgaaatgtacagaaatgccagataaacctttcagaggttacttgaggatttgtaactgtgtttccctaaggagacgcagcagctgagaatgtagttttggcctaggctaagcaatactgctggggggcagtagatgttttggtggtcacacaggactggagtaacaaaacccattggacactgaattgaaagtccaggagggacatatcttcgattcagtggctaaccctggagatggactgattccctttcatagcaaaggatgaacccattcttaatgcaagataacatcatcttgttcttgtgtgattcttatatatacagtgtccagtattcagtacaacattactagtcctatgaagacagataaattaatgacttaactaaaagaaaaatcattttagaagcgatctcaggtgatcctgatgttggagttagcacataaggactttaattaattaagattaatagcttaaccacaatgagctatcacttcatacccagtaggatgactaaaataaaaaggacagatataacacgtgttggtaaggatatggaaaaattggaatcatattgttggtggcacagctgctgtgaaaacagtttggttgttcctcaagaagttcaacataggctggtccaagtgcagtggtgtttacaactaattaatcacaaccatttacagatgtagttgttccttctccactcccactgcttcacttgactagcctttcaaaacaaacaaaagaaggtcaacagagttgctgtatggcccaactgttctactctgaggtgtataccaaagagaaatgaaaacatactttcattcagaaacatgctcataaatgttcatagtagagtggcattactcttaatagtcaaaaagtgtaaacaacccaaatatccattagttgcatagataagcaaagtatgctgtatccatacagtggaatattattcagttctaagaaatgaattattattctgctatatgctacaaggtagatgaaccttgaaaacatggtgattcaaataagccagacacataaggacaaattttgcatgaatatggttgtatgaggtatcaagaacagggaaatccattgagacaaaaagtagaataaaagttaccaggggatggggaagggggggatgggaagttactgttccatgtatacaagatttctgtttgggataatgaagaagttctagaaatagatagcggtgatgtttgtacagcattgtgaatgtacttaatgccactaaattttacacttaaaaattattaaaatgataaatcttttttactcttagtaaaagatatgtgttaaaaaaggaatgaactactggtacatgctgtgacacatggatgaatcttgaaaacttgatgctaagtaaaagaagtgggtcacaaaataccacttattgtatgataacatttatctgagatacccagaatcagcacatccatagagtagactagatgttgcccaggcctgggaggtgagaggaggatagctagagaatgggatttgactgctggcaggtgtggggtttctttttggggtaatgaaagtgttctaaaattttattatggtgatgattacgcaaccctctgaatatactttaaaagcactgaattgtacattttaagtgagtgaattgtatggtttgcgaattatatatcagtaattattaataagcttagataataaatagcaatgaagatataatacatattaatggatagatggaaattgttatctgaggaaagaaagtgtctaaaaccatatataattggagtcatagagcatagaaaagagggtattaaccaatatttgaaatggtattgactaaaattttccaaaattgatttaagatttaagggtgtctgtgaatcccaagtgggataaatacaaattaaaccattcctaggtacatcatagtaaaacagcttacaactgaaaacaataataaaacttttaaaacagccacgggggaaaaataacacactaccttcaaagtaacaatataagactaatagctagcttgtaatcccagctagttgggaggctgaggaatgaagactgcttgagcccaggagttcaagaccagcctgagcaatgtatctagatgtccatatcaaaacaaaaataaaaactgatagctgtcctcttgataggttgaatgaaggagggaggtagatcactttgattgttacagtagttcacacctgagccaggcattgcaaggagagatggatggattctcattaagttagtggagtatggctacctaagggaatacagaaagacttccctagagcatgccagtatggatactttcaagggaaatccatttctaaattttcaacttccacattcactcttttctaaaattccaccctgtgatggaagtatcacagcagtttttcctttctgtttctttcacaattacccattcccagtttgcaaagaaaggcatacctctcttgattcttactgtggtgctttgcctcagaatgtagcagccttcagatggcctaagacaggaatattttgaaatactggtattgatgtacatagaattcatttttaatgagttaggtatcagatcctagtcagatagtttctacttctttgctttcagcacaattgatgttagctattatttttgtgttctctttttattttatttttttcattcctcacctaactggtagatgttagccattctttaaagatggatcattaaaaataaattttaatattagatcagtatggatttttttgttttgcaaatggctcaggaggtgttcaaataattgaatgatataataagaaaaacatattctagtctcatctacttatttatgtgaataagacttctcagggcaaagacatacatttatacaaataaaagaaattatgctgattcctggatttataattgggaggaaaaaagtttcatccaccccactaagagttgatgcatccagtaaaattttacatatgcatatattttatgtatgtgtatgcacgatgtaattgttgtttggattatttgtatacttaaaatttggatagctcaatccttggaaaacaatacttgaattttataagcacaagaaatttcaaaatcttcaatttaaatttatttacatatatttttagagaagtaggattaaaaaataaatgtaagactttcaagcatgaaaatacaatatactgctgggtgcagtggcatgcacctgtagtcccagctactcaggaggagtccagcctggacaatatagatagtgagaccttgtctgaatttaaaaaattttttaatttgtgtatgtttgtgtctcagttattttttaaaaaaacaatatgctctgtttaaattgttatcaggagccaggtgcggtggcccacgcgtataatcctagcacttttttgggaggccgaggcaggtggatcacctgaggtcagaagtttgagaccagcctggccaacatggcaaaaccccatctgtgctaaaaattcaaaaattagccgggcatggtggcgggcacctgtaatcccggctgctctggaggctgaggcaggagaatcgcttgaacccgagaggcagaggttgcagtgagccaagatggcatcattgcactccagtctgggggacaagagcaaaactccatctcaaaaaaactaaaaaaaaatttgtatcaggaaagtgaaatggagatacaaattctttattgcttaggaagaattcatttatagttttttttttaatgcatgatggtatatatatcatcattatggaatgtaggttatattggatacattttaaagagtgaaataacagttttaatatattaatcataaaaagttttaaatgttaacataaatatccaagaatttaacagtttttctaaagtattttaacagatttctgaaaaaaaattttaattatcattgccaaggtcagcactagggtgaggcaagaaggcacctagagtgcaaaattgaagaaggttcttactctcaggattctgcaagtgcagcatcagcacttaggggaacgtaaaagtgagtgcctccctaaattaggcaccctaggatgcttgcttatcctagttccaaacctgatcactagattatttaacatgagaaattcgcttgtgaatcattgactttagaaaaaaataattgcaaacattaatcatttttccatcaactgcttttaatttgttttttagggtgggattaaaaactcagcctgaatcaaaatgccctgagctgcttgccaattactgtgacatgttgctaagaaaaacaccattaagcaaaaaactaacctctgaagagattgaagcaaagcttaaagaagtggtacatgaattttttgtatttcaacttttaaaattaccttactttgaatttgtgttttgcttataggactttctgtgatagtatcaatttaaaaatgtattatctgtaaagaactaatgttacgaagatttgcagtgcaagacctctcggggggttatttttctttctgaaaatttttattctacagcttcttgaaaggaataccatttaattcctctcctttcttggttatttttaggaattaagttctagctactaatacaggacatatcattccaacaaatttggaatgatagttgacagattgggagtttttcactccttcctttttgtgagagtccaagatagatagcaagggatgaatgagagtagattaagtagttgttttcatctttgtcacccagttgttagtgtaatgatgtaagcccaggaatacaaacaagaaaaaaaataagatattgggcaagtgtagacagaaaggccgagagagatgactagtgtcagaaaaaaaagtgaaaaagataagtagaagagacactttgcagggggacattgatttttttcatgtaaagtatatcgttgcattttatacaaaatctaaaaaactgatatttagaccgactaacaatttggttatagtctcagttttgctaacctttaaagtagtgtatcaggactgggtatttctcagagatggataattcagtaggcctctatctgtatatgctcataaaagtttctgacttgtgacaattggtggatatagaaaggtctaaattcgagagatggtaagagtatataagaactgaaagtaactttatttttcatacagctcttggtacttaagtatgtacagaacaaagatgtttttatgaggtatcataaagctcatttgacacgacgtcttatattagacatctctgccgatagtgaaattgaagaaaacatggtagagtggctaagagtaagtaaatttttttaaatatttggttttctaatacattacatcatttatatgtgtgcttaagtaatacattttggagatattgttaatgtcaaagaagtaggaaacattttataagaatatagcgtcagttaggccgggcgcactggctcatacctgtaatcccagcactttgggaggccgaggcaggtggatcacctgaagtcaggagttcaagactagcctgaccaacatggcaaaaccgcgtctctactaaaaatacaaaaattagctggatgtgctggtgcactccggtaattccagctgcttgggaggctgaggcaggagaatcacttgaacccaggaggtggaggttgcagtgagccaagatcgtgccattgcactccagcctgggtaacagagtgggactccatttcaaaaaaaaaagaatataccatcaattatataaaataaagtgatatctaataaatgttcttaatactttcagtaaagtatctttgttcttgagttgtttctactgtttcactcccatttgtacctcaactctcatttaaactgaccttattaataaatagactacaggggctgggcacggtggctcacacctataatcccagcactttgggaggccaaggcaggtggatcacaaggtcaggagatcgagaccatcctggctaacacagtgaaacccagtctctattaaaaatacaaaaaaattaacgaggcgtggtggtggggggcctgtagtcccagctacttgggaggctgaggcaggagaatggcatgaaccctggggggcggagcttgcagtgagctgaaatcgagccactgaactccagcctgggtgacagagcaagactccatctcaagaaaaataaaataaataaatagactgcaggacaaattattatatctttaaggtattttcagtactaaatgcttaactttagagatgtttataaatgataacaataaatacttctgtatagcaaaaagaacctttaaatgatggcctatttagggtaatcaatgctgattataactaaattcccatataaagtattttgagttctttttttgttttaattattaaagtaaatatctttaatttctgtgtatgtatataactctctccacatatatatggagagagagagagtgcgagcaagcacacacgagagagacctacagatattttaacttatagctagcccttcgcatggaactttaggatagtaaaaattactgtgctaactgaaactgcttagtaggaaaaagaatgattattctgtgactttttaaaactattgtcaaaagactcaaaactcttactgtcacttataagtatataggaaaaaggggaaaatagcaaaactaatacatatttactacgagaaacctttagaattaaattttctttctttctttctttttttcttttttttggagatgtagtcttgctgtgttacccaggctggattgcagtggtgcaatcttgactcactgaaacctctgtctcccagattcaagcaattctcctgtctcagcctcctaagtagctgggactacaggtttgtgccatgacgcctggctaatttttgtatttttagtagagacacggttttgcatgttggccaggctggtcttgaaatcctggtcttaagtgatccgcctgcctcggcctcccaaagtactgagattacaggcgtgagccaccacacccggcctatgttatttctttgttaaaaaaaaaatatcaagacccaacagtaaaatgacaaacaaggctaggcatggtggctcacacctgtaatcccagcactttgggaggctgaggagggcagatggcttgtgctcagagtttgagatgagcctgggcaacgtggtgaaaccccatctctacaaaaatttaaaaaattagctgggtgtgatggcatgcaccttagtcccagctgcttgggaggctgaggtgggaggatcgcctgagcctgtgaggtggaggttgcattgaacagagatcttaccactgtactcctgcctgagcaacagagtcagatcctgtctctctcactcacacacacacacacacacacacacacacacacacacgacaaataattaaaagcaggcaaaggattcgaattgacatctcttcacagaagatagacagatggccaataagtgcatgcaaagatactcaacatcattagtcattagtgaaatgcaagtgaaatgctcaacatgttggctcctgcttatcccaaatattttgaaaggctgaggtgggaggattgcatgaagccaggagttagaaactaccctgggcaaaataacaatactccatgtctacaaaaaatacagaaatcagctaggcatggtgatgtgtgcctgtggttctagctactcaggaggctgagatgggatgattgcttgagcccagaagttcaaagttgtaatgagctgagattgtgccactgcactgcagcctgggcaacagagtgagaccctttctcaaaaacaaaaaaaacacaaagagatactactttattcccactagggtagctaaaataaagacagatgataacaaatgctagtaaggaagaggagaaattggaaccttcgtaagttgctagtggagacataagatggtgcagacactttggaaaactgttgggcagttccttaaaatgttgaacatagagctgacccagcaatttcactcttaggtaattcatttgaagagaaatgaaaacatgtttcatgtaaaaacttgtaaacaaatgttcatggcaagattactaataatagtcaaaaagtggaaacaacccaaaatgtcagtgagctaatgaataaaatgtgatttatccatacaatggaatattttttgtgataaaaaggaataaactaataatacatgctgcaatattaggtgaactttgaaaacataatgctgagtgaaagaagccaatcccaaagaccatatcgtatgattccactaatgtgaagtgtccagaataggcaaatccacaaattccaggagttggggccaggaggggaaatgacgagtgactgtaaatagtatggggtttctttttggggtgatgaaaatgttctaaaattagatagtggtgatggttgcacagttctgtagatatactaaacttcattacactgtatattttatttttatttttattttttatatttttttgagacagagtctcactttgttgcccaggctggagtgcagtggtgcgatcttggctcactgcaacttctgccacccaggttcaagcgattttcctgcctcagcctcctgagtagctgggattacaggcgcatgccaccatgcccagctaatttttgtatttttagcagagatgggtttcaccatgttagccaggctggtcttgaactcctgacctcaggtgatccacccgcctcagcctcccaaagtgctgggattacaggcatgagcccagccaaattgtatactttaaaatagtagattttatggtagataaattatctgacacagtaaagctgttaataaagagtagtttgaatagcttttgccttcttgtgtaacttgacagagtaagcatcttttctttgccttggagagttgtcacaccccctgtaatttggatgatcttctagcattttatcttttgggctgtcagtgtcatgaaatactgagaattcctttatagcatttttgccaggatcacttcttctagggtatcttatcttttttgtcactcaccacttttatcttttatgttggtaatttgctttcactaagttcctcaacactggcattgtcagccttactaccacagtcagctttcttctataactccatttatgttctattttattttcatttccagcattatcacttttcatttcctgtttacttttatatctttgccaattatcttgtttgattattcttttttgtaagtagtcatgtgggtttattactggaagacaaggatgcaatgaaactgcatactttgctgtctgcagtttaactgaataaacaaatgactaataggttgtgtttacattttttaaaaatttatttatttaattttttcaagcaacaggatcttctgttgcccaggctggagcgcagtgacacaatcagagcttaaactcctgggctcaagcaatccacccacctcagccttccgagtagctgggactatctcggcagtatgccgccatatcctgctaacttttaaaatttttttgtagtgatgggggtgtcactgtgttgcccaggctggtcttaaaatcctggcttcaagtgatcctcctgcttcagcctcccaaagtgctaggattacacaccatgccaactaatagattttgaaagaagtattgtggttagtcattgttacttttgtcatgatttgtggatcaaagagctagaaataaagtttttacttcatgcagttaaatttattatatagtgtcaactgaaagttgagctttgttcttggggaattggtattatttaactgtactgtggtaactgaaattcatacatactaaaaatgcgcaaagcagggaccccttgtaataccgtattttgtttctaagtagcaaatttcataggtattagacaataaaattctaataaatgagaaaaattttgtattaaaacatttaagacttagtttttctattaaaatttttcccagtaatatatcagattatgtatttattacctcttccttctttggtttatatttataggaagttggtatgccagcggattatgtaaacaagcttgctagaatgtttcaggacataaaagtatctgaagatttgaaccaagcttttaaggaaatgcacaaaaataataaattggcattaccaggtattattttataattacatatatatattttttaaacttagaagaatatctttgttttccagtaaattaaaaataaacctcagcagtaatagatcgaaagatgttatgaagtccatttccgtggagacagctatcaaagcagtgtgttagatttacagatctttatttcaaaacaaaaggacacttttaacaaaatctttatagtcttattgatttttcacccaaagttaccctgtatttattttgaattttatccattgttaatttactttatattcctgatattcttctctatagctgattcagttaatataaaaattctgaatgctggcgcctggtcaagaagttctgagaaagtctttgtctcacttcctactgaactggaggacttgataccggaagtagaagaattctacaaaaaaaatcatagtggtagaaaattacattggcatcatctcatgtcaaatggaattgtaagtagatagtgtgttagttatttcagctttcagtttggatgaaagtagcaggactccgcagaattgcttaaacaaaatagatttttgcctctctcacatgtaaaagtttgagcagaaatagtgaatttttttcatgaagttgatagggacataggcttctggttataccatcatacttaagatactgccgttgtctacagaattcaacatgatcccaactatctcagtattcctggcaacagaaagcaaaaggtgagggtagcttacacctttcattagggacaacttctagaagtttcctctgtcattttccatttgcatccgccagtactcagtcacttggccacattttgttacatggaaagctgggagatgagcgtgtattctgggcagtcattaacgtcttctaaaatgtttattactgtgaaagagtggatactggaagacagcaacctttttcatatataaattcatgtcatagatattaagagagaatcatcatgagattctttattaaaaatctgttttatctattatagataacatttaagaatgaagttggtcaatatgatttggaggtaaccacgtttcagctcgctgtattgtttgcatggaaccaaagacccagagagaaaatcagctttgaaaatcttaagcttgcaactgaactccctgatgctgaacttaggaggactttatgggttggtttatgtttttttgtttttaagactgtatcctctcatgtagcaggaaatatatgattggcttgtaatatattagtaaattcataacagtttcagaatgtcttatcaagaaaaatagaggccgggcacagtggatcacgcctgtaatcccagcactttggaaggccgaggtgggcagatcacttgaggtcaggagttcgagaccagcctagccaacatagtgaaaccccatctctactaaaaatacaaaaattagctgggcgtggtggtgggcgcctgtaatcccagctacttgggaggctgaggcaggagaatcgcttgaattcaggaggtagaggttgcagtgagccaagattgcgccactacactccagcccaggcaacagagtgagaactccgtctgaaaaaaaaaaaaaattatgcacacacacacacacacgagatatttatggaaaaaataaattgcaaataggcaagttaccaaggcagagaaaagtgcttcaaaaaaaaggagaggctggggcagtggctcatggctgtaatcccagcactttgggaggccaaggtgggagaagaggattgcttgaactcaggagtttgagactagctaggcaacatagtgcaatcccatctctaaaaaaaaaaaaaaaaaacaaattagccagcttggtggctgtatccccagctacttggaaggctgaggtgggaagattgcttgagcccaggaggatgcagtgagccacaatcacaccactgcactccagcctgggcaacatagtgagacccatctcaaaaatttttttttttaaaaaagagaaagattgagttggtatttaagtgttacctgtgaggaatgtgaccagctatgtactttttttttttttttttttttttttttgaaacactcttgtcgctcaggctggagtgcaatggcgcaatctcagctcactgcaacctccgcctccagggtttaagcgattctcctacctcagcctcccaagtagctggaattacaggcatgtgccaccacactcagctaattttatatttttagtggagacggggtttcaccatgttggtcaggctagtctcaaactcctgacctcaggtaatttgcccgcctcggcctcccaaaatgctgggattacaggcctgagctactgtgcctcagatacatacttaatttttatactgagaatgtgttcaaagattttatgataatcaaaaatctaaaaactttggtctgtttgaggacttgtagattgtactcattagccccctgctcacaactacattttattactactccatagacctcttaaaagttccaggtttttttgttgagacagagtcttgctctgtcctccaggttggagttcagtggcacaatctcagctcactgcaacctccatctcccaggttcaagcgatcctcccacctgagccccccaagtagctgggactacaggtgcatgccccacgctggctaatttttgtattttcagtagagacggggttttgccgtgttgcccaggctggtttcagactcctgagctcaagtaatctgcctgcctcagcttcccaaagtgctggaattacaggcgtgagccactgcacttggcctgaagttccaaaattaattattacctatggaggaaatagctggtatataactggcagatggtgtttactatggtcctgtgtgaccaatcccagtttcttgtcttactgtaaagagagcatttattgctttctcataaccaactcttttcacctcttctctttcctcattatgcattcaaatgttatattcatggaagtaccacacattttaagtttgtgtttgtaatctttttcttgcctatgttgattatgtgggagaattgatcttagtattccatactgtttatagatgctaattgttttctccttattcttcatagtctttagtagctttcccaaaactcaaacggcaagttttgttgtatgaacctcaagtcaactcacccaaagactttacagaaggtaccctcttctcagtgaaccaggagttcagtttaatgtaagctcgttagttgatctaaaataaaaacaccttgtttgaattttagcactttgttttttgcaaaataattgttttccttacattatatttaaaacattatatactgtcatcactctaaacttacatcatttagttgtttatggaaaatattaatcagatgtttacttttctatatttttcattgatacatttttggtctctgacattatactgtattgcatttcatctttcaggttgatatctttttgtgctctaaagcaactttattcagagaaagcgttttttgtgttgttttgtttcgtttttgtttttgtttttgtttttgtttgttaagacccagttaggcaataacactgaatcctaacccatatatcttcaattagctagtcactttcatggcaatataaaatattaactttgtttttacagagaatgtagtcacttgttttattaacaggttagttatcatgtttaaggaaaatacatagagtttgttttaaagcaatatgtaggttatttgtcatttaacctttaaacagttctgatattttagcatatttttaaatcttttctctcagacattgttgctataataggatttttaaagtgtttttcaccataaaatacttgatgcaattctttttgtagaaaaaatgcaaaggttcagaaaaggggtaaaatcaacttgattggacgtttgcagctcactacagaaaggatgagagaagaagagaatgaaggaatagttcaactacgaatactaagaacccaggtttgtaatgttgacagaatgtctgaagtttaaaaaaactttagttttttttttttttttttaaattttgaaatcttttttgaatttaaaagcatgtaggggctaagtgcagtggcccacacataatcccaacactttgggatgctgaggcaggatttcttgggcaacaaagtgagatcttgtctcaatcaattttttaaaaatatattaaaaatttccattccagttgaaatatgaattccagtttcatattccattgtaatgtgaaattaggaaacttatttagaaccaaaaaagttctctaatattcatttcttcttttaaaaacagtttaaaactaggattaagaccttctgaatataataagtaacacctacacatgattgttttaattttagaaatagtccttttaaaaccaaatttttcaacttttactattttcatttaatactatttgaaacttctggccagtgtactttttttttttttttttgagacagggtctcactttgttgcccaggctagagtgcagtggcaccatcttaactcactgcagcctcaactccctgggctcaaaggatcctcccacctctgcctccggattagctgggaccacaggcatgcgccaccacactcagctaatttttgtatttttagtggagacagggttttgccatgttgcccaggctggtctcgaactcctgggctcaagcaatatgcctgcctcggcctcccaaagtgctgggattacaggtgtgagctaccatgcccagcccagtgtactttttaaaatataaaacaagacgaaaagattaaaaatgcatattacctatagatcatgtaataggataatgtggcagagaaaagatgaatgaataaaaaccaattgcatttctatggggcaataaataaaaggagaataaaataagaaaaatacatacacattttttaaaaagtactgtgtaggagctgtatgaaaagagtggccctttactgggagattcagaaggagagttgaataaatagaaaggttgagctctttttttgttgctaaaatttttagttgtaatttagacacaatggaatgtatctttcaaagtataattttcagtgagttgtgataaatatatatacctatgtgaacattacccaattaagatacagaacatttgtgtcacaccagtcatcttcccatgtttccaggcaggctctccgcctaccccagctgattcttattaccatcacttagttctgccagttctaggttttcatataaatggaaccagacagtatgtacttttatgtctgactttttttgctcagcatgaaaaactatattcttccattaaaggttgaataacttaaacaaaaaaaaaatttttttttttttttaatggactcaagcgatcctccttcagccttcccagtagctgggactacaggcacatgccacggcacctggcagctaggctgaataacataaaagattggtttttctgatattaatatcaagttcaaaattttaaaatttcacatgaaaattcaactaggaatatttttggaattttacaaattgttttttatcagaataaataagaatgattgagaaacttaaaaaaataaaaaaaaggtggtagtggtggaacttgccctgccaaatacgaaaatattttaaaaatctgtagtaataaaacagtatggcaagaagattaattgaagaaaataactttaggctcggcgcggtggctcacacctgtaatcccagcactttgggaggccgaggtgggcagattgcctgaggtcaggagttcaagaccagcctagccaacatgttgaagccctgtctctactaaaaatacaaaaactagccagctgtggtggcgcatgcctgtaatcccagctacttgggggtgctgaggcaggagaattgcctgaacctggcgggcagaggttgcagtgagcctagattgcgccactgcactccagcttgggcaatagagtgagactccatctcaaaaaaagcaaacaaaaacaaacaaaaaaccttactctgtaagtatagaagaatttatacaataaaggaaataatttctatgacctatggaaagaaaatgaattattcactaagtggtgttgggaaatttttctgtttggaggaaaagtaagaagatattcgtagctatgccaggataaactcctggagtaaagagttgaaatgtggccaggcgcggtggctcacgcctgtaatcccaacactttgggaggccgaggcgggtggatcacaaggccaggagatcgagaccatcctggccaacatggtgaaaccccgtctctactaaaatacaaaaaactagccaggtgtagtggtgcatgcctgtggtcccagctacccaggaggctgaggcaggggaatggcttgaacctgggaggcggaggttgcagtgagcggagatcgcgccactgcactccagcctggcaacagagcaagactccatctaaaaaaaaagagttgaaatgtataagcgggtgtagtcgtacgataagatgtgcagagaaattgaagttcttttgttttgtcttaatgtgacccataattatgtacaatccaataatctaagctgtctttaggtaatgctcagactttatttcctcctgatcctactccattcatccccattcattgctatttgcataggtggcatctggatatattgagtgtgagagggatttgcttgactggtaatgacagtaaagggagtgtcatatctatgcagttatgacagtgtcctggattcttgcttttggcagctatgaagtagttgattatctttgggaatttggctttctgttggtaactgctgctgttgtctacagcagatgaatttatggttcattctttttctagttgctaagggccccatggcctcttccctgctctctttcccctgctcttactgagctcttgaagcctctgagactccactacatcttctgtgtggctccttggcctacatggcacactgtcattgttctctgcagaataatgacaggatcaccttgccctgtcattaaaggccctgtggcaggtccattagctcgaaactcttgctgtcacacttgggaactgagggagagtcagaagtgcagattatttccctcatactgtgctactctttaagtgacctccagcatatcaaatggggaccagggccagtgtccctctgctctcttttcctcttaggttctctaactaccaccttcacctctatctaaggagaaactgggatgtttacaaatgcctctgcttttcctctgggttcctgtaatcttcaagtgcctgaaggaacacactttccttcttccttcttcctctctgaacccctgacataaaccccaatttatgatgatcaggagcctggtatctgaataccatcaagggtgagaggaattcacttgaccttctggtgtcatcatatcttttatttatttttgtttattttattttattttgagacagggtctcaccctgttgcccaggctggggtgcaatggtgtgatcttggctcactacaacctccacctcccaggttcaaatgattctcctgcctcggactcctgagtagctgggattagaggtgctcgccaccacactgagctattttttgtattttttgtatttttagtagagatgggtttcaccatgttggccgggctgatctcgaactcctgacttcgtaatccgctccccttggcctcctaaagtgctgggattacaggcgtgagccaccatgcccggcctatttttctattcttttgagacagggtctcactctgtcacccaggctggagtgcagtggtacaatctcagctcactgcaacctctgcctttcaggctcaagtgatcctcctgactcagccccctgcgtagctgggaccacaggcgcgtgccaccatacccagctaatttgtttttgtatattttgtagagatggggtttcgccatgttgcctaggctggtctcaaactccacgactcaaacgatccacccacctcaacctcccaaattgctgggattgcaggcatgagccaccctccctggctggttatcatatctatataggggaagttgaaggagtttttctcttactgaatagtgcctgactcccaagtctgttgatttgcagcaaaattatatttttaaacgttaaaagcaaatgttacttctttttctattttgacatttcttttacaacaaactctaatctgtgctaagatagatatatgccttttgttttggagacagggtctcaggctgtggtgcagtggtgtgatctcagcttactgcaacctccacctcccaggctcaagcaatcctctttcttcagcctcctgaatagcggggaccacagacacacgccaccatgcctggctaatttttgtattttttatagagatggggtttcgccatgttgcccaggctgttctcaaactcctggactcaagcaatccacccacatcaccctcccaaagtgctaagattacacacatgagccaccacacccggcatatacatgccttttgttgggtaaagagagagctggtactggaaaaggtaaaagagaaaagaatatttaatgattttctgataactcttattgtaaacttaacagtaattaaggaaatcatcaagaaaaattttgataaaatgacctagatgaaaaagatttatttctttagaaacttaaaagtgactgggcatcgtggcttacacctgtaatcctagcactttgggagaccagggcaggggagtatttgagtctgggggttcaagaccaacctggacaacatagcaaaaccttgtgtctgtatttaaagagaagaaggggaaaaaaaaaaccttaaaaacatttaattgagtcaatataaactgaagataatatttgtagcaaatataattaattaatctggtaaatatataaagagtactacttaatgacttttaaaacagaccccacctgacctgtactgctatacaaagaaataactgaatacaagggaaaaatttggtgtaaggggtttgttatattttaattaatgtttaacatgataccaggttatatacacattgttttcacaggtaagataacttttaagaatgtgaatggcatgggaaaaaaggaattgaaggaaataatattaaaacattaggtgtagttttctttcagcagagaagcagaggtaattttgcttttccttatttttcaaaatctctatagtcagattttttttaaatacatactttaagttctgggatacatatgcagaatgtgcaggtttgttacatgggtatacacgtgtcatggtcatttgctgcacccatcaacccgtcatctacatgaggtgtttctcctaatgcttatccctcccctatccccccaccccaataagcagattctcttttatggggcatgagaaaacaaaagatgtttttatttgttaagtaaaagatactagtctcaacattaatcccctagtgattattattcatttgggtagatgttggatagaggatgaatatgcataaaaagtcatttttcagtttgttgtacttaaaataatttcgtatattaatgcgcttttatttttattttttcttttaggaagctatcatacaaataatgaaaatgagaaagaaaattagtaatgctcagctgcagactgaattagtagaaattttgaaaaacatgttcttgccacaaaagaaaatgataaaagagcaaatagagtggctaatagagcacaaatacatcagaagagatgaatctgatatcaacactttcatatatatggcataattttgaatatcatggacaatatttagaacccaaattttggagtgcttgggcagaaagttgtaaagtttgtgctggagaaaggtttatttggactttgattacataaatattaaaatctctgccttaccttacaaaaacaactatattttgccaatcacattagttagcatgatggcattcccttcatgttgcacactctttgacagcatgctgttttgtggagaaacttgcattcatgaagagcccattatcaacttttaaaagtgaatttgatttgtacccaccaggagaaatacagttgggaagggtgagggtggggttcttgttgcttttttctcttttttcctctcttaaaaaatgtacttgcacaaggaaggatcttcagatattcatgcactgaaaaatgctgttatcttttgtttttaaaaaatgcaattaaaactagaaatagcactcttggtttcttttgatgaaaagagtgagctggtcaatgcaacattgggaaacggcagatgtaggtgagaagttaagtatttaatagtatcaaattgttcaaacattgctcagtataataactggattttaatggtgacctaaaaatggtattaaatattttcaactttcaaatgttggttttctttaagcaggagactgctattttagttgttgttaaatgatgaggagtttttttttttttaaatatggctggaaagcttgttttgaaaaatgaagcttatattaattgttgcttcaatagtttaaaaaatttatggagataggtaggtcattatgattgcagagccaaaatagcaaaacaaacatattaagtgtgtttactaaacatattgtgtgtttactaacacacttaatgtttatatacctaatatttattatgccatatctgaatttattaaaaacaacacagaaatctcctgctctgatatagttatgtaactgatctcttaatctgtagcatagaagtattttggtattttaaggtctcatgattagggatttgtagcctcaggtttgaatcagtcacctaggggtaagagaaaaaccacaacataagacctgaaaaacagaagcaaaattgttgcactcttaatacgagcagtaaacttgccaaatatatgtacatatatatttatatattttaaaaataaacattttttaaatcgtcagaaggcaacatttaccatgttcctttcagtctatccaaagtagcaacttaactagttgctggcaactgaatacccagagtagtggaaattttaggacttgaggacgtgaacaacttgaaagagaaaattgattccccttgaggaaagaatggctcaacgtggatttttattcattgtggtgcacgtttcaaattttcttgcaaattattttatatcttatttgatgttaagtaatatttttaaagtatggtttttgaagatagtaggaaatggagtacagaaaggcatacagtattatgttacagtggagtgctttcaagagcatttcgtaggatctgtccccatccgaagaggctttgtgaactgcctgctgaatggaaggaaagcaactttaaaacatttagagttttgctgagtatagccaaatgcctgttctgaaacttataggaaattggaattttgtttaaaattttacactttaaggtagcaaatgtcaattattagaccgagcatattgtgaagaattaaactaaaattaatacgtacagttttctctaattaggtgactgttcataatgggtatatttggaatttagaagaaataattttgtagtaattgtggcccttatgtttaacagataattcagcattggcgtatttgcttgtcccaatacaagaatgccaaaggaggaaacaggaaaaattgccgtccattttaaaaatttaggtttgttgttttaaaccataattgttctcagaacttttttggaacttctaattttgggtcatttaatttaagaatgagagtcatgatgttttgatttatgaaggtgaatttaatgcaaaagtgggtaacactacattcatagcaaagttttttattaaattttataaatttttaatagccaattatgtcctaattgtattttggggaatgaacagcagcaaatactgtaaatgtacagttttctttttttttttttttgggttatgtatacaaaagttttaactactttttggtgtttatgaaaatcatttagttgacaaggtgcctatgccattgttaaattttctttaagtaatttaacaacagatttgctaatttaaaaaaaaatgaaaaaaaaaatcttaccagcagtttgtaaaggtctggaatcacagttggcatcctttattcaggtctcttctctccagcgtacacttaaaattggtgccgagcagggatataacctgcagttaagtgaaaagaaaatccagcctccccctccaaaaaaaaaaaaaaattttaatttttaaaaattagtggtatggcaataagacacttcagaggctatcttaacctctgaatacccatcttctagtttaaagacagagacatcccatctggaaaatgttaacttgtgttgccatctcgttgccggagtaagtagacataagacagagtttaagaagtaaaaatatagaaaaattttgatggtcacaatgagataaatattagaatattactattccaatgattaaatgaggatcttgaaataaattctgaagtcttccaatttttacatttattggaggggtccctgagttctgtcaacttttttatttaagtctcttgctcttattttgtgcataaatgttaaaccttccaaaaatgaaatgttagctttctttcttttactttttattaaatttaatagaaaatatgacctgagtagttaaaaagtattttgcattatttgcagtaagatgtctctagcactgctcaaagggcaaattttaaaacttcagtctgggtgaaagatttgctagttttacagaaagatttgctatcttaaactcaagctggtttttctgttctcatgtaagtgactgggatgctgtcttatgaattcttccaaggtcatgtttgtgaaataaacattacatgagagctttcctgtcatctacactatatgttgtctggagtgttgaacaaatttattttagtttctaagttgtaatctatcctcatatggtctatacgattttgaatgtgtgccactacatactgagatgataatgctgtacaattttaagtggtagcagtttctgtatgcagtaggctgaaatattttgatgaactgcttaatttttggattttattttttaagttgtataatttattttcttgcaaaataaaaatgtaatataaaagcttttacctatccagaaaatgttgatgttctactataaaatagttacaaagagtttaattaaaatttttatagtaggtatatttttaaatttgaaggtaaattaatctcagccagccttaggaatcagaaatatgaaaagtaacccacttatttatattagacttcaaattctaattcaaaatgagagcagtcaggaatgtagcttttccactgatgatagcatgtggctatatgcctggaagaggtaataaaaaaaaaaaaattccaacctgaaagtggttaatatattcatcaactaagataggctatgtcataacaaaattcaaattttatagcagataaaagtaaaaaatgggccgggcttcagtggctcacgcctgtaatcccagcactttgggaggccaaggtgggtggatcacctgaggacaggagttcaagaccagcctggcaaacatggtgaaaccctgtctctactaaaaatataaaaattagccgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttggatatatttgaaaatttgtgaaaaacttatttttgtttttatttttattttttgagacagagtctcactttgtcacccaggctggagtgcagtggcgcgatctcggctcgctgtaagctccatctcctgggttcatgccattctcctgcgtcagcctcccgagtagctgggactacaggcgcctgccaccacacctggctaattttttgcagttttagtggagacagggtttcaccatgttagccaggatggtctcaatctcctgacctcgtgatactagctgcctcggcctcccaaagtgctgggattacaggtgtgagccatcgcgtctggcctgaaatacttatttttaagctagaaatagtttggcaataaggttgtgaaactggacagataatagcaattagttactgatcaagtgaacaatttaataatcgaaaaaactcttgactat

SEQ ID NO: 12244 - DNA, 19145 bp, Human
  misc_feature (1)...(19145): n = A,T,C or G
ctattttcactgccccaactccagactacctcctacaaccccaggagaacgccccctcccactgcctggggaggctctcctaaactatagcctctagccaggccagcacattgaggtcattgctctccctgccaaatgactggcctgagttcagtgtctccatctgtctgagcttcatggaaaacttgattgttgctctaggctctctattctatgtcctgccttagctatgtcctgctttgcatctgcttttttgtttcttctcccaacacccttttcttcccctgactctcctcagactagaatcacatctgttttctagtctcagccccttcactggggagcagatggaagaagagcaagttctggggcaggaagatcaggaagagctgggcgtagcactcagcttgttctgcggactgaccagattccatgtatcttagagatgtagcacttacagctccctcggaggtcccagaggtgcttacaaagtgcgatttgcttatttctgtgtccactgctcttttttcctctcaactagactccttccttccttctttccttctttccttccttccatcatacccccttttattttcttctagtatgtaatttattaatactatctgctctctgtctacctgtactcttctctaatttatttcatcagggagatatataatgtagactaaaggggagccaacaggaaacctgaaacttacatatttctatggcatacaaggtccaccattcctcagacttgagtttctgtaattcaagtttgctcttgaatccaaagcgggaatgttttagtggttgaaccactagagtctctgtgaataagaagaaatacaaagcctttaaaattcctgaatcaaggctgagcaacatagcaaaatcctgtctctacaaaaaaatacatctaaattcgcctggcatagtggcatgcacctgtagtcccagcgacttaggaggctgaggcaggaggatcacttgagcccaggtcaagcctgcagtgaactgtgatcatgccactgtactccagcctgggtgacagagcaagaccctatcttaaaaaaaagaaaaaatcctggatcagagaaagtgttatctacacattatatgatctaaggaaaaatattggtagaaaatgaggcaagcataataaccttgcctttcaattttctttgggcatctgattgcattttatccttaagagcccagaaacccagattcttagttaagctcaaacaaagccaaaagacaaagtaaggctggcacccctttcacagagcttctctacatttgaaaatgatttggagagttctgaaaagttcctcaactttttataaccctaaggtagccagccttcctcttggacaaaactcataaggtatctgtgttcgcttggttgtgagaatacataggatattccaaggggaaaaaaaacaagaagagtctaaatgtgtaggtcaagaaagaggcagagatgaaaaagaaatacaggaataaaaagaaatttgttagtgctgaagagacgaatattgaaaaagaaagtgagaaagaaggatgaaggaatgattcaaatatggaatataaggaggctgaggcaggataattgcttgaactcaggaggcggaggttgcagtgagccaagatcacatcattgcactccagcctgggtgacaggagcaaaactctgtcttaaaaaaaaaaaacaaaaaacaaagaagaagaagatagccagagagagagaaacagcatctataatgtgcattaaaacacaccaaggaggagacggaacttttcggtaagaaagaacccaaggaacaaaggggagctgggaccagatcgtgagaggagggaaaataggctaatggaagaaaggcaatacatgagctggggccaacacttccagggagcagcaagagctctcaccagtgtagtcataacatttggaatgagggtgtgagcaactgcaaattcccatctcccttctcattccagcctcattgtaacacacattctacgcctagcctggctttcttgctctccctcatctcattgtttcagcggaggccaaatctgaagtcctttccagggagtggctctgttcatcttattcgccagccaaagtaggaacagcgtaagaggagagagacacattcagcagccaaaggactcggtggaaagagcagaacaccatagacagtgagttatttgattacctgaaaccctaaagagacagagggaatgtgtgtatgtctgtgtgtgtgtgaaagggctggagggggcaatggggaatgtcactgaacttagtcttgagcagacctcccaaataaccgtggaattctgatgaaggagacgccaagatgagcagatgatatgaaaaagtcacgcatatgagaaaggaagattccacatcaggggtgaaagaggccaaagggtagggccaagtacggaccatgtagaatgtaaaatttcctctgacttggtagcagagaataataaaagcaagaataatggtaagtgaccaaggaatagatttgagggagaaatgaatgttgggtgaaaggtaagaaaagagagaaagggtttgagtcataagggaaaatgaagaaagttctgggaagacaaagagacagggacctcagaggcatctttccctggcactgaaatgctgatgtgcctctgagcatcacattctctgctatgcccaccacccctatagatatgtcgctcttgggacccaaggtgctgctgtttcttgctgcattcatcatcacctctggtgagtcctttattctttgctccctaaaccctcagctcctcagctatacacgtgtgtggcaggagatgggatggaatgaggtcgaagaggaatagcagtagagatgcttggtattgagctctggaattcctattagaagaacagattttgtgttaagaaaaaaagttcaggaatgtgactagacttcagactaggggaaaggcctcccaagaattatgaaactaaggtgcaactaagatacacacaaatgcatattaaccacccaaagagggtcacatatgagtaaacaaattgcaaagcaaaaaagaagctgatatacaaatgcatacacaaacatagaggagggactacctagaaagaaactggacctgggctgggcatggtgggctcacacctatactcctagcactttgggagactgagtggagaggatcactgagaccaacctgggcaacatagtgagatgagttaacctcatctccattaaaaaaaaaaaggaaaaaagaaaaaaagaaactggaccaaatgtaaatcttgaagaagaacagtgggaatacatacactattaccatcatgcatgcaggtatactcacatgcatgcaaaaaatatatgccatactgacacacaagagaaaagtgatcttcacagatttcccagaatctggctagaagactggccacagaaagtgaactttaggctgtaaagatgtcctactctatttttttccctccttcttccgatacagattgagaaaaataattcttctgtcttgttcactagcatagctagcggggaagccgtggggctagaagggctgccaggcctctcagtggagctggacttcattcctggccaggaatgagggtaagagggcagcagggctttgttctcaggaacttgtcttttttttctttttaccaaacaaatgcacagcagtgaaggaacttgtctttctgaagtctttctattcctattggttttgttcatagcactaatggtctcagtaattttatattgagctatataggaataagtcacaaagataatgtataaccatttctccatgattttctgatttgtctcataaaagggttacgaggtatagagctgcagtcactcacatctcttttctcttcctttgctatagactggatacccctgggggtcaatagtcaacgaggaggtaggtgaacccttggatagcggctctgttggggttcttatcaggaaaatttagatgaacagagttaaaaaatccttcctgcttatctatcgctgccaaaaaaaaaaaaaaaagaatatttcctacaacaaagagatgcattgccaaagtgtgagaaataggatcaacttcaccagtttccacaatcctattatcccattcataaaagcttcttgtgtgtgtgtttttaaactactgaaacaccttcccaagacatcctctatgaccatttctgttttcatttttctttacacatctcctatcttactcagaaaatgcttactagtccttacaaaaagcgttccttaattcatgtaacagtggaaaaatgaaagacaggataagaagtcatcttatacccataatcccagcactttgggaggctgaggcaggaggatcgcttgagcccaggagtttgagaccaaactgggcagcacagggagacctcatctctagaaaaaaaaaaaattagcctggcatggtggcgcatgcctgtggtcctagctactcaggaggctgaggcatgagaatggcttgaacccaggaggctgcggttgcagtgagccatgatcatgccattgcactccagcctgggcaacagagtggaactgactaaaaaaaaaaaaaaaaaattagaaaaaaagaagtcatgtcaatcctaggtgaaattgtggcacaactgagcaaaacccaaaaggtattttttggtttttcagctttttaggtaatttttgctcacaccattctctataacaaaaatcccaaaagttgtgacccctagaggaccacttccttcgacttcatgaagaaaactccattctgcctcaaggcattcaacataattataatttatctctttatttctcccatcccaggagagttagaggacagagcgctccagtaggcaacctattaatgggatcatgaaatcaatttagtgggtcacaactggtattaatttttaaaatgaattaagatagaccaaaacaaatataccgggatgcattgcatgtgttttgcaagagtaaagtattatttcatacaactttaataaaacttctcttagttttccatatgtatataccagggtacagtatatttttcttgcagtgggtcctggtacagaagataaaaatacaaaaattttttttctgttgttggtaaaaatacccgaatccccgagtttctgaatctaaatctgaatctaggaaaaaagggcaggaatgtgactagacttcagactaggggaaaggcctcccgagattttagtaccagcaaaactgaaaatcggaattcatttttctgggctgattaggaaccagtcctgtgttaagactttagatgcttttctcgcagacatatcataaggtatgatgaactgtcttgcctggtgtggtggctcatgcctgtaataccaagcactttgggaggttgaggtgggatgatcacttgaggccatgagtttgagatcagcctgggcaatatagtgagacccttttattttttttttttttcgagacagagtttcgctcttgttacccaggctgtagtacaattgcgcgatctcggctcactgcaacctccatctcccaagtacaagtgattctcctgtctcagcctcctaagtagcttggattataggcatgcgccaccacaactggctaattttttgtatttagtagagacagggtttcaccgtgttagtcaggctggtcgcaaactcctgacctcagatgatctgcaggcctcggcctcccaaagtgctgggattacaggtgtgagccactgctgccagcctgagaccctatctcttaaaaaaaaaaaaaaaaaaagccaggtgtggtggtttgctggttgtcctagctactcagaaggctgaggtgaaaggatcgcttgagcccaggagttcgaagctgcaaaggagctatgatggcaccactgtactgcagcctgggcaacagagtgagactctctcaaaaaaagaaaaggaaaagaaaatacgttaattttttttttcagagagaacttcatgaatactagataaagcatttatatggtgatagctcttggaacagttggttaaactgaggtatatgcagaaaagcagtactctgccctgaaatcccagagacagctaggatacattctcaagccctctgttcccccattgctttgctcctgtttctgtgagtggctggactggaatgtagctaggcctctagagaaagggaaccaggaaggattgggctacacccgggagaggctccactcctctcctgcagtctctggaatgattcaggttagtggtttttcaaatatcctgtgggattggaacagacttggattccttttgttaaaagattgttcttccaatcaatgacatcctacttaaaaaaaaaagtgttctgaaagaagaaagcccataatgagtgtgaaaggttaagaggcttttttgtcaagcctgatgaattttttttttggcagagtctcactctgtcccaggctggagtgcagtggcaagatctcagctcactgcaacctccgcctcctgagttcaattcattctcctgcctcagcctcctgagtaattgggactacaggcatgcaccacccatgcccagctaatttttgtatttttagtagagatgggattttaccatgttggccagactggtctcaaactcctgacctcaagtgatacgcatgccttggcctcccaaaatgctgggattacaggcatgaaccatgaagcccagccaaacctgatgaatttctatctggaatttagaaaacaggatgaggtaagcaagggaaattcctatgaaatgctttatttgtatttcaccttttttataattatccataactctgatatgctttataaaaatatttgttcccatcagatttacatctgacatttattaatagaatctgaagttaaaaaaagaagtcaggccgggcatggtggcttatgcctgtaatcccagcacttcgggaggccaaggtggttggatcacctgaggtcaggagctcaagaccagcctggccaacatggtgaaaccctgtctctactaaaaatacaaaaactagtcgggcatggtggcacacgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattaacatttacttttattttttaatttacatataaattatattgtatgtgtttacagtatccaccatgacattttgatagatgtgtataaagtgaaatggttactacagtcaagcaaattctcatatccatatcctcattagtttccttttttgtatgtgtataataagagcacctgaaatttactctcttagcaaacatttaaatatttagcaaacaggccaggtgcagtggctcacacctgtaatcctagcacactgggaggcctaggcgggcagatcacctgaggtcaggagttcaagaccagcctggccaatatggtgaaaccccatctctactaaaaatacagaaattagctgggtgtggtggcgggcgcctgtaatcccagctactctggaggctgaggcagagaattgcttgaacccgggaggcggaggttgcagtgagccgagatcgtgcgccgctgtattccagcctgggcgacagacagagccagactctgtctcaaaaaaaaaaaaaaaaaatatatatatatatatatgtgtgtgtgtatgtgtgtgtgtgtatgtgtgtatatatatgtgtgtgtgtgtatgtgtgtatatatatgtgtgtgtgtgtgtgtgtgtatatatatatatattagccaggcatggtggtatgcgcctgtaatcccagctacttgggaagctgaggtacaaaaattgcttgaacccaagaggcggaggttgcagtgagccgagactggccactcacttcagcctgggtgacagagcgagactcttaaaaaaaaaaaaaacaatactaccttttatgaacactcctaagcatatcagcaaattcatacccaattatatcagaattatgggccgggcgcggtggctcacgcctgtaatcccagcactttgggaggccgaggggggcggttcacgaggtcaggagatcgagaccacggtgaaaccccgtctctactaaaaatacaaaaaattagccgggcgctgtggcgggcgcctgtagtcccagctacttgggaggctgaggcaggagaatgatgtgaacccgggaggcggagcttgcagtgagccgagatcgcgcccctgcactccagcctgggcgacagagcgagactccgtctcaaaaaaaaaaaaaaaaaaagaattatgaatgtcaaaatcacaatgcctttggtatatccgatttcattttaaataagtattgcaaagaagtcatcaatcgtttgtcattattgtaagcagtcaaggaaaaacatttgtgggatactcaactccgctgggcactatgcttcgcaatttaacttactggaagtgcaagggtggcagggagacagagaatctcagaaattgttttctaattttcttttcagacgatgtgactcaagcgactccagaaacattcacagaagatcctagtaagctacacttttgtttgtttgtttgtttgctgttttattggggatagataaaggatcatgtctacataaagaaaaataaagacttcagaagggttggagggtgctctgagctcatgcagagttctgttgtcaccttagatgccagcatctctgtacgcatgcccagtcttactctctcttccatttctttctgcgatagtccctcatctgcccgagtccacaggctttcacttcagcctttcttgcctcctttgagatcatcgtccccttatcctgctttccttagctacttttcctgactgcattttttcattccttgttatgtgtctttgcagatctggtgaatgatcccgctacagatgaaacaggtaagttttaccgcagttaaaaaaaaaatggcatggttcttgttaatattcacaatatttattccagctcttgaattcattctgtgcttttatatttgcttttgttttttgttattgttgtttgtttttgagagggagtctcattctgttgcccaggctggagtgcagtggcacaattttggttcatggcaacccctacttcctgggttcaggggttcaagtggttctcctgccttggcctcctgagtagctgagattataggcacccgacaccatgcctgactaatttttgtatttttagtagagacgggatttcaccatgttggccgagctggtcttgaactcctggcctcagcctcccaaagtgctgggattacaggcatgagccacagcgtccagcctgcttctatctttggatactgaggttgtgagagtgttgttcagtgacagtgctaattttttttttttttttttgagacagagtctagctctgtagcccaggctagagtgcagcagcacaacctcagctcacagcaacctctgcctccagcattcaagtgattctcctgcctcagcctcctgagtagctgggattacaggcgcctgccaccatgctaatttccgtatttttactagagatggggtttcactatattggccaggctggtcttgaactcctgacctcaagtgatccacctgcctcagcctcccaaaattctgagattacaggtgcgagccactgcgccccacccaggactaatattctttaaaaaaatttataattatttaattaattctattcccttatacataaaacacaaagccagacatagtcttccacctgccacggtatctccattctcccttttcttactctgccttgtgtttgcaatttgaagccctcctcatacctgctgttttgtgccttttcagttttggctgttttggctgatattgcaccttccacagatgacttgggtgagttcagatctgggacccccaggtcatcagggccattctaggctttccccagagcccattctggatagtgtgcagctgctgaaggatcctaaaaagacaggatgacagtttatggagcacatatttccagtagttcaattcaaattaatgacattgttgaacacctgacaaacaggaactgtgctaatctttctctcaaagtttcaagacttgatgggtaaaggcaagataaaagtataaacacgttttggaggataaagggtagaagaagtaatgctttgactgaatttttttttttttttttttgagacggattattgctcttgtcgtccaggctgcagtgcaatggcgcgatctccgctcactgcggcctccgcctcctgggttcaagcgattttcctttctcagcctcccaagtggctggaattataggcacctaccaccatgcctggctaattttttgtagttttagtagagatggggtttcgccacgttggccaggcaggtcttgaactcttgacctcaggtgatccacctgcctcggcctcccaaagtgctgggattataggcggctagattattttttaacaaatcattattgaaaacttgctactaggtgccaaggatataaaagtgaacaaaactgattttcttctactagacatcttttgtgtaatatacaagatagacaaataaacagataactttattcagtttcacaaaattcgataatcaggataagcaagagaagctatggaagacacagaaagagttcttgactaggttcggtgctgggggtgagaaaaggttttttgtggagggcacatttgactaagctgcttcctgaaagacaagtaaaagtgaactaagttaatagaagagggaagagcttttaggtaaggaaaacaatataaatcaaaaggtgtagggtggacacgaaaaccaaccagagagacgtttatgcaaggtaagattataattagatttgtgcattggaaggatcacaccccacttccaaaccccctactgtactcccagggcagtgtggaaaactgatttgaccgtgattgatcgcctggaacccggaaaaccagcagggccactgttgcagtgttcccagtaaaagatgctgccctgaatcaaggtagagatagggagaattaaatgtgagctataagggagaggggattgttgagttgacatccagttttctttttcttttttctttttttttttttttgacacagagtcttggtcttgttgcccaggctggagtgcaatagcgcgatcttggctcactgcaacctccgcctcccgggttcaagcaattctcctgcttcagcctcccaagtagctgggattacaggcgcccaccaccaagcctggctaatttttttgtatttttagtggagacggggtttcaacacgttggccagactggtcttgagctcctgacctcaggtgatccaaccaccctggcctcccaaagtgctgggattacaggcatgagccaccacgcccagccatgacatccagttttctagatgtggctattgggtggatggtggtctcattcactgtataacaactagaattagtgaagggaaagataattaagtctgttggatatacattgaatgtgaaagatctttgaaatattcaagaactcttccataaaaaggcagttggatttataggtctggagtttaggagagagatgaggttggaaatacaggtttgggaattatcagcatatacacctgcctagaaaccatgggatagatgagatctcataacacaggtcctagtattctatttgcaacacttccagtgacattttccctggtaactcccctgactagtctattcatctaactccttggcttgttcttcattctgtgaataaggcccatgttaaatttgcccctaggttaggatgactctcattattctttatttatttatttatttatttatttattttgagatggagtctccctctgtcacctaggctggagtgcaatggtacgatcttggctcactgcagcctctgcctcccaggttcaagtgattctcctgcctcagcctcctgagtagctgggattacaggtgcacatcactacacccaactaagttttgtatttttagtagagagggggtttcaccatgttggccaggctggtctcaaactcctgacctcaaataatctacctgccttggcctcccaaagtgctgggattacaggtgtgagccattgtgcccagctgaccctcattattctttacccaacagcttctatcaagagaatttatgatgatgtatctaatctacagaaaataaattttctcttataaggaagagcttgtacaggataataatcttttctctgcttagctctaggaagaagctcctctgggcatgtaactctttgccttgtgttcctactaaatttgcttcttgtcaacaatacagagatactcacaatacaatgaatttctcaactctttagaaaggaaaggagaaaggaaaaaaatcccatcctgcctcctaatgtcttcaattttgtggagcaaatcagctcaataagggttttcttttagaagttgctaagagttattaattcatttgctccctatttatgggcactccaagcaggtcctaagtgaggcagtgtggcagttacagaagtagtaacttctagaattggtaacagtggaataaaatttctgcctttcagcctccctcagtgaaaaaaataccactgcaggtatgattgttgcttgcatgccttcttaagcctttttttcttcctgtggattccttacctccttgttctttggagggtacttggcacatcttctagtttacttccaattatttctcaaagagtattagtgttcttcactcccttactcttttttttaaaaaaatgagcacctgtcataaaagtcaaggggaaagaatggaacaaatgttgcatggtccccaaatagccctctccctaaagtacccttgcacattatgtggtggttagtggattgggaagtgaaatcaatttaacttcaaggactccatattaccacggaggccatggttaaaattgcatttcctaatgtactgataattctgatatatagctagggttgaaaactactggaacagagaaatagcaacctgcctaagaaatctgattctttcagaatgggattatcagcatttctattttattttactattttgttttattttattttatttttctgagatggagtctcactctgtcacccaggctggagtgcagtggcgtgatcttggctcactgcaacctccgcctcccaggttgaagtgattctcccgcctcagcctcccgagtagctgagattacaggcaactgccaccactcctggctaatttttgtattttcagtagagacggggttttaccttgttggccaggctggtctcgaactcctgacttcaggtgatctgcccgcctcgtccccgcaaagtgctggaattacaagcatgagccaccgtgcccagcctattttatatttcataacggacaattctagaaagactttattcctagaagtgctctcagagattattttatccacttctacttccaagtagggaagcgccaaaacttcatttagtcaattccctcttgctgtgtttttggtggacggaaaggatgtagcccaatttataatgattctctgtagagattactctgtatttttttcctactctatctatccttcccaattccttcaatccttcatttatgctgcttctatttggacctccttatttttttgtattgggcttcctcagagtgctgggatgagaaatttacctgcacaaggctctactctgtgcatcggccggttaaacaatgcattcatcagttatgcttcaccaggtaagggatcccagaatgcccaaaaagcatcttccatggtagtgtttctgtgttgataactatttaatgagcacccactatggaattgcaaactttgatggggccaaagtttttagcacaaccctcctagttattgctgaatgtaccaactagaacctggagtatgggctgaagtgtacaaagaacaggcagagtaatagaacttagaagggaaatgaaggtgggcgctggaggaagaagggtcatgagggaaatactggcatgctcaatttattacctgatagaaggagactgaagagaatggcccagctctaaggtagaaaatagtggggaggaatattaagcctgactttaggtagagtgtgcaaagtgtcactaagaagaataactaaaacaatggcctttgcaacaacttggatggagctggaggtcattattctaaatgaagtaactaaacaatgaaaaaccaaatattgtatgttctcgcttataagtgggagctaagctatgaggaggcaaaaacataagaatgatataatggactttggggactcaggggaaagagtgggagaggaatgagggataaaggctacacattgggtacagtgtacactgcttgggtgacgggtgcacccaaatctcagaaatcaccactaaagaacttatccatgtaaccaaaaaccacctgtacaccaaaaactattgaaataaaatttaaaaaacagaagagtaattaataccattccctcccctattttccagttggggggcaaaagtctgaaatacttaagaaaatacagttggggaaaagcagatagggaaagtggggaatatgagagttgaagaggcatcccagacccaggtgagttctcctctcaaggctttcttccatctccttccttgcctatgacactgggacgtctgcagtttacgacgtatgtacatcgtcaacaaggagatctgctctcgtcttgtctgtaaggaacacgaagctatgaaaggtaagatgatgtctggatgtttaatggagagaagcagttatgagaagggtagatagggacatgatattactatatccaaagtctggtactagaggagggcttcaggctacccccttagagtccatcagctcctgctggaagttatctcaaataaacaatctacataaagcagtatgcttgatatacaaacataaccctaagaaaagtacccctagatccctgtcctactagattgtaaccccacagtgtctcctacttagagagctttctgacactctggctattttaaagatcattcactggggttctagggaaaatttcaagtcagccattacagataatagactctgctagtccgcagccatgttcataactaaaaataaaacatacacacgcacatgcactaatttggagacagtaaggtttggatagggcctataaataaaaaatagatgggacatttagaaatcagctatgttataaatagttcaccaattccaagaacaatgaacatttcttactgtgacatttcaggtagaagaaggtagaaagatgttatggggcaattacgagggcccaaaatgtgtggttgtagaccatacatggtggaaacaaagatactctcaccttccccatggccagccccgaacgatggctgtggttggtgaaaacaccacagacaaagccatttctgactcagcagcccgctttgtgctgagttcctgagtaagagctgtagttaacttcgcagaaggaaacttgctgtgtgcccccattggctttgtgcaagccacctgcaagggaagcaccttgagattgaggatgggtatttgggactctaggcactttcaagtatctcaagggacttcctaaagttagctgtttgcccatagtaagcacgtaaatgtatactgaatgattggatctcatttttctatttaatagatccatgattagaagaattggcagctggatatataaaggaaactaacatttactgctcacctgtgctaggtactttgcatacatgatttcattttaatactcagaaatatactgttgaggtaggtattttaattctcattttacagaaagggatagtgaggtttataaaatttaagaaactttctaggaagtggcaaataactaaagtaagtggcagagctggttaaaacccggatctttttctctccaaccttttcactacaccacactgaaaagtcttctctatcccttaaaacaagagcctttgttatcttctgcattctcttcccatgatgttctgcttctcttctagatgagctttgccgtcagatggctggtctgccccctaggagactccgtcgctccaattacttccgacttcctccctgtgaaaatgtggatttgcagagacccaatggtctgtgatcattgaaaaagaggaaagaagaaaaaatgtatgggtgagaggaaggaggatctccttcttctccaaccattgacagctaacccttagacagtatttcttaaaccaatccttttgcaatgtccagcttttacccctactctctactttttcacccaaactgataacatttatctcattttctagcacttaaaatacaaagtctatattattgcataattttgctgcttctcaatatcatagacacagtgaatagatgatgactatatggcttatatacaaacattctatgtacaatttcaagggagactaaactttaggctaataatctttactattgaatctgtctgatatagatcttagggttgaagaagctatctttgtctatttgggctaaccatagaatttcatttattttcctcacaatattttcctagaccaactccccatcattcacgtgttcctctttactcttactttaactattttgctggcttgcccgaaaatttgcctggcaagtcttccttataagacacatcatggtaagttttgtagtcctgtaagattctgcaacacagtcaagaattatacaatcctactagcaatatataaggacccaaaatgtcttctgctaagctcagaggctggggctaaagcatgaggactatgccagctatagaacttggactcataattcgctatccaatttttcatgcagttgtctagtcgggaagtaaggttggaaactaagtctcatttactgattcgtttatgggtagtaccgggatgaacccaccaccacaaagcaaattagacaacttaatgtgaaatcataccattggttgacgtttccttgagttgctacttcgttcatcttcacaacttaacaagtgcacggtcgaattattgtgcaagtggcttttggatatcctgattggggcctaagaagggcattcagacttgaattttaataggcagacagaaagtttgcctaatagttaatacgaaagagtgaaagaaacacaatattcagacaacccacattcttatcctggctctagcagtaaccacgtagccttggataagccattttccttcattaggtcctggtttaatttcctcatctttaaaatgagaaggttaaatttatcttagtactgctgggcgcagtggctcatgcctgtaatctgagcactttgggaagctgaggcgggtggatcacttgaggtcagaaatttgagacgagcctggccaacatggtgaaaccccatctctactaaaaatacaaaaattagctgggcgtggtggcacgtgcctgtaatcccagctactcgggaggctgaggcaggagaatcaattgaacctgggaggcagaggttgcagtgagccgagatggcgccattgcactccagcctgggtgacaaaagcaaaagtccatcttaagaaatatatatatatattatatatattcttagttctaagatttcctttaattctatgattctctggatttaaatgcattattcatatttcttgaagcttagatacagtctaattcatagcaaccatatctgctttatcctaggtgagggtagcagtccacaatggaatagaagaaaatcccattataacaaatgacaaattatatatcatgaatccttctgtctgactaactcaataactttctataaaagccaatggaattcaaataggagctaggagacaacaagttatatatgacagtggaggttgtattccttttatattgctgagaaaactagttaaatgatcagattcttgctgttaagaaacaatttcgtttaatgggatctgtacaactgattttaaaaaaatgctacaaaaagccccaaagcatataatctctactccttacagtctctagaattaaatgtactcatttagacaacatattaaatgcatattttagccactttagagaaacctcataggcacagagtttccaagattaattttaagaatatcttcacgaacttgaccctcctactccacattgcaacatttccatcagacagcatttcaattccagtattatgtatattgcaaattaaacattttaaaatatttttttccaatttatttctcaaaataaaatgtcttttgttctggttctttttctcttctatgtttacgaaaaaggcctgaatttatgaacttttattccactttaaaaaatgtgtatcagccgggcgtggtggctcacgcctgtaatcccagcacttttggaggctgaggtgggcggatcacctgaggtcaggagtttgagaccagcctggccaacatgataaaaccctgtctctaagaaagatacaaaaaaattacccaggcatggtggcgggtgcctgta

SEQ ID NO: 12245 - DNA, 113100 bp, Human
  misc_feature (1)...(113100): n = A,T,C or G
tgtgtttatatacacataaatatattctccaccaaatatacaatttggaactaatggctttgctgattgaaaagactgaaacttgtgtcacttcactaaagcatttcctaaaaacaaatgccataaagttaaatgtatatatggccaatgtatgctagaaaataaagggacatgtaggattttaaatcaattgatttttcagccatcagtttgagtaacataaattgcagactattaggaaactttggagaaatgcataggctcacagtaaaaggatctgagtggggaaaaaattaccttctagggaaagccaaaaagactgtagtcacaagagcagaatgaacatactgagacatcgccggggaggtgggggcagagcaagggtctctggtaaacaggagccactgtgagaaggatccaaggtaaaaggttcgagaaatcacagtgagtatttttttttaggttaaatgttagcaaaatgcttctgacaggcgtgtcaaacactgtatccgtggacctacagaggctgtttgtgttccaagagtagtgcttcttcattctgaggaagaatagggatttgatcacagaatttctgaactcagagttatgccacgtcttttggctttttgattggtgagaagtaaggcttctgtgaataactagcagataacagataacatccatttttgttgctggaatgaaataagacccaacactggcaaatttacattcatgataacggcctagagccacttgatttcctagtggagataaagaggtaatgttttatttgggggaagtggggttatatttgtcagtatatagtagtaaataacaaaaccaaacacatcgcgtagcgatccatgagcagtaatgataatatcttgaatttgtacagtaatttgtaaagcactagttaatcagagagaactttaaatcattagcttcattttccagaggccctgggccagggacgtctgacagatctgttcaacgtcatagaattaactcatgggttgagaggctgggcctagaatctgggcatactgcttccacccagtgtgttccttggctcgttgagtgaccaaagcaccgcagtcacccagtctacctctagattatagactcatcaaacaattgaagctgcagagcaattcatttttaaatgacttctaatatgaagcactacacaattatcagtatgcccttaccacatagaactgggacctatcttgtttttccacagtagaaagcattcagaatcaagacagtgcaagccaccttctccagttccttagcaattgttctttaactgatttttttgctgcaactttacaactaaagaattactgttttataaatgaataaaacaaggtgcaagagaatggttctgatatgcacaactggttgatttgatgattctgaatgatgtgtttattaattgattcaaataattgtttttgacattttgaggattaaatttctggctagtttgatgatactaattacttattttaaaactcttaaacatcctacatatatataactctacagccaagtcagcttttggttaggtaaattatagagtgaaactgtatagagtgaaaatttttttcactttgggaggccgaggtgggcagatcacctgaggtcaggagttcaaaagcagcctggccaacatggtgaaaccccatctctactaaaaatacaaaatttagctgggcatggtggtgggtgcctgtaatcccagctacttgggaggctgaggcacgagaattgcttgaacctgagaggcagaggttgcagtgagtcaagatcgcgccactgcactccagcctggacaacagagcaagactccatctcaaaaaaaaaaaagtttattttaattgcagataaatagaaagtcatttatatcagtctttgaaatgcatgtcctaatttttatttcttagaggtgtggctttctgattattttgggagtaggttataatgaattgactttatcacacacacacacacacacacacacataatagaaaataaggataaatactaaaatgggcatttttctgtataattaacaatattgatatagtcagttaaaccaaatgaaattgccgtttttgtaggtaaaaaaattgaatattgtctatttctcatgctttattctgcttaattttgtttacgtgtttatcaagcttcttgtatgggattccattgtattttgaaaccaagctctcttccagaagaaaaagaaaatggaaaaaaaaattaccaatattcaaatattttgattgttcattattacagttttataggttgaggaatagaaagaaaaagcagaagacaaataaaatacctcatgtccaaacctgtgtgtggacactaactccacagcacagacatgtcatcactcaactccacttcttctgagaatagcgacacagtgtgcatgacaatgcctgccctgtatatgcacagtactctttgcacgcttctacttacataaggaatatttttctttaaaaaatactttccttaaaaacacatatattcttaaactaatacattctctttagaaattttagatgactcataaaagctgaaggaataaaataaaattgttgaatcttactactcagaagaaatcagagttaatattttagtgtaaattttttatctatgaagtaaacaattttaaaagctaaatatagagtctcatttagaaaatatgtattataccttgtgtaattttgtattctttacacttcacatgatattgtttcccaagtcattaaatattcttctaagtaaccagattagatcagcaatagttcacttaaaacagcgaacaagctgcattaaaaaccagccagagccttaccaaagagctgatgctatgaataccaatcatagcttagttgctgttccatatgttaatttaatttgacagagtaagagtctttgaagtcctaattctcttttgcatccaataaaccagtttttatagtgcgtgaacttttagacatcagcctgcagctaaactcatgtcgggaagttgccatgaggtcacacataacaatggcttggaggggcgatcctttggaagtcttgtgggagaggtgaggggactgtcaggggtcacttggggggtcagtgcctccgatgatagcatcttatgggcatacagatttgttgccattttatgtgagctcttgaaggttgatttctacagaaatgggtccacagtagcccagcaacattcattaataagtgtgtaggtacatctttgtgtttattcatgggctctgtagctttagaaggaaaaagctaagcacaagtgtcttgctagtatgttgtttcacttcccatacttcagcaagaaggtgactctctagtcttccctatcatcagcatttagaatccgggtggtgagttagttcaactcatagaatactcttggggatatttttgtttgatgctgattagggctggtggtacccactagaagggtagagggggaaagaaacagggcattagagaagaagatcataaagaaaaaggttaaaaataacaaattatgctaaacattaagttctgtagagtaaggattttaagtttttttattattctttgtttagattgtacgttctttgagggcagaaaccatgcttataagatattacaagtctagaagctgatgttattgtctaatagttattctggaggttcaacgtcaaatatagtgtcctaattgctacaaacattaaagatcaagaccctgtggaaatgggtttcttttccaattactgatcacctccagtgtgccaggacctgtgcaaggctagcatttgactccaaaggtgtatgggcattccctgtacctgaaaacgagtgggagccaagcatgtgaactgttaacttcaattaaaaggggttgctgggtgcggtggctcacacctgtaatcccagcactttgggaggccgaggcaggcggatcacgaggtcaggagttcgagaccagcctggccaacatggtgaaaacccatctctactaaaaacaaacaaacaaaaaatacaaaaatgagccaggtgtggtgatgcatgcctgtaatcccagctactcaggaagctgaggcaggagaatagcttgaaccagggaggcagaggttgcagcgaaccaagatcatgccactacactccagcctggacaacagagtgagagattccgtctcaaaaaaaaaaaaaaaaaaaaggtggggggtaaagtgctctgatagtcatatgctgagagttctgggcctctcagcgtttgtgcaaagttaggggatcactcaacaatcaattaactagcataaaagagcaattcagagaggagtctatgcccctctttggagggacctaggaggcctattctttggggagttcttcatcaatgacagcgatttgagaatagggaaccgaaagatagggtggccacttacaaggcacacaagccaacgtttagggaaattggtgattaacaggaaattattggacaagtgcttaatttttcaagtaaggatgtttctaggtaacaatcctgttgtggccgcatggttctgggaagtggtagacatgggattaagcagctgcactggatagtaatgatgtaattgggtttccaacataatttccagtccttctactgcttctgggtggtttcaacgactgtgtgacctaagtttcattttggcagtccatttcagctgtaccattgcttttcaaccattacaaaggtagcttgactctctttttacacttaattactcaaatctttgtcctttaaataaaattgagatatccgtagagtctgccaattaagcatttagaggaaaccacacactctttgtggagaaaagaaggccaaattagacaatcaagtgtaccaagaatttgcctaaatttggtataattttgttgaagattaatttattttcatggtgagttatggtattgcatgaaaagcacactttactttacttgtacctgactgtcaaacagccattacatgcgaagggcagcctgtatacaggctgggtttccccttcctgcttgggaacaggtacggggaactgttggcatgagttgttctccttagctcggcatatctcacacacatattgtagttctattctccagtctgtctgttctactcagtgtgatttcttactcatacattccaacatctctagatttttcctaatctcttcaaagtctcattcagttgtcttccagatatttcccttcacatcctttcttttttttcctttgcctttctctttgttattaccctttctacattttcaaaatgagtttcatatgtctccagttgttgctgggaagtagaattagatggtcctctcttcgttcatccacagccattttagtgcacagtgttaaaattatttgtttatgcatctatttcttccttgaaggaactttcatccttaatgtcttccttggcatctaatggggacttaatagatgcctatgtttttaaccattgtaattttagtaagaacgtttattctgctttcctgatagtcaattcacaaacagacttttgcaacccaactcccatatagactgaggagtttctgcaatgtggtcaactacagcaaaaggctttttttgttacaaaactctaatcttcatctactttggcccgacctgaattccactataattacctttacaacatatatcctaccatcatcttaaaaaggcttacttctgaacacatccgctggcagaagatttgttttgctttcttttctaggaaattgtagcttagcaaactatgagactgtctgactttaatttttcttactttctaactgttgatctaatttttttaaagtaaatagattacctttaatttgcttattatgctcaataatcacacattagcaatgtaataattttaataacagaaagtacatctaaatctctactgtttgtatgtaagtcccatacctgggagccacaatactttcaaaagtgcacatcaaagtaattgttttgtctggcgccagcacaaatttctgctgggaactgccccatttaatataaattatattacctgtggaatttaaaaggatataaggtgtagtgtgccctgcaggcaggaaatttaaactatggattgccttcttttttttttaatctctgatttattcctgtaatgtggaatatttagcatccctaatttccatttaatctttttacaggcatattttgaatttttcagtcatagggaagacaaagttagaaatgctattattctctcaggctaacttgagaatgaaaaatatctaaagctaagggtgaagtgggaaagagatgtcattatctgaaggagtctatttagaaaccaaccaaccaacaaagaaaaaaaagggatgatgaagaaaaacagggaactttgacctaatttaaccaaaaaccatcaagcctcaaacctgatgtctttgcctcttttttgcctatatagatgtgaatgtaggagtagcacatccacgggcatgaatatggagatataacctcatctctgtaaatccattgaacatagttttataccctgcttagaggaccaagatgttacattttaagcctgtaggagtaaacacatgcaaacccagctgttcaggtggagacctctggcttccacattcacaccctcggtgacctatttggctcacgtagtcctctcttaggagatggctgcatgcacatcgtcttggatgttgaatgtacagaatactttcactaggaccagtaaaaagggcaaataaagctaacagcacaaaagaggatatattgaaaagaggtagagaggaaggaaggagagagagcatacactagagaagaaaactagaggagctaaagaccaaagcaatgaagacgaggctcctgtccacctcccctctttgtgttccaggtggttcttacactcatttttactcagccacagctgaaaacatgctcctttctctgcccttagtcaggggaagaggcctctgctcagtctcttaattcagtcattgcctaaccattctcatgaaacaggtccccatcaccaagagcagataccttctccaggtctttttcttttttgttcaataatccaagtattctctcaaagactaatattgcagtcatgaacaatagtcactgctgaccgaggtactgcattaaatcttttatatctcacttaaaaatctttacaccgtactcactcctcacacctaccacatagattctgttgtcccaatgttatagattattgagtaagatgttctgtatctttagccatgaatatgaacgcatgtagttgataattctacataagattttgctgtttttcctttgctcctgcatgcatttctctctgttcggtgtctgtggtccctgagttttcatgacatcttctggtaggaacttggggtactaggtcctcagacactttttacagttttctcctttttttctttttaaaacatcttattagttcttggagtactgtccaactgaaactgaaatgcacatatccatagttttcttttggtttcttatatgtgtccttttgacttataaaaaaaagggggctaaataccctttgttccaagcgttgactgaattcaaaggcgcaaattcaactcaagtttttgaactgtatagaccagttagtagtagcaattagtagtcactgaatgccagtggttaagagaggtggtgtttagcttccttccaccccattctctattcacctttatcctttcagcactagagcccccacagattctgcagcaatgggcaagatctttgagaggaacaatattaagaaataagccttcagatatgcagaggacattttctaagcttaaaagctgatatcgaacaatagaactatttatttcaaaacgacactccatgtatccaactcaattggtatactttgatgacttacattagcatttaaagtacaagcaaattttagaagatgcctctagactcaagtgttggaggtagggagcagctggtctttgttgttagaaaaacagatattcaaagtttgggataacagatgaaccatctctaccacttgactttaaagttagtttttagataagaagatagcttaataatgggctggttgttgagaggatcagccttctaaaaaccttaatatgctttcagtcttccctggaaacaggtgatagggtaattagcatccacatcctctactcaacagagcagcttctctgctggcacattgcttggcaggactccagggaaagctgtgtgatgacagcaagattaagatccaggaagcaaagccgggtcatatgctctaagttgtccattccttctattctcttagcatgttcgattccacaaacacggcttattccaaaagccaatcctcctaatgagcattcggtcattagaattttcatcaataccaaacggaattacatttggggccccttttggtctttcttgtcatacctgagatgatgagatcctttattctctaagtgccccttatgcacacacagaaccagagcatccgtgtagaaataagaacttaccatggtaaatgatcagtattgttgaatctccaagatgtggggttcaccacatttaactgtatgtttattaacaattccattctaaaaattatgttacaagcatggccaaacagaaatgaaactatgatagtggcatctctatactaaaagtctactctctatggatctggccatatctacacttatagataatacgttgtatggaagttctagtgtcagagcttcaggctggtgatccctgatttagatactgtattaactatatctttccactagtctttctgtttatgttctctttacaatccccaaacacccaatagtttgcaacccttaccatacttcacagaatgattcttcaggtaaatgataaatattaaatttttaaatttatgcatattattttggtaagctaatcaaattttttatgttaaagtgaacttgatatatttttatattctgtcatttatttctccattaagtgcacagctttaaaaattttcagtgctgcaaaaataggccaaaaagtgtgacctcatctattttaaatttaaataaatgaatgaatatgcaaatgaaagaaagaatgtcccctgggagcactcttcatggtgggcctcagcaaaataaagaacaaaagcttctagaccttgcttcctgctcctgctctgtctagaacccttctgaaaatcatttcctccaatctgtagagtgtcaggggagtcttagatacttgggtcctttgcattgtcctgttcatgctgaattatcagttttatttagcagttataagtgattcacattgaagttaaaggaacaacctgaggaggtattgttcacagacagccaacactcagaatgtgattgaaagcataggttttgattctggaaagaatcctggatttggaatctattcctggatttaacgtcatgccatagctccatcagctatttactggatgagtccctcttcctctctggcccacagttttcacaagtctaaaatgtggattctcataggatgatcatgccaaatggggcattttagtttctaaaatgagaacgttattcatctatataaatataaagttaaaatagaaactgttttagggttgacaaaaactctcaaagcagtcctttagcacttctgtgcccctgctctgaggcaggaccactcttaaattcttccattcagataaaaaatctctattgtttgaaaacaccttcagaggagatgtggtaggaatttgcttcacaagcacagttacactagacgttattaaaacaaaaaggttttaattaattacttataatcatgagtctcttgttttctgtgtagttctccacacaacagttcttctgttcctccattccttccaccattttgtgctattttttccttctgccattttgtaccattctgcggcagtttgcctctccttccttttctctggtcaactccttcagtggtcttccccattttaaacaaacttcacttctccgcttttctccggggtcagtcatcttgacttctgcacaggaagaagatcccccagtcttcctcagccactgagtccaataagtgcaatccttctggtaaggaaacttgccttcttgttgcagttgaagcccattttctaatcttatttcttcagagcccatttcaaaacagctggttaccatcctttaggttagtccttcctagacagtacttcaaaaacattatatcacttttcagtcatttttatcaagcatgagttatagaacttcctttatccttttctcataaggtgtattattcagccttttaataagcagcagggtgtaattgaaagaatatggactgtgtagttagacctaggtttgaatctgggccgtgttactcactagctgtttgaccccactcagagctcatgacttctctgaacgtaagttccctcatctgtcaggtggggttcatgggacctgtctctcagggtccccatcacagctgatgtgtgtagtgttcctgatgtgtcaccagtgctctaagaagtgttggttacccttgctcttccctttcgttatactctcctctacatcagttcactatttcctggcacttatggagcctagggttgaacacaatgttgagaatttgaaataattgtctttattcatccccctgcaacatgctttttaaaaaatgttttggagaggatgtggagaaacaggaacacttttacactgttggtgggactataaactagttcaaccattgtggaagtcagtgtggcgattcctcagggatctagaactagaaataccatttgacccagccatcccattactggctatatacccaaatgactatgaatcatgctgctataaagacacatgcacacgtatgtttattgcggcattattcacaatagcaaagacttggaaccaacccaaatgtccaacaatgttagactggattaagaaaatgtggcacatatacaccatggaatactatgcagccataaaaaatgatgagttcacgtcctttgtagggacaaggatgaaattggaaatcatcattctcagtaaactatcgcaagaacaaaaaaccaaacaccgcatattctcactcataggtgggaattgaacaatgagatcacatggacacaggaaggggaatatcacactctggggactgttgtggggtggggggaggggggagggatagcattgggagagatacctaatgctagatgacgagttagtgggtgcagcgcaccagcacggcacatgtatacatatgtaactaacctgcacaatgtgcacatgtaccctaaaacttaaagtataattaaaaaaaaatgttttggttgtttgttgttgttattgttgttgtttttgagacggagtcttgtttttgttgctcaggctggagtgcagtggtacaatctcggctcattgcaacctccacctcccaggttcaagcaattctcctgcctcaggctcctgagtagttgggattacaggcacccaccaccacacccagctaatttttgtatttttagtagagacagggtttcaccatgttggccaggctggtctcgaactcctgacctcaggtgagccacccaccttggcctctcaaagtgctgggaatacaggcgtgagccatcgtgcctggtctaaaaaatgtctattagtgttccatcactagatctcttctgaggtattcatgccatatgccccatcctgatgtcatatccacaggacaatctactaccaagaaccagctccaagaagaaaacatctctgggaaacagtaccaaaaggagtcactgaattgtcattggaggagtccaggatagctcttcatgttattttcaccttgaggaattgtccattacatctatgagccttatgtgtggctttctccgatatagaaacctatcaggtgtcttttagatcatttcaaaacactggcttattctttcttatgtttccaactgaagtctgcatcccaagatgtagtttcactgctaccccatatggcacccttgtacgaatttgaaaaaagtactcactctaggcacatgcagagccatgcctgcggggacagcttagagagtagagggtgggctgaactccagttactctcgtacagggatccacctttttgcagaaatcacagtgtggctatggtgtggtttgatttcataaaacagatgcttaaaaagtattcactgtctctgtctcttcagtgccatgtaatatcacatgactttcctttctcattccattggtattttcctgtgtcttttatcctctgtgcagtttgtcagtaacatttcattcccagcttcagatgggctgccatgacttctgccagttccagctatttctttggatgcacctttgaatacctaccttgacttacatttttttgttttgtggagttactctttgggtttaaattttggacatttgggtattaacccaaatagattttgcttaaaatgtccacattctattaacagattcttagtaatagcaaattggcaaaatcaagatagttaattcatattaacgttgcttccccctcttctctaccacgcctctagagatgacttaactgagcatccaaatgacctaacccagggtactggagggaaagggggaatgggtgaccatcagtcttaaataatctacacactaataaccttcctaggaggtgagagtccagtcgttctaagaggagtaccgtgctgtcatccttgccagaaaagaagatccttttatactaggcccacaactttgaacaagtcccccacagaacagtaagggagtgcagtggaccattacattttccagggctcaaccaaattggttctggtgatcaatgaagctgcaagtctgaggcagctggttccatgttcagtaactgataggtattcttacattcatctcaaggaggtagaagaatactttaatataaaaaagtgtgtaaaaagggatgaagattaagaagtggaaaacttgaagataagccagaggcaaaatttcctgacagcatgatgtactggactgcagataggtcttttgatggatatgcttgaaattccattgttacatttatcttgtctgcatttttctgcatttatttctaatgtgtctgctaggccagtacctctctgggaacataatataaaaacaactattaagtaaatagaaaagcttaaacaatacgcatataactccagcttgaagcattttttaatgctttataaatcactagaaaacacgtgacaggaactattcctgatcagtcttaggatgtgcaggatgccccaagaagcttttcctgtttactacttttttgagtgtatgaatatatgttttttgactttgagatagttaatatccagaagagttctttggctatggaaatagccttgaaggcttgggtctgggaaaataatagagagaaagagttactagggcttagtagaagaattgagggaaggatgcagggaaaagcggacaataaatagaaagaggaagctggtgaaggtagactttggcagctggggcagcggcacttgggccgcttatgtgaggtagcccgcagaggcacctttgggtggagagagaataaaatctggttttgacacgtttgttttagatggcaatgaaatgtctagcctatatattttgtagacactgagaaataagggactgaaaagaggaagaggtgtcagggctgaagatggaaatctggggctcatctgagtataggtggtaattgaatccttatggctgcactaagggaataagtagagaaggaaaagatgggctaggagcccctggctgaaccccaggggcactaagtggtaatgcatggagggagggggagaagttaaaagaaggaagaaaaagcagacagaaatatctgaggagtcccagggcctaaggtccctgccactgaggccgtgagaatgttgagaaggcagcacagatccctggaacgggattgccgctaagaagttaagtaagaagccatggtgtttgacagcttccataaaagcaaatgacaaaagctaggactgcagagaggtgaaaccagggcctaatctggatctggtctggattgtttcctccatgctctctagcacagagctttataagacagtgttggtttaacgaatgagggagggaatgagggaatgactgaatcaagcaagtaagcagatatagaaacatgggcgttttcataaagcagagtactcaacagtgcctgtgagcatcactgacaggccaaacacataaaacaggcagaagggagaaaaggaattgagaaaaagaaggacaaggaagagacagaagggggaaggaaagagcagtaagaactgaaaaaggctggagtttcctggagtgtgcagttgtggagccctagatctgtgggtttggcccttactttgctcgtatctctagttgtttctttgacattcatcttgtgtctgtgatgaaactttaagtttcttagtaaagacaagaactactattgtgtatctctttagtacctaatacaattctacaagcatttactttattcttgataacaggtggagagaaagaaagcaggttttcagtaatttataaaagtgaagaattatctagaaatgtagtcagtgaaaacatccagttttgataagtcaaactaaaacatccattcttcactcagagtaggcttttaaacttggattttctaagtaatttactcaaagccctctctctcaaagaccctcttgtgaaatgcccttgtgaagtgcttgtgaaatggccttttgagttagctccacaaaatgtccttcctaatcttagcaaaatgaagaaatgggtcaaaatgatttgaaatatgcttctctgtctcttccttcacctctttttggtttcattttcgtaagagtacctgtcagcatttgcagaagaattaaaggcagtgtcgttctggagggaaatcacatgttcctttaattttgtgatggaaggacttataaagagaagtggagcttggttagaaaggggagatgtgcacataggaaatgtaagcagggctggtgagaaaacttggtggtggcgtttaattaattttgaaactgggaaatagttctacagttaatctgtaagtttttttatgttgaatgcttggaaaatttcaacttttttattttcagacactttgtatgcagtgatgacataaataagaaaaatggccttgaaaacatcaaaaatgtaattttcaccttcttatgctttaaaaacacctgaatgcacttttctcaaacttttaagaaaagaaacaaaactcagattttggtaaagatcaagatgaatggtgttgacaaatttcaggaggctggagagtctgaaaatagtcttatggatgacatctgtatgtaactttttaatgctctaccacagatgctcccataagggcaacagagaaatagctggaaaaggtaacaatgttacttattttattaaatacgtaagaattgtttgcatccatttcctggcagtatttcctatttttaggagtgaggtgaatgatgttgtagagctggagataccagtgggctgactacaattttcaaagcaccttgagatgtaaaaaaatgtttctgtaggagggaaggggtacggttctgataaatctctcagcaggatgaaaaagaaaagggaggtctagacagtcttgtttcatctaatagaattttcccacagaagatgggcaaacatcagataagaacatttatcagacctcacacattttacagccatatccctttgggaacattgcgcagcatagacttgctaagtcctgaaaatggaagacagaaagcactataaaaaatatggactggcgccctgaaaaaccagtctttattactcaccctaacatatacatttggcattttggtgtacttgttaaatgatacataaaaccgtatcactaatgaaaatacagcagtagtccatgagctcttggctcaaaagaaagcaaaagtaaattaagcaaaatatctactttaaaaaaaaaatggtagtagtcccattggacccactttcctattctgctcttgcctgattttcataacagtgggtgaatgcagagatgctttagtagtaagtgcaggtgatgccagggcagatttttgccaatgaaataagaatttaagaaaaatgttaaattcatgtaatgttatttcaaaggctaatccaataattcttaaacatttatgtaaatctgccattttctcactctggaagacagataaagagaaccacgtgagaagatatagcatgttctattacttgccattaaattgataagaattacaatgtctgtgaatccatcaataccactgaaggacatgcagtggaatcaaataggtggcagaatagctatatgaatcacataatataacaaatcttttcaccagatggtgttcagatttgctgtttatttgtggcttatttaatattatcctgcttttcctcaatccacaaaggattcaaagcttcttacaaagaacaccttgggcctcaggcaaccagtttttaatgacgaaagatggactctgaagtccatgacatttagtaatttgtcacttttcttgtgcacaaagttgaattctggctccgggaagctgatgtttgggagaaaatcatttagttgtggatgaagtgagccaatacatagctggtagtcccaatatgacttgtttgtttcctaatttgagtttacatagtaactcttttaaagaaacaaaaccattttttagtggtgggggagttctttgtgaaaatagccgtgaagtgagagatgagtccggggtagaagctggaaaaggagttaacttgcagtctgaggatgtgcacaggaaacgcttgcctctagatagtaatacagtttcaggagagatctccaaacctgagtgaactatttcctggattcttaagtttagagactgtgaatctgggggcttgccaagtcctcaaaaacatcaagggcctactaaaatataatagaaaatctagaataaaaaaagagaaaaagacaaggaacatgtagatttgtttagaatgcgtattttaggtgcaattctcctattaccaactgatatggtttgcctgtgtccccacccaaatgtcaactcgaattgtatctcccagaattcccatgtgttaggggagggactcagcaggaggtaactgaatcatgggggccagtctttcccatgctattctcgtgatagtgaataagtctcacaagatctgatgggtttatcaggggtttccacttttgcttcttcctcattttctcttgccactgccatgtaagaagtgccgttcgcctcccgctatgattctggggcctcccaagccatgtggaactgtaagtccaattaaacctctttttcttcccagtctcaggtatgtctttatcagcagcgtgaaaacagactaactaatacagtaaattggtaccaggagagtggggcattgctgaaaagctacctgaaaatgtggaagcgactttggaactgggcaacaagcagagattggaacagtttgaagggctcacaagaagacaggaaaatgtgggaatgtttggaacttcctagagacttgttgaatagctttgcccaaagtgctgatagtgatatggacaataaaatccaggttgaggtgttctcagatggagatgaggaccttgttgggaactggcacaaaggtgacttttgttatatttttagcaaagagactggtggcattttgccactgccctagagatttgtggaactttgaacttgagagagatgatttagagtatcttgcagaagaaatttctaagcagcaaagcattcaagaggtgacttgggtactgttaaaggcattcagtttttgtttttgtttttgttttttgagacggagtcttgctctgtcacccaggctggagtgcagtggcaggatctcggctcactgcaagctccgcctcccgggttcacgccattctcctgcctcagcctgggactacaggtgcccgtcaccatgcctggctaatttttttatttttagtagagacggggtttcaccatgttagccacgatggtctcgatctcctgacctcatgacccgcccgccttggcctcccaaagtgctgggattacaggcgtgagccactgcgcccggcaggcattaagttttataagggaagcagagcataaaagtttggaagatttgcagcctgactatgtgatagaaaagaaaaaaatctcattttctgaggagaaattcaagccagctgcagaaatttgcataagtagcaaggagcctaatgttaatccccaagaccatgggggaaatgtctccagaccatgtcagagaccttcacggcagcccctcccatcacaggcctggagatccaggagaaaaagtggttttgtgggccaggcccagggtccccatgctgtgtgcagcctacggacttggtgccctgtgtcccagcagctccagctgtggctgcaaggaaccaacgtacagcttgggctgtggctttggcgagtggaaaacccaagccttggcagcttccaagtggtgttgaatctgtgggtgcacggaagtcaagaattgaggtttgccaacctccacctagatttcagaagatgtatgaaaacacctggatgcccaggcagaagtttgctgcaggggaatggctctcgtgaagaacctctggtagggccatggggaagggaaatgtggggttggagcccccacacagagtcccaactgggacactgcctagtggagctgtgagaagagggtcaccatcccccaggccccagaatggtagatctactgacagctttcactatgtgtctggaaaagccacagacactcaacaccagcccatgaaagcagctgggagggaggctgtacccagcaaagccacaggggcggagctgcctaagaccgtaggaaccaacctcttacatcagtatgacctggatgtgagacctggagtcaaaggagatcgctttggagctttaaaatgtgactgccccacaggatttcggacttccatgggccctgtaacccctttattttggccaatttctcccatttggaatggctgtatttacccaatacctgtacccccattgtatctaggaagtaactagcttgcttttaattttacaggctcatacacagaagggacttgccttgtctcagattagactttggactgtgaatttttgggttaatgctgaaatgagctaagactttgggggactgttgggaaggcatgattggttttgaaatgtgtagatatgagatttggaggggccagaggcagtatgatatggtttggctgtgtccccacccaatgtcaactcaaattgtagctcctagaatttccatgtgttgtgagaaggacccaggggagataattgaatcatgggggccggtctttcctgtgctattctcatgatagtgaataagtcttatgagatctgataggtttttcaggagtttccgcttttgcctcttcctcattttctcttgccaccaccatgtaagaagtgtctttcgcctaccaccatgattctgaggcctccccagccatgtggaactgtaagtccaactaaacatttttcttcccagtcttgggtatgtctttatcagcagcatgaaaatggactaatacaccaaccttgggaaacttcattgcctgaccatttccctagtttcttcaattggaaacgaggggaagctgctcatccccaccaattgttgtgccccaaagaagggcagcgtggtcctcctgctaatttagttggtaaacttgggcccaatcaagtaaaaaaaagaagaaaaaaaaatccctatggctattcttaaagaagacccctcaagaaataaaagaacatggttctgggtcctttcccactcccaaaggagagcagctccatttttatgatttatataaaatgatgttctgaagactgggggttaggggagagaatgaggaagtggaatgtttctttgatgaaggaacactcaccacccactaggggcttccctgtgttacattcagactattgtcagttcctgggctttcagggactaagctggtacagtagtgagctccccttgccagctacagcactggaccagtccaacaaaatatattttgaggctgaagatcaaacaacttagtgaataatggaagctcctgtaggctcctgtaccctgtgggaacctagaagagtatggtaggacagcaacataagagccattttctggcttcaaatgggagctctagggctctgattggagatgccagactttatcacccgtaagaaagtcattctcgccgggtgcggcagctcatgcctgtaatcccagcactttgggaggcagaggcgagtggatcacctggggtcgggagctcgagaccagcctgaccgacatggagaaaccccgtctctactaaaaaatacaaaattagctgggtgtggtggcacatgcctgtaatcccagctactcgggggctgaggtaagagaatcgcttgcacctggcggggcggaggttgcagtgagccaagagcacgccattgcactccagcctgggcaacaagagcaaaaccccatctcaaaaaaacaaaacaaaacaaaagaacaaacaaaaaaaccaggaaagtcattctctgacccacccccagcccaccttgggaaggatactatttaatagtgacttaaattcctcttagggtagggaaggtccatcttgtcttggcttattcagggcagtggaagctttacccacttcctactcttcttcatgttattgaagcccagttaaaatgaaccaacttagaatataaaattattttaatatttcttcatctgacttctaatcccattgttctttttgctgtatctgaagatagtcccaacttctcaaatatgttattaatttctgggctgtaaaatgaatatggaagagggactcaaattttgtaaatgctgtggggttacaaatcaccaattgtcctctgcctctgtgttgcctcagcctaccgcaagacctccctacacacacacacacacagacacacacatccctgaagtcactctaaatatcagtaattatgaagttggccaggcacagtggctcacgcctgtaatcccagcactttgggagactgaggcaggtggatggcttgaggtcaagagatcgagaccatcctggccaacatggtgaaaacccatctctactaaaaacgcaaaaattagctgggcgttgtggggcgtgcctgtagtcccacctactcaggaggctgagacaggagaatcacttgaacccaggaggcaccggttgcagtgagccgagatcctgccactgcactccagcctggcagtagagcaagactccgtctccaaaaaaacaaaaaaagtaattgtgaagtctttggcaacttcctgaggccttccaactctctcccagcctttcagaacaggtcttcctattttcttccatccctcttctgccgttctgtcatatttctagagtggggctggcaataaaactatcagagaagagagaaaccatatgttctgaggtaaaatttaacagaataaagaaatttccagcccttgaaaatgcccagaagcttccaagcagaccctccttaaaagtttccatctactgtcttttattaaaccctggtattcctcaaatgtgaaattcctttctgaattgttaaaatatttttataaataaaaaaactcaattaattttgagtagctcaaaagtatcttttctacaatttctaaagtaaagatgctacattttaggttataagtttttgccaccaggtgtgactctaactattcttcatatcttttgttcgctcaaacgtgtcccaaatttgaaaaaaattgacttttggacaatttctaataagcatttgggtggtcctgagcaggaggaacttctagtttgtgaagtagctaaggaaaacatcttaggcaatttttagttccaagaacttagcctgaccaagtaacctgacttgcagcttaggcgtttaattaggagcaatttggacaccagagttccgattctgctcttggtgccatctttttctttggggaagtgttctgcttacagcctatattttgtgaacatcgtttcctgtatatctttgtgtctaatacggcacttcaaacatagtaggcatttggaaattgctccctgaactgaattaaatgcaaggttaattcatggttgtacatgatcagagttggagtaaaaaatgaaataaaatgaaaagcactatcaattaatcaggttaagtcatgtcaagcgatcattaagttttcgatgatcttgcagatctttgagagaatgcggatctcgggcattttcagttgtgtgcactgacacgtgaatgtgtgtgtgccctcacataagttcttacatagcagaaggaaggaagttgtgaaaggggagaaaatagagctattgactgcagagccataaagctgtttttagaatgactgcttctgttgtattggggaacgcttcctttgagagggggtatattatgcatcctctttccattaagtctatttttggaagaaattacagaagataatatattaccagctcccagggatctcttatcaacatagcctctgttctcataacacacctgcttagagcaaaataaattattctgtcctcaggaatgccaaccccagacaatcaaaatcttcactaaatccctgtatttattagggaagctcggatttttgaaaagtgttaactccgcccctaaaagcagtaagcgagagataacaacagtggagtcttgtggttgagcattcaatcagcttcaacaggggcaaagtctaggaattgttttcaaaacagtgtggggcttcctactcagggggaggatttatctgcatttggcaattactccagttaccttggaacaagaaatttacttctcagtagttttgcaaattaagtgtttaacttcgtctctatagaattaatgcctcggaggtggggagagggaggcagaggagaggctttcaaggccagttcacaagtttgacacttaaagtgatagtagcaagtttttctctaactgcaagagtgtgaagttctgtttccacctaattgcagtttgcatcctgcaagtgtattgatttagacattaaaacaacttaaatgtttagcagtaaaaagttgtttaatcattaaaccactaccattttctttcgccctttaaacctgctttcaatcagcaaatgctgatttggatgctggtttacagtctcattaaccatgaagatcacaaaggaaaggttgtggcagcagtgggaagctctgaagcaccctcattgtcacaggaaacattcagtgagacattcagctgtctcacaacacacacagctctgagagaggtttgggtgacagaaatgcagcctccagttccagaagcagcacgctgttcattccaggaaaggaaaaaaaaagtgcttttctgcgtgaccatgttgatcactgttaccatgcagtaatcaggggtctttttgccacttaagtgtaatgggaggagggtatatcattggagactcctaggtgaatggcgtggatgttactcttttgcaaagcaaggaggagttgcagtgtttcatggccttctttcaacacacgggagttttatcactcattttaaacgcacaacttaacaccattttcaaactgagttccagccctggattgtttttttacaaaatggcccctttcccctcatagtgggatggccatgggtgcccattaattgctacacttataggaactgaatttattcccttcatggtagaaaaaccaagcctattttctgaaacttaatcctgtgagctaccatccacggccataccaggctccaggaagggatcacaactttctgaagagatgaattgctgctttaacaaaggctacgtgtgccttttgattccatattctgcctccactagatgtttggttttgctgccaaatataaaaaccacactggaaaagacagttcttcacttttaagtggctgtgtgatagaaaattggtaattagttcagttttgaggaagacagggacaaactcttctttacgttttataaaatcacaaattatgacagtgatctccatttgagatggagaaatggaaacctagcaagttccagagacttgcccaagatcttgtagctaattattagaagcaggaaatgggttagaaaccagaaccctgatttacagctaattgtattttcggctatccaaatatctttactggattaatacaaacttctcttgtcctcaggtaatacaaatacctgtcctcatagaaaataaaggcttattggtctgtctctttctctctgtctctctctctctttgtatctgtgtgtgtgtgtgtgtgtgtatatatattttttatatatgtatgtatatataaaatatgtatgtatatatgtatgtatatacatacatatttctgtcacccaaaatatgtatgtgagtatatatatatatatatgtatgtatgtatatatgtgtatatattatatattttataaagatatatattcaatcatacattgcttaacaataggggtacattctgagaaatgcatctttaggcaatttcattgttgtgttagcatcaaagagtgtatttacacaaacctagatagtacagcctactgcacatctaggctaaatggtgcatcccattgctcctaagctacaaacctgtacagcatgttactgtactgaaactgtaggcaattgtaacacaatagtaagtatttgtgtatcaaaacatatctaaacatagaaaaggtacagtaaaaatacagcataaaagattttaaaatggtacacctgtatagggcacttaccatggatggaaattgccagactggaagttgtggttgctctgggtgagtcagtgagtgagtggtgagtgaatgtgacagcctagaacattactgtacactatgcagactttgtaaacacagtacacttgggctacactaaatttataaaaaatatttttctttcttcaataataaattaaccttagcttactgtaacttttttactttataacctttaaatttttttaacttttttactctttgtaataaaacttcacttaaaacacaaacacattatgtagctgtacagaaatatttttctttatatctttataagcttttctctattttgaaaattttaattttttttaattttcaaactttttggctaacaactaagacatagcacacacatttgcctaggcacacatagggtgtggatgatcaaaatgtcagtaggcaataggaatttttcaactccattataatcttctgggaccaccaccatatatgcagttcattgttgagtgaaacgtcattatgtggtgcatggctgtatttatatccgtataaagattacacatatataaaggatgcaaagacaaagagtacatatatatttatatatgtagtgtactgtatatatgcatgtatgtatgtatgtatgtatgtatcttactttgggatttccttttttctaaccttcttaccattttaagaattggtctatgcacagcaaacttttagaatcgcaattaaaatattcagagaagtggccaagtttttgtataggtgtttggatactgtgcagacaagttctacatttctctgttctcaaaactccttcctacataaatactgaggactgttctctggccaaagtttgtcaaaccatttctctgagtaacaagacttcctcatgttttccatactctatagttcagtgttgcagccttcccatacttgatttttaaagcggagttttgttttgtttgttcttagtgcattatgactataaaatgtaaaaacctttcctctttgaagataaaaggaagtaatcctaattttaaacacttacttgttttaaaaaattgaaaaaaaagtatcgacttgatatgtctaaagagacctatgtatatatgtattagatatttatatacatacatatgtatgtatatatgtaatatatatcatatatatattttagaaatctgcaaatttaaaaagggagtgtttagattgcagaagacctatccctaaaccccgaatcccagaattcttaagctagaagggcacttgagaggtgatctcatctataaagagatgtatatttaaggagctaatttacacaggtagatgacaaaaccttacaccaactcttcaagcacaggaagcaccttacacgaaacactttggtgaatgctcatttctactcaattttaaactaaattcaactgaaaatacctcattttaaagaggatattcagttgactcactggggaaaaacaattggataaactggttgtttgcccttaccgagataaaatcactgataagttgaatgcatttttgtaatgtgtcaagacagatggctttaatagtcacacatattaagtatgggatatgtggcgaggaatagaggtttttatatacagaagtaagaactgtagaggggggaaaccatgaaagatagaaaaagatgagaagaaagaggacagagatgatacactcaagaaaagctgcctatttcagagtagaatatattgtaagccccagtatagttgaatgcttacaagaggagaagcttttagcaactcctttgtttcttaatgtatatattatatctgaacagaatgcttctttcctgtgagctagacagtaggaagtaatctatcttcaaccttgtttggtgtgtaaataaaactttagaaagggtctattgaactttggacaggcaagctccatgagctctccctcactctttgaggcaggttaaagggtacggccatgaccaccaccttaatccttcagggactatttacaaaagattgaaaaatgtgcccagggcccgtacctgcccctctgtggaactagcccaactcaagtgggctggcaggcaagcctggctttcatggggacagaagagagagtttgcggggagcttggcatttttcaacacatgctttttggcttctcctactgaatttgtaatttccatgatatttggtgggaaaatggacaccggcctcttttgctttttgtctgctgctttgcagctattgggattctgcgccttgggataatgaagcaggctgtcatttcctccccctaaataatgcattacaaagtggaaatgcaaatttcctgtgcaagctctaagtagcaggtggtatttccttaatatattgtttttgacctttggggaaattggtattacgagctgactttggaaaattaaaatagcatcaaggtcctacattttaaataaaacaatcgatatcttaatttttaaaatcagactagattacgataccaggaaaagacatacatattttgcttttatgtgttaaagttttgtaattcagggaggacaagaaaagggatatggtgcagctgaactttctaattcactaagacaggaaaaaaggaaggaaaaaatgtatatttttaagtttcaatttaaacctttgctgttaactaaatgctttgatatgatcagtcatacaaagagttaaattaagcatggagctgttcagatggcaaatctgcgttgagctgaaggtaaaagacatctgtatttttcattcatttgctcagcagcactaaatttcaagcttgttttttgttcagcatcaaagaaaaggttgttttatggttattggattttttttaacccacatatttcatgaaagggactcaagtcactgggtctttatattcttttaagttatttttctgcccacagccattctgcaagccatcttgttgaagagggaaaacataatttcattctttttctcttcctttgaagaaaaaaatttaagagatttaaataccattcacattttggaacttccttctttaccccctcccgaaaccatcatctcacaactatgtaaagcaatcaaatgttgaaagacttaagagattttcacacacataaatatcctttatatacttataactgctctacttatcaagggcaacaagaatggaacccaggagctaagtttatagatgtttgtgtgtgtgtgtgtgtgtgtgtgtgtgtgtgtgtgtgtttgtgtgcgtatcaatatatccagatgtgtccaaatgtacacggtatttttagcatacaaattgctgattaggcatctatgtccctttctcctctaaaacctctaagtgcatggatctattagtggatgggcgccagaacgacacagtcaatgcaggactgaaatatttaccaaacccaagaaatgaaggtttgtttgaatagtttaaacttgacaggaggctgagacaagaggatcacttaagcctaggagttcgaggctacaggcagctctatgatcatgcccctgcactccagcctgggcgatagagcaagaccccgtctctcaaaaaaataaaataaatttgagtagtgtaagctatgtaaacttggataatccggttaccttcattctttaatttttccatagcatatatttggcttcaatgtccaggttttcgagcacgagaaatctgcattttcattctaagaagtataaaacaagatagttatacttcatgtaaggttcacattaattgtcattgcacctcttcttcccagaaggaagagggaagtgagagctggagtcaaaactgggtactgtaaatgctcatctaatcttggaatctcaggggatattaattttccagatagttgagttattgccttcaaattttaacttcaaattttgttaatgtggttgtatatgcaaattcagccaatgtgcatgatatgtgtgtctcaaactacatttatgaattcactgtaattttatgtttctcttgataatgtttgattgttaacataagcatcactagacttgtcaagtggcaaagatcatattctttcattctttcttcctttctcatttcttgaatgctggctatatgccaggaactatgtacccaccctggtgcttggtgtatagaaggcactcaatgaatgtatgttgaataaatgaaaaaaataaatgaataaacaagttcaatggatagttaaaaggatagtttcaattctataaaccttaatttgggtgtaggaccagtcacagtaccatgacagatagagctatttggtgataaatagtgtggaatgtatttaccaccaggcagtaatgccctgtccctccttgaatagtactacagatatgagagtgcttttttaaatttttaatcattggccactttctctagaaattggagggaaactgtgcagcaacaggactctctgggcattgtgacaggtctactgtctacaaaatttgtgttcaaggcaaaatctaaagcagccatctttcaaaaggatgtcctcactttataaaaaacaattattgcaatgactatagccaatgaggttgttcttgccactgccattcaaaacatcagtgattttggcatcttgggcacataccacagacaccaacttgttttttctttcccacacctctgtcctatatatgctaagtttattcttgggctgtgacagaggagcattccttatcactttgagaagttcagctaggatatttaggggatgaactgcattcttacgaattctttatcatgattacactcctatctagtataatttgaaggtaaagtagggcctttggaggtagactagcataggtttgaaatgtttccttcattcattatcagctgccaagagtaacctggggacgattccgtgcttcgtaaacatggtctcttcatatacatgctgatatacaggaaagacctttgcagaactccatgaaagtttgttttttattattgtactaaaaattacatatacctgaccagacacaaaactaagctgtaagttttctttaaacctccttaatattttgtcctttaagcataagcgatgttgcaaagcacccctttaatttatcctgtgtaaacaatcactatagtctgcaaaatagattgcatttcttatgaaatccactttgtaataacattttgtatacagaatgatgcattcagtgaatgaggtaattaatgctaaaggataaaaagattatttaaaaaatttaccaaactataccttgcttcctcagtagctatgcataggtaagtctgttattctgaaattatggttgactgaaagaataaatataaaagatagtgggaggtatccatcaaaaatgtctttatctttttaaacactggtatgcactctataaggagtaagcaacagtgacaatttttccctaatcactaaatgattattaaccatttgtaagaagagttaacctgtccttaatttgtttgaacccatggggccatgaacaaacaccataatagagtgaagaaagcaatgccaacgtagaccaattttatcactaatatagaactgccctgggacagagtatgcccagatatgagttctcagaaaaagccacagaactcttctgtaaactcctatatcaactatatcctaccttctcttctgcctcagcttgcagtagcagaaaaagtttacatgtgtttgtatattcactgaacagtagccctcaaagaatagggaattctcacatcttttcaaaaagagccacttaaagaaaatacattctaagtgctttaattcagatttaaatggctacattgcgagatattattccatataattggagtaattgtgaatttatacagattttcaacagtggcactgtgtaaccattgataaaatacaggggctggggggataaaaccagtattgcctggatccagtgacattttcccatgctcactttttccagttgtgtagcaatgaccatattctctaataacatcagcatacttttatgctttggtctttttccttttcattaggagaatactggaattcatgctgtagaatggttccttttataccccagcccacttgttcaacgacattcctgtgattttactatctaatatgttgtggctataaccagagaatgcaaaatctgtcttcctgagagccttggcctctatgttttctaccaaatcatacctccattttctctataaaggctgttggtacacccacaaatgtcatctgtttgtgatgagcagaactgaggcacttttgttctgatgcttacatttgttcacatgaatagaagttcctcacttgaaagtgatttgcacataggttgaggaactgtgaatgaaatcactcaacctagaggctggcattcttcatgctgctggctgttgatttcttcatcttctccctgaagaccctgcatgagtggtgagtatccataaaggcaccaggagacccagacacctctgtggcagccaagcaggtgttaccctgcaggacttaagagggatcttaagagcaagagaaggaaggagtgacttctctcaccagtggtcagagcagaaggtgcagagcagcaagttgcaggtgctggcagtgatggcttctgaactgaagagcaaccaaaccctcccatgtaaccctgtcaccacagctcaaagggaggttttcttgccccccagtagaagggaactgacagcgcctgtatggctttgcatcctgaagatactgtagttgttgcgtctgttggggaagcatcaagaaaattagattgttccaacattcaagctcttccatattagctttgtgttccatttgatgtcaaacaataggttgaaaaattagcttaattctaagcttatatgtatatagggaattttatcaattattagcaccattataacttgttaaacagtgaacttatagttgaatgtgatctattagatggctgcttaacatttgctcgagaataatctattagtcatctaagcacaaagcagctatttgaaaatttgttgagtaaatgacatctctttgacagaaatatctgcataattgcagtgtgttatacatgctcgttatagcctaactacacgtctgtttgaatttgggtttttctttttttttttctgtctgcataacacacatgcagacatcatagtgtgaatacttactgttatgatcttggagaaaagtgtatctgtcaactctttaacagcctaagcatactaaaggtagtttgtaagcaacacataactttgaacatggaaaaattaagtttgcttttaatgaaattctaattttgtaacttgctgagagttatttttagagagtggtaactgttgaagaaaaagaagctttttttttctttcaaatcctgaaatgtaattggtagtcattaattaaattttataaaatagatgttcctttcaaaagcaatctcaaacaatagtacattttaaagtctggatctctttcccagcagcccagggtgttttgaagataggagaacaagggaagtactttaagctgtaaagtcttgcagggtagcagttaagtgcttaaggcactgcattcttgatgcagcgtcctgttacagtaatattatgaaaaaaagctacagggaattctcatacatgtctaatacatatagctttaatgttcacatggctggacccattcacaaatggaatctgtgggtcagatgtagtttgcaagccactattattaagctgttttccttttactattaagtaatgttgttccttgttaatattatgaatgcgtgtgttctttgctctctctgtaaatcttttgttccattcattttttttttttttggccttacaagaatgtggggggaggatatccctatccacaaatcaagtactttaaatagccaggctagagctgaatgaaggaaatcagtctagataacatctttgtgaaatgtatgcctatgaactctgcgtcacacaatacaaaggaaattgccattgtcctgcacaagttaggtgaacaaagcacataaaaaatcctgttctggttgccatacatattcctgtgcagctgaaactagaattccaaacgccacagaaacggccaggcttaagtgactaacttgcaaatcagagagtgcaggttttacattgataatacagagagacctgtaatcattcatcacagtggtactacatttattgatactgagcactgcaaatcataaacaataaggattacatgaccactgctgctacggtgactactactgccatcaccgccaccctccctagtgctattgaataatgcttattaagttctttcagccagcaactgtgctatgtactttagtgtcattcatcatatttaatcaccccagcaacccaatgaggaatccactttatagaattaaggaaattgaagtttaaattgctaccaggtcacacagcttacgcatacctggtctcatacttgatctcagaggtctttctggccccaaagccctgttcttcccccactatcttgaacttcctttccctgtatgtgaagggaatggaactcaccaggtaccaagatgtcacctcctaacccttacaaagcccagtgagttatttggaggagaatttttcccaaggccaaaaagctgcccgtgtaatactccaaagtaacttccatatcctggaaagagcaactacaatcaaagatagcaccttacaaacatccttcttttatttaaaaaaattaatttttttttaaaagctaccaccaccaacagttcttcccaagatcagagatacctgcacatctggcaataagcccagacataccaaactgtgtattatctagagccagggacttgaataccactgcatctgcagagagacaagcatctcatttcaatagacaacttgttcctagagtgggatactcccctgctgaactgacagggagccggaagagcggcattgaacaaagagaatagttatgactgggcagcagacggccccaagcacaaccccaggttctgctcttcttcaacttaaccaagcagaactgcagttgactcccattaaaagtcagtagacatttagtcggcttccagaatgtgggcagaagctcatgttagttatttactacccatctctggaattccttttggacatgaccaatgagttacagctggtctttaggcagtatggcacactcattaactagctgtcaggaacagctacaccctttggtccacaaatctggatttgccagaggaaaattccaaacagaccaggaaagcaaaaaccactgacaccatctccataataactgtaaaactgaaacatacacgttctacaaagagggctgttcttctacctcctcaggaacaatttgacaaaggcaaacactttatgcactagccctggacaaacaatgcaaagaaaaatcttgtgcagctgatttcagggtcaagagggcgcttcttaccaaccctcaaagacaaaccagcacagagaatagtaaaatgtgcaaagccaaaccagttgctactctctatccattccccaatttcctttgttcacagaaagtgaccctctccatggccctggggtaaatctgatttgttcatggtggtgatgctggtcccattccccttgcaaagcaggtctggcctgttaaaaagggccatgaaatctgcagggactgtcggaagagactctcctgctggaccttgacatttctggaagtgccactatgaatggacactgcaaatggctgtacccattttttgactctgaaggaaatagactgagaataaatgtcaactggaagagcagaaagaaagaatctgaagctccgacatttcttgacctactgaatttaccaactttaaatgtgcatcatctccaggctttttgttatgttaagtaaataatatccttattattaaatcagtttgagttggggttcactgttatacccaaaagcatacagtaggaattatctttggtgggctatttgagactcatcagaattctttatctacagtcttacaaattggttggatttccattacctccttacatacactgatcagcaggaaatacagggagatcaaattatatttaatatgtcttttaaaatacactcattttcttctatccacttttggaactccaaaaaagtaactctctcatgctaacaactcccttattagagaaaagaattgtaggtgtgtaagcattgttttcccatgacaacgtttttttttaattatttatttatttagagacagggtctcactttgtcacccaggctggagtgcagtggcacgattacagctcatggcagcctcgacctccccaggctcaggtgatcctactacctcagcctcctgagtagttgagactactactatcaaatgggtagcatgtaccatcacacccggctgatttttgtacttttttttagagatagagtttgccatgttgcccatgccggcctcgaactcctaggttcaagccatcctctcacctcatcctcccaagcaagtcactgggccccccaaatctaagagtcatgtccaggaatcagcatttctaacaagcactcttttatgagatatatggaaggtatgactcagcgcttgaggaagaagagctacaagaggaagaggacttcttccaggcaatgagaggcttagaaattagttggaaaccttttttgaatatttacttcttccagaagactagaaacatagtagggactgagtgagtcaggtagatggccaatttccctgctttgggaagattctccctgaaattttccattggtgttatgctctgctcaatgtttgtaaacacagcttctctgatactggagcatgaagcagtgtgtcggtagctttgactagtaatgtgtcttaatgtaaatatgtataaatattatatgtacacacacacatgcacacatacaagctttttttttttctttttgagaccgagtctcgctctgtcacccaggctagagcacagtggcgtgatctcggctcactgcaacctccacttcccagagtcaagctattcttttgcctcagcctcctgagcagctgtgaatacaggcacccaccaccacacctggctaatttttgtacttttagtagagatggggtttcaccatgttggccaggctggtcttgaactcctgacctcaggtgatccccctgccttggcctcccaaagtgctgggattataggtgtgagacaccacgcccggccacatacaagctttaaatgaagtcttttaaatgacttcctctgtatttatgtatcataagtaaaaaataatgtcatggatggtaacattctacagaaatgaacacatgcacgggagcaccagccagggaacacagagaccatactggacaagggattaaaggcaagagacgtggagatttcttcagtagaaagccatgtggatgggaaggggagagatgtgattatgtagatgggcctacatcattatgggaaagactcgtatggcatctgtatggggaacaagcatttttattcttctccatattttggtcacagacaataacacataatacatgagattgtaaagtccagaggtacaggaactgtgcctgtatattttctatatcatagataccacagaatttatagctaacatttgtaacataatcaaatattatagcaggtgataaacaagagagaaaaaaaaacaaaaataagtcattaacatttatcacggatattttagccttcatagccttaactgaatttcttttctatagagttttcaagaggaataatagaaataaaagattaaagaaagtatagatagatagatatagctataaataagaatagcaggataggatttctacttttatagaaatctagtgagaaacaagatgctctttatatttctaaaacatcttgaactttttgatgagaaaacttttttcagagcaaagctgttactataaaaatagtattctagtgctgatttgtcctttaaatatattagaaacattcttttgaactaagatcttttaaattgttatattaaaatgcagtttttctccttatttggtcatttttcttcttagtgaaatcatagtccaaggaagctagatttttattatgtttttaaaaacagatgctatttttatagataaaagaggatggttgcctataacactgattttcttcgtaaaaaaaataagaagcacagaatatgctgaataattgcccaaaatacttttctggggcagtgtagaatagtgagaagggaaaaagatgtggagctatacaacctgggtgggtgttatagtttcattatatgctggccttgcaatgttttgcaagtcaattactgtcttttggatttagcttctgcatgcatgaatctgaatggctatacttctgtacatggttgttgtaagggttaaaatcagtcagtgcacttttaaatcacgttacaaactatgtgtcactgttatgtgacacatacaaattatgcattatcatcatatgatcgatatcaacaaaatgaaaactcgtgtcatctcatcttgaaatgaaagaatgtttgattccatgaatgtgatcgtgaagccgagttcagagagacatttctggaatattctatacaatgctaaacaaagataagcagtttttaagttaacggaatgctgaacccagaatcatccattttagggaagttgagctgagtaaggtagttcaagacagttgcctgaagctccacttaggtttgagatggagtagattcggaagacaagacgaatgaagtatttgattttctaaaaaagggaatggagacattttaatttacagcttctgaggaaaggtcatcaatccagagaagaccgtgaaggaaggtccaggaagaaggtatcctctggaaaggccagggtgtcagggccactgtggaagtgtgggcatgtagcagaaagaactcacttcacaactgtttaaaaacgttaaggatataagctaatgttcgggaatagttaatgtttctcggagtgaatattaagcttcctccaagaaaaacaactcaactcctaaagtcagccctaaactagtgccaagaaaatagtgctaaattaggcttctaggagagatatgactcagttaagtatcatagagcactcaacccataaactatccatttgtagtccttgagaacataagagattacaaataaatgtactgactctttccttaaggaaaagaaatgcctaaaatcatgattcagctttttaaattcagtttccatgtgtaactgttatagctgctgggaaatacttgatagtcaaatcattttgtaaaaccatttccaaatgtttagtctaagattgggcaaatgttcttggaaccaaataaattttctgagtattgattctaaatctctttagtcagaatgaaagtactaagaactgttttaaaaatcatatttttctgtaagcttatgggcaagcatacaagaaaagatatacatgttacatgtcaaattgtgtgtatctagttcaagtcctgatccgatttcatataatctctatctgaataattggccaaatgtcaagaagatgcatatcttaaagggactttcaagtatattgccaacgtgattggagtattaacaacaaatttggatattaattcttggtaatctccaatagcatctaatttcatttccattatttcatagatgcctccttttcatctaatattgagcattaattagtctttatttggctggagttaacattagctaaagtttgaacttaggctatagcatctgtgcatacatgtttgatttgtgaaaacccagcagcatggcagttcaaatatttattcattttcctgtgctggctcttaagcacatgtgcatatgcaaagtgacctagctttgtgaatggtcatacacagagaaaaagaaatacatatagaataaataatttgggccttaaaaaatatgtatatatgtgtgtgtgtgtatacatatatatgtatagcgttccttttttgaaaacttgtagcataaggaaataggactgaaacattcattattttctatgaagtaacattaatctcacaattttcactccactttttgactaagggtggatttttcccctaaaatcttagagaatcataaaaaatgagatgaaaagtcaacttctgagactgtgtattcctttaccccacctgtgtgcgactgtttacttcagactgctttatgttcctcagagcacaaccatctcctgtaaaacaaaaatgcctattaaactgctataactcgggagcacaccggagcatccccttaacactaaccatggtttgacaacactatccccaaaccacatcttttgctttctaatttgttaagcttaactgtaatctttaactttccaaagtgaaggcaaagaaattttcttaatgtatttctttgtgatagggaaaaagtgatacttttcttctacttcgtcttcaaatttcttctggaattttttttcagtgaccttatctctactttttcattttccctattataaagaaaatagtcatctcttctttcatacatttatcttttccatatttgatgagcacgcctccccgcacttaagaaaacattgtaggaaaaaaatattaatctaaaattgtacattgtactctaatatctgtttttcatttgtctcccccattagactctaggcttcttgaaagatttcttctttgttttctacacccagttcctgcctgtcatatagttcaaatatcaattagtattcgatgagccaatgaaccacttcatcaggtcagaatccagaaggatacattttgaaactaatcatgacactgtgatttttaaagggcttcccattgatcttttcactccattccaaaggtgtctgaaaggcaccagagggaaggcaaaaactccaaagtatcagccccccagtctgttctcatgagagctgctatggctcattgccacacatacgcagtctgatgttaatcaacactaactagagcagcttgtggctattctcatccttgagcagatgaaacaaggccagcagcagtgagggcactttgctataataatccaataaatacttttgaaatgatgcttacttttgtcttttgcattaaagtctaagcgcaaagccaagtagaatagaaaataaagaacacttcccctcttccacaataccaagcagaaattccagagattttgccaaaactcccccatagatttatcgcttcttaggagactttgtacagagaactacaaaatctcctttgcaccataagggccagatgttactgttgaattgtaaccacccatagctacatgtgtacacacatttcacagtcatctctaaatgcacacaggaggcacaatgaatggaagttaagacctaacctaggctttttctaggttcagagaaaaccctgactagctactcctggtagatggtttctcctctttaccaaagcctcccatcactagggggcaggttcattcccaacttaggaagcactaaaacagaaaagctttcaaccccagaaaagtggtacctagaggtgtgatttgtatagctagctgtagctgagtctcatcctcacaatgttgcatcaacatttgatctgaaataaatccttcaaacttcagatatatcatattcctatctaattatcaaaatacattccttaggtacattaaaactttttgatcacttactattgtagaatacctcaaactgaactcccctatatctgatcaatacctgagttgaccattaattttaaatttaattcaaagtgacagttttcattctagaccttccttggatagccacagagatgtgttatgtacaaattatttcagtcatccagtttcaatgaagaggtagagttcaggtggatttggagtgggtatgagaatctagccagatggccacaaagacagtcctggtgctctggaagaacaaccacagcataagcaagaaactggaacaccacacctggtataggccaatccctcttttcaccacaatctggcagtctttggtaaaataagtgtaaggggaaggatccaggctggagaggagtgagcagaaaaattgagtacaggatctcagaaggtacaaaaagctacgcagaaggtacaaaaatctgttgcctaatacagcctaatgacaagtcacaaaaattaccttactgaattagaaagaccttatcttgattgtatgggattaaaccatatgaaattgctgataattgattggttctgacctacaaaaatgccagttcagctagctcaacctgatagtatgagtcacacggggtgaatgctatgaagacgctctgcctccacctatcctggtgatacaggtctgcaggagggtttgcatctagaaatcagagatttttgttttttaagagtcagagtcttgctatgttgcccatattggaatgcagtgactactcacaggtgcgatcatagcacactgcagcctcgaacttctggactcgagtcctcttgcctcagtctcccaagtagctgggactaaaagcatgtgccaacatgcttagccctaagatttttttttttttacttaacctcccctggagctccagtttttcgttgaggggcctcaggggcatcctgggagggcagagatggattggagtggaggccacgtgaatgagtctcagaaataccattttgtctgctttctgttgtagggttccacataagatctaacataaaaggtgtgggggaggttcttatgctttaaaaaaaaaaaaaatgattcaaagcctccaaagcctgaagttcattttttgaaaagtgacccaaacacaaatcttgacattctggaatattgaagttttaaaactaaatccggagggccatgaacaagtatgtcgatcacataatttcgtgaaaggcaaattcttgataatggtcatcctccttcagccaggtaaatgtcaaattcaaagaaaatatattcaggacagcactgtgaaatttctgaggataagagcatatttcacagcacataaatgaaagtggatctcggtgaatgttctatacagagagaaaggttgtgttttgaacctttaaataactttggacaaagggtgaagaaggatattgttcacaccacaagtcaaaagccactcccatcaatgtgcccaaccacacaagtcgaggctgctgctggccttgatggttcatggccatttggagtgtttgcagagagattggatgattacttgtctagaatttgagctgtgtctacttattcaatattttggaacattttttctataaataaccggtcaattttgtctagaaatcagtgaagtgattaagtaataggtctatgtatttattgaaatgttgtctatatggtagggatatattcatctgtcagttcaggcagataaaactggctacacttgtgtggatacaaacatgatcataaacctcactagttcaatgagctggcttacatctaaaggactcttttggaagttgaaaaacaaatatcttttgcgtaaacatttttaatatgacaccatatttaacttaaaattttaaataacagatgatcctgtgagatgctattttgtgaggtgtgaaaggcccccaaaatgtaactctcattgaggaatttttatagaaattagggtttttacattctttattagtaaatagctagaagatctgtcttatactatattgctatgagaatggaaaacaatctacatgaaaaaagattatgctatggcacagaagtacctattggttgaacaatggtcatatgattttaaaacaaaatcatatgattttaaaacaaagtgggcaaaatcacctactactgcctggcaagaagcaaaggatctaattatattaaaattctgctgcttacattaaacccagagactcatctgcacagacagccatgtgaagggcttctttctttctaaggtcaacttgagaccctttacataataatcatgtttgctttaccatacattgtgcctaatttttttttaaaaattaagtttgtaagctcaattcaagcctctttttatttaatgtttagattagtactaaaatgaactactaatgtctgggtcctttgttagcaaggattttctttcaatacctaccagaaggagtggcttagctgtctgagtatcagctttaaaatacctagacttcctggaaccatagattgtattcttaggagggctgaggaacttcttaattattctgaaataggtggaatggcagaccatttcctacacaagtgtctctctacaaaatcttaaaaatccaaatactctgtggattttaaaaattcagtaactttttttcttccatttggagaaatgttcatttgctgtatgacctcagaaatccaaaaatatgtcctttccttttgcttatcttctacagtttcttagcatgttgtaccctaagctatttgtatatactttaacaatgatatttatttgcttaagcattatactttcaattgtggctgagctagtccattctaagggctagactgcagagaactactcactgaaatccatgtggttagaaagagcccttttaagcttcacgtggtatgttcaactcatggggtctttgaattctcaccacttttttttttttttgaggcagagtcttgctccgtcacccaggcgggagtgcaatggtgtgatcatagcttactgcagccataacctcctaggctcaagcaatcctcccacctcagtctcccgagtagctgggagtacaggcatgcgccactatacctggctaattatttttaatagagatgaagtcttgctaggttgcccaagctggtctcgaactcgtgagctcaaacaatcctctcaaagtgctgagattaccggcatgagccaccacacccggccacagtttcgttttaacatctgttaatccaaaaaatttcttcaaagtcctttggtgattttgtcaatgctgctattgatgttttgttctgggaggaagctctctttcaccccattgtattttagaagtttcaatgcaaccatggaatgaggattttcattacaagctttttgaaaggtgcaatagtctcaacataatgaactcaaaatctcagtgcattgaagggtttgcatgccaagttgaccaagtgcctaaactgtataaactccctatgtgcacacttagaattggatcatcagatttgtctaaacaacttgaaaggctttgctatctgttcactgaacagtcattatgatgtacacacctttaagagggactcagcccctccacaactgataatgaaggaagaatctccaagtgaggtgaggcagctggactttgcaggtctgactcttgtcccctgcgattcacttttcatcagcaacctggaggaatcagaactaggccctgctgaacaatctggagatgaaaatcaaagccgggaagtacagcttctcctggattggatctcgatttgacttttttcttttttctttttttcaaggaacagactgggtttcttcagagcattatatcagggattaagagaatcagtagactcgggttgttttggttttagaaaaagatctcagacgattatttaaattccctatgccttggtttccctgtgagaaaatgaaaacagtaaggcctggaccctcccagtaacaaaggggcagatgttaaaaatataaaggattctagctttcatataggaaatgcatgtgcaaaatattactcatttattaaggtgcatgaaaatttactgttaacaacacagaagactaatatgtatcattgatgttattcaggtcttataaaactctagtggccagtcgtgtttttaatgccaagaaccccgaggagcaactggtttctaagaatcaacacttagttctgagccgagagatgccccaaggaagataagagacttacagtttgtttggcgtccaaaaagctttccagacagcagtttgtttcctttccctttttatgaatggtggtagtattatgcttcagtctgcgttttctaccaaagccattcataaaaataaaaacaaaacaaaataacaacaacaaaaactttctcggcacagtctggagccattgggtgccagaggctgggaaaacatcctggcagccataaccccaaccaacattgaaagtattcaagggtctgtttgtttggtggtctgaaaagtatgaagtgctgtgtctgagggtagctggtagaagttccgtgacacggactaggccgggagccagggctggcagagattcagacattgtctttcccctcattgaagtgtcaggacctaattcatggaaaattgggtgagctggcagctctttcagaggatttcattgagctgcagtgtgcaggagtcacatgaatgcgggagcctctgccaaaaaaggagggggatttctgagcagtaggaaccagtcagcctgcaagaatgtatgtggatttgaaacggtttgggagtaaacatgtgtacaggtgtaatcaacagggaaaaatgggaggaagatgagtgctctcttcttccaaatgaccctttggaaatgaatcctctattagcccacgcttttgtgtcctaagaggcaagaagtcctcatcgttcttggttcgattttccctggagaaaacatcatctcaaaacttgggcttttgtgatgacgtcatctttactgtgatttaaagtcaaatggaagaacgtcttttcctttgagcaaaagtaccttgccatttattttatttttattctgtccatctaaaaaaaaaaagctctaatgatttttatatggaatttttaatgtaccagcaataaaccactgtaccactgagaggaactctgagaggaaggggctctcagaatgaatgaacaggggctagtgaatagtgaacgtatcctaagtgctgttatttgggagaactggtgcaagaaagcatgtcgctatccacatcagagtacctcaggtgtactcacaaatctcagcgatgtgtagatagaataatacatgcctatattcagacatgagagtgaggactggaagcaaataatccatcgaaaagctcaggcttcaaatccatcttttataatgccaaagaaataacaagtattctctaatactcgattggaaagttaggcaggcagaaaaacattccctcggatgtttcactcaaaagaggagagttttgctctacacatacaatagatacagatataacacaatataacacaatattcttcccatgataccacgaagaaactgaacaaactcacagaattatttgcaaatcataagggacttgaatgcaaaacattaaaagaactcttacaactttgttatgaagagatagcaaattttttttaaatgggcaaaggatttaaataaacatttcttcccaggagacatataaatggccaataagcacatgaaaagatgctcaacatcattagttgtgagagaagttcaaattgaaacagcaatgatgtttaacttcacatccacttggatgtctacaagcaaaaagacaggcaataacaagcattggcatgtatacggagcaattggaactccagattcattgctggtgggacggactgcaaaatggtacagctgctttagaaagctgtctggcagctcctcaaaaagtgaaacaaagaattacaatatgaaccagcgattccactcccaggtacatacccaagaatgaaaacatgttcgcacgaaaacgtgtatataaatgttcatagtagcattattcataatagccaaagggtggaaacaccccagatgtccaccaactaatgaatggataggtaaaatgtggtatacccatacaagggaaaattatttagcatgaaaaggaatgaactgctgatgctaccacatggatgaccctagaaaaccctaggccagtgaaagaagccacacacaaaagactctacatatatagtatgattccacttacatgaaatgtcaggataggtaaattcatagagacagaaagtagattcatggtcacttaggcatgggaggtggctagggacgtggagggtagtggggagtaaccactaatgggtacaagatttcttttagaggagatgaaagtgttctaaattagactgtggtgatggttgcacaaccctctgaatatactaaaatatactttaaatgagtgaattatgtggtatgtaaattatgtctcagtgaaggtgttttaaaaaaataaaatattaacaaattaggtaccttcactcctcagttttgtgatatataggctaaaaacaaagtgaatcaaacagttaagtttctttcaagctagttggcttgtatgccagaatttaattgggaattggaattgttttcactgagataacctatgttgtatttccttaatatagagagatcatgaatagacatttttgttttttttgagatagggtgttgctctgtcacccaggctggagtgcagtggcatgatcacggctcactgcagccttgacctttcttggcccaggtgatccttccatttaggcctctgagtagctgggactacagttgcaacgccaccacaccctgttaatttttgtatgtttgtagagagagggtttcaccatgttgcccagcctggtctacaactcctgggctcaagccatccgtccgcctctgcctcccaaagcgctgggattataagcgtgagccaccatgcctggccaagtataaacacttttaacattggatataccagttgaactttatactttcctctttcctttgcagacaagtatctgtatttaaaatatgtacacctaattttttctataatgtatattttcttttaaaatatatctttttcttttcctccttagccacaacaagttgttcagaagaagcctgctcaggtaagacatagtcattaatttttttctcccaattaatataaaaagtgaaatatgtactgaaaaatgtccccaaactaaaccttatttcgcattttcttacttttggttatcgtcctgcagtattcctgaaaatgtgttgtagccttcaaagttaggaatatatagtctgcaatcgtaccatgaaaacctcccaaaatgtaaggtcttaagtgtacaaagcaaatataaattcttttaaaaataaaactattttattacattgcctcatatgtaaaacaaatatttaatcttatcctatattttaccaattcttaaacatcaaattttgtccttccaactgactgtctatattctgttgacaccagacttatatttaatgattcatgactggaaacatatttcttcattgaacaatttcataatatttgatgatcccaaaacactccaaagaatgctagaatacttggaaattaagttatactaacgtgcagactgatgcattcttagatcttatttaaataactgaatcacagtctctgaagtttttggcaacatcaaattggaaaatagctctacgtctcttgccccatattcctggagcaccttgtcctcactataatctgtacatagaaacattaaaaaaacatatttattgaggaagcatatcttgaagaaaacaaaactgaagtataaattaaccaggattgctaataatgtgagccagtattaaagtataagaacgtcctgctgttctcttcccttctgtatgtaaatagtcattggagatccaggtggtatcatgctgaacctgctaaaataagtagtaagcagtgtcatgagctatcaaattaagtagaactctttcatgtaattttaagtatccatgaaatttttttccctagaagtctttacaaatctaccttgcatcctgttttcttaggtcaatgttgccttgcctgggaaggaccacccgggcaatcttatatatctactgttctctaaaaatgccacttagaagagaattgaaacttccaaacacatgaaaggatccaaggaaagtgtcttcaaacaattacatatgagctttaagtggaataaaaacagagttaccatgaaaaaaatcattttcattgctgctcccatacctaaaagctaagagtgggagaggggtgctaaaaaaaacccagtgtttgtgcgtctttaagcaatatttaaaaatatatacatataaacaaaaacttgacattttcattaggagaacccaaatatatttagcctctcatcctttaactgtacaaaaatcaagagaaagtaaattgataattctgtgcatttgagtcaaaggatgaggcagagttcacatttgcatcacaggctgtgaactatagattaatcactttatgtggtttgttaatattgattcagcccctgtgcttagtgtcatagggaagatgagtcaaacaaagaaaaacagtcactgcatctgagaaatgtatttatatgtatatgcctgtgtcctatccagtggtatgctggaaccagcccttgtgagcaaatagtgaacatctcttctgaattctgtgttcagtgatgtcaagtaggtagcttgaaatccactatggtgggagtatttacaccatggaaagtgacaaatactacaaatcaggacttttttttttcctgaggagcaagtagttaaacatttacctccccagcatggccccacccttcagcgattctgtttatttggtctggagatccatcatattttttatgaactccctaagtgagtttaatatgcaactagagatgaagacactccatgaaaacacatgagaagatgtctgaacatttgttgagcaaatgaccacagaatgtcaatgtgtatgggacacacgggggatacagatgaatgagtggaatgcctcaggttatcaaggggatgataagactggaattttcttgttttgtttgattttgttgttgttgagttgcagaagggaaaactgaaacataaattaagggaaagaaattacagatgagatgaatggcatatagaaaggtagagaggcaagaacaaatacatcataggtggagattattaatatggctagaactgattgcaagttggacattaatacatcaagaaataatataagtgaaatcacagttgtttttcccaagagaattcagaatctcaaagaagccacaagtggattgagttgatcttcaaggatcaatctggctatcttacagaccctgttccagatttgccctttataggagagttcagactcagaattataaaaaagaacatgagctcattgggctacctaatttatattgtgtaatgacacagtgatgaattatataaacatgaaaactacgtgaaagttcgtggaggataatgtaaattttacactacattcaaaagaatctcttccttttccatctgtttctttcaaaataccctcccagatggctttcccatgaggcaatctggattaactcagcctcatatccttccttcaacagcactttgaggggttacattcagaatcgcttttgaggtggtaaaaattttagcacaactaaatattttacatctaaagaaaagggctcagcagtgtgtaaacagacctacgtttttctttctggccccatcactgggctaattaatttctctttgctctatttatccatctaggaaatgggataataataatgccttttcccttactcccaagaacattacaagagatgcataattatataaattccaggtagcattattacattctgacttatttttgactgttaagtttttcatttccagagatttatagtctcaaaaattctagaatcctgatttattccaaagtacttcctctttgacgtcaagtgttttcattgaatgttttttaaggcaggaattttttagctggaggaaattttctagtaattgctccatcctactgttagggctaaagcattcagaatcatcttcctagcatttatgtcacacgtatacagaattacaaaggctctgtggtgaagtatcctcatactgcccaatgctgaagtctcctcagaacttcaagaatggcccttgttgaacctggggtacaaagcagcagagtttattctgaggagacaaattcagaattatgataaatctcagcacctgcatacgcacttgtgtttgtgtatacaagtacatgcatctagagagaaatgaaaagtgaaggaccaccctgttgcaggggtttgtgtttgcgaaatccaccaggtgtcatcagctgcaaacatcaagtgtgtcccataatcctaatgggagagttaatagtctcttaaaaatctaaaggggaaaatctgtaatatgtacgttaacttttttctaaaattccaaaaccaatgaaaacagcttacaaaataactctactatatttccacttcaagtgataaacaataaattgaaatcagctaattacaaataaatagaaatgaggctgggtgcagtggctcacacctgtaatcccaacactttgggaggtcaggagttcgagaccagcctggccaacatggtgaagccccatctctactaaatacacaaaaattagccgggcgtggcggcggccatctataatcccagctactcgggaggctgaggcaggagaatcacttgaacctggttggcgggggagggttgccgtgagcagagattgtgccactgcaccccagcctgggtgacagcgagactccatctcaaaagaaagaaagaaagaaatagaaagcagctcgttttttagcaatttgagcagttgaattctcagtcatatgaattacattcttcagtaggaaatggtggtaggtttttctttttctttttttaaaaaaagaaacaccataaaagtaccagattattattattattagagggtgctttgttactcaagtttttactttgataaaaataagtgtctctccaactgagatgtctaaaaaagtttcgctagtttatcaggtatttgatcgtttattgctatttcccttttaaggctttaatctgagacttgaagggactccctaaatgtaattcagacatttttctctcacctttcttctacccaaagggaaaacaggtttttaaaatcctaacagctctccaccctttcaatccactttccccattgttgtacagccctggcaaacgatgcctctggcaattaggacaggtataaacctgctccttttcaatttcccaatgagagaattgcaaagttttcagtttctaaaagactggaaacaaagctttctgtttcaaaaaaagagtttttacttgcaagtaacatcttctgtgggtggtgtgcacccgggcaaagaaatctcagtaagccttgattatcacgggatttcttccccctcaaaataaaatgttgaatgtttttacagagacttcaagggcagttttaaggatgtttatatttcagacaacctaaacattgtttggagcaaaatgagagatttcattttgggacaagcaagttgatgaattgcagtcagcatctcgttctcaaagaaggcatttttactgggggcttttagtctagacatacaaagagggaaggaggaaaggggaaagcattctcactctaacactcgtcttttacatggtaccttggccagtgcagtaaatagttcataataaatcagacttacaaatactcactcgtctactcactcaaggagcataatgatttatactgcctaagtcacaaagattaccgatgtatttattttcttgcttatgcactttcaagctagtaaaacatcttgtgggccagtaaatgtttagtaccaactggcaaaacatgaagaatcatatcaaaggttgccctaagttgcacggttttgttgtataggaaatactttttgacttaacctctgacctctgacatcaccaaggtcaagggaaaaggagagagcaaagtagaaaccaaggtttaacccttaataaagtagctcaaggacatagaagcacagggaaattggagggcagaggaagcgtatcaaaatgattattaactgtaaacagatgaagtaattagcttagctaacagttgtaatacaggaatattggcaggatgaagtcagcggttcttggcaggaaatgttttatagagatgacaacttctaacagaagtgaaagaacatcaatcaatttagggcaacttataaaactccaaaaagcaaaatttagtgtttctggacttgacaaatttgctgtgagagttttttttttaagtatgactgtttctgtgtggggaagtctgtggattaggctcaaaacaaaatggcagtggctgcctgcatttcctcttcatattgcagaattttcctctacattttgatgtgtactggataaaaaccaattgtttactcaatatataatctttcttcttactctccaaacttgctgacccaaattaatgtggaacaaatagcaactggctttaaaacctggtctttctaagaaaatccttaatggttgcatagaaatatgttgcattgcctcagacacttacattcaggaaatgtttgctggacactcagatgtctacagagaaattgttaacttactgttattgatatttttataatcttactcaaaagtcataactcaggataatgaaaaatgtttggtgcaataatgattaaaatccacaaatattctgttccctggccgcaaatacaacacctatgcaaaattttacacatctacaaaacaaagggaaaaggtttttcctagtctatgccattaataagcacatctggaatataacccttaagcagtctttaatcataatttaaagctactttgcataaaaataagaacattccacaacagctgtggaaacattgaaataaattttcttcttctgggccgggcacggtggctcatgcctgttatcccagcactttgggaggcccaggcagaagtattccttgagcccaggagtttgagaccagcctgagcaacatagtgagaccccatctctatttaaaaaaaaaaaaaattaccttcttttgaatactttgtttatgcaaaaatccttttgctttctttagctatttttttaaatgcagtgttcctgcagtaagaattgaacctggcatggaaaactgatcaaaccggtagtcctcagaaatcatcactcctgaaacttgcaattagtttatacctaaaatgatttccctatttgaaaaatgtgcctaccatttccagattttaaaaaaatggccctttatcccagaaaggagaaattcattgtatcccagagaccagcattacttctgttgcagtattttcagtgatggaactctgttgaggctacagacaagaaaagcaggagagcattttaggaatctaagattttttattttactttcctctggggaccttctttaatagtttttttctttcttaagaacctatccttgaatcataggtaaagaaataatcacagaatgagtaactgacattaataatcacagcttcacactatagtcttactggatttttacgtttttcagggtttccccaagtggtggtcacatttcttacacaactctgcagtgtagatagacatgtatagtcattactgggctgacacggtgggactgagacctgctagtgccgtggttggcatctatgattagtgaggtccaagatcaaccttctttacattaaacatgccctagcaagaccttcaacccaactttattaagctgatgctaacgcacacaaagaagtcctaacaattctatgtttttatatacataatgcaaaaataaagacaagatcaggtacaattgctgtcaatatctcaacttattgtctccttttgaaaaacataattcccgcctagcatttccaccagaatcccttgctcttgccaggttatattgtttatatatgttccatttaacatgttttttaaaaatctgctgtagagttttcctagttggaggaaataatcactttccattaagttaaacagtcccgataaattttaaatgaaaatatctgacagagaaatagaaaaactcagccttgtggtcttgccggtcacttagctacagatggaacttgaaaaactggttcctggtcattgctgctgaagagagccctttatttctgttgtgacaggactgactcaagatactcatgaacgtggaaaactcctaaatgtgtcattctgagttcctgagaagttgaacatacacagatgacaaaaaagaatgccatttagccataactaccctttctagattaccaagtatttgtaggtttattggcaagatagcttaaattacgtatgtatttctggcctgcaacatcatgtaatagaagagttgcagaattctttgcagttaagaaaaaaaaaaaaagataaggacttattaaagctgacatggactgtgatttttgcactccgtaccacacacaaaggagggcatcgtggtgacaccacccctgtgtttgtatttcttggttccatttagaattcactggcctcttctactgcagacctgctgtttagtctgcatctggaaattaaacccagagcttcagctcttagcattaaatattgaactttcttccagcacacaccctcatccatgcctgtatagtaagtctgattaaactcaagacattttaaaattccatcagccttaggagttaagtttggatattgggctgtcttcctcctcctttttaatctattagaagaagtgtacccaaaggtatatataccacatgcatcatgttgaaccaaattaaaagaacagtgatatgtgcaaactatatttctgggttttagtggagtttttttccaaacttagctaaaacaatgagttacatttatcaaattccttttttcatgaacaaaagaaaaactaaggcaaagtaagtgcacttttccagtagttataataaaaatatagttttccaactctgcccacccctgttccccactcatcagttttctgccaagaaacctcacatgtttcggcccggtacctcacttgtctttgtaaagtagctgcatgatggctgggagcttttcggtgtttagaggccttagtggctggtgctcataaaaatgtcaccgtgcacttgcactttgaaaagtcctttcatctgaacattcctgaagccccattccaacaggtaagccttcttgaccaaagagtggctgtttagccttcccaccctgccactagaccctaatgagatgtgtgcaactcttggctacagttttcatctccttattacttcaaggctcctcttgggagctacacaagctcaaaggtcctttgaccattaggtgacaaatgagaagcaattttttaaaaacatgtcaaggtaaaagctattgtctataacacacggccatgtctttttttctttttttttctttttatttgagacggagtcttgctctgtcgcccaggctggagtgcagtggcaccatctcggctcactgcaagctctgcttcctgggttcacagcattctcctgccgcagcctcccaagtagctgggacttcaggtgcccgccaccacgcctggctaattttttgtatttttagtagagatggggtttcaccgtgttagccaggatggtctcgatctcctgacctcgtgatccgcctgcctaggcctcccaaagtgctgggattacaggcgtaagccaccatacctggccccatccatgtcttttaagttattaaagatgatcgaagctcaggggtccctaccaactcctcagttacagaaacaggactctttggggatgtcggagccagctgcttattctccatgtcacctgtttctgttccctctttgcaccacagaagcaccctgtgttaagtctggccgaaccatgacacttaggagagctgagaatgggttttccaacctcattcctgacagggaggatttttcttctcttcattgaatgcacacttgtcgtacagaatccgcacatgtaaccaaagaccaagtcactgggaaggtgagagctgaggtttgcagaggtgggaaaagccacctgccccaccacatcaaccctttgggaaccattccttcctttgaagggtggccagccagggctatgccaagaagagagagctctccactaactagacatttgagaaaaccatcattctgagcatgtgagagccacattgcctccaaacctttaatgaagtgagacttccaccctctgacatcctagtcatgttcccagtactaactgatagttactagtagaattctaaggtcagcagaaagatacattaataaaacaactatccacattgtcttatccacattgtcttaaggacagttaaggaaacaatatgacctaccaccattttcatctgaattgtgtctaaagggttggaattcaggagtttcagcagctcacatcaagcaaagtttctgggaatgttttgaaaagctgatcacattccatctagtacaaggtctttgttaagttcatggcctgaaaattctgtttccttccggatttgaaagtaccttggtttccggatagtatagaaaaatcaaacagttagaaattgaataattacagcacaatccaggaggtttgccagcttgactgagttctatcaattttttaaccgtaagaaggaataaaatatacttgctggcttttatgccgtggtctgtttcagagtagtcacctaagtccacacctcatgtcagaatgagaagtgaatcatctggggacaaacgaggtgtgtatctgcctaacagcttagtgactttctggaatttaaatattaagtgaaaggacagggtcacagggcagctgatctttggctcgtctctctttcgtctgcccatggctttgatcatgctacatcctcctttgtggccagggctccacagagaatctcagggtcatggcctgttgcctagtcaagaggtataaacctgctgcttaaatatgtgaagcccacagtttgggggttgggagttaaaggggaggtagcctcatacgttccacttttcccacaaaacccaaagcagactaaacaaaaccggtgtgaaatctcatgacttgatgctgccgtggttatatttttcaagctgtaatccattcatttgtatgtgtgtttattcccaggatttacagctcgctcagtcttcggggggaaagagaatatttgaaaccttttgcaaagggtttgaagtatgcagtggcctgtgattaaagcccaggatagagtgtgtgtgtgtgtgtgtatgtgtgtgtgtgtgcattcatgtgaatgtgtgagtgcccattcttgtggggtttttttctcccatttgctgcttttacgcaaaagcatcacacatggtagcatttaggagccccttcacagctgaagtgtttcaaacactaatgaatggaagtttggtcatataatgcagacaagctttaaggcatgctttactgaatggtgtactgtagtgacctgggaaaggaagagaggtataaattgtgtcggttagccacccagacaaaatgaagccatgtggaaaatcaaatctattaaagtatgaagactgttataagctgttttaagctggccattcttaaaggggctcggtctgctgcaggagtaaatgtttacctcttcccccagatctttttcacatgccgtcttatgagacaatgtgcagcatttgataaaaatcatcctctcactaacgacgcttttatcggaaatgtttattgtctccgctttaccacccatgtcctgaaaggtactgcacatttgttaaataagcaaaaggaaagagaactttgcggctcaagccggctcgcagaaaccccaacaaattccagagccataaggaatcagaaaaaggaaaagggaaggaggagttagatttatatgaagagggggccttgcaaaaacatatatattagattttctctgcttggctagcccaccatcaaatgtttggtcgatgcggattagtattgagattgagcagttaacgccgaacttgggtcactgtctcaaaatgtgctttaataaatacaagggggaggaaatggatttgggaaggctcgttgtcagctctgcccctgctctcacactgcctctgcacagtggtgtaggggtcacacacaggtgttggcaccagtaccaacccgacccaaatcctggtcccacacaccctgtaattttgggcacattacttgtctgtgccttggttttctcagatgtaaaacaggaatattaacagaaggtgcctaagcatctggtaagcactctaaaaataccagctattattaccagtatctggagggtgggttcatttataccttaagaaaggatccccctaactctatttttcttgtgtgccggtttttaaaactgatgaatggcatgctgtcgggaaaaatttatccattcctactttttttctaattggtgagtaagcgtgcattgccctgacattctctggacagcaaacaattgaatttgctgaccagccgccatgatgtcaagccttaagtcaacagtggctaatgaccgctctgggaaaaaacaacaccttgattcctcaattacggtttaagaagccctgggaatgagggctcgccagtcatcgtcatcctcttttgaggcaagcataatgtgctgtggaaacaggttacctctgcactgttggcaagagcagcccacacagtataacgattgagcgtcatggctgtgccctttgtgtgttccaggaggaaactgaagagacatcctcacaagagtctgccgaagaggactagggggcgccaacgttcgatttctacctcagcagcagttggatcttttgaagggagaagacactgcagtgaccacttattctgtattgccatggtctttccactttcatctggggtggggtggggtggggtgnnnnnnnnnnnnnnnnnnnnttaaaaaggactatattaatcaccttctttgtaatcccttcacagtcccaggtttagtgaaaaactgctgtaaacacaggggacacagcttaacaatgcaacttttaattactgttttcttttttcttaacctactaatagtttgttgatctgataagcaagagtgggcgggtgagaaaaaccgaattgggtttagtcaatcactgcactgcatgcaaacaagcaaacgtgtcacacttgtgacgtcgggcattcatataggaagaacgcggtgtgtaacactgtgtacacctcaaataccaccccaacccactccctgtagtgaatcctctgtttagaacaccaaagataaggactagatactactttctctttttcgtataatcttgtagacacttacttgatgatttttaactttttatttctaaatgagacgaaatgctgatgtatcctttcattcagctaacaaactagaaaaggttatgttcatttttcaaaaagggaagtaagcaaacaaatattgccaactcttctatttatggatatcacacatatcagcaggagtaataaatttactcacagcacttgttttcaggacaacacttcattttcaggaaatctacttcctacagagccaaaatgccatttagcaataaataacacttgtcagcctcagagcatttaaggaaactagacaagtaaaattatcctctttgtaatttaatgaaaaggtacaacagaataatgcatgatgaactcacctaattatgaggtgggaggagcgaaatctaaatttcttttgctatagttatacatcaatttaaaaagcaaaaaaaaaaaaggggggggcaatctctctctgtgtctttctctctctctcttcctctccctctctcttttcattgtgtatcagtttccatgaaagacctgaataccacttacctcaaattaagcatatgtgttacttcaagtaatacgttttgacataagatggttgaccaaggtgcttttcttcggcttgagttcaccatctcttcattcaaactgcacttttagccagagatgcaatatatccccactactcaatactacctctgaatgttacaacgaatttacagtctagtacttattacatgctgctatacacaagcaatgcaagaaaaaaacttactgggtaggtgattctaatcatctgcagttctttttgtacacttaattacagttaaagaagcaatctccttactgtgtttcagcatgactatgtatttttctatgtttttttaattaaaaatttttaaaatacttgtttcagcttctctgctagatttctacattaacttgaaaattttttaaccaagtcgctcctaggttcttaaggataattttcctcaatcacactacacatcacacaagatttgactgtaatatttaaatattaccctccaagtctgtacctcaaatgaattctttaaggagatggactaattgacttgcaaagacctacctccagacttcaaaaggaatgaacttgttacttgcagcattcatttgttttttcaatgtttgaaatagttcaaactgcagctaaccctagtcaaaactatttttgtaaaagacatttgatagaaaggaacacgtttttacatacttttgcaaaataagtaaataataaataaaataaaagccaaccttcaaagaaacttgaagctttgtaggtgagatgcaacaagccctgcttttgcataatgcaatcaaaaatatgtgtttttaagattagttgaatataagaaaatgcttgacaaatattttcatgtattttacacaaatgtgatttttgtaatatgtctcaaccagatttattttaaacgcttcttatgtagagtttttatgcctttctctcctagtgagtgtgctgactttttaacatggtattatcaactgggccaggaggtagtttctcatgacggcttttgtcagtatggcttttagtactgaagccaaatgaaactcaaaaccatctctcttccagctgcttcagggaggtagtttcaaaggccacatacctctctgagactggcagatcgctcactgttgtgaatcaccaaaggagctatggagagaattaaaactcaacattactgttaactgtgcgttaaataagcaaataaacagtggctcataaaaataaaagtcgcattccatatctttggatgggccttttagaaacctcattggccagctcataaaatggaagcaattgctcatgttggccaaacatggtgcaccgagtgatttccatctctggtaaagttacacttttatttcctgtatgttgtacaatcaaaacacactactacctcttaagtcccagtatacctcatttttcatactgaaaaaaaaagcttgtggccaatggaacagtaagaacatcataaaatttttatatatatagtttatttttgtgggagataaattttataggactgttctttgctgttgttggtcgcagctacataagactggacatttaacttttctaccatttctgcaagttaggtatgtttgcaggagaaaagtatcaagacgtttaactgcagttgactttctccctgttcctttgagtgtcttctaactttattctttgttctttatgtagaattgctgtctatgattgtactttgaatcgcttgcttgttgaaaatatttctctagtgtattatcactgtctgttctgcacaataaacataacagcctctgtgatccccatgtgttttgattcctgctctttgttacagttccattaaatgagtaataaagtttggtcaaaacagatcaaggagggagacactcacaagtcattttgttgcaccccttgcacacatcttggcacacatgtacataaagtgtgttttacatatcatactccttcaatcaactgccctgagctcgcctttcagattttgacatttaattctacagagacaatcttagaagaaacatgaagaacaagctgtagctccaaactacagaatttttacttcaggctagcacctacaaagtttgtaagggaagtaactaatgcactagtcgtctttgaagtaacattggaaagagatccggaagattgatgaataagaaatgaaagccacgaagagtctcctagataggagccttttaactctaaaaactactagcagagtcagaatgattctaccaagttcaaggtcaacttgacacttaagttgctaattatgaataaatctaggatttttaaaaagctaaaactttcggtttttactatcaccgttgttactcaaattttcttcatttagcttcttagaaggagaaatttgtttctaggaaaagcttgccaattttaagacatctactgtcaggaaatttgttaaacgtattatttcattcctaaattcattcacttattctcacagccaatattctgtgagtaccttactgagttgtcctgaaaagtggttgcatcctgaagcccctgccaataccaaggacaaatcacaggccctctcacaaaaagcctttatggtcaccatcagagagggagaatgagtttcaaccaatgtagcatttcacatgggagcgtggggagggtatgtatcttttaatgggctgaggatgctcaactctctggtgaattcaggaatagtaaatggtttaggagtctaggcagaaataaaaatagaatttaggaatgaataccatccagctaggaggcatatgaggcaaactccaactgtaacaaaacttcagagaagtgaaacataagaagcccaagaccagcacagtggcgcactcctatagtttcagctactcaggaggctaaagcaggagggtcacttgagtccaggagttggaggctgcagtacactgtgatcacacctctgaatagccactgcacttcagtctgagcaacacagcaaaactctgtttctcaaattaaaaataaaaagcccaagggcagagagaagacggcagatttgatgctcttcttttcaagttagttttatttctgtgaaatgactttttattgagcaagactaatttctagagttaggtaaggtcattcttgagcaagtactcttcagatctaggaattctggcctaaaagtggacgaaaagttgaaaagaatcaaaatttttttgaaatacataattcagatagacaacaaccggaggggggagtcaaaaggcaacaacaggggtctacacccctggtctgagttcagccgtctgtaaaacttggcaatttttcttctgaagtaggagggaaatggctgcagatatgaccctctctcctccatcctcagcctctgtatttgggactccacccaagctaagccagtcatgccttggttccactctcataccaagacccagttgcggcccatgggaaaatgcctcatgtcagtgagcaatactccactttgtacctagtttgcgatagttaggttcttgtttttgcctttgagcctaactcaacaccttgatgatctgcctccaccccatgagtaagcccatctcagccttcccagggccctaaattcttcccctgtactgccacccaccctaaggttgaccccttgtgacctgttagtcccatctccctttcttctattcaattacctattttctcactcttggaaattgcttgtcctgtggcttccttagtcctagtttaagcatacattcttgaggatgtgaaatagcaacatttgagaatgctgcactgccagaacccagactgtggggtatccaccttgaaagaaacttgctatgtgaggaaaatggtagacacagatctagctctagtagtgtgctgctgctgagaatatagagaggttggagaaaagaggagccctttaacacactgccatgttctccccaaatcctggagatctcaaaagcgtcaatgtcctcctaagtcagatctctaactgatgtctgctgttccgctgggcacattggccaggttttagaggaacctaaggaacaggagctgccatttaagtggcaatgctccaagggatgcaatgaaacaaagaaaaagttgatattaaaatacagatagtttagtctagtgcaggctagcagctcctgccctagaaatgaatggctgtgttagccaggatcccttcagttgcacaagacataaacccaatgcagaatggcttaagccaaacaaaacaaaacaaaacaaaatatgtagtagctgataaactaggaagtccaggatgtggatctttaggtatggcttgatccagggacccaaggatgtggccagaactatagtctgtgtataacctatagttcagcttttctctatcttgccttcattcttggataggttatcttctagtgatgacagggtagctgctggaagccccagacccacatcgtcttggtctagcaaactctgaagaaagatccttatttttttccaatatttctaacaaaatcttggagttgaatactgttgggccaatttggatctcaggccaatcactataaaatcattctggccagaagtgggtgggagtggggagaaaacagtgattggttagatcagatgtgggtcacatgtctgtccccagagccagtccataaaggcggacctcagtaagtgagagggagggaagagaggaggcccagccccaagtgaaatatgaaatgagagactccccaaagacaagcccaagcctacatccaggagaagggaaaacagatacaggagacaggaaggatagcagctgcctgttacaatggcacagccaacaactctcacttaacagccggaaacggaggtgagacaaatgtgagcaaggctgaagaatgtcacagactttaccatgaacgtgaatggaaataaaataccctgcgaattgttggtctggcagtggactttgcagggggataaagacacctcatttagagccactgagagtttgctgtttcttaccatgaaacaatttagcctatcttgactgggacaagtaatgacaactctttttgcatcatcagttttttgcttacaaaccactttcacaaattttctttcttttcatcttcagcaccatggtgagtaatatagcaggtattattattatttattttacagatgggttaactgaggctcagagagcataagtgactgacttgggaagacagctagtaaatggcaaagccataatgtaatctcagatcccacactctcctctatactggtgtacacccacagagtattgcatgcaattgctgctcaggatgaaccttctcttgggtacacatccctaacatagttaatcctagcttcccaagcttcagtcagattttccaaagttatattttcaaagggaacactgaaatagcagcacgcgcagtctccaagtcttcagtactcttcagttggaatgattctgttgcactgtggaacacctaaacctagctattcatcccatttagcaatctaagaatacatatcaagagactatgagctctatcgtgtttaggggattctcgaaattgcagcaaataagctggccgtaagactcagaacattctgcaaaaccagtaacgtttaaggtcccattcctctatctttagtccagtcctcagatctgtaggcttgtcgaagttccctgtggcctcgtctctgaaatcaggcattaggtgggctgatacatggtaattatttattacaacgggatacatttagccataaaacaattacgtttagcctaatcccagccaacttaatcacgtcatgaaaaataaaacctatatttcaaccagctaatgaaaatgtgaaacttatctaaatccataagatatattgtactgcccgtccaactattacagaagtcatctttacaagaaaaggtcctcaaatatctcgtgaatgtgtctgctttctcttcgtcaccattgccactactacagttcaagcaccactgcatttttatgctccgtgtgctcttacccacttcaattttttctctatccatagccagtgtcatcttttgaacaacagaaatccaatcacaaaattaatggtctcagtaaaattcaaaatctttcctatggcccaaatggcctgacacagtctggctccttcttcctttttgagcccgagctctctcagtcttccttactttgtgctcacttgccttacagtggcttggaatgtacctttctctttccaataaacttgagcactttttcccaggctctagtatcccctgtttggaattcttttcctcctcggcctctcttccactctggccaacctcctcctcagtcttcagatctcagttgaaatgttgctccctctagggtagcctctctgccttcttactccccactctgacatacagtggggtcctctagtacaagggtcgccagaccccattaccaaacctttaccagtttgtagtttgtggcctgttaagaactggtctgcacagcaggaggcgagcggcaggcaagggagcacttccacccatgcttcacctcctgtcagatcagcggtggcattagattctcacaggagcacaaaccctatcatgaactatgcatgcaagggatctaggttgtgcgttccttatgagaatctaagatggaagagtttcatccagaaaccatccctcactcccaacatcccggtccgtggaaaagttgtcttccatgaaaccagttcctagtgccaaaaagtttggagaccctgccctagtgtatattctctcttttttcatttgtataatttaagaggtacaagtgcaattttgttacatagtggtgaagtctgagcttttagtgtagccatcacccgaataatgtacattttacccattaggtagtttctcatcatccaccccccaccctttatagtctcctatgcctatcattccacactctatgttcacgtgtacacattatttagctcccacttataagtgagaatatgtggtatttgacttcctatttctgagttgtttcacttaaaataatggcctcaagctccattcatgttagtgcaaaagacatgatttcattcttttttatggttgtatatatacactgcattttctttaatcatctgttgatagatgcttcagttgatcccatttttgctattgttgaatactgaatatattcaaaaatatattgaatatattctcttgtaacaccctagaattctccctggtagcaattactgcagttgtcattaaccaattgtgtgatgtgcccctgtggagcatgagagctggtctgtcttgccacctttgtctttctagcacctggcacagtggtggaacacagttgctcttccaaaactgcttgaatgaaatgaaccatacccagtttcctctgcacttagcagacagattctttctagcatcctctcacctggccttttcctagagccctcctgtccttcaacaccctatttaccttcactcagaacttactttccctcccctgtgcaaagctctgcactccaagcctctctctgttgccaccccatcacttcttcaacacagccaatgtaatccctcctctgccccatttgtatgagttcaactttctaccagcatgttcaccctgaaaaagtatctgcttaacaaatgaattgacaacagatgctccatagacaaacacctaacacagtgtctcaggtatagtgtgccctgggaacagagagttgtttctctgaactactcggcatctattttacctctgctaacagaaatttttttttcttcaggagatttctctcttcactctcagcctgtaagattcagctggagctgacatccaatccctggtggcaggggagggtatgtgacttagttcagaccagtggatatattttgaccctctgattggttcaaacagaggcacacaacccaaggcaagcccatgatgtttaatgtcacacttttctgggactggtaggaaagtcagcctttctcactctggtagacttgaagctggtagactgcatgcctgtagcttctgaaggaagggtggtgaggaggaaggcctgtggccacagcattggatgagcttgtcagacaatgaatccagcacagaggaaagcagagacaaaatttggagacagaccaagtgttgaagacattatttaagccaccggatttctttgtgcctggaggttttcagttacacgagctaataaagttccttcttttcttgaagtttgtcagatttgggtttctctcactttcacccagaagaatcctgatgacgccgtaaactaaagcatcaataaatacaggaacgcagtgaaagtcgataaaaatgaccttcagaagaccctattctagccatggttctacaactctcagaggctgagaccttggacaaactctgagttcccatctccttacctatagactgagcttggtggttgacctttatctccttatctatagactgacctttaatattgtttctagatttaaaattctataattctgtaatactaagatgtccacaaagcttaaacacaacagaactagttcacagaggtgagaatttagattaagagcctgtagaggaaagagtactgaatcgagggacctttcagggtctgccatatctcacgtgtgcacagcttcctagtatatttccaagttagagaaatgaggaaactcctgggctgataacagaacctactgaagtttgaaacccacaaataacaaaatagcaaccccataggcagcagtggagtttcatgagacagctgttggggatccgtacacaaagccggtttcnnnnnnnnnnnnnnnnnnnncccgcatatacatacacacacatatatacatgtagatgtgtatatatgcatatatccatatatatgcatatatatgtataatattactttaagttacatatatgcaggatatgtcttttcttaaatttaagataatacaaagtcattcataattaaccatatatagtaataataataataacagtgataacaattaaaaatcctagccagagactagtaaagaaagtagagctagtgaagaaagtaaatgaaacatcaggtatcatgacacatggatcagtgtaagaaaatgtgctattattctggtcataatggaaaacaagatatagatttgtaactgacatggtttcagcttttaactaaatatttctctggagctccatttgaatcaaaaggacattctgcatagaagtattcttcctacagaaggaagaactgccatatggaaatggacattgagccagagtctaatcttacatcattcaatgaaaatcctcctacaatcatgattaatagcatcctgatttatgcattttccattagagttatgttaactgaaaatctagcttcacacataaaaccatcaaactagaatcattctctatttcttcttactattcatttgtatatccttgagtccattccaaggaattcttttctatttgatttgttgtttctgagcctgtcacataacttgaaataaaaaaatgaaatcttgcccaatttctcaatgatcacagacagtcacacctccttaaacaattatctttcaactagcctcagattaaaattttagaaccacctttaaaatttcttttcatgccaatgtcctgaatggtattgcctaggttttcttctagggtttttattgttttaggtcttacgcttaagtctttaattcatcttgtgttaatttttgtataaggtgtaaggaaagggtccagtttcagttttctgcataaggctagccagttttcccaaaaccatttgttaaatagggaatcctttccccattgcttgtttttcctatgtttgccaaagatcagatgattgtagatgtatggcattatatctgagtcctctgttctgttccattgttctatatatctgttttggtaccagtaccatgctgttttggttactgtagtcttgtagtatagtttgaagtcaggtagcatgatgcctccagctttgttctttttggttaggattgtcttgtctatatgggctcttttttggttccatatgaaatttaaagtagttttttctaattctgtgaagaaagtcaatggtagcttgatagggatagcattgaatctacaaattactttgggcagtatggccattttcacgatccttgattcttcctatctatgagcatggaatgtttttccatttgtttgtgtcttatttccttcagcagtagtttgcagttctccttgaagaggtccttcacatcccttataagttgtattcctaggtattttattctctttgtagcaattgtgaatgggtgttcactcatgatttggctctctgtttgtctgttattggtgtataagaatgcttgtgatctttgcacattgattttgtatcctgagactttactgaatttgcttatcagcttaaggagattttgggctgagatgatggggttttctaaatatacaatcatgtcataaaacaccagaagcaatggcaacaaaagccaaaactgacaaatgggatctaattaaactaaagagcttatgtacagcgaaagaaactaccatcagagtgaacaggcaacctacagaatgggagaaaatttttgcaatctatccatctgacaaagggctaatatccagaatctacaaggaactaaaacaaatttacaagaaacaaacaaccccatcaacaagtgagcaaaggataggaacagacacttctcaaaagaagatacttacgcagccaacaaacatatgaaaaaaagctcatcatcactggtcattagagaaatgcaaatgaaaaccacaatgagataccatctcatgacagttaggatggctatcattaaaaagtcaggaaacaacagatgctggagaggatgtggagaaataggaacgcttttacactgttggtggaagtgtaaattagttcaaccattatggaagacagtgtggcgattcctcaaggatctagaaccagaaataccatttgactcagcaataccattactgggtacatacccaaaggattataaatcattctactataaagacacatgcacacgtatgtttgttgtagcactgttcacaacagcaaagacttggaaccaaccaaaatgccaatcaatgatagactggataaaggaaatgtggcacatatacaccatggaatactatgcagccataaaaaaggatgagttcatgtcctttgcagggacatggatgaagctggaaaccatcattctcagcaaactaacacaggaacagaaaaccaagcactgcatgttctcactcataagtgggagttgaacaatgagaacacatggacgcagggaggggaacatcacacactggggcctgtcaatgggtgggggccaggggagggatagcattagaattacatgtatacttatgtaacggacctgcatgttctgcaaatgtatcccagaacttaaagtataataataataataataataaaatttcctttaaagtttttaatatcatttgtgagggcattcagtgcatattagctctggtccaatgaagagagataggaactaagcatggaggaggctgggcacggtggctcatgcctgtaatcctagcaatttgggaggtcgaggcaggcagatcacctgagaccaggctggccaacacggcaaaaccctatctctactaaaaatataaaaattagccaggcctggtggtgcatgcctgtaatcccagctactcgggaggctgaggcaggagaatcgcttgaacctgggaggcggagtttgcagtgagctgaggtcacgccattgcactccagcctgggtgacagaacgagactctctctcaaaaaaacaaacaaaaaaaaggcgtggagaagctatggtgcttcctatggcctcttctgccccagtggagagggtagtggacggcagggagaaggaactgtattgaaaacatttttgcttcacataatccagaacctgatctcatgagtgacaaggcaagttaacttttcaatgtggtctttgttaactattattcaaaggctctgaagaaataggaaaatataacaactttccctcacctatttgtcaagccataaataagaggctaggttatagcatgtggcaccaaccattctgaaatcatcttactttcttctttcatggggctgtaaaattatatggtgcattctcaatttacttaggaaatggctggaggaaaaaagcttaggaaatattcatttcctatggaacacaggaaatctgcataaccttctctctatctctttcccttaacttttgggtttaggccaatattttttaactcattagcctttaactgagcagttgtttaacacatctgagggttgtttaggttgtcatttttcacataatcagtgtgtgcaaactaaagtggaactgtacacagtgacagtggctttctttcattcattcaacatgtttactgagcacctactatgttccaggcactatgccatgtattggaactaccaagagaaatagtccgatctctgcacccatgaagaataaagtccagcaggagaagctgaaaacaaatgtcatggttgagggaatagatactccatctccataaagtgattctttcacattgcatgcctgtaacaaagtatctcatgtacgctgtaaatgtatacacctactatgtacccacaaaaattcaaaataaaaaaatttaaagaaaacaaacagcagtgataatagagtatatgaaggaaaatgccagagggatgcacccggaactgtgggagttagagcatcccccatttaggtggcgtcattgttgagaatggcatctctaaggaaggcacagctaaactgaacctgaaagatgagaaggagttagccaagcaaaaaggaaaagggaagtggaggatgttcccaatagatccataatatagtctacacaccagcaccatgcaaacaaaagaattgtgctaaaaagattttttaaaacaactatccatgtttaaattacatcactgaaataactgaagaatgagttggcatggtatctggttccgtgtgctcttgaacaactaactggcggatgacaatgttccagcacaactccgggcacagatagagtggcacggatcagagctgaggctcagaaatgactgtcagaagccatttcatgttgtgaaaatctcatgaatttcctgaaacaggtcatttatactccagatgaacagacaggaagataaatgtaggaagaagggtggtgggaaagcaagcagaggacaccaacagatgtttccaaaagagtgtatacacaacttttccttcactttctatagctcctgttgcaacaaatcctgttgacaagcactgttgcagttctacaagaatgccctagtaaatacaaatgatattcttaaaagtattgtatgatgctttttccttgcattttaaggacatgaataggcatatcaaattcatacctgttatgaagattgataagcagaatttatccaattgagtttatgttactaaatatttatatttttggattgagtttttctctacttttaggctaaatccagaggttttcaatccatgcaagatgacaacagagatataatacatccttcaataatccacataaagcttagcacaatgcctggcatgtaagaagtgttcaatgctcaataaatgttagctattattattgttgatatgacctctttacagaaaataaacagaaaatgttttctgagacatgtacactcttttaaaatcaacaatacaagcacatgatgaaaaaaacaagtagttcacaaaatcttataatgaaaaacaatggtgacttgcttcctcctgcccacagcctctcttcttattcctcagacacaaataattgcctttcactttttcagctgttccatcaggtgtttgctttcctatttttaaattatagactatacctttttattgattaactcattccaggcattatcaattgacatctttccatggcagatgaggatttaggtctcttgcatcatttcctttagtcattcactcaagaaataataatagctaatattattattttgagacagggtctctctctgtggctgtggtgcaatggcatgatcaatcttggctcactgcaacctccacctcctgggctcaagccaatctcccacctcagcctcccaagtagctgggactatacaggaacacacaatcacaccaggctaattttttgtattttttgtagagacggggtctcactatgttgcccaggctagtctcaaacacctgagctcaaaagatctgcccaccttggcctcccaaagtgctagaattacaggcatgatccactatgcctggccaactcaacaaataattattgaacacctagagtgccaagcacttatctaggcactgaggatacagcagtgaacaaaactgacaaaaattcattgcctgcaagaagtttacattctagtggggaagagagacattaaacatgtcagagggttacatgttcaatggagaaaaatttagttggtgaggaggatatggagcactggctagagaggactacagcttaaatactttggtcatgaaatgcctctctgagaagttgatatttgacaagactctaactttgggaattttctgatgttgtttctttgataagctccatcaggtcatttaaggacttctctacactggttattctagttagccattcgtctaatcctttttcaaggtttttagcttcattgccttcattttctctcttctacttttttggataccctattaatcaaatgttgaacttgctggtttaatcctctacaatgcttggattttcttttctatctttctctgtctttgagtttttgttctattctctgggagattttcttgacccatcagtgtgctgtattcaggagactatctcatgtgcagacacacataggctcaaaataaagggatggaggaagatctaccaagcaaatggaaaacagaaaaaggcaggggtcgcaatcctagtctctgataaaaaaaaaaaaaaaacgttaaatcaacaaagatcaaaagagacaaagaaggtcattacataatggtaaagggatcatttcaacaaaaagagctaactatcctaaatatatatgcacccaatacaggagcacccagattcataaagcaattccttagagacctacaaagagacttagactcccacacaataataatgggagactttaacaccccactgtcaacattagacagatcaacgagacagaaagtcaacaaggatatccaggaattgaattcagctctgcaccaagtggacctaatagacatctacagaactctccactccaaatcaacagaatataccttcttctcagcaccacattgcacctattccaaaactgaccacatagttggaagtaaagcactcctcagcaaatgtaaaagaacagaaattataacgaactgtctctcagaccacagtagaatcaaactagaactcaggattaagaaactcactcaaaaccactcaactacatggaaactgaacaacctgctcctgaatgactactgcgtacataacgaaatgaaggcagaaataaaggtgtctttgaaaccaatgagaacaaagacaaaacataccagaatctctgggacacatttaaagcagtgtgtagagggaaatttatagcactaaatgcccacaagagaaagcaggaaagatctaaaattgacaccctaacatcacaattaaaagaactagagaaggaagaacaaacacattcaaaagctagcagaaggcaaaaaataactaagatcagagcagaactgaaggagatagacacacaaaaagctgttcaaaaaaatcaatgaattcaggagctggttttttgaaaagatcaaaaaaattgatagaccactagcaagactaataaagaagaaaagagagaagaatcaaatagatgcaataaaaatgataaaggggatatcaccaccgatcccacagaaatacaaactaccatcagagaatactataaacacctctatgcaaataaattacaaaatctagaagaaatggataaattcctcaacacatataccctcccaagactaaaccaggaagaagttgaatctcttaatagaccaataacaggctctgaaattgaggcaataattaatagcttagcaaccaaaaaaagtccaggaccagatggattcacagccgaattctgccagaggtacaaggaagagctggttctattccttctgaaactattccaatcaacagaataaaagggaatcttccctaactcattttatgaggccagcatcatcctgataccaaagcctggcagagacacaacaacaaaaaaattttagaccaatatccctgatgaacatcaatgcaaaaatcctcaataaaatactggcaaactgaatccagtagcacatcaaaaaccttatccaccatgatcaagtgggctttatccctgggatgcaaggctggttcaacatatgcaaatcaataaacgtaatccagcatataaacagaaccaaagacaaaaaccacatggttatctcaatagacgcagaaaaggcctttgacaaaattcaacagcccttcatgctaaaaactctcaataaattaggtattgatgggacgtatctcaaaataataagagctatttatgacaaacccacagccaatatcatactgaatgggcaaaaactggaagcattctctttaaaaactggcacaagacagggatgccctctctcaccactcctattcaacatagtgttggaagttctggccagggcaatcaggcaggagaaagaaataaagggtattcaattaggaaaagaggaagtcaaattgtccctgtctgcagatgacaggattgtatatctagaaaaccccttcgtctcagcccaaaatctcctaagctgataagcaactttagcaaagtctcaggatacaaaatcaatgtgcaaaaatcacaagcattcttatacaccaataacagacaaacagagagccaaatcatgagtgaactcccattcacaattgcttcaaagagaataaaatacctaggaatccaacttacaagggatgtgaaggacctcttcaaggagaactacaaaccactgctcaatgacataaaagaggacacaaacaaatggaagaacattccatgctcatggataggaagaatcaatatcatgaaaatggccatactgcccaaggtaatttatagattcaatgccatccccatcaagctaccaatgactttcttcacagaattggaaaaaactactttaaagttcatatggaaccaaaaaagagcctgcattgccaagagaatcctaagccaaaagaacaaagctggaggcatcacgctacctgacttcaaactacactacaaggtaaccaaaacagcatggtgctggtaccaaaacagagatatggaccaatggaacagaacagggccctcagaaataataccacatatctacaaccatctgatctttgacaaacttgacaaaaacaagcaatggggaaaggattccctttttaacaaatggtgctgggaaaactagctagccatatatagaaagctaaaactggatcccttcctcacaccttatacaaaaattaattcaggatggattaaagacttaaatgttaggcctaaaacaataaaaaccctagaagaaaacctaggcaataccattcaggacataggcatgggcaaggactttgtgtctaaaacaccaaaagcaaagacaaccaaagccaaaattgaccaattggatctaattaaactaaagagcttctgcacagcaaaagaaactaccatcagagtgaacaggcaacctacagaatgggagaaaatttttgcaatgtactcatctgacaaagggctaatatccagaatctacaaagaactcaaacaaatttacaagaaagaaacaaacaaccccatcaaaaagtgggcaaaggatatgaacagacacttctcaaaagaagacatttatgcagccaacagacacatgaaaaaatgctcatcatcactggccatcagagacatgcaaatcaaaaccacaatgagatatcacctcacaccagttagaatggcaatcattaaaaagtcaggaaacaacaggtgctggaaaggatgtggagaaacaggaacaattttacactgttggtgggactgtaaactagttcaaccattgtggaagacagtgtggcaattcctcaaggatctagaactagaaataccatttgacccagccatcccattactgggtatatacccaaaggattataaatcatgctgctataaagacacagcacacatatgtttcttgcagcactattcacaatagcaaagacttggaaccaacccaactgtccatcaatgatagactggattaagaaaatgtggcacatatacaccatggaatactatgcagccataaaaaaggatgagttcatgtcctttgcagggacatggatgaagctggaaaccatcattctgagcaaactattgcaaggacaaaaaaccaaacactgtatgttctcactcataggtgggaattgaacaatgagaacacatggacacaggaaggggaacatcacctaccggggcctgttgtggggtggggggagtggggagggatagcattaggagatatacctaatgttaaatgacaatttaatgggtgcagcacaccaacatggcacatgtatacatacgtaacaaacttgcacgttgtgcacatgtaccctaaaacttaaagtataatttaaaaatatatatatatatatatatatatatatatatatatatatatatatatatatatatatttaaagaaaatgtggcaaaaaaaaaaaaaaaaagaaaagaaaaaagaagtctaacacataaggaaaaaaaaaattttctgtaacccttactagtatgtaagctcctggggcagacaccacatgaagtatatctgtctctgtattgtgagtcccaggcacattgcccgacacatagtaggtgctcaataatgtttgaggaaggaagatgaatttcagtaaaggaaatagaatttattaagatttattaagatctcctatcccatcccctcctggagattatttctttctctttcttccacgtggctatctttgacacttatgcttaccttccctaggcagtgtcatatgttctgaaaccttcctgcagcatcaaacacctgtcctatgtcacattaccactgggactctgccctcttctggtcaatatgggaactgatctttttttttcctgatgctattttaatggatgattaagggctaacctattttccttctttgtctgtatttctatcttaattggcaatttctggaaaaacaagaactagccccaaagtaaagacttcaatccatttctgtttagtaatatgtatataaaccaagccaattaccaaattcatgagggatgaatccatgtatacaaccatggcagtcttctttcatgaatttaagacctatttattgactacctatgttaaaacaaaaacttccgctgaattaaatttaaaggagtctaattgagcaatgagcaattcatgaatcgggcagcccccaagatcacagcagattcacagatactccaggaatgcctatggtcagaacaaatatatagagaaaaaaaaaggaagtgatgtacagaaatcagaggtgaggtacagaaactgctggattggttacagattgctgtttgccttatttgaacacagtttgaacactcagcagtgtacaagtggttgaagtatggctgctgggattggccaagtctcagctatagtttcagggcatattcctaagttaggttttcaatcttgtcggcctattaagttaggttgcagttcacccacaaggacttaaataaagaagtacagagtccttctcaggcaatatttagtttgctttaacaaatccccacttttggtcatttttctcaattttgaggcattaaccaaaacattagtcattgatgtcactatcaccattgtaaatgtacttatttggtcttgaaacccactaggaaacagtagaacagtgagttttgcaaaggtaggaacaagggcttgagtacaagttacctccttttgctggaatattctgtttacaggagaaaaatgaaacctggtctattctaagatgtatgtgtttgcttaaaatcttagtttgattatatcacatgtagcatgagcgactccatttttgtttgctttggtctgctggggcctagtgcatgaactcagtccaaaacaatggcctcctgtaattttgctttaaaaaatctccctttttgcgtcaggttctcacttaggtgagagtgtgaccaaaacttagggtcttagtgccacactcagttaccatcattttgggtttccagtctcagcatgtcattcataggttacagtgtccttacggttgaacacttctttcagctcttgtcattgcagtgaagacagaccatttgacattctagagatggctgcatgcaaacatttaaaaccttcgagagaatacagtatgccagggagactgttattatgactttggggaggataataccaagaatttggagtatgctccttactagggtccccacaaaccaaaccacctaaaatcaaatagattagagaatgagctagacaaagagtctactcacttaactaagcagtctcttcgttaatcccctacaagtgaatctctataatctacatttgatgtatttctccataggccacgagggccagcagctgcacagatacttttctgttcagccactaaataatctagagcaattctattatttagcataactttcagaagagaatttaagtctgttgtgtaaccatagcctttatagtagaatctgctacagagcctgtcatgagggatacatttctaatcattgtctgttttattccaagccatgaaaaaagaacctaacaaatgatgcctctcttgaagagtgaaggcctcctggcaatgttctctttaacccatgatgtgggttaagaagagtgaaccaatgttctgtttttgagtgattatgaggcaacatatgtacaactaaagtttcttatctacattaggactttttttttcttttttttttgagatacagtcttactctgttgcccaggctggagtgcactggtgcaatcttggctcactgcagcctctgcctcccgggttcaagtgattctcctgcctcagcctcccaagtagctgggactacaggtgcaccaccacgcccagctaatttttgtatttttagtagagatggagtttcaccatgttggccaggatggtcttgatcccctgaccttgtgatttacccaccttggcccccaaactgctgggattacaggcgtgagccattgccccagccaggccttcatttttttatctatcaaagtataaggttatccatgtatacggctggttgcaaaacccttcacaaataaaagcataacccataagtgcacacaacagacccccttttcatttctattgttcatagacacataaacaaggagaaaaaattcaaagataagagtctcatgagagtagagaagtcttgatccatgatctcgggaaaagctgctcacatcaaggatgccatcttctggagagaaactttcctggttagctttaccttaaggattccagcgggtgtacagttccaagagtgtggagggacccttctcagttgtgacattatgaacccaaagttcaagtgtccaaagtcttgttgtagtgtaaatggcaagggcagtctttccctgatattttcagaagatcccgttttcaggttctagtttgtgaaggagttgactgtcctcagtaaaacataaaaagctttctttagctggtgaaattacaatgtagcataataacgtactgttacaacatcagtcctcttgcatgagagaacttttctataaccagaaaacatgcattgaaaatgacaattgaatgaaatccctttataaaatgtttaaatggaccatcaggtaaccaaatgtacctgaagttttgattgttttcccaggaatatgggtttgacaaaccaaacactggttatacactatttatcaatttataagttaccacaccaatatatttaattttgattattttatcttttccatgatgagttatggaatgcaggacttttaataacaaaagctttaagggctcaggaaggacaaggcagctgtcctggtcctccaagtatccatccttaacattggacttatgttctcttgaacaccagttgtttttccaatttaggtgcatagcactgataactgataggttaccacaggtaatttgacttagaccacggagctcattcaaattgcatatataaacaatttcagtattggctgatttaggatgaaaatctggcaaagtattttcttggtatttaattaatttttgttctacatgggttagtagttttataacccagtcagtcttttctgtaacattccaggaatttttacccagtccaaatgatatgattctaaagttatcagaaacctgtattcaggagtgcttttcaaggttctttctatcctttcatgaacctcctaaaaaacatcagcatattctaggattttgtatgcttatgaagttttcagaaactgcaccagcattaaccaattaactggaaataactttaaatagtcatagtaaaaaatacaattgacaaggaaatttggttctttctgtggtctacaataacaacataataaccataattataattgatagcatatagacatattagaattttagaaatcccatgcaattttgggacatattgatgatatacactagaatgtaacctaaagatgtataacctaaaacctataaacattatttcttattttgacaatacttcctatgtaacttaacataccaaataatcttgtttacctctttttcagttgcttcaggggccctatgtagcatcccaaagttagaggtcagaaaagacaattttgcagctgaaatttgattttgggaagtctttcaatatgttaaagctttaaaacacttgatattatgagatagaattgcaggtcaccacaagccattcatttagccaaaataatgagtttaaaaaaatttttaaggcaaaaacctttacatattgatagagggaagatttagctttccaaataatctgtcccttgtctttcccttcttttttcagtagtttattcagtagttattcagtagtttatttgtttgccttattcaaaaggcaaacaaaagtctttcattatcctttgatattacctgaaaattttgtttgagagggaaccaaacttcacacttccattaatctactattaatgtcaaccccaatttttaataacacttatagacaaatttatcaatttaatcagtttggccaaaaggtgagattctcataaacctttataaccctttacaatttttgttaaagaccagatcagtactctaagaaaaacctgttatgcttttattttaatgttcaatttacagaaaaactggataataccccctttaactttagccaatatggttacaaacagaacgttttacaattaattttacacaccttccacaacttgctcaaagctttagcattttttttttttttttgaggcagagtttcactctgttacccaggctgaagtgcaacggcacaattttggctcactgcaacctctgcctcccaggttccagcaattctcccacctcccagcaattctcccacctcagcctccacaatagcacgtgtatgccaccatacccagctaattttttgtatttttagtagagatggggtttcaccatgttggccagactggtctttgaattcctgacctcaagtgatctgcatgccttggcttcttaaagtgttaggattataggcatgagccaccgcacctggcccaaacctttagctttgtcttatttaatttaaaacaatcctttaaccctctaaactgggtaaaaatttacattcctatgccttcttataatttttttttaccaaaagcatatttcactttccttacacaccttgaatataaaactgttttttcagtatctcaattacatgtgataatggtaactcttagcaacttttatttttggtgcataaatttcctttcacaagtcttttcatgacttgcacagatcatctacaacatccttggactttctcacttgtcctaaacatcccttttttaaactagttattttactttaggacaagaatttaccatacaagatcctttctttcataaaatttcttttctttataatcttctttgcatagctaaggggcatggctaattccacatgttcccaggccttatctagaatctaatgtctccaaggtaggtaaattgaacaattttcaaaagtcaaagcagtttatgaccttaaagcatttagcaaacctaatatctgacctgcctaatttagaacaaaagtctttattttaccaataatcttttaaactttttatttcccaaagattactaaggttacatgaactaaaaagccttaaaatttttatttttctttcaaaaaattttctttaaatgcttatttttctttaagccaattcgttagagctcttttatataaacatcacacatacaacatatatataactatacagatagacagaagaagatccagtagttgtaagatttttcctttgccagtttttaagttttttaactggattactggctttagggtggagtccttggagagacaggaccaggaaagcatgcagtttctacagcccaatataataaacagacacagctggaaggcaaatcagatctccagaaagtaagggtcccattcccatttttataacagatcctggatccccaaaagaggggatcagctcatctcccatgggattcttatctctcagttgggggtggggacatttccataatttctaggtggccaagagcatgcttctcttatccaaacatgcagagctaagtatctccccataatcgccattagctaaccccaaaagtatatttccaacctagttactacataccaaacctctcttataatgcaaagtaatttctgataccccccaaagtcaaaaatgtcagataatgccacgcaaaagagaacagagccttagatttttgagagggaactgtcaggtggctagaatacagtaagccaggagtaaactgtcagagatgaagaaagagaggtagccaggagactagtcagagacagccttgtgaccactgcaaagaccatggattttattctaaatgtgacataaaggtattgaaaagatttgagcacaggatcaacatgatactacttatattttaagaggatgactgtcactgttatgactttaggaggaagcagggagttgagggaagagaagaaacagatgaatcaggaggcacagtgcagcaacaagagatgaaaggtaacagtggcttggactacaatggtagtgggagaaggtgaatacatggtcagattcaataattagttttgaagttaatgccaataggattaggagatgggtttgatacaggctgtggtagaaagaaaggagtccaggataatgtcaaggttttatgtcacgggaagaaggagaaggttccatttaggtaacaatatgtaatagcagcatgttgcaacccacacatattttattaaagagttcatgaattctgttaacttaggatccttctgctctaaaggctaacatcatccttccagctcccagggaaacacttctctatatcacttgccccatatccttgtaagtttctgactgtcatgtccaacctgcagcccatgggccacaagtagcccaggatggttttgaatgcagcccaacacaaattcataaactttcctgaaatattatgaaattttttgtgttttttttttaccttatcagctattgttagtgtttcacgtattttatatgtgacccaagataattcttcttctaatgtggcccagggaagccaaaagattggacaccccagtacaggttgcaccattgccaacactggagattaacactgctttgagtaagaagatgatttgagcagtagaaacacttgggtgagacagaaaaccaaatgagcatgtcacaccttttttctacataaatgacatcatttcccagtagtactgagcatcaagtttcttgcttctcatgatattccaatttgtgaccttggagatgcttaccaatgagctattcaagataatgatataactattcgacttaataattcaatgagataacaattcaaaaagcatatggcttctgaagaaaacaatttgtaacttaaaaaaatcacattacttttaaatttatatatgtaggtctcagtctaactaatgtgtgaaatgtaatattgattcttaacactgataataagatgaacactgaacattagatttgcaaaaagctttacttctataaaatatttgataaatgtgattaacttttcaaaaaactaaatttaaatacatgaaaattaggagatgaaggcagagtcatgcagaatgaagttttgaacacgagctctgttaagggatcagttgcattttcttactggtagggaatcagcctacctcagacacctgggcatcaatccactggtgtgaatgtttttggagagggacaagttttatttaaataattttaaaattttgttatatattttgttatgataatcacatgtatttatattttgcctttcaattttgtaggttattttaaatagaagaaataacttttttgaaaacacaccaaaataattttaattttataattttgacatttactctaatatatttttataagatacattcaattttatatccactaaatatattttattaattctttagatcattaatggcaatgtaacacacattcgatgaaaaactcattataacataacaaatgattttgcaaagtcaagaaaaatctattttatagaatgactatataaaaatgtacatactaacatataacaatgtatgaattatatatatatattattttcaacctgtaagttaaataatgtttaataatacttgttcaattccatttaataatctttgttattttgccaatgaaagcaatgcatttactcatatttttattctgtctgatattataatagtatttttgacaaggaagtaggagagaacatcttttatttgaccagggttagcttgatttataacttcttaaacatttggtatttgggtattggtgctcttgcctagaccctataaatattccagacagcttcgttgttcacagagaagactgtgattaactctgtctggagggtcagagaaagcttcactcaggaggtgctgtcagtctggaggttcagagaaagcttcaccgaggatagggtcatgaagggcagttaggagctcatcagtaggtgagctctccatcagactatggaagaagggcattcagagcacaagaacagcacatgcaaagctgggtggccatgttctgtgaaatgcagtacgtttgacctagttggatataaagttatgtggggctaggggaatggttgggcatggagctagaaatacgactcagagaaagacatcttttgctctccaggagtttgaaaggagtctggtggcagtcatggtgcatatcttaggaaatactttgagtgacagatcctgatacagatctttgctattctacccagcctaggatctttcgttttgtgtattttttgagacagggtcttgctctgttgcccaggctggagtgcagtggcatgatttctgctcactgcaacctccgttttccatagcccaggatcttaaaccaagtaaattcttggaatatttgctgaattgaagtgaaaaaaattacatatttgaatttattctttttttttttttttttgagacggagtttcattcttgttgcccaggttggagtgcaatggcatgaccttggctcactgcaacctctgcctcctgggttcaagcaattcttctgcttcagcctcccaggtagctgggattacaggcatgcgccaccacgcccggctaattttgtatttttagtagagacggagtttctccatgttggtcaggctggtcttgaactcccaacctcaggtgatccgcccaccttggcctcccaaagtgctgggattataggcgtgagccaccacgcccagccgaatttattcttaaggctacttgttagaaatgctatgagatagttgaagccttgcaaacaataaaatattaattaaaattaacataataaattatgattatcaccaataatattaataacagccttgtcaataaactagcacatgatgatcagtatattacatgctctagatgaattatctttcttttttttcccagctaataaaatgatcacaaatacatgaaatatctcttaattctcacatgaatgctgatatagatgggctatcaagggacagtgagatgaattcacctgccctgatacagctaataagtgacagaccagaagtctaaactcaggttggcttggatctagaaagatttggaaggtgtcccccctcctcccactccctccccacaaggaacaggcagtgcttttaaaatagttcaaaggattgtaatcgccctcaaaatgcaccactttgtggggtttttttttctcctggcaactttacaaggtttgcacaatggccacatctatatgataaacagatggagcatgcactgtttccatcggtgaaacacacaatggattggtactggggtttctgtgggaggtgaagggactcgccagccaataagagaacacagatattcaactgacagagctaggggacaagggtttccttttgcaggattcctaagtgctgtcagtaagaatctatttgccccatcaagggatcagttgagagacaccttttcccccaaactggaagtactggaatctattagaaatgtttagaagaatgtaactattaagagaagggaaagaattacttcatggtatacaaaaatttgatgaagagatttccttacaggtgaatctcagttacttggagccagatgataggagagtttgctgaagaaagatgagggagctgggccaccagctatggttttgcaggttgtacactgcacaagggtacctggctggaatagcaagtgagaccaaaacccagcaagcactctgcttgccaactcatccacactggtgcagggtttcatctgcccaggagaagggaaactttgcttgaatatgtatatattcaccaaatgtactagtggcagcccagccctagagtgcctcctctttaagggtgccagtggtgacattatgcattcctcctcagtcttccaaatctccaccacgacttggagcatttgagagactatatagagtagtagcctctagcagtgcactaccaagttcagtagccactagtcacgtgtggcttttgaacagttggaatgtggctgttgcaaattgagatataaaatacacaccacgtatgtaaaatgtaaaatacacaccagattttaaagactttatatgaaaaaagaataaaaagtattcattaataatttgattacatgttaaaatgaaatatttttatatattagattaaacattattaaaattaatttcacatctttttactttttaaatgcagctattagaaattttgaaattctctatttggcttacattatacagttgacctttaaacaacacaagtttgagttactcaggctcactcatgcatagattttcttccacctctgccgcccctcagacagcaagaccaatccctcctcttcctccccctcctcctcctcctcaggttactcagtgtgaagacaatgaagatgaagacctttatggtgatccactttcacttaatgaatagtaaatatattttcttttccttatgatttttttaatgacattttcttttctctagcttactttaccctaagaatacagtacataatacatataacatataaaatatgtgtccatcaactgtttttattattataaggcttctggtcaacagtaggctattagtaattaggttttggggggtcagaagttacatatggttttcaactctgcagggtgggggtaccttggtgcccctaacccccacgttgtttgagggtcaactgcatttcacttggacaacatcgcactagagtcaggcagaggtggtttaaacccccacccatccacttatcagcactgcttcttcaggcaagtttctttgtttgtttgtttgttggtttctcaagacagagtctcactctgtctggagtgcagactggagtgcagtggcgtgatctcagttcactgcaacctctgcctcccgggttgaagcgattctcctgcctcagcctctcaagtagctgggactacatgtgcacaccaacacacctggctaatttttgtattttcagtagagatggggtttcgccatgtgggccaggctggtttcaaactcctgacctctagtgatccaccctccttgtcctcccaaagtgctgggattacaggcatgaaccaccgtgctcggccttcaggcaagtttcttaagtgtttattttctgtaaacatgacttcataaacttacagagttgttctaaagattaaatgaggtaatgcatgcatcctgacactgcactagcacgtaaacattattattaaagtgttccggtcacagttcccccaaagagagggacaggagacacaagtggatactcccagcattccaatgcacaggtacaaattgaggaccagaatcaagccatagcctttatacaaggaaggagatcttgcaaagggccttacctttgagcactgttttttgttgttgttttgttttgtttgagatggagtctcgctctgttacacaggctggagtgcagtggcaccatctcagctcactgcaacctctgcctcctgggttcaagtgattctcctgcctcagcctcccaagtagctgagacactaggcacgtgccaccacgtccagctaattttttgtatttttagtagagaaggggtttcaccatgttggccaggctggtcttgaactcctgacctgaagtgatccacctgcctcggcctcccaaagtgctgggattataggcctgtttttctcttttcagaaatcctgcctttgttccctagaagcctgctctctaaggactctaaggaagcattcttgctggagtcatctggagccacctatctatgccactctgccccatggggccctacatggtaaggtgctcagggcagtgatgtagctctgttttcttcactaggctctacactggggctcagttctaggtgatgtgttttcaggagcactgttttttgtttgtaaacatactgcccttttcccctcgtaggagactgaaaagaaaacaaacaaacaaaacccaacaagctgctctgcaaccacaatactcaccgctacgtgtgtatccagcttgttcttggacaggtaaaggtaggagggaatgttcatagttttcatttttgcaaaagcctcaaagatctgtataaatccttggtccagacatgtttctttgtgggcacattgacaacgtttcgattcataaatgaggaagcgaggacagatgtgttaatctgaatgctcagcttctgaacaagactgaatattcgttcatctactcattctacatttcagaggggttcacaccagatttccaggggcgcacaagttgcaacctgagtcaattcctttgatcacaactgtcatttttctctcaaccccaaccttaggtggctcagtcatttgttcgttcactttcccgctaaggcttgtccctggaatgccacagctgcagagttccccacataaacaaggcttctaactaactgatacactcaaaacttactgataaagaaagcagcaatagcctatgcttgaagatgacaaaaagaaaaaataaaaataaggaaaagaaatagtaatgaaaacaagaggagggtgtcactgtctgctgattggatctgcacccagagagccatgcacttttctgagttttaaaattttccaacccaaatcagcacaaactgttaagctttgtgctgaagattgtggggacaggaagttagaataaaaggcaagtgatgaatatcatttatttaagaaatctggactcaactgaccatcatgatcgttgtcagttttgcaccataaaaatatttagtcaaaaggtttctgccctgttcctgtttctttttgccccttcacgattccattctgtttccagtatttcactagctgggaaattttatttttgagttctgaaaacagagaggcatggtctccaagccataggttgattttcattgggaaaatgttgaatgaatgtttggtaggctcacgacacgaaatgaaaggagatgcaaagataaatgaatgttgcatgtgccttcacggcatttcagtctagaggaagagcttagatgtatatttaatcacccacaaacatttattaaatgcttacttggcttactacatgccaagcatgttctcagtatcgggaacaaagcaaagacattgctatcatgtggctcatactctggaagaaggagacaaacagtaaagaaataactataatgtgcctgatattatagtaccaacttagtgctgttcaccaaataattctggctctcccccttgctgggcacatggtgacatcactcttcccttccctttttgaagttaggtgtgacttgttatgaccaatgacacaggagcagaaatcacatatatcacttgcaggcagaggctttaagagtcagtgcacaacccaccacatatcccatcaccactgctgcggtaattgcagaaacacgtgttaaatgatgcctcgtcactcttcaaccctgggccattaccatgatcagaggctcctgctgaccttcagtagacatgtagtgtgagcaagacaaatgtttgcttttttagccactcacatttgaggattatcagttacccacaacatagatcttttctgagaagatgggttggctaagtactctgcagaaaaaccaagcagggttaaggatataaaggaatggggtgagaggaagtggttcctatatcaaatagggtggttagggaggtcctctctgataaattaatatttgggcagagatatgaaagaaatcagagtgccagccatgaggatttctggctgaagaacatctcaggcagataaataggcaagcacaaatgtcctgagacaggagcatgcttgcaatgtgtgatgagaccagtgtggccaaagcacaatgtgaatggaggagagtggtaggaaatgaatttggaaaggttggtgggcataacagaggagggctttatggtctgcatgtggtatatgttaagatcaagtgtgacgtgaagtcagaggcgtgtgagatgacagtagatgaacagcatttgagctggtcatctttgatgcttatcactacctcatcgtttatgtctaactcatcatcaaatcctaatgatctcttggatctcttccctctgccctgcccttgtcagccccacagccaccactttggttccaggcttattagcctttacctgaaccattgcagtagctctctaactgaccaagtcctttcattcttagagccctcaaatgaatctaatctattacagccactgcctccaggaatgaatcctttaataactcaaaactgatcaagttacacagccccagttataacacatccatggctccacactccctaatgaaaaacaaaacaaacccaactatttagcacagaatgcgagactcttcctatgaaaacctacaagtccccctctccagtcttgacctcaccatcactctttcttcctcatctccagaattctctcactccttcagcttcctacacatcactttgtttcataccttcgtgtctttgcactcattcccttggcctctccagatccttatctgccagcatcactcaaaaccctgtttcatcatggcctcctttgcaaaacttcctgtggcactgatccaatgaggttcccctctcctttaccttagcattttaaagactacatccatggctgcacgtatgacctagtatacattacctgtttacgtggctgctcctcttccagtgtgtatgttctttgagaatggaaacgtgtgattcacttctgttatcaggggcagggcctgtacagttcttcctccaccatggggtgattgtgatgtctccttcaaaagcaccctctgagtttccagaccttgcctccaaacctgttgtctcccaaacctgttgcccatgctttgcttctaacttttggttttattctctgttaaatgctttggacttaatattttcaacccttccacatttccaccctcaggctttgcactggacacccaaaacataccacctggggcctgcttggatcaatcctggtacctggaccacttccagagccgaggtcctatttgcagtccagtagttgggcattgcacactgctgtatacaacagctgcttcacacaggactgcagaactgaactgccctcatgttgcttcaccttctgtcttcttcactgtgcactggcttaagaaaatagcagagctttctccaattctcccccaagctgactcaacataaagcaaagtttcaaaaggtttgaaaggtgagtggcagcagcttcctatagcagtttgggtggtcccaccagggcccatcaaacttaccttacctacctttctttatctccacccaccctggtgcctttctaccttgagttgctggaaatgccttcagagcccccacataggaatagagtttgtagaatttgtccaagcctgtctgaaataggggtatggaaaccacaagaatgaagttgtggttttttttaaaaatacttggcaattcttcccaaatatgcattctgatatgggtgaggagacagaatgagatccttgtcagactctgttatgtcagcatgaatctcctcctagggccattttgcctcaaagagtatgttttgagtctttttgtcctggaaaaacccacaggagctgtgagtaaggatggtggcatgcaggggcccaggtgtgggctggaacacttcttgctgccagctccagagttcctgggaaagcagtatgatagtggtaggaagaatttctaggcaatactgctttcagggaataaaggtgaaagtgaagggaaaattaagctcacaaatgaaaatgaaagataaagtagcctttcttttctctggcctgattaagcttagtactctttcgttgatgaaaagaggatccaacatgaggattttaagcttgtgctgtccatggtggcttcatatctagaaggtatttttaataaaaggagtgctcagatcactggctagaagaaagagcacccaagcacatcagagatgtcatggttagtcccagatctcacaaagggaaccaaaggattgaccaaccccacacaggtcaggtctcttatgtttgaagccttcacagtggcctaaaaacatctgcatgaagcctccaaatggtagacaactggatgcttgatatctcctctattttcttattttggcatagattaatggcttatgatattgcatcacattggtttattaaaaccagaactaacttccctttaattttaattatgagtgaggtttattcagagaccattgcgaatgggtaggaatcaactacaaaagtgtaaaacctgttttcagatagaggccccttgctcccaatgttggaaataaggtcctaatcccaaagttaggtaattttcaggtcaccccagtgaccactggagagacaagagaagccagggagagagtttctctgagaatcagtcagaagtctaggcctgtgtctctcaaccttgattgtatagtaagatctccagggaggttttttttgtttttttgtttttttgtttttgtttttttttttggttttgtatgtgtgtgtgtgtgtgtgtgtgtgtgtgtgtgtgtgtgtgtgtgtgtgtttaattcccagagacggcagacaagctcaagaggtcttcaggtggaaaactagagccattacctgagtagctgtaatgcagctgctgcctcaactctgtggtaaaagggagatattaaagatattggatcaaatatttcaccccctgcagagaagtcttcatgctgcctacgaagtcttctcttgcttaaaggtgcttccccactccccagaatacaaagtccaatgcatagcatctctgagaatcaggcctctttctcctgttcccggcttcccaagaattccaccattccagtttttttctaggtatctaaccttatctacatagccatgtatctgagtgatggctgactccatccctatatcaaagtaagtgtctaagccagatgttggcaaactatggcccttgggccaaatccaatctgccacttgtttttgaaaataaagttttattggaacacagtcatgctctttcatgtacacattacctatggcagtttttgcactacatcagcagagttgagtagttgcaacatatgatatggtccagaaaacataaaatatttattgtttagctttttatagaaagtgcttgtgaatcctggtctaagtctttttgctcagagacagatttagaagtgacaacatgagctatttcaggccaaccaagtatgatgagatgtctgctacagtttcctaaaaagacagaacaggaaaagagagccctgtccatcttctgaccattgctatgtctggatatgagagtcaaccccttgaagactccttgaagaggaggtgttgaaagaacttacgtccttgatgacactgttgagtctctcaatcatccaactttgcagaattccccactctagacttcttaatatctgacatactaactacctgtattgctcaaatcagtttctgatggggtgcaatattatttgcatgttaaatatcctgagtcaaatataaattactaaacttgactccaagagaaatattaagctaaaaaatactaatacacatttaaaaatttcgtagatagatcattgtcaataatctaactacaaaacaaggaacagattcatagagtataccaagccctcaaagaacaaataacttattttacacaacagttatagaaactataaaagggagatgctctccatatcctttttatgaagctagaaaaactttgatattaaaagtgcataagggcagtatagtatgagaaaaaatgtataatagacatagctatgaacataggtacacaaacttttcataacacctaatatctgttactttttaaccaaagaaagtaaggaagcaaaagagagggagaagagagaaaaagagagagagagaaagataaaaagagaaagaaggaaaaaagcaagcaagaaaaaaaatttaataaatttgcaataaaaagacattttcttaatctgatataagtacctgtcaacaacctaaagcagatgtcatactaaacgtgaaaatcaaaagcgttacctttaaagttaggaacatagtaaagaaactattactgcttctattcaggacaaaaatacagaaacagaaaaaaataagagagtgataagaactgaaaaagtgaaacaatatgttcaatattagctggtgatattgttgtctacataaaaaattgaagatattccacaattggattaatcaaagtaatgatggctcctcaaagtttctggatagaaaagcaatatacaaaaacaatagctttgctatacctaataaacatacatttagaaaatgaaactaaagaaaagctcccattcacaatgacggcaaaaaaaggaacatataaatttttaaaaagatgtacaacattgtaataaaaatataaatatgtattaaaatacttaaacaacaaataaatgaaaaattatagaatgctaatagttagaaagactcaatgccgtaaacatgataatttttcccaaattaacctataaatctaattaaagttcaacaggatttttgctgaacttgacaagctaatcctaaaattcacatagaagaataaaagatcaagagtcatcaagaaaactttgaaaaataaaaaaaagaagggagacaccttgccctctcaaatatcaggatttgttatagagttttagtgtttaaaacaatgtgatactatcttgaggataaacagatggactcatgcaacagaaacaaacattcacatttagagaatgcggtacatgtagttctggtgtcgggggcccttgaaagaggcaaaataaatagtgggaaaagaatgagctatctaataaatgaggctgagaacactggctatacttatggtttaaaaaaaaatcctacgaaacctttatatgaaaaagaattcctggttaattaaggccctaagtatgaaatgcaaatgttccatattatgagataacaatattgaggatataaacataggaaaatctttatgatcttgaagtagggaagaatttcctaaataaaacataaaatttaccttattaaagcaattaaaaatttttagatggcaaagactgtctgaacaaaattttttttttttttttttttttttgttatagaaatctgtttaatggtttaggaatgtgtacactctggctctgccaagtttccataaaggcaacttttccatgttttaaaaaatagatttggtataaagatttatatattcataaataggtggcatgaaaaattaccaaatgcaaatggaatacttgcgctgactgaagccctgttcaccccaagtccaggccctgcaggggtccgagggtctctgctggaggaggccccaactccggcagcctcttagggaagagaaactgaattaaatgtgtattaggaacccctccagctccttaagccagcgtcgcactggccccaccgaggcctcagcccacctccctctgcttccccccgccacctccaccattgccccctcccctgcactctggcccctgaccccacctgctcccactctttggcaatttatcaacaaaggaagagatgacactgtgtctgaacaaaatttaaaggcacactattggaaggagatgtagaagaaatccccaagaaaatattactatacaaggtatacattttaaaaatctataaataaatataaaaaaatcagatagaaaaattggtaaatgacatgaacaggcaatttacaacaaaaggaaggtgaatggccaataaccacatggaaaagttttcaacttccctagtgattaggaaaatacaaattagacaaaaatgagataacactttataccaagcaaattggcaaatctaagaagtctcacgacatttgtgttaatgaggaagtgaaacaacagaaagcagtgttcactgatagtggcagtgtacatttgtacaaccatttgggaaataatttctgctaaaagtgaaaatgcttgtactcagcacttctcttgctgaatgctagaggtgtttgcatacatgcataagaatattcactgtagcattttgtaatagtagtagaacaattgggagaaaaaaattttatgtcgattagtaaaaatataaagtaggccagatgcagtggctcacgcctataatcccaacactttgggaagccgaggagggtggatcacctgaggtcatgagtttgaagccagcctggccaacatggcaaaacccggtgtctactaaaaatataaaaattggccaggcgtagtggcatgcgcctgtaatcccagctacccaagaggctgaggcaggagaatcactggaacgtgggaggcagaggctgcagcgagccaagatcccgccactgaactccagcctgggcaacagagcaagactctatctcaaaaaatatatatacatatgtatatataatgtaatttataaaatgaaccagatcaccatataaaatatagataaatcccataaacacaatattgagtttttaaagaaactgaaaaagatatgtataatagatttaacagtgaaaatttttattatataaaataacatgttatttgtgggtatatacatgtgtagtaaaaatatagaaacatggttagagcacttttggatgagggaggaaagaaaattggaagagagtacctccaaatctataacattttattcctaaagcaataaatctgaggcaaatatggtgacactgacctggctacctagactctgaacagtggaggcatgactgaaaacaaaatcttgacacaccccatgcatagcagctggcacctgagccctaggtaggtatcctacaggctcagcttgccacctccagccaagccagattctcctgtctccagcctgtcagccacactcagagacatgcctttcctaatatgggacagaaacagtccccagctatgatggttaattttatgtgtcaaactgactgggttgcaagatgctcagatatttgatcaaacattattttgggtgtctctgtgaggtgtttttggatgagattcacatttaaagcagtggactttgagaaaagcaggttgccctttataaagtgtgtgggactcatcttatcaatcaaatgcttggatagaacaaaaaggctgaccctcctccaagtaaaagtctttttaacagcctttgaacagggccatcacctttttcctgcctttgcacttgaactgaaacaccaattctttctgagtttcaccctgatgccctttgaactgaaatgacatcattggctctgctgggtctccagcttgctaactggttctgcagatttggggacttgccagccttcataatcacatgagccaatttcttatactaaatctcttttgatatatataccctgttggcgctgcttctctggagaactctcattaatacatcaatttttttggtattaaaagatctaccccatttctcttcctccgaaactcatcccccaaagcttagactcattgctggattgggcttcctgttgggtagcaaaacttttcctccacactctttattctcttcgtctgtattttttctttaataatggcaagttgttatatttaacatatatttaatatatatttaataactacttaacagtcaatatttattatttggagattccacatttgcaaatttgcctacttgctaagatttgtgtgtagcctccaaatcagaacaagcagcactttcacggttctttgtggacaagcattgagtggtgaagaatttgaatcacctgatgcacactttcccagctgaagtgaaacgaggccacactctaccttctttttatctatcatactctaaacaagtgttctttttgtggtctatccagtgacatttttttttttttttgcatttttgtgctttttcttggtgattttactgtttaaaatagcccccaaatgttttgctcaagtactagtgtctagtgttcctaagtgaagaaagctgtgctttcccttttggagaaaataactgtacatttaagcttcattcagtcaagttatagtgctgttgctgtgagttcaatgttaatgaattaaccatatatatgaaatacagtgttttaaacagaaacacatacaaagcaaggttaggtgtcgattggttgataaaaatgtgactgatctgaggctcacaggaatctaaccctgtgtttctcctaagagcagtggttcagtattcagtaactcagtgttcacagtgactttgcaggacattgctactgcaaataatgaaaatcaaccgccaggtgcaatggcttacacctataatcccagcatgttggggggccaagacgggaggactgcttgatcccaggagtttgagaccggcctggaaagcatatagagacctcgtccctcaaaaataataaaagatattagctaggtatgatggtacatgcctgtggtcccagctacttgggaggctgaagtgggaggatagtctgagcccaggaggtcaagactaaaatgagccatcatgccactacactccagcctgggtgacagagtgagactatgtctgaaaaaagaagaaagagagaaagaaagaaagaaagaaagaaagaaagaaagaaagaaagaaagaaagaaagaaagaaagaaagaaagagaaagaaagagaaagaaagaaagaagaaagaaagagagagagagaaaggaaaggaaaggaaaagacaaaagaaaagagaaaagaaaagaaaaaagaaagaaggaaagaaagaaagtcaactgtatgtttaaaaatctaagttgtgggtgggtatctgaatgtattttttaaaacggttcataaaaaaacacaagacttcttttgtatgtgtaaaatatatcataattttaaaccattttaaaaaataaaagggcattcattgatgccaaagcttagtgtatgacagagagactgagggggcagactgagggggcaggcagagaagcaggtgtctgatcgtgaagaggcagtaggcaaaaggaatacatttgaattttattcagaaccaaaataattaactcatgctggcaaaagattttgttagattactcattcccttctctctcccctcttcatcctgctttctataactttctcacccaactatcaagggacccaaatatctggtgcatccctattcaaggatgtacatttctagatatctcattttcacaataagtctgactccatttctgatgtttgacttctgtcagcttttaggcctcacccctccctccttcccctgtcccacaagtcagtaagctgataagaaattctggatgttctctcctttggcactggtgagagattcaaaccacctaagtcctttgcctgcacaggaaccctcagcccagacccaccacctaaacactgtaaaagcaccaaacccatctcctttccttgtcttttaagccattttcagattccatgggtattccttttctgctccttacagaaatgcctcagtcatgtaagtatcacaacttttcatgtcctctcggtatatatgtggcatcatcagtctctgcatccaagccaaattatgggtgggggttccattgtatttttgcagaaggactattacactttcaatatagaaaaactattccaggattaagaactaagtgacatgatctaaggtcttgggggaaataaacattgagagattaataaaactaagcatacacttttgaaaaatcaaagcaaaataacatatttggtgactgatctgcaaaaaagactcatttgtccaggtgtggtggctcacgcctgtaatcccagcactttgggaggctgaggctggcagatcacttgaggtcaggagttcaaaaccagcctgaccaacatggtgaaaccccatttccattaaacatacaaaaattagccgggtgtgggggtgcatgtctgtaatcccagctactggggaggctgaggcatgaaaatcgcttgaacctgggaggcagaggttgtagtgagccaaaatcacactactgcactccagcctgggcaacagagtaaggctctgtctaaataaataaataaataaataagactcatttggttttgagtcttgttgtaaatgcaatgtactttaacctgaccaccatcttattcttatgatacaatgagagataaataggagtctttgtagatttatctaaactgtttattacacggctggtgctattatttttcctattcattgtatagtcccatcactgtggctgaaaagataaacatgagttcctgaagagctctcttacttttgttgtacctctttagaccaccatgctccatagctatgtccacctggaacacagaggaatgtagaatcctctccattaatggcagagccataaattgttatatctgccatatgtccctgtctcttgctattgcataaaacgtggtcagctaaaggcctgccactctgcacttgagctaggaaattcttccccatctttactcaaaatggaaagtgcagctataacaaagtacctgtaattagaataagccatcagctaaatgtattattacaatttattggcaggataacaatagctgctatgttctgtgcacctaccataaccaaaatcatttcttctgttttcctgaggcagctttccccttcctgggctataataacaaggtatttccccttcctgggctataatagcaaaataaatgccaagaaacataattaaatgaggaaaaaagacaaataccaaatatttagtatttacaaagtattgtcccttttgtacttcccaaagttcaaagggccagaatttgaaccaagatacatctgactccaaagcttgtcatctttatgcctatggactttaccaggcaacactaatcactgaacagtcattacccacattcttttttgctaaaaatagaatcctgattttgttcagctgtcaggtggccgggtgcttcacagaaatttgttctcttcccagcccagaagtgacctttgatgaggtcaaatcaaatttgatagttccatcccttttctagctattgattgagcagtggacatgtgacccaaccctttcaaataagacacgtagaaagtttgctgagagacttcttgggacatttctttccttaaaatataatgacacgagtccattgatttttcttatgtttttattttattgatttatttgtatttatttttgcttttttgttgctctggatatgtttgcagggatgtgatgcacagaacattggtagtcatcttgcgacattgggggaaattacactaagggaacacaacaatatcctgagaataccagaatggaaaaatataaagaacctagatccctaacaaaattgctgaaaagtttaactaaaccttgtacctccactgttctcttcaaatgagataatttaaaacttttggtttgggtattttgattgggttgtctgttccttgaggtccaaaatgaccttgctgacacttggtctataaaatgagatttattacctgtagatgttttaaaaacctagaaataaattttcttgtaaatcaagaaacagtatttctggatcctttattggatgtagaaagcaggaaagaatatcatcccacacttataaccaataagaaaaaaaagttaatttacaaaattataacttctcttgaatctgtcacagggctatggtcacaaggcagacacaactaacttaagaaattcaaagaaagacaggtgccttcaaggagagtacctgcttgcctgcagcaaacaccagataccatccaagctggtaagaaaaaaatcggccaaaatttttaacagactgttaaaggtcaaatgggatagtatagggtatagagtttagagtgacagtatagaactactgagagccacaaacataaggggaattcacatccacttgcaggctcttctccacagatgctgagtgctcatgagaaaaattaaagacaggatgagattccagagaaaacatcactgtggtacagacttgcagaggagaagagcagccaccgaggcaaaggcttgaagatatacccatttctttctctcctcaggaaaaaaacaaacaaacaaacaaacaaacaaaacaaacaaaaaagccttatcccactgagggaaaaacaacaacaacaacaacaaactatgtcaccatcagggcactggtagagacccattgtagctggggaaatgaacagaaaaaccttctggggaagggcaggaatatatcctaagtctagaccattagagatcattagagatttcctactcctgggcaaataaaaatatcacagagaaagcctcacctctaagacccaaggacagagcacctatctgagactgagactgaaccagaacagcaaacaacgcctccattccactcccaacaccaggctagcaagctcaataaacaagtaatagcagtcttcaatgctaagagaacttaacaaagcataggcacaaagggaagacctaaatctgaggatgaagcagacattgagaaaaaccctctgacaaactactctccacctaagcacaaggtaacgctagaagttgaagcctgtgacacattgagagtaaccataacaggaagatagcatacacccagtctaactcctgacttgattgaatcaatcccatacactagaagcctagcaaaaagccataaatattttcttcagtctttgctgtctacaaaaaagtgtccagttttcaaccaaaaattgcaagatacacaaagcagcacataaagagaatatatcattaagagacaaagtaattaacacaactacattcaattatgagagataatttggaactatcaaacagtaactttaaaacaactataattaatatgttaaaggatctagtgaaaaacgtcattaatttgcatgatcacaaggaaaggatcagcaaaaagatggaaactataagaaaaatgctagaatgaaaagcatgataaaagagatgaagaatactggagaatgatgaaagcacgatgatgaataggcattgtctggcttcattccctctcaccctcaagaaatctaactagcaattatccacaggcaaaaataccatcctgaatactgggagtaaatgtgacacccccttggactgaagaacctagaaaagctgcaatcaaatgacaagaggagaaattcttttgaaccacactgcaccttcctcaagccagcatagtgccacacagagataatttccctagacccacaatttctgtagtagaaaaaaaatgagttggagatggatagtcaacttccccaccattctctctttttctttcctcaggaaaaaaaaaaaaaaaagaaagccttatcccgctgagggaaaaacaacaacaacaacaacaaaaactatgtcaccatcagggctctgatagagacccattatagctggggaaaggaatagaaaaaccttctggggaagggcaggaatatatcctaagtttagaccattagagatcattagagatttcctactgctgggcaaataaaaatccttctttgcaggaggattgtttctcttatcacatagagaacattgggagtactgacagggctagaacatgtggggtcagttagaaacaaaaaacaggagtgaacctcacagtgaccagtgcacaaatcttggtggttgttctgcattccagccaatttctaaatgactcacagatcaaaaaggaagttataaggagatttggaaaatattctgaattgaataaaaaataaaaacacaaaacaacaaaatttgcaagatgtggtcaaagcagtgcttttgggaaaatttatagaactgaaatgctcatattagaagagaagaaatatttcaaatcagtgatgtaagcttttgccttaagaaacttgataaagagaacaaagtaaacccaaaggaagaaaatcataaagatcagagcagaagtcaatgaaactgatagcagaaaaattatgggaaatattactaattaatataattaattaataaactgacaaaaaagagagagaagacacaaattacaaatatcagaaatggatgaataaatatcactatgtaacctacagctatttacagaataatagaaaatcaattatgtatccatagatttgacaacttagatgaaatggacacatctcttgagacacaagcttccaaatttccttcaagaagaaatagattagtcttatatcttttttaaaaattcatttttaatgaaaaaccttccaacaaagaaaattccaggcccagatgacttcacagctctatcattttctacatttgcttcggttttgattctccactctgagcttcataattattagatttttattttttcaaagcaaggtctcactccatcacccaggctggagtgcagtggtatgactatggctaactgcagtctcaacctcctgggctcaagcaattctcccacttcagccacctgagtagctgggactacagccacacagaaccatgcccagctaatttttaatttttctgcagagataaggtttcactctgttgtccaggctggtcttgaactcctaagctcaaacaatcctcctgactcagcttcccaaagcactgagattacaggtgtaagccactgcaactggttgattacttggcctttgtgtgtgaatactgtttgtgttatacctacagaattattttttagatattaagttcatagaaatttagttcaaaatgttattagtacactatcttagattcatgatcatttttcaattaatgactttataagcaccattaaagctatccccacaactccatgaaaagaggaggcaaatagaatcatggggaacagaagttaaacaactcttccagcctcatgctaaattgatcagttcaaatgagttcaactataagtcaagggccttgagtcttgtctgctgcacccctgtgactggactaactcggtctggctactgtgcaaggtcaaaaatacacaaccaaaaactgtcaagctaagggagaaatcaagagttggagtaagattaccacgccagagctagacacacaaaaatgaagatctgagacaaagcagacacagtcagcaggaagcaaggacgactgagagctttgcaagtctgaattaggctttcaagccatagtaggacaaaccagaggtcaaaggggaggcctagaggaaattcaacccttcaggctttctgctgaaataggatggggtcagggaggccaattggcagcttagagaagagagcctgaggctgaatatctcgttctacctggggtgtgtgtcttataccctttctgatctggttcacagattaacttttgcatgctcaattcactcaccctgctcccccacaaggtccagaactgatcagtaaactcagctgaacagtggattttgtgaaataaaaaaagccaagacagttgattgaatgaatgtcagcaattcgttagatgttttggtgtcctttggacagagcttattcataatcactcttgcttaatgttttaaagtatgatcttacatttaaaagaaaatgtggagtagcaacagaaagaacaagttttgaagtcaaaatgacttgaataaaaatcactgctgtttttgggcacaagactttagacaattagaaatctctaaatttcaatgtccccatatataacatgggatcaacaatgtctacctcttgtgagagataaatgaaatgatatttgcaaagtacctaatacatagaaggcacttgataaaaagtaataataatgattattttatatgtcttgtttaaactgaatcttggacattccataaataatccatctagtttattcaacaaatatttattgagcacctactatgtgcaacaaatactcttataggtacatgggattcaacaagaaaccccagtctctgtccacctggaactggccttctattgagggtttgtatactatatgccaacacagcaaaagatgcttcttccactgaacccagaatgtaattcttcacctcacttcactccactggtaacaactaaggttaccgaattacacctattggaaagacattctgtagatttccctgataccttctgcctcatctaataatatcctgctaaagaaaaggtccagttctgcagaatggaataacatctattcagaatagcaacgtaaactttgcagactccctcatacatctgtaccggtattggtatttcaaagtaatcatatgctacaggggccaaagactcaaatgccatctggggggccatgggtaaatgagtcaagaagcccagtgtcatggttagtgaggaaaattataaaaattaaactgtctctataaaatgcgcagccactactactgtcagttgatattgccagagaaaatgctagtgtggtcagatctgactttttaagagaagctgaaatctgaatttttacataaaattaagtgattttccaaataaaacctctcaatagtacttattcagcccaggagacataaatttacaagcccaacagaggtttagaggactacgtttttaaaaatcagtagtgtaaacagtctttaatcctttttcacttgctacatggaaagacactctcagaattgcaaaatgccaaatggcaatggtttatcattttgttcatttgtttgtttttatctgaaaccacagttgttattcaacatctaagaatgtagagctcaatgggtcaatcccataatttgtggagaagctgcaataaggctggaataatgatggattagaaggaataggttgccctcaccctaatgtctcgtggcctaccactaccctgggattaagacatgcagagacttgtttgtagtcgcagattttgtatcctctcttgacatggctgcaacaagaatgcacatctgtgaagtgtttgccagcatgtcaagagtaacaggactcttgaagccatttcaaatgtcatgtcaatgcttgtgcataacatctttaagaagattgttgctttagagatcttaatattaaaaaaaggaacctgaaacacaatactttcagccacttaaaagtggagttctttttcactaagcagagctgaactttttaaactttttaccaaacaagcctctttttggtggtgagcaaataaattagcatgtgggtcctaagtgctcttaaaatcgttttgctatagatctgtccactgtttataattcttgaataaagctaaaagtaaagaaagcctttctctgaaggtttatgagcatttttccatgaagcagaagtcaaacagaagatcaaagtgatctaacaaaatgctccaaacttgggttggggtgggctgaagggcggtgaaaagaaatcagcccctccagatagtttgagagatatgtctttttacttaaaatgaaacaaaacggaaagcatgagagtttgagtgtatcagactaatgagagtttgagtgactcaagctaaggtttctgaacaatgttgttaaagtatccgcctttgatattttacccatagtatcaaaaacatcttaaaggaagttagtcaactgttgtaccaagtagcaaatatgaacaaaatcaggtgaatttcttatccctctgttcctaacagccattcatttctaggattctctgagtttctgccaagggtggacttttccaagctcacaaaggattaatgtacagtcttgaactgtcttgaagtgtctaatgtattccatatattttgaatactacataattggcatttagcttttcatacaataccagtttaaatgcctactaaccatttactttacatagaaaaataaaacaaaggaaacaaaataaatgtattgctgaaaaggcatgaatctattcatccatgattaaagcctcaataaatctgcttgcaatcacccattggtatttaaagatctagtaactactctattaaatttaattctctctgtttaatgacagttattctcaatataatgacagttatttgaaata

SEQ ID NO: 12246 - DNA, 9076 bp, Human
tggtcttaaactcctggcctcaagtgatcctcccgcctcggcctctcaaagtgctgggattataggcgtgagccactgtgcccagcccaggactagttttacttcctacaaagaagaatacaccaactcttatgggccaccatttaaagagacattttcatagtggacttcaatgtaattgagtccatgatccttttgagaaggggctgaactgacaagcctccctgagacaggtgccccatggaatgctagtggagagagaaggaaagagagtggaatgggcactgggcaggggcagagggaggaggagatgagtttgggaccaatggtgagccaggacaggagtcagatgagattgtgcatctactggaagacaggcctgtgaagccgggaatgggagctccaagggagtcacttcttaagagtttcatgacaggtcgtcgcctccatcagggttctttgtttcttttcttttcctttttttttttttttttttgagacggagtctggctctgttgcccaggctggagtgcagtggcgcgatcttggctcactgcaagctccgcctcccgggttcacgccattctcctgcctcagcctcccgagtagctgggactacaggtgcccgccaccactcccggctaattttttgtattttagtagagacgggatttcactgtgttagccaggatggtctcgatctcctgaccttgtgatccgcccgcctcggcctcccaaagtgctgggattacaggtgtgagcctttgcacccggccgggttctttgtttctttgaatcaacgtaaccacgactacaatcacaatagagaacttttttgtttgtttgtttgttcgtttgtttgtttgtttgagatggagtctcgctctgtcacccaggctggagcgcaatggcgtgatctcagctcactgcaacctccgcctcctgtgttcaagctattctcccgcctcagcctcccgagtatactgctgggattacaagtgcgtgccaccacgtccggctaattttgtatttttagtagagatgaggtttcaccatgttgtccaggctgatcttgaactcctgacctcaggtgatccgcccgcctcggcctccgaaagtgctgggattacaggcgcaagccacagctcccggcccgatagacaacgtttctacaccccagggcagagttctttcattccatctagcagtgtctcatccccttgcccagtcggttatatagttgtagcctgcctgctgcgcccacccctgctttcatctttgtggaggacgcagtgtcgcggttaagatcgctggttctggagccacgtcacctggggtcaacccaggctctgacccctggtagcgatgcagtggcatctgggcgggtcctgcaggcgctagctgtcactgtctctgttattccagtttcgcgatcccgagtacggggaatggtttggctacctgagccgagagggcaaggtggccctctccatcaagggaggtcctttcaaaggtgagtgggggagagggcggggccgcaggggttgcgcctctcggctgcccccggccctcactacctgcccgcctctacccgcaggctgcttccacgtgccgcggtgcctagccatgtgcgaggagatgctgggcgccctgctgagccgccccgcccccgccccctcccccgcccccacccccgcctgccgaggcgcggaataaaggctgagtccgctccacctgcggctgtgcgcgcgtctgtgggctcgcgggaggggggctgtcgcgccgagggaggggccggctccagctccggggcagcgcccgccccgcccccaggcccgccccgcgctgaccggctccgcgcattggcccgccccgtgcgctggcctgtcccgcgcattggccaagcggccgggaggacgggcccggcggccgtgcacttccggccggtggccggcccggcgcgcaccgccccttccgccgtcgcccagcgagcccagctccggtcccagccccggccgtcccggcgtcgcttcggagcgcggcggcagctgactgcgccttcacgatccgctgggacccgcgagccccgccgccgttatgaacatccgcaatgcgagggtgagcgcccggggcgggaggctgtccgcgccgcgtgggcgccgggccgggtggctgccgcgcatgctcccgagggccccggccgagcccggcccggtggccctgagtgtgcctgcggccgctggacctatggggctggcccagcccgccgaagaggccggggcgcggggccggggctgcgattccctcctgtttgcgtgatgtcgggcctccgttgggtgggctccggggacctccggggcgcccactcctgttcctgtgctccgggcgttgtgcaaagtcagatcgtcacagtgcctgcccagccccgagggagcggggccgagcagaccgacggggagcaggcttctcacccgtggtcaccgccgccttagactgagcgcgttccactgccctccttccctgcagccagaggacctaatgaacatgcagcactgcaacctcctctgcctgcccgagaactaccagatgaaatactacttctaccatggcctttcctggccccaggtgggcagcttctgaatttgggcatgggggaaagcaggccgaggaaaatcccatctggccatcttggagggagtggacaagtctgtcagagcccagggggctgtatggtcggtggcgtcctgggtgttttcagctggcagacaggggcaaaggaaaagaaggcgcccgaagggagcagagaataggggcaggatccccactttgcgtcttctttctgggtatgggcagggcacagtgtggcgagggggagaccaagccactcagcccggaggtcatgagccatcacacaactcgccactcgtccagtttgtgtccctctaaagggctcttctagctccgacaagaagttttctcactctgttttcctgtcaccagctctcttacattgctgaggacgagaatgggaagattgtggggtatgtcctggccaaaatgtgagtcaccaaggaggaagacagaagctacacgtgtctggtggatgcctctgtgggctttaaaaaaaatgaataggcttcttcttttcagtacagttgaaagtttatagaaaaattgaacagaaaggacatggagttcttatagcacccctcagcatcccctccctgccagcttcctctgttagtagcatgttggatttgtgtggtccacttgtgacaagtgataaatgaatgtgatatgttactattattattattactattattatttgagacggagtcttgccctgtcgcccaggctggagtgcagtcgcgtgatcttggctcactgcaacctccaccccctgggttcaagcgattctcctgcctcagcctccttagtagctgggattacaggcacatgccaccacacctggctaatttttgtatatttcagtagcaatggggtttcactacgttggccaggctggtctcgaattcctgacctcaggtgtttccacccacctctgtctcccaaagtgctaggattacaggcgtgagccactgcgcctggccgatatattattattaactaaacccatagtttacattactgcacttctctttgtgttgtaagccccatggttttgaccaaatgacatgtgtccaccttcatattatcgcaggatagtttcactgtgttccacgcattcatccctccctctccttaacccgtggcaaccactgattttttactgtttgcatggttttgccttttccaggatgtcacagagttggaatcatactatatacagctttttcaggctggctttttttcacttagtaatacacatttaagcttctgccttgtctttgcgtgggttgacagctcatttctttttttattttttgagacagggtctcgctctgttgcccaggctggagtgcagtggcatgatcatggctcactgcagcctcaacctcccaggctcaagtgatcctctcatgtctgcctcccaagtagctgggaccacaggcatgcgccaccacatccagctaattttttgattttttttttgtagagacaaaaaaaagtgttgtccaggctggtctcgaactcctgggctcaagcagtcctcttgccccggcctgccaagtagctggaactataggcgtgtgccccacacccggcaggcttggggttttcaggcagcagagggtggcaggatcggctgctctgatccaagaggctcccggctctcccccagctggggtcttagggggctgtagtgcatgtccactctacaaatggcaggggggctggaggtggctgtgcctacactgagctcctttgcagcctctcctttctccctctccagggaagaggacccagatgatgtgccccatggacatatcacctcattggtatgtaaggtccacccaggctctctggtgggggtggaagtgggggttagttggggcagccctcaaggtcccagtccctcaccccatctctgctcttctcccaccaggctgtgaagcgttcccaccggcgcctcggtctggctcagaaactgatggaccaggcctctcgagccatgatagagaacttcaatgccaaatatgtctccctgcatgtcaggaagaggtggaagccgggctgagggaagggggattgagggggagagatactgccttgacgggggtcctggggtacctcagcttttggtgaagatccaggaagtgggattggggggaaggagggaccaggaggaggggcaagacctggacgtgctacccctccctggccaaatccgtgcagctcagcagtgccttgttcccctgcagtaaccgggccgccctgcacctctattccaacaccctcaactttcagtaagtagatctcgatttttctaatgggctggggttgatcccaggtctggcccatcagggcacctgagaccggctgagttgccttccaggtcgggggtgggccggctgtggggaagaggctgtggaccccagcactgccaggatacctccacattcactcggcggctgatggttgaaaagccggcatggagacagcacctgcctgctgaaacgtgctccatgtgttgtgatggaggagctctggcccatgatggctgaggctggcgaagggcacacgggctgtttagtaatgtttgggaatagagaggtgtgggtccctggcgtgagcagatgctgaggagcaggactcaagcatgaccaagcacctagaagaatccaagagagagcagaatcgaggagaatgcacattcaggaaggaagggccagtggccaggcagcctagtggatgggggaggtctgcctgaggaccaggaggccccgtgtgcctagcacactagagagaacctggcagttggcatgcccagtagacagtggaaaaaagtgcttgcaagtgaagctggggtgggctgcctgtggagggacactaactgcactcagcccgtttggtaggggatgaagaagagggactgttgggaagggcggtggcctctgggctggatgctggcaagagggatctgtgacccagatgacgatgtctggtgggaattgctttatagctaagtcagcaatcctcatgtcttaggcctggcagggccagcctaggccattgagtccagctccccttccagggacatggccacgcgagtctgcacacacacctgcccagtgtagtcacggccccagagctgctcaggcagggctcaccgtctttcctgggttctgatggctgttgtgaggcagctcagtaagggacagggcgcagggcagggagggaaggggaaggctgaattcagggcttcagctcacaagaaaccgcagaaatggatccttagtatccaggctaaggacacagaacgggggcaggacgggtggggcgggccgctgtgtcctggagcctttgctggagagaacagagggcaggtcacactggacttgttgtctcaggatggagccttcagggagaaaacatggcaccttgctccagtagccacgataccaggagtggaggagggtgtccccgggatacaggtcttcctccttgctctctaaccctctgcccccaggatcagtgaagtggagcccaaatactatgcagatggggaggacgcctatgccatgaagcgggacctcactcagatggccgacgaggtaagcgcctgcatgaagccaagcaaggcgagcgggggcggcactcaggagccccaagacagtggctgcaggcgagaccgactttggatgccagctcttgtggctacgttgccaggagtcacgacctcagtttcctaggctgggctttagaggaggccatctgcctagcagcctggagggtgatgggagaggcagagggaggaggcttttagaagggaagtggggaggtctagggaccagtgggtggcctgcctgctcaaaggtagttctgagtcagggttctgcccaaggctcatcgggtggcagggctggtcaaggggcagcgctctgtcgtgggggcctccatggtagtcggtaagcccaggtagcggtggactggggctccagccaggtgtccccactcagtcccgcgtgtcctgcctagccctgctgcctcactatgcccctctcctcagccagcgacagggccaggctccctttgtctggaaacttaggccctgtctctttgcccccgcttctccctgggttcctggtggcagctgaggcggcacctggagctgaaagagaagggcaggcacgtggtgctgggtgccatcgagaacaaggtggagagcaaaggcaattcacctccgagctcaggagaggcctgtcgcgaggagaagggcctggctgccgaggatagtggtggggacagcaaggacctcagcgaggtcagcgagaccacagagagcacagatgtcaaggacagctcagaggcctccgactcagcctcctagagcctgccccatcccctcctcaccccacgagctttcacaataaattcgctccgtggcactggggaactttgtgtgtgagcgcgcgcacatttagagggtgtgtttctccaggtcctctggtggggatgtgagccttggccttttgacccagagcatcctgccaggcccgagtacaaggaaagagctttggaggtgggactccctagtctcatgaccttcagcagctgtggccccggggaaggaggccctggacttatgggagagaccctgccttggaggtctgcttggccacgctgaatgtgttttgtggcacaagccggggctgctcaggctcaaagctcaacagcagggctcccactcttggtggccttcagttctcttcccaccttcaccttcagactttctctccctaatcacacctgcttcgggctacagcagctccccagcatacccgtgggctccagatgtggacatccaactgctcattgggcttatctacaaatgtcctgtctgagtaatgacccagccagatgccccatcaacagtccttgagtcctccctcccctgccaccctaatggtcagtgagtccatgatacctcttgagtctactccctaacctgagtttgcatttgaaaataatttatttttagtacaattccccgcgtttccccattgacattttgtattagttggtgtatttgttattgttgatgcgccaatactgataagttattgtaaactacagcccatggtttacagtaggtttcctgtctgtgttgtacagtttctatggggttacacaaatgcataaagccatgtattccctcattaacaatttcatgcaaaatacaaaactgggcggctgttgggtgcggtggctcatgcctgtaatcacagcactttgggaggccaaggtgggcgggatcacttgagctcaggagttggagaccagcctgggcagcatggcgaaaccccatctttactaaaaatagaaaacttacccgggtgtggtggtgcatgcctgtaatcccagctactcgggaggctgaagcaggaggatcgcttgagcccgggaggtggaggttgctgtgggccctgatcatgccaccacactccagggacagagacccgtctcaaaaaaaaaaaatatatatatacatatatatatacatatacacatatatatcaaaatcctgtttttcatggagtcaccctaaccgtaacgctcgtttctgtgtctttcctcctttcccttccctcccctccggctgcaaagccatcatttactgtccctagtcctgggcgggccctgtattcctgagccctctctgtgtcctgctactgcaggtggcacactgctcctccgccgggttgaaaactcgccacacaggcctggagctcggttctctttggctggcgcctcgcacgtgaccagcaggcagccggcagctgtggaagcggagcccagagcgcggcagggcggggccggggccggaaaggcgcgtctgcgcacgcccacagctctccgcttcccggctcgggcgaggctgtgttgattggcttaagacgtgggcttccctttgtatgggccggaggcggagtcctgtcccgccccgcgcctggcggcagtgtcttccggttcgcaagcccgcggcgaggttcgttcccaggctctgattggtccggcggcactgggctcgcgcgcagggtgcgggggaagggcgggcttgcgcactgcgtcggccgcgccccggcaccggtggaagggaggtgtcccaggctcccacggcgcccacggcgccctccttccgccccggccaggcccatgggacccggcccgccctctgccgtccgtccccggcgggcccgatgcctgtcggccgctgagcctccgtccccatgcgggcaggtccgcgccttctgcgggctgcctggcttttggatgctttgaaggggaacaatggagcgaaggatagacggagcagcagggggcagttgcgttcagggccttaaatgccaaacaagtgccctaaaagccagggcccaacactcaggcccta

SEQ ID NO: 12247 - DNA, 14395 bp, Human
ggctgcagaagcaccgctggcaagttggcgggcgacacggccgaagccatagttccgggaaagggtgcggtggggagaagtcaacaagcgggaagggagcccctcaattcctttcacacaccccctttcgtctaaggcagctctcacggagaagcggtttctcacacagcggtagacgactccatggaggccgccatcttaactgccctccttccctttggctcttccctttcttctcgctcaccccgtctccgcaagagccgcccgaaactgtcgagcgcctaggctcaagaagctggaggccgctgagtcccgtcgccccgactacttgtccgggcgctcccgcttacaagctcgggcgggaggccctgggagccgccatcttgagccgcctctctctcctcccttcctcagtcgtagccctcccccgccggaaatggcggagccccggcccggttcccacacccccaagtccccagcactggccggcttccggggcgggtggaaaggagccacaagcgccgcggtcgtcgcagccccgccggcgctcagaccacaattgtgggagccgccatcttgagaccgtcccgcttccccgcccagcgccttagtgcagccgccgctcccgaaacagcctcgacacacctaacgaatggaggcgggccggaggccggtggaaccagctcgagctctcgagggccgtttgggggctcgcgccgtacggcttgtgaagtctcgcgcctctccccttagtccgcctctgctgctcaggctgcgcctgccgccgtgggagccgccatcttgagactagctccccgttcccccctattctcttcctcctaggtcagttcttccactgcacaccaaactcaaggcggtgtccgatcctcacttcccgccttatgactccttcccacaggagccgcttcaaagagctagagttaggccccgaagcggcaactgtacggcagaagaagcggtaacggcagggcgctcatgcctcctccctgggagccgccatcttgtgtgaagaagtaacaactaaacatggcggcagcggcgccggcggtcgggcgaggaggcggagccgggtgacgtcaccgcttccccccactcgccctcgcaccgcttcgcccctgggcccaagcctcttaaaggacccctgcgctgcctcgcggcgggggtgggggtcggcgctgccgcgcgctgggctaaagctcgagtcgcgctcagatcaggtgcaggcgcaggcgcgccccgccccacggcccccccaccgggcgagcctccacgcctccgccctgggagccgccatcttgccacttcccctcgcccggccgtccgcgggcgtcaatagcgactttcagcacaaaacaaagatggcggcggcggcatcctcggaaatgcccggatgagactgctaacccctccgacgcgctcggccccgcccccttgggaacggtctctcgggttgataagggacgcacgcccgaagaactgcctttaaccagcactggggacagcggcacgcaggtggccggggttggcgaacagccactgcagccgcgcctgcggccgggaagcgagcattttcgcgccctgcacacccagcagccgcaggaggcggcccgaggcgcgccgcgggggagccgggggcggggcgacagtgggaggcgacgcagccgagcgccggcgcccgggggtggagcctccgcccgctcccaggctcccaggctgcggggcccgccctcgggcgccaccgcctccgcccgcgccgcagcaaaatgagccgggccgcgcgccccagaccgccgcgcgctcggccgcccccactgccgagaggcccgcagtcgggccggtggcgcacgagccgggcgggcgaccgcgggaggcgtccgcgtcatctcgcgtcacctcgccccgcccgcttcccaggcttcgagtcccgccctgcgcgcaggcgcaccggcgctgctcggatcctcccttttcggagatttgaatttcccccagcgaggcgagtgaggcgaaatacccgtatggtgatagctggccttttcgcgccaatactgtaagtgctcaccgcagccctgggaggtgggtcccggcctcgcccccacgtttcgcctcctctaggaggccgcccgggcgcggcggcggcggcggcggcggcggcatccgccctgccacgcgcaggccgcagcgcggggacccaagctgctgcccgggagcggcagtcgccagtagaaatggacagaccggtcctgtcagagcctgtggcttttgttgtaaacgtctagaagttcagttaaattacaagatctaccagatctaccggcgggcagaattattactttgaagttactgaagttatgcgtcctgctggaagaccttgtaatttaatgcgttagtaaagaagcacacgtcaccctctcacacattttcaacaatatttttaaagtcgcctctcaacatattacatgtattttgtaatcgtctgtgttttagttcatgcagttggaagtatccatttgagaagggacaaagagaagaattcttgcctgtctgtgccaccacctgctctttgtgaccttggctagttacctcacatatgtccccaagtcccccacccatggtaaataagaaaactaaggcctgatgcgttggctcatgcctgtaatcccaacactttggaaggctgaggtgggaggattgcttgagcctagccggggcaacatagcgagacccggaggcatggtggcacacgcctgtggtcccaggtacttggaacgctgaggtgggaggatggcttgagccagggagttcagggctgcagtgagctgagatcgcgccactgctccagcctgggcgacagagcaagaccctgtctcaaaaacacacacacacacacacacacacacaaaagcagctgctggtttccaagggccttgcctggaatcagtccagaagctaaattaatgttaattgatattcctttatccacagaaagacagcaagaaaggtcatgcggagcgggggacataactaaccataaatgctaaaggcctggaggtgacagtgcctgctgtttaaacgcgtgcgggagagtctggggcctttagccaggagattgtcaggcttcccagggcttccctgaaagaccccagacccaggggccagtgctgttgaggtgttggctttcccatgccaggcgctgggggaagctgtgacgagatttgagtgtcacataataaggatcatggcaattcaaaggtacagggaagctaggctataaggtaaccagctcggttttcctgggggtcttggacaggtgctttgattacatggtcactgtcagcccgtacccccggtcagatagactgaacccctgcagccggaaagaggagttgctttccatgcccttcctggagttcttcctcgatcaagttgacagtgtttgactcttgttccagctctccgccctgcttgctggcaggcaggagggtcagactagcatgggtgccatggggccctaggtgggtgcagggaaggacctgtagacgccatgcggggcctcagctggtgtctcagctggagtcaggagctgaacggggaagtgcctgagaggaaatgacagctgagtcaagggcaatggccaggcgaagtgggcaaagggcttccaggacagagctgggcctgaggagctcacagggctggatggggatggcactttaagtctggccaagactttgggacatgatccaggacatggaatgggaagctggtcatggaagggtggaaagccagggcagacatgatcccatccagggctgctcaaagatgctggggctgcggtgtgcacacccctggacccagaggcttttttgactgggaggacggggcaggaggagttcgggtgccccatgctgagatggcaggcttgtgtgaagcaaggacgtatggagtgatagtgaggactgtggttcctgtgtggcaacaccatgcttcagagggcaatggggcacccacatgccaagcctggtggccctcctcagcaacggaactccaaggcaagaaggctgagaatgaggcccaggaggatgcggtgggccccaggacctgcttgagaagtgaaatagcaaacaggactggtaaaagggagcagaggtgctggctttgttctttaatataattgaattgaaattgagcagggcttcactgggcatctgaggaagagcaaggaatcagaccctgtcccacccatttggggcctaaattgcagtagggcagatggacattgcacctcaaaaataaacagtgcttgtcacatgaatcatttgcaaatattttctcctatattgtctcttcattgttgattgcttctgtgctgtgcaaaagctttttactttaatatactcccatttgtctgtttttgtttttgttgcctgtgattttggggtcttagccataaaatctttcctggagcatttccccattttcttctagtagttttattttatttattttattatttgtatttatttatttatttattttttgagacacagtctcactctgaaacccaggctggagtgcagtggcacaatcttggctcactgcaaccttagcctcctgggatcaagcgattctcctgccacaccctcacaagtagctgggattacaggcgcatgccaccaccctggctaatttttatacttttagtagagatggggtttcaccatgttggacaggctgggctggaactcctgacctcaggtgatctgcccgcctcagcctcccagtgtgctgggattacaggtgtgagccaccacacccagcctttttttttttttttttttttttttttttttaaagacagagtcttgctctgtcgccccaggctggagtgcagtggtgtgatcttggctcactgcaacctcctcctcttgggttcaagcatttctcctgccccagccccctgagtaactgggattacagatgtgcgccaccacgcccggctactttttgtatttttagtagagacggggttgcactgtgttggccaggctggtctagaactcctgaccttaagtgatctgcccgcctcaacctcccagtgtgctgggattacaggtgtgagccaccgcgctggcctcttctagtagctttatagtttcaggtcttacttttaagtctttaatccatgttgagttgattactgtgtgtggtgagagataggggcctagttttcattcttcttcacatacttatccaattttcccagtgccatttattgaagagaccatcctttccccaatgtaggttcttcgtgcctttgtactacttataatagctaagatatggaagcaatctaagtgtccaccagtggattgatatgtaaagaaaatgtggtatagatacatgatggaatattattgagccatttaaaaataaactgttggcgggcgcggtgtttcaagcctgtaatcccagtactttgggaggccaagacggccagatcacctgagatcaggagttcgagaccagcctggccaacatggcgaaaccccatctctaccaaaaatacaagaattagccaggtgtggtggcaggcgcctataatcccagctacttgggaggctgaggcaggagaattgcttgaacctgggagacgcaggctgtggtgagccgagattgtgccactgcactccagcctgggtgacagagcgagaccctgtctcaaaaaaaaccaaaaccaactataaaaaataaaaaaaataaaaaactattggctgggtgcagtaactcacgcctgtaatcccagcactttgggaggccaaggtgagagggtcgcttgagcctaggagtttgagaccagtctgggcaacatagcaagaccctgtctttcaaaaaaaatttaaaaatttgccaggcatggtaacatgcctgtggtcccatttacctgggaggctgaagtgagaggaccacttgagcctgggaggtggaggctgcagtgagctgcaatcacaccactgcactcagcctgggagacagaacgagaccctgtctcaaagaaataaacaaactaataagataaatcttgttatttgtggcaacatggatgagcctagaggacgttatgttaagtgaaataagccaggaacagaaagataaatattgtatgtgttaattcttatgtaaaatatttaaaaaatcaagctcatggaaatagaagcatagtgggtattagaagctggaaagattagagagtagggaaagattcggaggagtcggataacaaatacaaaatgccagcttcatagcatgaatggatcctgctgttctgcactgtagggtgagcactgttaactacaatttcttgtgtattttcaaaagactataagaaaggatttggaatgttcccaacacaaagaaatgataaatgttccaggtgatggatatgctaattaccttgtttgatcattatacattatatacatgtatcaaaatgtcactctatatgctattaaaaataataaaataggctgggcacagtggttcacgcctgtaatcccggcactttgggaggctgagggggacagatcagttgaggtcaggagttcaataccaccccagccgatatggcaaaatcccatctctactaaaatacaaaaattagccgggcgtgatggcccgcctgtacttccagctactcgggaggctgaggcaggagaatcgcttgaacccgggaggcggaggttgcagtgagccgagatcctgccactgtaccccagcctgccccacagagcgagactctgtcccaaaaaataaataaaataggccaggtgtggtggctcacgcctgtcatcccagcactttgggaggccgaggcgggcggatcacttgaggtcaggagttggagaccagcctggccaacatggtgaaaccctgtctctactaaaaaaaatacaaaaaattagctgtgcatggtggcgggcgcctgtaatcccagctactcaggaggctgaggcaggagaatctcttgaaaacgggaggcagaggttgcagtgaggcaagatcacaccactccagcctggacaacagtgcagacagtgcaagattccgtctcaataaaaaaataaaataggccaggcacggtggctcatgcctgtaatcccagcactttgggaggccgaagcaggtagatcacgaggtcaggagttgaagaccagcctgaccaagatggtgaaaccccgtctctactaaaaatacaaaaattagccgggctaattttagttgtaatcccagctactcaggaggctgaggcaggagaatcactcaaaccccggagggagaggttgtactgagccgagaccacgccactgcactccagcctgggcgacagagcaagagtctgtctcaaaaaaacaaaataaaatgaagtaataataaaatagtgctaagtggtctgcatatacagatactttttttttttttgagacggagtctcattctgtcgcccaggctggagtgcagtggcacgatcttggctcactgcaacctccgcctcccaggtttgagcgattctcctgcctcagcctcccaagtagctggaactacaggcatgagccatcacgcctggctaatttttgtattttagtagagatggggtttcaccatattggccagggtggtcttgaactcttgacctcaactgatccacccacctcagccacccagagtgctgggattacagacgtgagccaccacgcctggccactttttttttttttttttttttttttgggggggagagggagtttcgctcttgttgcccaggctggagtgcagtggcgtgatctcggctcactgcaacctccgcctcccgggctcaagcgattctcctgcctcagcctcccgagtagctgggattataggcatgtgccaccacacctggctaattttttgttttgttttgttttgttttgttttgttttgttttgtttttctgagatgaagtctcactctgccgcccaggctggagtgcaatggcacgatcttggctcactgcaacctctgcctcctgggttcaagcaattctcccgtctcagcctcccaagtagctgggattacaggcgtgcgccaccacgcctggttaatttttttgtatttttgtagagacagggtttcaccatgttggccagactggtctggaactcctgacctcaagtgatccacccgcctctgcctcccaaagtgttgggattataggcgtgagccaccgtgcccggcctaatttttttgtatttttggtagagacggggtttcaccacattggctaggctggtctcaaactcctgacctcagatgatccacctgcctcggcctcccaaagtgctaggattataggtgtgagccactgcgcctagcttttttttttttagagatagggtcttgctctgtggcccatagctcactgcagcctccatctcctgggctcaagtgatcttcctgcctcagcctcctgaggagctgggactataggtgcaccaccatgcctggctaatttttattttattttttaaatttaattttatgtattttgtgtagagacagggtctcactttgttgcccaggctggtctcaaactcctggactcaagcagtcctctcaccttggccttccaaattgctgggattacagatgtgagccaccatgcccagctacatatgctttttgatgtataacagggtaatgtccagataaacccatcataagtcgaaaatataggaactggactttcaacttaagaggggtttagctgggtgcagtggctcactcctgtaatctcaggactttgggaggccaaggcaggaggatcacttgaggccaagagttcgagaccaggctgggcaacatggtgagaccctgtctctacaatttttttttttttttttttttagatggagtcgcgctctgtcgcccaggttggagtgcagtggcgcgatctcagctcactgcaagctccgcctccagggttcacgccattctcctgcctcagcctcccgagtagctgggacaacaggcgcccaccaccacgcctggctattttttgtattgttttagtagagacggggtttcaccgtgttagccaggatgctctcgatctcctgacctcgtgatccacccgccttggcctcccaaagtgctgggattacaggcatgagccaccatgcctggcccaaaatttttttaacaaaaattagcagggcaggccgggcgctgtggtagggaggctgaggtaggagaatggcgtgaacccgggagatggagcttgcagtgagccaagatcgcaccactgcactccagcctgggcaacagagcaagactccgtctcaaaaaaaaaaaaaaaaattagcagggcaaggtggtggtatatccctggtcccaactacttgggaggctgaggcaggaggatagcttgggcccaggaggtggaggctgcagtgagctgtgattgtgccactgcaccccagcctgggcaacagagcaagacccccgtgtctaaataaaaatacccaggccatggcagcagaaagcaaggaagaagccacgtggaagccctcctggcgcttcttccagggaggtgagcagagagcacctggggccaggaggcggcatgcctgggtttctgctcctcctcactgtaactttcagccaagtcaaactgctagagtttcagtttctttatctgtgaaatgccggggctggcacagatggtttctaagatccctcccaggcctggaacttctaagcgattaggtcaaaggtgagctaaccgggctgggcacagtggctcatacctgtgaatcccagcactttgggaggctgaggcgggtggatcacttgaggtcaggagttcaagaccagcctggccaacgtggtgaaaccccaactctactaaaaatagaaaagttagccgggcatggtggtacacgcctctaatcaccgctactagggaggctgaggcaggagaatcacctgaacctgggaggcggaggttgcagtgagccaagattgtgccactgcactctagcctgggcaacagagtgagactccgtctcaaaaaaaaaaaaaaaggtgcacaaaccgaggcccaagacagttaaggtgcaagatcacatggttagtaagtgggagagccaaggtttgaacagtctggcatcagctgaccaggaactggagcccacccttctctctccctgagcccgcctacccgcccaccctcttgagtgcgaaatttattaatatggaagggagaagagctttaatgattggagtcattttcagagcattaaagctcttctcccttccatattaatgtatttctcagctactagggctcacttacagcaccagtggccccaaagcagttgacagtcagtggtaattaaattgtctctctggttctgtgactgaaggagacagaaggctttatggtggcctgaggaaagaaggtgatttggggcttggcacttcaggagagggcaggcgagtgagccagggaagctggcctgggaagcctgcgggtcacccccttgcctcccggcctggtgcttgagtggcagacggtgaatcctcctcctcctccatcccccaccttgtgtcagaggccagagctcggactccatctaatggtctctagttcagctgggtatttggtgaaaagggctttggggctggagacgtccacttttataacacactgacatgggaaggcgcattctgagttgtaatgacagagctagacaggtcttgtctgtagatgcagtggctttaaggaaactaggacgatgggcaggattttcctaggtgccaggagaaaggggtgatagaggattctagaggcttgagagagtcagtgtgcagcggtttcactctgatttgcttctccagtgaagatggttggtagctcctgaggccgggggtcaggaacatggaggcggtgctggggacggtttgttttctaaccacactccttttgtaaccacaaaggaaaaaggcagaacgttcctccgctggcgccagccaatcagcaggactcctgccttccttcggggcaaggtcgcagcatctgcctcggaaatcacgaaatcacggggcttctttctgctggctcagccgggaggcccagagtgttctgcagaggctgcgtattgaaggctgctctctgaagctccctgccccaggtcacgccgccggttccagatgaatccagagtgggggcaggccttcgtgcacgtggccgtggccggtggcctctgtgccgtggctgtgttcacgggcattttcgacagtgtttccgtgcaagtgggctatgagcactacgccgaggcgcccgtggccggcctccctgccttcctggccatgccgttcaactcactcgtgaacatggcctacacgctgctggggctgtcgtggctgcacaggggcggcgcgatggggctgggtccccgctacctgaaggacgtgttcgcagccatggccctgctctatggccccgtgcagtggctgcgcctgtggacgcagtggcgccgtgccgcggtgctggaccagtggctcacactgcccatctttgcatggcccgtggcctggtgcctctacctagaccgcggctggcggccctggctgttcctctctcttgagtgcgtctccctggccagttatggcctcgctctgctgcatccccagggcttcgaggtcgcactgggtgctcacgtggtggccgctgtggggcaggcgctgcgcacccacaggcactatggcagcaccacctcggctacctacttagctttgggggtgctctcttgcctgggctttgtggtcctcaagctgtgtgaccatcagctcgcacggtggcgtctcttccagtgcctcacaggccacttctggtccaaggtctgtgacgtgctccagttccactttgcgtttttgtttctgacgcatttcaacactcacccaagattccatccctctggcgggaagacgcgttgaacccagggaagaacctgctgaaaaccgatgacccccagcattgaaatggactctgagatggcagcgtggtgccagtgtcagacatcctgtgtgtgatgatatgcactgatcacacaagactgccctttcctgagaagctgcgggcttcggtgtggaggggtggagtgctgtgatctcgacaacttactttcaaagacataaagcacagatctccgcacaggggatgtgtgtgttcctgatgtaatttgcataacttttctgtagtttgaaatgtttccaaataaatattggcaaggggagtggaaatgacaccaagaagcccctcatgctcatggttggacagagagcgatcgtctggagtatctttggggtgtcagctctgggtgtggactggcagcagtgaggcaggccagtcagtggggtaccagtgagtgtccttagaggcggctggattcagggagactgagtcacactaaatacgtgcccagcagactgatggggaaatcactcaattatccccatgacatctgtgactgttaactgtaggcaggtcacgtgagagccacatcacctcagatcgtctgtggaaccaggcagtgtgcatccagatgaggaaacacacaaatgtcaaaagttgaactctcaacagaaagttgctttgtgggtctcccctcagagccagggtgtggcttagatgcccttagtggctacagtctgagcagtccccacctgcccgtcacccaggtccttgcgaaccagtctgctgacagtatcgtcaggcactgtgctggaggcggcacgtgcttctcatgcaggcaacagtttttgagccctcgagcccaaggcccagactctctagtttgtggtcaggatgctgggtcattcttagccgcagccagagaggcactgaggactccgtgccaccctctctactcccgggacagtccttcctgccggtcactatgttacttagaggcctgcctcacctcctttcatctgaaggcatctggtctgtaaaggggacttccttttttcgagacagagtcttgctctgttgcccaggctggagtgcaatggtgtgatcttggctcactgcaacctctgcctcccgggttcaagcgattctcctgcctcagctgcctgagtagctgggattacaggcacccaccaccacgcccggctaatttttgtatttttagtagagacggggtttcatcatgttggccaggctagtctctaactcctgacctcaggtgatccgcccgcttcggcctcccagtgctgggattacaggcatgagctcccgcgcccggcctgtaaaggggactcctgaagacaggtaatgtcatttaactcaggggctcttcatcccagactccatagtcttgtccctggagccttaagtactaaggagggtctgctttaagcccacaaattaaatggagaagtgaccagctccaaaggtgagggcagaggagagaggatgccctgtccctgccaaatggcatctcagcatgggccacccatgtgcacctgctcagtgccctcgaggttggcattcggcccacgactgtgatgactgagatgtttctggaactgggcacctgggctggatgttctgtcctagctggctgagcacattgccaccaggtaaggacctggggcaaatggcaggacccgacccagggcttggggcctgggggtggggcacgtggttggcaggggagagcaaggacagcacctgcttgggaaacagcctggttccatttgaggtcgtctcgaaagcaccatgtgccctagaagagggaagaggctgcacacatcaccagagaggccacccttacttcacagaggctggagggagggcgaaaagaaggcgggcttccatgcgggctcagagacagggtgggggcaggctcttcatccagcagtgggggatccccttttgtgatttctctgtgagtagctgtttccctcattgacagaggactgctgggacttcatgccacacctcgcagcaacaagcactcatcacgattttactttttcttcctaccaatacctgtgtaataaacagccctgcgagcctcctgggtcaggcggggtcccacgggaaacaggtggtgtgcctagattggggtgattcagggcggttttgtgggacacctggaagagtggaccccacccaaaggagaggcttatgtggaggggacacctccagaggggcagggactgcaggaagcctggctccgctccctccctctcctgccagagttgccagattatacgccaggcgatgaacaatggttttgcacaagcgtgtctcaaatgttgcatgaga

SEQ ID NO: 12248 - DNA, 34030 bp, Human
  misc_feature (1)...(34030): n = A,T,C or G
agcctgccagaggctgcggcctacagccggggagaggccagcccggcctacagtgcggacacaggacagaggggagccaggtgagccaggtttttgggcagggagggactgggagaccccagaggagagggctgcccccatgatgaccctgtccgcagctccgagagaccctgagcaaggctttcttcactgggcacctcctgcaaatcaggccctgcactaagtgttagggtcacggcatgacagtgacaaagatcccggccctcttgcagtttctgtgttagtagcagggagatggaagtaaacaaaaacatatgaaatgagtaaatgatctcaaatgtcagaaggggataagtgaaaagagaaaaaggagagcagagtgaggaggacagggaatgccgggggagggggcttggggttttaaagagggtggcctctttaaggttaaatgaggttcaatgcaaaaagccctagtgacatttgaagaaagggtgttctgggcagatggagatgccctagcaaaagctggcagtggcagggaggcctggagcattcagaacagcaaggaggcagtggcagcagagcaaggaaaagaggtaaggcaggacgagaggagccgcactaggggcacttgcaggactccggggggcagaggatggggccccttgccagcacccccacagccctgctgggggtattggtttgaaagcctcatatgaatcatttgctacatgtggttgcatgacccttataaagtctcctccctttccaaggcccacatcctctccataaaatggtaataacagcagtgcatctgtcaggttgaggtcaggaaggaaggggatcaaaagcatggcagcctgccggagagatttacaacatacctgctgcaagctaggaaacgcagagctggcctcccaggccttgtgggaggaacatgtaagcaaataagaacttgtccctaaccctagagcacccagggaacgagggagctgaactttgttcagagagaacagcaggggcaaagggtaggaagagaatgagtggaggccagggatgagggcagtaagttgacataggagagaggtgagtggagtagggttgggtagacacagcaaggactccattccacaaacagtgggccccaaggagcagattccaagcaggagaggaaaacaatgtgatttgcagttcaagagttcacctggcagctgggagaacaaataagaggaacactgaggccaagtaagagataacagtggcctggatgctagccaaagagatagcaaggagcagatggactcaagagacttgtgaaataggatggactgcacctcatggttgcctcactgtggaggaataggggcttctcagaggccaagcacttgccatgaaggagacagggtccaacctgggtatgaaagacactcaggggctccaggggaacacttcacaggcaggaagaaggcttcctcccttcagttccacaatatacctgcagggctcatagaaatggagctgagtgatcctagaacttatgagcagtttaatgagaccaaggtgcccccagcaatcctccacagtggagctgtagtatggacaagtcatgtgctttgtggtcagaccccatccaactcctggccatctccagctgtgtggctaggggccactcaacctctccaggattattttcttcaggtgtaagcttcactgacttttttgtgaagatttccctaggcaattcatgtaactcaaactgcagtggatagagcccaatctttggggtcaggccctgtccaatcttggctaacaagtattgaacaaacatgtaccaagcaatggctgcataccatgcctaccatgcacacagtgcctggtccacagccagtgtccacagggggagtggggaggtggagtggcattcaggtacttagggatgtctttcttctaccaaccagccctggctgacacccagccctaggcagttcctcttgcacacaggttctttgcactgaccaatgctgagagcagaccctcggagcagccgggttggaagtgtctctccacagtcaccagacagatccaggataggatgggcagcccagtgcaccgagtgtcattgggggatacctggagcaggcaaatgcaccccgacatagagagcgagaggtatatgcagtcctttgacgtggaacggctcaccaacatccttgatggaggtgcccagaacactgcactccgcaggaaagttggtaaggggaagctggggaatgggacatctgttttatgccccatgcttctcttgtaagaagagtccttcattagcagttctgcttccaaataacaaactttgcccttgaaattccactgttagagattcattccttcgaactgtaaagacaatcttcacatgtcaatattgcctgagcccacctaggggatagaagagtcctaggcagcagaagacctggattctggtcctaaaattctgccactgcatagctttgtaaccttgggcaattcactttcccaccttggtcctcagttttgtcatctgtaaaataacaataatgtctgacttcctttccagatccatgaagcaagtgggtgagaagatttgaaggtgccagaaacctcacccaggtccctaagccctctgttctctgtcctctgcagagagcatcatccacagttacccggagtttagctgtaaggacaattatttcatgacccagaatgagcgttataaggctgccatgcggagggcattccacatccggttgatagctcggcgcctgggttggttagaagatggtcgtgaattaggctacgcttacaggtgctcactcctcgagcagccccactagagagggatctacctgggatcacctggaaaccccctagccccatgagccatttcccccaacaaagggaagacttgttgggaaaccaggatgctaggtgccctttatctcctgtactctgctcaggcagggggtacctgggcccctgtctccaataagctactcaactacagcatctctccccaacagagccctttctggagacgtggccttaaatatacacagagtcttcgtgagagccctcaggagcctgggctcagaggagcagattgccaaatgggacccactctgcaaaaacatccagatcatcgcaacgtatgcacagacagagttgggacatggtgagctaggactgctgcgtgtggtgtttaggttgtgcactgcaaaactccagagggcccatttacatctaggtagtcataggttcatatgctccgagggacatatgtttaataagaaaacattccagcagctggcagtcaagggtcctgaggaaggggtgccaccttctaatttgcacgtattgtatgagctcccagtggggcaagtcattccttctggaaacatcagcagccaccccttctcatggactggctataggggactgtgtgtcccacacacagcccacagatgaaaggggagaactgcctgcaagtacagctgggagctgggccccactccatactgcgctgatgcctaagagttcagacccacctagaagcagcttcacaggtaagaaccccacctcaggccaatgtctaacacctctccttgatcctaagggacatatcttcagggcctggagactgaagccacctatgacgcagccacccaggagtttgtgatacacagccccacgctgactgccaccaaatggtggcctggagactgtgagtatacatccaccccccttccttaactctccccaagtagaagaatgttggagggcagagtagcactggctttgaggtccaacagacctcagattgattttctgttctaggctgctgaccttgggcaagtcagttcaccaacctgagcctcaggttcttactctgtaaaataggtgggatattaaacatttcattagtgagtggctggaaagtccccaaaggaactttgaagtagaggagacaatcgatccatgagagacaaggcctcactcacacacacacgcacaaacacacacacttggtctagtcctaggcactcctcacaaccccggttcctctcatctcccgagttagtggcagagcttgccaccagccagagcacaggccctgtgatgacacagtggaaagaatacgcctgcctgcccctgctgcagacacccaggaaggctcacgcccattaccagcccccatcaggccaccaacgccgtacctcctgctgtggccaccaggtggcggccacatcaagcgtccctgaggcttggtgatttaccaagccccaacgagggatttccccttcctcaaacttgagaatttcacctccaaggacacatctgtggcacttggggacccacaccttgtgtggaaaaaattaaaacaaatatgctgagcccaactaaagcaggagagtgacagagatgagagacacatagagagagggagacacaggcagagaccagagacataagagagagacatgagccgggtgcggtggctcatgcctataatcccagcactttgggatgccgaggtgagtggatcacctgaggtcaggagtttgaaccagcctgaccaatatcattaaacctcatctctactaaaaatacaaaaattagtcgtgtgtggtggcgggcatctgtagtcccacctactcgggaggctgagacaggagaattgcttgaacctgggaggcagaggctgcaatgagccgagctcaggccattgcactccagcctggcgaaagagtgagactctgtctcaaaaacaaaagaaagaaagaaagaagaaaaagaaaaaaaaagagagagagagatgagagagtgatgacagaaagagagagagaaaataaatgaccactgtcaaaaatgaagacaaaagaaaccagccttttagatcagacagaccagggtacagatgaatcctagctctgcccctccaggccaatgaccttcagtgtgtcactctactctctgagcctgtttccttaactggaaaatgggactcatcatcctctctcccctgcaagaactggaaagcatctatcacagggtctagcgccacctagattttgataaatgataattatctgtattcattattataaggttgatgacagagtaattcattaatagttggggggggcaaaaaaaaagctggatcatttcacagtgcctttgccaacgctgctaggtttgcttggttctttgggggcaatcccctctctctttgatcagtgacttttcagggccccagaggtacccatccaaaaccccagccccaggaggctgggttggttgggaaaagcaatgcacaggtcttcctgtgacgggccgctactctctctgccctcagtgggacggtcagccacccatgccctggtccaggcccagctgatctgctcaggagccaggcggggcatgcacgcttttattgtgccaatccggagtcttcaggaccacaccccactgccaggtaagcccataatgctccctcaaggaaccctgccaggaggagagcccaggtggcctccctgacctggggccccagagggccacaggagtagctaagacatgtctcccttgggcagggagcggtccagttggacagacttggtgctaactggctaggtgaacttgagcaagatttagcatctttctgacctcagcttgttcacctgcaaaataggtacaataatcccagtgtcacaggctgctgtgacctggaatgtgtgtatgatacctgccacatagcaagcactctctcaactgataggtgtcctcatctccatctccttcaaggaatcatcattggggacatcggacccaagatggactttgatcaaacagacaatggcttcctgcagctgaaccatgtgcgggtccccagggagaacatgctgagtcgctttgcacaggttacagatctggggaggccggggacttgtacttcctggagaggggacctgcgctttgtgcaggctgggcctgggtcctccatagagcttagtttgggccacataacctcctcccccaagagaggctctgatatcccacagattggggtgaaacccctgcttaggagcagtatgatcttgggcacagagcctcagacctctcatgcagaaatgctcgtcacataggctgacagagcaatcgtggggtggggtggcagccccaggagaggatagggctgaggtgacctgcataatatttacccacagtgaggcctgacacagccaatcgcccaacagataccagccagaatgccagcaggagttctgaaggtcccaattctgccaggcatcacccctttagttatgggtcgtggggaggtccggggtgtcccaggagaggcactgtgaagcagggcacttggggaaatggcctggtattttaacactccaactccagatgcgccggttgaggggcgaggtgccctccatgtgtggagccccacagctctggagaagcgagggcatcctgggaagccttggcccagaacttgtgcccgtccttgttccacacaggtcttgccagatggcacctacgtcaaactcggtacagcacagagcaactaccttcccatggtggtggtgcgggtggagctgctgtcaggggagatcctccctatactgcagaaggcctgtgtcatcgccatgcgctactcggtcatccgccgccaatcccggctccggcccaggcaaggggtgcccagtgactgactaccgcagatatgctgcctcttggtcccacagtgcctccccctgacaccacccttctgccagagccagagtgctgggagcaggcaatgccccccaccacatacacacacacaaacacaaaatctacccagcctggccccatctgggcatgtcagaggagtctctctggctgcctctaacagggctgaccagccggcctaacctgcatcctcagtgcctggcccccatcgggctctatgtgatagtgtctttggccctgtagcaccaggtctgtctgactctgtgtctgtccgagtccagccgtgttctgtgcggctgtgacgggttggacgggtctgggtcagccagttgccagctgcatcagactatggctggctgagttgattctgtcaggccgagcctagcaaaatccaatatcatatcgactgtgtgtggctgagctcgttctgtccagctgtgctgtcagcatcccactggtatgtctagtctggatcccttttgttgtaattggttgtgttgctaccactccctccacctcacagcacagaatagcaagggctgcctgaaccctctgtgaacactcagctcggccatttcacttcatacctcagcttcctcagctacaaaatgggtgtggcagaagtggcctttcagtgtggtgtggagggtgaaatgcagtaaggcacattaagtcctcagcccagggtcctttcctctggcaagctcacagcgccctcgcctggcctgggcttcagaatctgggctgcaagagttctctggaggacagggccactgggaagaaggggcttctgctgctgtcctgcccgaggcccatttatctgggctgcagaagtgtccccagggtggttataagaaagatgcgccaggtaagcagctgctgtctgtagaggaggcttcttgtaatcacatcctctttcaatccagttactgcgagctcctaaatgccggacatagccttgggcactgaggacatagcagcggataaggcagacacagtcccttccttggggttccatcagacctgagtttacatcctaagagttattgtttaggcttgacatattcctcagcgcgcggcaagtgcacacgggcagtggaaggtcacaggttcaaatcatcacaggtgcagggccacaactcttcacctgaaatcttgggaccagacgtgttggagtctcagaacttttcaggttttaggataatactgtgtatatgctggaattctataagcctcccttaacaaggggcagtacccaccaacaaatgtgtcagtattcctgcagtgaaatgtgtggatgttcatgttagatgggatttttaaaggattatcaatggcctcatgtcagttcaagttttgcaatgagttctaaggaactgtctgtttttaaggtttttatggtgtcggggataggggaaggtggacacaacaggtagtgatctaaatcttctggttcttttcccttcagtgacccagaggcaaaggtcctggactaccagacacaacagcagaaactctttcctcagctggccatcagttatgccttccatttcctggcagtcagcctcttggagttcttccagcactcctacactgccattctgaaccaagacttcagcttcctgcctgaggtacctgctgtctgcggaggggcaggcgctggcaggcgctgggagctaagattgttccactcactggggagcagccacagccccatccccatgggcactccccacccccacctctcccagctttcagcatcccagggcgtctgggtgaacggcaccctggtatataaatttacccacaaccagcccccagagagctacaaacatactaagagaaaacaatcacacctagcgtagagaacacaggtccacaacccctgatgtgtatttgaaacctgaaaagctccgaaaaacagttgtttggaactcatttggtggcatagtttgacctgaactgacctgatttatccctctgagtgtgaatacattttgcagtaaaattattaatgtgtttaatcactaaagctgccccaaaccccactggggctattatataaaatgcactttaaatgccacttggcctctctataatccaaaagttactctgattcctaaacacatctggctcacaggtctcaggtaaagcattgtggacttacatatatagtaaaattcagtctgtccaggctaccatgctttataagcactgctcattaacccttccaactgcaatgaggcacagagagatcaagggacataactttcctcccaaggacttgaaagctccaaagataggcagggtcttcaagaaccaaaatctgaaagcagtcctgctgcccagcagcctctgtcctgttggggccactgtaacaaaataccataaagcagtggtttataaacaacagaaattggcctggcatggtgacttacacctgtaatctcagcactttgggaggccagggcaggaggattgcttgagcccaggagttcaagacaagaccagcctgagcaagatggtgagacccccgtttccacaaaaaaaaaaaaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgcctcccaggttcaagagattctcctgcctcagcctcctgtgtagctgggactacaagtgcacgccaccacgcccagctaatttttgtatttttagtagagacggggtttcactatgttggccaggatggcctcgatctcctgacctcgtgatccacctgccttggcctcccaaagtgctgggattgcaggtgtgagccaccacacccagccagaagcagcctctttcatgagggcactgatcccattcatgaggcctccaccctcatgacttaattacctcctgaaggccccaactcctactaccatcataatacctcctaatcctagtcctaatcatcaatacctcctaatcctagccctaacccttgagggttaggatttctacataagaattttaggtggacacattcagaccctgtcaccctcctacaacccagtaagtgggcttacagtggacacccatcctcataagctagctttctaaaacccaggccagcaaaatccgtaactcctggaggtttgtgggcccaatccaggcagcaccctcttcccaatcctggagacactggccaggccaggttttccttcactcttatgcccctacagctacattgcctaattgtgtgcctctgggtgagtcacataagctgagtacccgccttctcattcataaagttgtgagcagaggaaacacttcttacctcagagctgagctgggcatgagtagatgctcagtaagtggtgcacagggttggtccctatggtggaggccccctaacaccgcccaacccccctccatgttctcacagctccacgcactgagcacgggcatgaaggccatgatgtcagaattctgcacccagggagctgagatgtgccgcagggcctgtggcggacatggctactcgaagctgagtggcctgccatcactggtcaccaaattgtcggcctcctgcacctacgagggtgagaacacagtgctctacctgcaggtggccaggtaaggtccaggctgacccaggcctttgcccaagcccttggggacccaccaagcttctgttgggtggagggttccgtctgaggcccataaaaagagcaggctttgcgaagtgctatttgggagctgtccaattccccagtatgactaacctatccacttctaggccaccatcctctctcacctccaccacagcctcagacccctccctggtctcttgcttctatcctgtcctgcttctccacaggcagccggagggatctgttcagagcctagggaggatcacatctttctctggtttgaaattcttcaacggcttcccagtgctcataggaaaatgacatattctatgctgtggcctgcaaggtccatgtgacctgacccctgcctccccgtccatcctgctctcaccacctcctgcctctgctcacttcttcttcttctttttttttttgagatggagtctcactgtcacccaggctggagtgcagtggtgcaatctcggctcactgcaacctctgcccgccgggttcaagcaattctcctgccttagcctccgcagtagctgggattacacaccaccatgcccatctaatttttgtatttttagtagagatggggtttcaccatgttggccaggctgctctccaactcctgacctcaggtgatccacctgccttagcctcccaaagtgctgggattacaggcacaagccaccgcacccagccacctctgctcacttctgccggccacacacttctttctgtccaggaggcctttgcatttgatcccctcccacccaacatggccttgtttcctttggagcagtttcacaatctatcattgtctcatttttttgttcacctttttagctctactctccaactagattaggagctccctgagggcagggactacccctaccttgctcgctttagcatcgcctaagcttggtgcagagcctgcacacagaggctccaagcaatggccaagtcagcttcctccacacaggcgatttcttttcatccctcttaggtctgtgggccctggaggccgacagagcctcatcctcacctattctcaggtgaacaaacagggcaaatgcttccctatgcaaggagaaagaagttcactggcaaatatgaaaaacaacatttattatatttttaaaaatatataacatcccttggtttttttccaaattagaaaaggagtacaatagcacatattatgtactctgcactgtgccaagcactctacaaatatcatctcattccatttcacaaaccctcaatcagatgagaactgtcctccccacctagagctagagaaacagagacttgggaggtgaagcttctttcatcacacaggtctcggcgaggctgtatgggaatccagggctgtctaagcccagaacctgtaaccactggattatcctaaagcagcagttgagagtcacctataatcctcctactcctgttagcattcttgcctctatccttcttttttcagctaagaaaatttaatttccacccagtcactgtacaagtcattataaatcccaaaatcacagtgttctgatggaaaattctgtttgctcagatcacagaagggtttatgttcaggatcagagagtgtctggcccagctccacaggtcctgggatatgcctgactgagggcctcgaggcaggacggcccgagggggaaccctcaggagggaggccaggcagaggcctggtgacctggctctcccacgggaaggctggaacctagcatgagcttgcctgtctctgggagtgaggggtgctgggctgtctcacagagtctctgccctctcacctgcctcctcttccaacccccaggttcctggtgaagagctacctgcagactcagatgtcccctggctccacgccacagagatctctctctccatctgtcgcatatctcaccgcacctgacctggccaggtgtccagcccagagggcagccgacttcctctgcccggagctctacaccacggcctgggcacatgtggcagtaaggtaagccagtgctgagaaatcagccatcccacctgggcacaggctccatgccacactagggcctttggattggttgggtggacattcgtggattcagttctaaaaaccaccccatgcctagcctccccggtcctctcagttcctgccaccatgggcagagagaggggatgtcccccccatcagccatggacccccgtcacttccccatcctggtcacagtagtagaaggacatcacacctctggccagtgagatatttttaaaatctctagggtcctatggtgatttgcaatacaacgaatgtacccatatgtaaatactccaaatgtattgatatgcaaataccaataaataaagcaatactcactcgtacgtttgaaatatcccataatctaaaaataatttttgaaaatatgactacaccacgggatagaattcatttatttccagggtctagtaggctccagggaacatggacaaaaccaaggactcatccattctgtcattcaacaaatattgttcagtacctactatgtgttaggaatgaacaaatgtgccaggggctgggaatagagaggtcctgaccaaacacacataccaccatggaaaagatggaggtttaactacctaaaaagaaaacgttctgaatgctgcccccaaattaaaacaccgaaaacaggctgggcatggtggctgacaccagtaattccagcactttgggaggtcgaggtgggcggattgcttgagctcaggagtttgagaccagcttcggcaacatggtgaaaccccacctctaccaaaaatacaaaaaattttaataaaaaaataaaaaggaaacaccaaaaacaaactggaaaaacatattttcagtatataataagaggtcttatatcccaacctgtggtcccagggatggttaatagttatttcaagatcacaagcaacttggaacattcatttatttattccaaaaatatttattaactgcctataatatggcaggcactgttctaggcattagggacctatcagtaaataggcctgataaacaccccaaactcatagagctaacatttcaattgggagatttgaggaggggaagataaggctgctcgaggtgattaaagtgtcatggtatttctccttgcttgaaactcagtgtgacatctgcttatctattccctgacaaagcaaaaaacatattgcttaataaacagtttgctttacacacaaattctaagggtcatggatggatgggcagggaatagaaaataagaggggattaaaggttatttaatgactaatttagtggtttgcaggacaaaggttggttttctctttttgtttttaggtcccttgggtagaacctgcagcaggctaggtgaccgacgggcctctctagcctttacagaaaaaccattctccttgctcaggccacaggacgtcagtcaacaaaaaggcctgaacatactggtgtgaggctggaatctgcattagaaataggggacagctcctggcctgtggccctgaggctttataacatggcgattaacaacaagtcaaaatcctggctccactccttactagctgtgtgaccctggacaaattggttaacctctctgggactcagttttccccattgcaaactggggggtgcctgcccttaaaagagttaaaaagataataaatatcaatcatttagctttatggcacataagtggtcaataaacaggcattatttctacttctgagggaccacaggaagcccatcagttgtcttttccactcagtcaggaagctgaaccttttttgctttggctttcaggctcataaaggactcagtgcagcatttacagaccctgacgcaatccggagctgaccagcacgaggcttggaaccagaccactgtcatacacctccaggctgctaaggtgagcgcctgccagctgaagctgaaagggatccattttgcttcccaggcaggctaccctgctgggaaaatccgggctctgccattattccccaactctgcttcagtggcggctgccctcatttcacttccaaggctttagtccagggtattttaattaaaggacttaactccaaagcaatcttgctggcagctcttaggggaaaaggtaatgaggcagtgttattggatttgcttcaggttgttcaaatatttcctcccagatagaaaagcaggtcaagtctccccttagccccacaggcaatccttggatgtctgattccatttccactcgttttgtgtttctgcataattcacagtcggtcggcaaatatttgagcacccactctgccctgggcactgacctgggtgctcaacagtgaagccactgcccatgcacggctacaatcaaggaagcaccatgacagggaaatacaggctgctatggaatcccagagcaggtacacttctgcccacctggaggagtcagaaaggcttcccaaaagaagtggcatatcagctaagacttcaaggataagctgaaattagccagctaaagggtggggtggcagctttggagagaaaagtttccaggcaaagggagctgcgcgtgcaaaaggaagcagcaagaaggatcctggtgtgcttgggaggaagtgcaaatctcccaaggaggacctaaggagaaggactgagacaaggggagaaggagagacaggcaaggcctctgaccttttgcaccactgtgaaaagttggggttttgttttcattgcaatgcctttgctgagtttgtttggaggtggggtaaagtgatcagtttcattctagaagaatcatgcaggttgcccaggatggaatgaaagggagcaagttagaaaggagcaagtctgaaccgggactgagggtggtcctgaccatgagcatggcagaaggcctggagacaagtgggtagatcagagatgctaagggggaagaaggcagggacaggcctcagagtgctggggtgggaaagaggtaagaacaactcctgagttctagcttaggcagctgggactctggcaccgccaataactggaaaactaaagtgatcacgccaatcctcaggcctcagacccagaaaatggcagccttggaacaggagagccctgaagggctgcagaggccctcgtgggacagggctggtcaggcaggctggacgttgagcaccaccacgtgacccaccacctccaccacaccacacgtgatgggattacctctgcagccctcagttctgctcagcctacagcaggggcaccccctgctgtgctaactgtcctgtcaacacagaaggtgagccaaggcttcctgctttcactggatcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcaagggtgaggaaagagaactcaggacttaggtcccagaggtaggaaatagctgagtccagatgctttcccttcccacaccactgagggtgtgatgagtgactgaggtgagcaacaaattctggggggatggagggtgacagccagccagcctgcgggggaagaacacgtccctgacagcttcctggggaggtggtgccccagctgagtctccaaggtcataatggatagggctttctgtactctctgtgctttgtggggttatttagtctacagaaagcttcagcacccaactgggccccatctagaaaccataaatgtgcaggtagagataactgcaacttgagggaagaggggatgatactgccagaagagtagacaagggggagccacgggctaaattctggtcccagctctgtgtgacctcaagcagccccttccctctctgggctttaacttccctgtctgtagacaaaggggcatggaagagccctttaggctctgtcaggccgtggtcctataattcagactctgaccagaagagatgtcagtctccaggaccatgggaacaaatgctggcctcattataatccagcctcagtctcctgtggctttggccacacagggttaggaatacagccctggtgtggatctcactgctaccacttcctagccatgaccttgggcaaaaaacttaatctttcagagcctcagtctcttcgtctgcaagatagagctaataacagtacctactttgtaggattctaataaagattaaataagtaaaacttagagaggcagctagcacccccacccccaaattagacaggaggcaagatttaaaccaacacacacaatgtaaataatgttcactgtgctcagagcgtggggccaaggttcagctcagcccttccccaaagtgtagaggtcacctctgtctctgatcctcatcctgctttttaaggcccaggcccctgggcagctctccatcactccactcctcaactcagagccttgagcatttgaggatgtggctctcagattaggacaggaaaaggagtgcgggtccgcagttctgccaagctggacccagtctgagcaacaaaggctactggagccagcagaggcaacacagcacatctgctcaccttccacagccaaatgctgcaagcccagcatggctgtgagcacaccatgtctgaatggcaaagtggagttgtcagcacctgtgtgagggccccctaggaaacacaagttctttccaagtgagaaagcggatcgggtcactgcccagctgaagactcccagtcccacagagcaaattctgaccatgttattcacagcccttcactgacctgggccccaggtatgagtccaccctaacctccatggttccccatcatcacctcattataccaccacacttcagcctcattaaattgcctgcagcttcctgaaagtacagccttttgcacataaagctccccctgcctggaatgacctttcccccaactcatgtccgcctgggtgaactcctttgaacccccaaggcactctttttttttctatgatagagtctcactccaccacccaggctggagtgcagtggcacggtctcagctcactgcaacctccacctcccaggttcaagcaattcttgtgcctcagccttccgagtagccagaattacaggtgtgcaccaccacacctggctaatttttgtattttttgtagagacagggttttgccatgttggccaggctggtctcgaactcctgacctcaagtggtccgcccacctcaacttcccaaagtgctgggatataggtgtgagccaccgcgcccagccgaacccccaagacactctaagtcttgctactgaaaatcactacagcagcatgggcatcacaggggaccttgttagaaatgcacagtctcaggccctgccctggaatctgcattttgacaagatccccaggtgatctatatgcacataaaaaactgagaggcagggcggggtccagaggctcacgcctgtaatcccagcactttgggaagccaaggaaggaggatcacttgagctcaggagttcgagaccagtgtaggcaacatagcaagaccctcgtctctactaaaaatacaaaaaaaaaaaaaagccgggcatggtggtgtgtgcctgtggtcccaactactcaggaggctgaggtgggagaatcacttgagcccagtgggacagaggttgcagcaaggcaagattgcaacactgctcttcagcctgggtgacagagtgagattctatctcagaaaaaacaattaagaagcactgctttatactttctctcttccttgctctcccttatagaactcatatatcctacctgacaaaataattgtgtgtgcttgtcttgacgagatgcggactgttcaaaatatgttacaaccagtaggacaaggcaccaaccaatcaaaatggactttagccctaggggaagcaaggtcctgaaggcctcctgctgagtcaaacattaatcctttagttgctgggctgtggagagaaggagggggtcttcgggaaggagtccatctggcagaaggggctctcacagggttgatggcagtggacagttgccagctggtattaaagtattatttttacaactgccacagccagaccataacatatgggctaaataacagcactgcttaccttaaggagtttatactctagctggaataaatttcatatatatcttgaaactttctcaccccatggtgcacacatgtgcacgcacacacacacaccactgacttgaacacagcagacaacaaatagctattttcttttcttttcttttttttttttttttttttttttgagatggagttttgctcttattgcccaggctggagtgcaatggcatgattttggctcactgcaacctccgcctcctgggttcaaatgattctcctgcctcagcctcccaagtagctgggattacaggcatgcaccaccatgcctggctaatttttgcatttttagtagagacagggtttcaccatgttggtcatactggtctcaaactcctgacctcaggtgatccacccaccttggcctcccaaagtgctgggattacaggcgtgagccaccgcgcccagccttaaaatagctaatttcttaagaacagtggtgctgtcctccaccttccccaggccagcctccaatatgcctgtattctttccttctactttccaacctacttgaaaccgctccaagcaaaagaaaacaagggccatgtttcaaagcccaccagtcccccccgtccccgctccccccccacacacacacatatacacaacatcaaaacgccttgatcagacccagagctaggagaaaaggcagctgctcatcagcctgctgggaagcacatcatgcctcaagtttaattccagccatcttgccatgctttccagggtgacttctggagtagaaaaccagaaatcaggagaacatatctttgtgtctttgtaggtgcactgctactatgtcactgtgaaagggttttacagaagctctggagaaactagaaaatgaaccagcgattcagcaggtgctcaagcgcctctgtgacctccatgccatacatggaatcttgactaactcgggtgactttctccatgacgccttcctgtctggtgcccaagtggacatggcaagaacagcctacctggacctgctccgcctgatccggtgagtggcagagacttcaaaccatgttagtcttcagagaataaccctaccccttgttcacaggtcacttccaactccaaaaccttgctaatgggcagagcagcaacagccctggagaggtctacaccctattatcattacaccagcataaagcattatgaattaatgaaagaaaaaaatgggaaaaaatgggaaaaatactgaagaataaatgagctacctcatttgaactctttacattgtcaaggaaataggaatagtatctaaggaaaatcaataaaatgaagcatgctacatatgaatgatatgtgctaatgtgctaataatagtctcaaccatagctaactttttttttcttttctttttttttagacagggactggctctgtcacccaggctaaagtgcagtagtacaatcttgtctcattgcaacctctgcctctgggttcaagtgattctcctgcttcagcctcccaagtagctgggattacaggtgcccacccccatgcccagctaatttttgtatttttagtagagatggggtttcgccatgttgaccaggctggtctccaactcctgacctcaagtgatccacctgccttggcctcccaaagtgctgggattacaggtgtgaaccaacgtgcccaggcatagccaacctttaaagagcacttatgtgacaggccctgtgccaaaagcttttacatacatctcatttaatccttacagccctttgaaatgggtactattaatctcctcattttattggaaaggaaattcaggctgatgggagttgcccagtatcacacaatcagccagaggaggggctgggtacaatctcaggtctggcccctgggcatgagctcttaacctgtatgttaaggttaaggttgaggtattatatactttgaacacatcctagtctttgttgaatgtgcttaagcaaattcttaccaagtttagtaaacttaccttaatcttccctcagcttcaagatgaaaaattttttttaactctgtaattcatatattgatttataaaataataacannnnnnnnnnnnnnnnnnnnattattctataatctaaacgattgctttaaaaacatatcaaaaccaaagcccaacctgatcagagtcctagaaaaaatagaaataaaaacaataaagtaaaaaaaaaagcctgggcaacatggcaaaaccccacctctacaaaaaatgaatcaggcacacacctgtagtctcagctactcgggaggctgaggtaggaggattgattgatcccaggaggttgaggttgcagtaagctatgatcacaccactgcactccagcctgggcaacaaagtgagaccttgtctcaaaaaaaggaaagaaaagaaaacattgcaaattatttaccattgtccataagattaaaaaaaatggactaatttgagaatataatctttttgagacctcactgggcagaaaatatgatacctattgcatggggttagaggcgactcctagaatctccaacaattcttatatcaacaagactaataaaaagaaaaaaagaggctgggagcagtggctcacacctgtaatcccagcactttgggaggccaaggtgggaggatcacttgaggcaaagagtttaagactagcttgggcaacatagtgagaccctgtctctaaaagatttgtaattttttaaaaataagattttaagacaggtttttaaaaaactagaccaaattccttttatttctcacaatatgcaatatgttacatgccctttatgactactcatagcatgtaacagatagctggtggtcaaaaaaatgtttgttcaggccaggcgcggtggctaatacctgcaatcccagcactttgggaggccaaggtgggtggatcacctgaggtcaggagttcgaggccagcctggccaacatggtgaaacccggtctctactaaaaatacaaaaattagctgggtgtgatggcacatgcctgtaatcccagttacttgggaggctgaggcagaatcgcttgaacccgggaggcagaggctgccgtgagccaagatcgtaccactgcactccagccttggcgacaagagtgagactccatctcaagaaaaaaaaaaaagtttgttcagttaaatcatcaaaaactgtcaaaaatacgtttgacacaattatgtcccaggtataaaactttccctaatacagggaatccagtggtgaaaactattaagagcataattaagtactgcacagttcaagcccaagggtgtccatctttttgaaactctcagaatttaaaagcacttgaaaataatgttctagccccggttgtcagtgatgataaaatacaaaagattaccttaacaccctataagcatgttttttaaatttgcaaacagcatttctaagtgcttgccttggctccagaaacttacaattcaagacaagacagacagcccagatgcaatctgccaacttactcatgcgtcaaacccagaaattgatttacttccatgatggttcctaagtagccttactactgcagggtaattaggcacataacagattctatgcatatcactgtttggtgtcacagttccctgccttgattagtcactatctccctaagatttctgagatgaaaactgaagggcggcatagtatgctatggatgccaagaacaagctctctgcaatgttaactgacccaaacagtttttagttgtttaagcggtcataaaacctcagctggggggacttccaggtaaagatgacagattaaactatgcatttacttctgttctttcccgaaaccctactaaaacatcagtgaatggactgaaattttttaaaaggcataaacccacaaagagaaagagatgttgtctctgtgttgtccaggctgctcttgaactcctgggctcaagggatcctcctaccttagcctcccaaagtgctgggattacatgcatgagctaacacacctagcctctgtgagtaattttaagactttccttgactctgccctggcagaagggtaaatagaggatctgtggactagggagcatcaggtatagttgataataaggctacccttcagaaaacacagggttctttataggccaaatactgacacctccctcccccagaccttttttcccactggttcctaaaaaactggcagccagactagtaccctgcaagaagatggtaagatgatccttctctggagaatctgaccagcccaaggagaaggagctaaagacactgacatcagagtcccccaatggtccacccaattcactccatagtgaaccccatactagcaagcatagccacaagtttgtaatcagctagttaaggctttgcttttagctatgatcagacactcagggatcaccaaacacctgaagaatgcccctaacataaaagatggagaccaaaacaagcaagaacaaggcaattcagaggacataagagaatccacagggagaagaaaacttaaaaaaaaaaaacagtgatatctcagagttaagagacggtattgcaaccacaaaataaaaacctgaatgccattatttaaaactaatattcagagaacctaaaaaaagagctccttgaagttaaaaaatgataatggaaatgaaaaactcaatgtaaggactggaagataaagttgcagaaatctcacagcaagaaagcaaaaagacaaaaaaaaggaggacttttaaaaagtaagaggaccaatcttagctgttcatcatctgaagaacaggtctagaaagaagacagagaaaacagaaggaagcgaatcattaataaaataattcaagaaaacattcctcaaatgaaggatacgagtttcagatgaaaaagggtcacagatgcctacagactagaggagaggagacaggcacacacatgcacaaaataagtcacactgtataccatgtgaaatggtaatacctaccatgaaagaaaggatagcaggaagtggaggaaagaatgctgggggtcagtagggaggaggggaagctacaattttaagtaggccagagaaggcctccctgggagggtgacatttaaggaaagacctgaggagaaggtagggagaagctgttgtggctgctagggaaagagcattacaggcagaacataagtacagtcatgcatcacttaatgactggaggatccgttctgagaaatgtgtcttcaggtgagtctgtcatcatgtgaacatcacagagtgtacttacacaagcctaaatggtatagcctattgctcgtacagtcacacctgcaaagcatgttgctgttctgaatactgcagccaattctaacatcaatcactaagcaataggaatttttcagctctatcataatgtcatgggaccgccatcatatacatggtccatcattgaccaaaacatcattatgcagtgcatgacagtacaaatgttggagaccagagtgtgcttggcatatccatccagagaacacagaagaggccacaggggcaggaatggcatgactgcagtggaaaatgacggcagagggcagagagttaagggagtacagtagggggtgggaagagacggtaaggtagatcattgcaaagacttaagagaatgcgagggttttgagcatgggatagaatgggagggttttgagcattggatagacacaacctaaaagaatctgatgtgtatttttaaaggcttgctccagctgccatattaagaactaagagtgaaaagcagggagatcagctggatcgctaatgcaatcatccaagtgagtgatgatagtggattggagcagtgacagtgctggaggtggtgggaatggttgaagtttgaatatatcttgaaggcagaacaggatttgctgacagattagatgtatggtgagaaagaagagaagaatcaaggtttttggtcagaagggcagagctgccatttactataaatgcggaagactacaggaggcccaggtttgggcagggtggacgggaaggagtttgggttcagatacattacttttgaagagcctatcagaaatccaagtacagatgttggtaagcaggggacactggagggataagtttggaagtcattggcgtatggttgatatttaaagccttgagaagaacatcacaaggagtgcatgaagagaagaggtccaagtactcagtcttgagaccctcgcaagataataaggaagtaaccgtggcaagagctatttctgtggagtggtgggagtaaaaacatgaacagatccagttcaggagagaatgtgaaaattggaaatcataagcataaacacacataacactttcagggagttttgtcctaaacgggagccaaggtgatggagaaggaaatagagtcaaaagcttgtgtttaagatgggagaaatgattgtctgtttgtatactgatggaaatgatccagtagagaggggatttttttttcttgtacctttctttgaacttgatcttggcctcccatcacgccttgtgtttaagagcaaggtctttgaggagatccttgttgatgacagtttgtccaagaggatatctacagagtaccttgtgggcatgaggtgattgcagttataagcttttgcaaaagacttgatccttgacctcttggagatcttcttgcctatggcagctgtcactttgtgaggatagcagtcaattccagctaccaaagcatgactgtaagaatggactgaggtgccatcatcaatgtccttcatgataatggctttgcgtccagagtagcatccagccaggaccagcaccactttcccactttttatgaacttgcccattttgacagcaaccagccaggcctacagtaaaaagaaagaagggcatttccactaactttttacccctgaggggaattttgatgttgttggagaaaggcaggagaatgttgttctccagtatgcaagaggaaaagacatctagtagacaaggagggactgaggcctgagctgagagcctgaagagagaaagcattgtatgtataaatgcaagggtgggaacttacacagattctcttactgcttccacttcattagtgaaatacgatgtaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttttttttttttttttttgagcgggagtcttgctctgttgcccaagctggagtgcagcggcacgatctcagctcactgcaacctctgactcccaggttcaagcgattctcccacctcagccttcccagtagctgagactacaggcacacaccaccacacctggctaatttttgtatttttagtagagacagggttccgccatgttggccaggctggtctcgaactcctgacctcagctgatccatctgcctcggtctcccaaattgctgggattacaggtgtgagccatcgcgcccggcctgttgaatgtatttttgagagagtaatagaacatggaatttcagctggataaggaatgaagtgagaccacaagggggcagggggacattaaattggcggtagggctcatatgatgttggggatcatcaagaaacgattacattggatacagtatcccagttaccaccaatgctttaatgacacacaatcatcataatgtcaatactaaatattggtctggccaaaattataactatattgggaggcccgaaggccaggaggaagaagaatgggaacaaggggaggtaggagtgaagagagggggtgataaatataaatctttaccttttgaatgaagattcaacagataatatctcaaactgaaccatcaacaagcagcaatataaacaagatattttgacattcagataaatactgaaatatcaactaaaagattgaaattgccagccgggcatggtggctcatgcttgtaatctcagcactttgggaggccgaggtgggcagatcacctgaggtcaggaattcgagaccaacctggccaacatggtgaaaccccatctctactaaaaatacaaaaatcagccaggcatggtggcaggcgcctgtaatcccaactactcgggaggttgaggcaggagaatggcttgagcccgggaggtagaggttgcagtgagctgagattgtgccactgcactccagcctgggcaactgagactctgtctcaaaaaaaaaaaaaaaaaacagattgaaattgcttctgaggaaaaagaagtggaaatcagacaggtatatgctcgttatttatttatttatttatttattttgggacaggagtctcactctgtcgcccaggctggagtgcagtggcataatctccactcactgcaacctccgcctcctgggttcaagtgattctcctgcctcagcctcccaagtagttgggactacaggcatgtgccaccatgcctggctaattttttgtatttttagtagagacggggtttcaccatgttacccaggatggtcttgatctcctgacctcatgatccacctacttcggcctcccaaagtgccgggattacaggcgtgagccaccacgcatggccggatatgctgtttttttaaacaagccttacggaaccctttgactcattatactatgcacatataactgattaaaaaataaaaactaaaaaaaaatgctgaattgtttgaaaagcgaataatcatgcaacctctaattaggtattgttattcaccatccaagactagtttgattcataagagcaatctaaaatacttacaaactcttgtttcctatcccaggaaggatgccatcctgttaactgatgcttttgacttcaccgatcagtgtttaaattcagcacttggctgttatgatggaaacgtctacgaacgcctgttccagtgggctcagaagtcaccaaccaatactcaggtagttgagtggaacacattataaattatgtaagaaagcagagaacaggcagtgaatacaccttcatgttctcccattttaattgattcccgttaggttggcaatcacttggcgtagcacgtctgtttaaaatattcttagagaacacataaaagaaacaaggagtggcagtatggcctggcaggaactctgagcctggattgtaatcagcaaaatgcactgctcggaacttagtaaagggaattaagaggaaggcccaagctctaaatcatggcttgacagacccaagtgcatacacacagagtggtaaactggcttttaagtaacaaaaagaaggagataaatcactgcggtaattgaaccaccttattttcagccttttaactttcagttttgtgtagataaaagtaggtattcagaagtggtaggaagcttgagggatgtctctcttagacctgattgcctgctagagatgataccctctcctcttcactctaaggaatacaatccaaggagcaaagaaagctgctgcactgccattagtagcccaggaaagccatatgagtgacaattaaaagggtcatgccaaaaaaatccccagccatcctaggagagcacaccagaactctacatcattaacagcgagaagacggggaggactcataaggtcccaacactcaagggccagggtatgctcgcagctctatgcttatgagcctctttgggaaaagttgtaaatgtcaatgaatatgttaacaggagtgaggtaataaaccctgtagttagaatatgaggaaccaatatttaatagcagattttacatagatgatcaaaacaaaaagtctataggtacaaaacagattattttaaattttatagtgcaaatacatgattcaggtggtgaagctttcttttttacctctttggtccaatttcagaaaaggtgtcttaacaccacatcaaattggcaactctcaggctttcattcacacccagcatggtgttagacttgctcttaacaatttgcagcctgtcataccacatggcttaatttaacatgattatctaaagttacaacacaactaacccatcttggtcactccctgtccccagaaagacatccttttaactcaaggaaatataaacaatatatgttcactgctttagtacagttaacctacttccagtgtgttactttttctaatgattagatctaacatttcaatcttggcataaaaatacagcagtcctcccactccagactagcttccatggtctaaagataaatgtgtgccctttggtgctccacagaaaaacccgccctgctataacacctgtcagaaatgctgacatatatagcccaaacctgttatactggcaacacaggaaacattctggtttctctagagagaatggagggggctttcttgtgttttagttggttttaatatttattttaaaagactttaatctggatactacatgagaacatgtttatctaaacgagaggaatgactgacccagagggtcaacacatttgggaaaacattgatgcacttcatcccattcacttctatctccttccacttgactgtgaacaacgaaggagtcttcaccttcccaactccaagatctatcacagagtagacactccacgtctatggaataaatgaacatggttttacaacctgcatagtgagacaaaggaatctgctgcatacacagtgccacacactcttgtcatcctagcttatattaccttcctaaaaaggtgacaggtatagcattgtggatctttcacgcatgataatttgggaatgtgaagttacaaatgaccttagtgaactgtttccagtcagttaaaatgacatgaggctgcctgctaatgtacatgatcttacatttctggctccttttagagatcaccaaaatagcacttttaaagtgtattttttaatgtgctgtggataattttttaaccctactcttaagatataatgctataattttgaagctgcaataagagacattttcctcatttgcactaatagaaaaaggcacactacagatattttatgtatttttatttattattatttttgagacagagtctcgctctgtcgcccaggctgaaatgcagtggcacaaccgcggctcactgcaaccctctgcctcccaggttcaagcaattctcctgcctcccaagtagctgggattacaggcacaagccaccaaacccagctaatttttgtattttgtattagtagagatggggtttcaccatgttggccaggctggtctccaaactcctaacctcaaatgatccgcctgcctcagcctcccaaagtgctgggattataggtgtgagccaccatgcctggcagatattttaaataaaacagcagctatgttgaaacacaccctgtagacataaaagtacagacaggaatatatttcactgacatttttctaccaaaagaaaagtgctatgctaaggtaaacatcttagaatcataggagaagctctcttctgtctggggcagcgttgagctttattcctggacaggatgatgtgctttccttggtttaagggaagaatcattggggataatttcaaaacaaaaatcctgtttttccccaattattctattgtaaaaatgtgtccaagtaggagttagatgcattaaatacatctactgattcattcattcaacaattcaacaaatatttactaagtacatgctttgtgccaaaaactattactagatactgaagatacactggagaacaagannnnnnnnnnnnnnnnnnnngagtttgagaccaacctggccaacatggcaaaactccgtctctattaaaaatacaaaaattagccaggtgtggtggtgcacccctgtaatccaaggtactcgggaggctgaggcacaagaatcgcttgaacccaggaggcggaagttgcagtgagccaaaatcgcaccactgcactccagcctgggcaacagagcaatactgtctccaaaaaaaaacagtcaaaagcccagtgttcgaggagcttacagttttagtgtagacaggcacacacacacacacaaagtaaatattataaaagatgagactagaactaagaaacaaagaatcaagacactgaattacagcataatgaggataacctagtcggacctagaatactgcttatatgatccctatctggttccttgctttgtgattaatgttcagtttcagagagcctcaaagagtcaagccttttatttgtatgaaattccaaaagcaagtgataagctgtgtttttaattggccacctgcatccacaatttaaaatctgcatgagaaaaggaaggatgccctttggaaaaaatgtttctccatatgttcacacaaaatgagtcttagaaataatttttaaaattaagaatcttacgtaatgttactttttgaagctagagacttaatttgaaagtgaaagtcattaatcctggcagaaatgtactgtgttaataatgcgtttctttctacaaacaggagaaccctgcctatgaggaatatataagaccacttttacaaagttggagatccaagctatgaaataaccaacagtattcaagaagcaaccagcaccatcatgtgataatggtactatggcatatatgcaacattaaaattttaaattagatatttatgttttagagtcattatcttttagatacagtctgaagtgatatatgtgaaataatatctgtgatttacttcaaaataatccataggagaaaaaagccaaagtgaacagttgttgaagctggtcaatgggcaggtacatgagtgttcattacactatcctctctacttctgaatgtgtttgcaatttccagtagggcgtggtggatcatgcctgtaatcccaacacattaggaggtcaagatgagaggatcacttgagcctagaagttcgagaccagcctgagcaacatagagagatgccatctctacaaaaataactatctcacgcctgtaataccagcactttgggaggccgaggcaggtggatcacgaggtcaggagatcgagaccatcctcgctaacacggtgaaaccccgtctctactaaaaatacaaaaaaagtagccaggcgtagtggtgggcgcctgtagtcccagctacttgggaggctgaagaaggagaatggtgtgaacccgggaggcggaggatgcagtgagccgagatcgcgccactgcactccaacctgggtgacagagcgagagtccgcctcaaaaaaaaaaaaaaaaaaaaaactggccaggcatgggggtacatgcctgtggtcccagctatagggaggctgattgcctgagcccaggaggttgaggctgcagtgagccgtgatcacatcactgcattccagcctgagcaacagagtaagaacctatctcgaaaaagaaaaagaaagaaatttcccacagtaaaaaaaccgtaccactgtccatttatagcatctatttggttaaatacaaggattttgctgtagatctagcaaaagccaataggctcattagttagtgtgtttttcgcacacatttatccttgggtttaaaaggacacacatacatgcacacacacaatcctcctaagtgcgtatacttgctgtaatctaaataaaatacagctctaagaatgcaactatcattttttaaaaatcaactcttccacagtgatgatttaaaatttcattaaaagacataactgtctcaagttacccaaataaaatgaagctacatttttcatatcattttcaattgcccaattagacaaaacactctaaatgtcactagacaagtaaaatggcaaaaaaaaaaaaaaaaaaaaaaattcagctggctacttttcctaatttactcatataaacaatcatttcattgttaataatcagtaaatttgagaaaatttaccaaaagcaaacttatctccagtaaacaggacaaggaagaggcctcataagtttttaacttttaaaaacttgggatgggcgcagtggctcatacctgtaaacccagcacttcgggaggccagggcaggtggatcacctgaggtcaggagttcaaaaccagcatggtcaacatggtgaaaccctatctgtactaaaaatacaaaaattagccgggcatggtggcgcacacctgtaatcccagctactcaggaggctgaagcaggagaatcacctgaacctgggaggcacgggttgcagtgagccaagatcgcgccactacactccagcctgggtgacaagagtgagactctgtctcaaaaataaataaataaaaatcatttaaaaataaaataaaaataaaaactggaaactagtattattcctatttccccacttgttttcaacccaaatcattttatttcatattgacctcagctagctcaacaacacgtaactggttgggccttttttttttttaaggtaactatcaaatcaattttaaatacaagataattttccaaaatgataaccttgtactcgtatattgatttactgaaaccacagcaacctgtcaataacatcaaaggatcttagtttgaagatggtgaaaatagggtaattacaggtttctggatgtgggtcatttgtcacattttaaaataaattttcagagacgtgggcaaaaatagacat

SEQ ID NO: 12249 - DNA, 77997 bp, Human
  misc_feature (1)...(77997): n = A,T,C or G
ggaccccagtcctacataaaaaattggattctaccaacgaactgaatgagcctgagaacagattccttcccagaacctccaaataagagcccagccggcaggctgtttgattttggcctcgtgagagagacccacagcggagaaaccagcagagccaatggggattcctaacctacagaactgagacaatcaattttttgtactgaccaatgaatttgcagtaatttgttacagtggcaatacgaaacacatgctgctgaataaagtttcaggtaagagtggctgaggctgaagtgtcaaggtcacgggcagtaaaaataaatgccagagatttaacgaacgctgaggactagtaggttcccatccatccagtctctatgctctttcacagttatttgtctcagcataaatagctctctttatgttggggaaaaggcttatggcatgcctgtataaactggccataaaaatatgagacaataagttgtggaaagccacaagaggcctctgaggaggaaagccttcttattgtcatgatgttcccatgctctgggcgagacctactgtcttacctataaacactgtgttcaaggagaaagacactcctttgaatcactacaatgtggtcagacatgcaggctcctagttaagcacgctcccactggttattctccgacaagttaaagataacgctgtttgagcacaaaggagattcatttaaaccgccactgctatagatgacatgtatgatgcactgtctccctttcaccctttcgccccgaacgtccgcttcttagatctaagtgattgtactcaatagtgtggagaccagagctcccaggctttggcagcctccattttgcaattggccccctggcccccaatctttatgcactcttaacctgtctcgtctcattccttcgtcgccaccggactttgagtaccctacgggtggtgttgaggctggtccccaacacttttacacctacagctttacctgctaaactcctaggtattacgcaatatccagctagtccttcactgtctctttgaagccttccagacaccaccccaatcaattatcccatcttctgtactaaggacacacatttctatgcgcccactcaaaaaactatgaaacacctaacaacctccctaggacatcgcagaggaactagtacccttaggactttttcattgacccgaggttctatgaatgcttttttatctaatcatatccgtccactatcaaaacactcttaccttgcacgactatttccctcctgggagttgtaagggggcaatgtgggctagttttcgggatgacggttctgagaaccacgtcgagctcacgctgcgcctctggctgcgatcccgccccggagctggtgaggaaggccagcaactccgaattgccacgggcgagactttgggagaaatcctcccaaagcgaatccagatctgcggcggggaagtcgccctcccttccttcagcatggccggggtgcccggagtccctcaggggcactgaggcggcttccctctgtgcctcctcttgctggcactggccctgggcctcctcaagttcgcaacatgccgtgccctgctcgggtcctgatagcgacctgggacccgggccccctccgggggaaccctggccgggtcccggaccccgctccttctgctccgagcctgcgctagtcccggggccgcgggcctccgcgcagggcagggcggcgctccagcgggcctccaggcgggcgccgcaaagccgtttgtttgccacctgcggcctctccagccacacttcgaccgcagcccagaagccctgtgggagaagcgcgcctgggtagctgatcccggtacggcccacctcagccatggcagccagcaggtgtacagccctggcagcggcgcgccgagatgacgcagcccggtggcgcggcgcgttgacgtcatggaggcggggtgctgggaccggaaatgagaatggcgccgctggagatcctttcctgcttttggtttccctggcaggggttgaactgtggagtgtgtgggtgaggaatttgacctgtgttttattcccttttgagagaattctgggcgtggtatagttacagaatcaaacatcagccagccagcgggtgtggaacgcattgtcctcagtactgattaccgataaaagtcagggagcctaagtttgtgaacgtaaaagatgagtcctcttatgaaagctaacttttctccacttgggttctggtttgcttttagtgctggcattacagccagtgccttcctaagtctgagtgcagccatggctgtttcataagaatgatgtaacgttgtcccatgagggatgaaagtcatctgtcacctactgtagcaggacaagccacagacaaaactcctcagacaccggattaaagaaggaagaggtttattcggccgggagcatcggcagacttgcgtcttaagagctgagctccccaaaaaagaaattcttggcctgtttaaaggcttacgactttaaggggtccacgtgaaagggtcgtgataaattgagcaagcatgggaaacgtgactgggggctacatgaatcagctaacagaacagaaagttttgcaatgcttttttcatacaatgtctggaatttacagataacacaagtagtttaggtcgggggttgatgttattattattattttttttaactcctagggccacgtggtggtgccaaggttgtctggctatttatctgacttttgtttctttctaactttttgctttctctcttttcctcctgtcttatgaactaggcaaggtggcagggaggagggcagcaggagtagtagtggtctccttatcccttcctttgagaattttcacaaattagtgggagttctcgcttttatttttactttgagtctctttgggagacagagtgatagtgttttatgtaatacacttgcagtgagggttttaaattctcttatagctggaaactatcttttaaataaagacctaggatcaaacctgtgttaaaccagtacaggcacatgtgccaactttgtcatgtcctaagcaggttagtttttttactgggtcttaaaagcttttttcctagcaagcaacacagtatttcttaataataggagtttttaagagccaaatgcttgaacttggcatctgcttggggaaagagttaaagtaatcttgaggcattaaatcttttgcttctcaaggccattggtctctcatgttagcctttttataaacataacatgaagaaacgtctaggctgctggcaatgttttcagccagctgagcaaataggttgtttgtttgttttgctaaaggaggaggctcttgtaacttctggtttatgtgtttaaagaatgacttaaagactcggaattgttgctgggctggacgggtctgggtttcctgactaagtagtatgtgtacaatggggacaccttatataggtgtttcttctagcatggttatggggggtaacaataacaaaacaatatacagcatatttgtatccagcaaggacaaaagaggtccttacctgggaaaaagattgaatacagtgacagaacaataggaaaacagtattacaggaaaactattagtcttaagatttttaactacgtttacttgcttgacaagtcctcaagcttcggccatgcgtagactattcagctgccagtgcgtgactagagccgggcttgttgtttcttcaagcttcagccgtgtgtagactggtcagcctccggagtgaccagagcagggctgtcgtcctcagcaacagcttggtctcgtctccgaatcagccgggtaggaagatctgtgtcctgctggctggtctacttgtcctgagctgccagtgttagctgactgtgatggatctaagacacaacacctgcaacttttaacagcagtgggagtggaaaagattacagtataaggcccatcctatatgggtcctagaaaaattagattttactttttaacttaaacagagtcactagatttaaaggggtgtcaggcttataggcatttttatgtatttaattataaacactttgtatggctatttctaaaatctgcatttgctttcttaaggttaattcctttagttcttggaggtcacctttaatttgacctgtgatttgggggtggccgaccgaacaaaatcttatagggtaaatacctagtttgtttggtgagggtgcagctgacttgaaggaggaccataggcaaaagcctgattttatcttaaatgaatttcctggcaatatttttttcagtagctgctcgagtgtccagttcatgcactccactttttcttgaactttgcagccaataggctgtgtgtaacttccattttatttttaacagtcttgttaaatcctgccctatttcagctacaaatgctggcctattgtctgactttaaagttagaggcagtctaaacctggggataatgtcttttaacaatactttagtcacttcttgtactttttctgtcctggtggggaaaactttaacttaccctggaaaggtgcaaacaagcactagcatgtaccgatagcctccagcatgaggcagttctgtaaagtctataagcaagttttcacaaggtatggctctttctcctgtttaagtttcttagaggaggggttctttttctttcccccctttgtaactctatctagtggcttagccatcagtgagaaattggaatccagatatggcagaatcctgctgcttttaacttctaatgtgacaatgggctcctgggagcctaataagaaggtgcctagtctgccctagtctttacattctttagctcctgccagcctgatcagatcagtatttggttcctccaaggtgcggcagcccttggccaatggcctctttgtcttgcagccttggccatttcttttattgccttctgaacattcacccttctagtgtcctttcttttttcatctcacacattaatgtctctctagccttggccggctctcgaatccttgcctaacttgacttcttccacgtctacatccgtgtccacgtcctctcgcattgctaatctctctttttataagagctgttgctaacagattggcctttttccttaagtctttgtttttctttttccttcctgagttctcctgcttctatggccacctggcggggccaggcagtggcacaggccctgcccccgcgcactgctgtctctcccattttcttctgattctcttttttacacttactgtgagtctttctttttgttttgctcttctcttggcaccggtctctagcctcctctttttttctagatagagctgagccggggagaggaatttaacccttggcgtgcctagctgccgcacttgttgcttttgctctttcctgttttgttccttggtcacagctaacatacgccttggtggccacttttatagactgggtgatattcatgcctgtagcttctgcttgatgttaccctgggcttgctttacaaacgaagtattcactatatatatatttatatatatatttacatatattttttttacatatatatgtaaatatatatatttacgtgtatatatttctatatatttacatatatttgtatatatatatttatatatattttttcgaatatatatatatgctgattttttttttttttttgagatggagtctcgctctgttgccaaggctggagtgcagtggtgtgatctcggctcactgcaaactccacctcccaggttcacacaattctcctgcctcagcctcccgagtagctgggactacagctacccgccaccacgcccagctaatttttttgtgtttttttttttttagtagagacagggtttcaccatgttagccaggatggtctcgatctcctgacctcttgatctgcccacctcggccttccaaagggctgggattataggcgtgagccaccagcctcagggttaaataggatgtaaagccagaatgctttacagagtctcttataaaactgacttaggctcttgtcagctccttgaagcacttctgaaatcttttttatattaattgctttttttctactacctcttagcctctgcagaagtgcctcttagtactgctgcaaatgctgaagctgagttgcattctctgggtcttttttcccctttttcctagatcttaacaggcccttttttaaatataattctccatgcagttggagggttaaacaggcatactgagagtcagtgtaaatgtttagtcttaccttcactgagttctaaggcctgaattaaagcaatgagctcagcttaacgacagtgtccagggttatcactgcatatcctgcacatctctctccttgtgggttgatgaagctgctcccgtccatgtatagctcccagtctactgatgcccaaggctggtctcggaggtcaggtctgctagagtaaacttgagtccaacacctctacacagttaatgctcgacagggctctagctgctgggaacaaggtggcgggttcagggtgtttccagtttagtagatcaatggttaaaaagggctgatagatgaaagtctgttgccccaccccctggatgtgggcttggtcattataatagacaggtcctcgtgtctccctgagaggcatttgcatagctccagcaagaccagatctgagagggcccacttgactatcttgacttccttccttggcctcttgaggctccgatcttccccttcaaggtgagacctggggcgtgttagctccttaatctcgtttctcagggggctgttggcctcggtaaaggggggtaggctgggccatatggagaaagaatttctgttatctctggcggctcctgcaaaactggcttctcttgctctttctgggactccccttttcaactctgtgtctgctggtgcagctgttcttactttcacttttggcttttttgcaataagctgttaaacagggctaaatttatgctggtttttgtctatattatatttaaccatgaatcaatataaaggaattgatctaggtccactggctgtcctccaacccctgtcaccaccttaaatacatggccaattgttccctgtctgtagttccttcggtgggccatccaacaccaaaagagggcaattcttttttttttttcttttttttgagacggagtctcgctctgttgcccaggctggagtgcagtggcacaatctccactcactgcaagctccgcctgccaggttcatgcaattctcctgcctcagcctcttgagtagctgggactacaggtgcccgccagcacgcctggctaattttttgtttttgtatttttagtagagatggggtttcaccatattagtcaggatggtctcaatctcctgacctcgtgatctgcccgcctcggcctcccaaagtgctgggattataggcgtgagccaccgcgcccagcaaaagagggcaattctaattcacatagagttcttaacctctgggggcttaacctctgtaatcccctgcaaaacctttcttaaggttctgtaacatgcattttaatagagtaagttttgatgattagatgactttccttttatttttcttcttgaaatttttttttaacacagtttctagcggagtgggcttactttgtgtttgacctatttttctcttgagacaaaacaacattcacactacaagaaggaaagggtaaaaggttactcactcgtctaattcacactaaaggaaaatcaaaactaaaaccaaagtgtcattaaaggcacacctgtttgtcaaggaatttaagccaagtcaaaatcagaaccaaagccaaagtgccaataaaggcacgcctgtttatcaagtaattcaagtcaagtcaaaaacaaaaaccaaagtatcaagcatttcaagtcaagtcaaaaacaaaaaccaaagtgccggtacaggcacgccatgggtgatcaggccacgcttccactcaaatggagtgtgcaagttccaaagaccagtcttaccaagtttcaaatgtccagacttaaagtgctagttccttcccagtgttcagccactgcgttgatcctccacgggggcttgccatgcaccgctctgacgaggcattccacgggggcaaatgcctacccgggagcactctcaggatctgcatcgcgcaagctggctggagccccccacagggatgctctacagggcaggcataagctgcctaaggggctggcttgaacgtcccttaatcacctcgcttctcagtcagggaaccaagaaatgtagcaggacgagctgcagacaaaactcctcagacaccggattaaagaagaaagaggtttattcggccggaagcactggcagacttgtggcttaagagcggagccccccgaaaaagaaattcttggcctgtttaaaggcttacaactttaaggggtccatgtgaaagggtcgtgataaatcgagcaagtgtgggaaacgtgactgggggctacatggatcagctaacagaacagaaagttttgcaatgctttttcatacaatgtctggaatttaaagataacacaagtagtttaggtcaggggttgatgttattattattattattattattttaactcctagggccacgtggtggtgccaaggttgtctggctatttatcttacttttgtttctttctaactttttgctttctctctttcctcctgtcttatgaactaggcaagtttgggggtaggagggcagcagtagtagtggtctccttccttactacatgtccccaggaggaacagagaaggttggatactgccaatttagcccaacattatcagcagctggtctgcagaatctctagtaaaatccaaaaacctccaatattcttaattacttttgtacattaatccctccattgggattttgccattccctaaaggatctctgtcggagtaagaaaagtgaaaactaactcaaatcatgtgatttattagagataaaagcacagaccaaatgttggtagaattaagtaaaaggcaaatgagacgtatcctcccagacacactggctcaccctagcccattcagtgtttgatcacatacagtaattgatttttatgctatcttagttttccagggcttccataacaaattaccgtaagtttggtggcttaaaacaacacgcatttattctctcatagttctaaaggctctgagaatccattcatctctcctagtttgtagtggttgccagcaatcattggcattccttgacctgtgcctccagcacttcaatctctgcctccgtggttacgtggtgttcttgtttctccagatctcttttcttcttctaataagggcaacattcatattggattagggccaaccctaatccagtataatctcatagtgaataactgctgaatgaaacagtcactgagattagggagcgtgtcaggagaatggtgcagatggcagaactatctcagactgtttccctttggggaagcaggccccagccagaggctgctgggtccagggagcagggagaaagctggagatatccaggcttaggtcaaggatctgacccactgcctggggctggaaatagtgtctacatagcactgtcctgtaggactttctgtgataatggcaatgttctatgtctgcactgtccaataccgtagttacttttggctactgacccacacttgagtgcagctagtgcaactagggaactgatttaaattagatttatgggaaattgaatgtatttaactgctgcacatttaagtagccacatgaggctaggggctactgttgaacaatgcagcactagagacactcacctgggacccttaaagcccctccattctgagttgtcagcgtctaagtgctggaagctgggtggaactcgagaagcagcagtggaggctccaaccggaagtccctggctgctctgagcgccctgagtggcagccctgttgtgctgatcagaatgatggctccagccacttcacagcagcccccattaccttccagggcctcagccagaaactcatctgatgccaagaccttaacagcatagaaacccgttaaattcaatatgttgggtttataattaaaaaaaaaaatcaggccgggcgcggtggctcacgcctgtaatcccagcacattgggaggccgaggtgggtggatcacaaggtcaggagatcgagactatcctggctaacacagtgaaaacctgtctctactaaaaatacaaaaaattagccgggcgtggtggtgggcgcctgtagtcccagctactcgggaggctaaggcaggagaatggcttgaacccgggaggcagagcttgcagtgagccgagatggcaccactgcactccagtctgggcaacagagcgagactccatctcgaaaaaaaaaattcattggctcaagccagtaacatttgccatagggacagccatttgtttgtgcatcttgtacaaaaccacatttatgttccacaactctttcccaacaccgttttcagctgcctaccacttaatgtgatgtgactaggggaagtgaggtggctgctgggtggtggtgacgactgtggctgagctgtgatggatcattcttggtgccgaatcatcagaacccattcccttcccaaggacctggtgacttcttccagccactcttctgggaatgcagaaccagccaaggaggtggtggtgggaaagacagaagggataaatggagacaaatgaccggagggtgggaggcaactttagctttaacaatgtgtgcacataacaacaatggccaatgacagtcaatagcaccaaggtctaaaactgagcagggaatcggtgtgccgaagggagcagaagtgggacagaagtcaagataaacaagagagggggtgggtgaggccctatggcagtgctcccgtgggtcattgtccactgagttactgatgacactcaccccacccctactgttcacactaggggtccacgtgcagctcctggtggtttcacccagaaatagctaacaaacatgtataaagccaaattcccttatttttttccccaaatttgctcccttggtgtcagtcccagtggcatctccatccacccaggtcccaaatacaacagagtgtagcacgaccccttcctctcttcctacctccccaccaccctgactcacagagaggcccgtgttccctgtcagatgcaggtcagcagtgtcctcaggcccaggaggggagcacggtggatggagagtgctacagcgtgagcaggcaaatgccagaaggtggccccgaggtgaagccacggtcaaagctgagaactacagtctgacctgcagatgccaatctgggaaactaaatggagagagtgaagtcagggggccaaaacttgctacaggccagccctgacaagccagagggtagaggaagacaagtgtgaaaagaggagggtgaaaagggacaggcagagaagggaggggagcctgaggacctggccaaggctggaaacctgtgctttgttttctccatgtcattttgtgatgatgccctaacttaaatagaaccaacaataaaaagccactcagctccctctccaccctccagctccaccaagatggccttatctcaggcccttgtcttttacctgtactggccaccagatgccctgagctcttcccctttagcctgccttccaatgtctacctagaaatggcttccctctccctctcactcctgcaatggacccaaatcatttcccagtgggaagatatttttatttttattttttgagatggagtttcactcttgtcacccaggctggagtgcaatggtgctaccttggctcactgcaacctctacctcctgcgttcaggcgattctcttgcctcagcctcccaagtagctgggattacaggcgcccgccaccatgcccagctaatttttgtatttttagtagagatggggtttcaccatgttggccaggctggtctcaaactcctgacctcaagtgatctgcccacctcgacctcccaaagtgctaagattataggtgtgagccaccacacccagccgaaagatgtttttctaatgtcagtaacacatgtgaacccaattgattagtagttgtaattttggcagaaattgtgacctaaaggaggtgtgagttctgcaataaatggttattttattactctcaacagtatctccaaacatttgaaaaacagtggtgtgtattttttattagaccatgattgctttgtcttcaggcaatccttgttgctcctggggattcagggacctttgcaaaaacacaatagacccctggctgggaaggctagtctagactaaggatcacttccgactgcttagcagggtacctgccaggcccgaaatgatctttcagtcccttccttctgcttttgcaatcggacgctcccactgatacccataattatatgtctgtttaaataacagtaataactgtgaagaaaaatgttgccatggaatcaaggagaaggtatttcagagtagaacagaagtagacagaatttccaaacatgacctgagtatccccacccagatgtcctaccaacatcttaaacttgatacacatttaaaattgtacttctctttctcctccccataactgagctgcactgcccatcttttagttccctataaatgcaaacctttggatttagttttccttgtgcttttttcacttttttttttttaatgcagagtctcactatgttgcccaggctagactcaaactcctgggctcaagtgattctcccgcctcagcctcacgagtagttgggactgcagatgagagaaccatggcgcacaacgcctggctcttccttgttctttacatggcaaattgctaagtctagttgattctgttgtaatgcccaaccttgtttttactaaccctgtttttagactctcccttttcctttaatcacctagccttgtttccacctgaattaactctcccttcgctaagagagccagacagactccatcttcgctctttcactggcagccccttcctcaaggacttaacttgtgcaagctgactcccagcacatccaagaatacaattaactgataagatactgtggcgagcaatatccgcaattcccaggaattcgtctgattgataacgcccaaagccccgcgtctatcaccttgtaatagtcttaaagcccctgcacctggaactgtttactttcctgtaaccatttatccttttaacttttttgcctactttatttctgtaaaattgttttaactagactcccctcccctttctaaaccaaagtataaaagaaaatctagtcccttcttcggggccgagagaactttaagcgttagctgtctcttggccgctggctaaataaatgcactcttaattcgtctcaaagagtggcgttttctctaactcgctcaggtacaacactgtctctgtaaatttcataagaagtgtgtgtgtcttagtttggatctccccaaacagaccttgagacgaggctttgggtgcaggtaattgaaaatggagctgatctcggagtgcacgagtgaggaagtggaaagtgtgagacaaagaaaaacaagtaaagggtgggtgattgagctggttgctgctctggtcaatgagggcccacttccactaggggctctctgagaaactctgcagaaccacggttctcaaacttcagcaagctcttgggcatgccgggtcttactatgttgcccaggctggtctcaaactcctggcctcaagcgatcctcctgcctcggcctccgaaagcgctgggattacaggcatgagccaccacctagagcctgctgattaatttgaaaatgcccggccccagactgggggtcctgatccagtagccttggagtgggccccaagaagggccgcggtgtgaactgcatctcagaactacggcgctccgagagggcagcgactcgccagagtcggtcagccaggccttgcctaaaagcagagaaggcaagagtgcccgggagcgcctggcgaagcttcgtggcttccagcccgcccgggtggcagcggcgtccgcgtttccagggcaacgagggtggcgcggttcgatgacgtcagggcgcccgcggctccgccccgcccatgggacggacggaggccgagaggcgtggcgggggagcagtggggccaggccagagacagctgcgctgtgcgggcagctagtcccagtactccgagtcggtcgcgggccgacaggcatcccctgagcgcctgctgggtgagttggacggtgcagagcagcgaggaccggggagcccgaaggtggaggctgcgttagcgccaggggcgcggacgcgacggggcgggagcgggggcactgaaagtgccaggcccgggggtgtgggggctgtgcggattcgcgggcgggggggccagggttacccagagcaggggccaggagggccggtggcccacgtgctgggcattcggaggactttacacattgaactaggcagctgttcacgaaagggaagtgatccacatcgcagagaagactggaggcagctgttgccagaatagtgatcttgaagccccacttccttgccagaaactgctccaagcgtctcatgtgaatgacagaagcctagacggtagaccctgggcactaggcaggcgtcactgtatttggatgacagtagcctcagacagtagaccctgggcactaggcagacatcaccatatttggaatgcagcagcctagacagtagaccctgggcactagccaggtgtcgccgtatttggaatgcagcagcccagacagtagaccttgtctagacactgggccctagcaaggcattgttactggccggtctttgctcccagggtggtggcaggccggtcccaatggcagcaaggctcttgctctctgacctggggttcttggcctcatggattccaaggaatggaaccttgggccatgcggtgagtgttatagctctattagaagctgtgggtcacggaagagaactgtggaacccagcgactagtgttcacctcaattaggatgaacccaggcacttagctgtgcaggaacaatggcgagtctctagcccgggagcagcaaccggtgcctcgctggatcagaagcgcagtggacaccctgctggatctggaggggggtggaagtcagcggggcgtctgcgacagcagccatcagcagtggtggatggcaagcaaaagctcagctcaaaccggaacaaacatggaccagaaaagtgtgcagttgcaagatttaatatcgtgaaaacagagctcccatgcaacgggaggggacccaaagagggttgcccgattcggcttgaatgcctgggtttatatcctgatcattgtccctccccctgtgctctcaggcgacagatgatctgattatttctttaccacctgtttttagcctcattggtattttagtgagctctctttactacctgattggtctggtgtgagctgagttacaagccccatgtttaaaggtgggtgtggtcaccttccccagctaggcttaggaattcttagtcggcctaggaagtccagctagtcctgtctcttagtaccccctctcaacaggaaaacccaagtgctgttggggaggttggccgatgaccgctgtaactgcttcctgctgaattggggcgtagtagaggtcatgcagttgagatttcctcgggagtggtgccttcgatgtcatcaacattggagcatgggctagcaggccagtccaggggtccacggtagatcttagtcatggactgcatctggggctccatttgaagaacatttgtagtttcacagctttgattctggaagagacaaacttaacaaggaggttaaagatacagggattgaaatgtgtggcccgaagtgcaggggcatatgggtgtggatggtgaaagtggggtttcctttagaaaaactcctatacaatggggcatcaatatttctgggaagccgcattctccatagaagctcttggtaaggggagctactggtagtatagcggcatggagggggtgaggtgatagtgaaaggggggtaagacaacagtaaagagaaaaatatgacggggggggccatggagctctacgattccagttactttcctcgcagttgtcgcttgaagagcaggtgcagatcctctagaggttcacaggaatagctagcgttgtctcctgaatttttgggttcctttggcggtatccagggtttgatgtgtctaagactccactccagacactttaactgcactcagggtagataaaatgactgggtagggtccttcccagtatgtatctaggggtggggacttagagggaagggacttgactaataccatgttaccagggtggaattcctttccctcctctcgggtacaggttccctgtaatgttttaagaacttgttgatatttggctaaggaggtgatgtctgcaactaaattggccgtctctcggtcaagcacaaggtcattggttaggaagggctgtccatacagcatttcgtatgggctaagtcctgctttttggggggagttttgtattcttaataaggctatgggcaacagagcaggccatgcgaggtgggtttcctgagttagcttttttagatgttgtttgagtgtttcgttcattttctcgaccttccctgaggattgtggcctccaggcgcagtgtaagtgatattgtatgcctaagtaacgtctgcgatactcgctgggttactgcagccttgaaagcggggccattgtcactctgtaagtctcagggaagtccgaatctgggaattatttcatgaattagtgcctttattacgtcttcggccttttctgtcctacaaggaaaggcctcctcccaaccagtgaaagtatctatccagactagtagatactgaaatccctgagatttgggcatgtgggtaaaatctagttgccagtcttctcctgggtaatggcctgttctttgttctcctgaaggagcttggcgataaggcaggggattatttctttgccacacttcataggccctgactatctgcttgatagttttgaaaagtcctgatccagttaataatgatttggccgtctgataggtgctatcaatgcctaagtgaaaggtctgatgaagggttttaagtaatttcaattggttagctgcaggcaaaagtatttttccttcttcggtggctagccatcctgaggggaagaaactatgtcctcgtgaggttccccatcctatttcttttgagtactggggcttggtttcctacaggggattaccccatactaggggtccttctataagcatttctaatggagggtcccaccttgcggctcttttggcttcagtatctgcttcgcggttcccttctatttccctttcctttcctttctgatcaccccggcagtgtaagactgccacctctttaggtttctgtacagccaattgtaatctcctaatggcttcctgagatttgataggtgttccctcggaagttaggaattccctttctctccatattgctgcatgggcatggaggactaggtaagcattcttagagtctgtgtatatatttaccctttttccttctcctaattttagtgcctgagtgagggctattagttctgccagctgagcgctagttcctggagtgaggggattactttcaagtattccattatcactgaccactgcataccctgcttttcgaagtcgtttttctacaaaggaacttccgtcagtatacaagttgaggtcgggatcagtcaaggaaacctctagaaggtcccctcgagcggcgtaggtttgagcaatcacctgttgacagttatgttttatcttttcttcattgtctggaagaaatgtggctggattaagagttgcacgagtgcgcagtcgcagcactggcccttcaagtaatagagcctgatatttaagcaaacggttgtctgacagccgtaagtctcctttagcagtgagtatgccgtccacatcatgagacatccacacagtaagatctcttccctgtatcattttaactgcttcagatactaagactgctactgctgccattacccataaacaatgaggccaaccctttgccactacatcagtttccttactcaggtatgccatgggttgcaacctggtccctcggacctgtgtaaggaatcctagagctattcctgttttttctgtgacacataaagaaaagtcttgcccctttggcaagcttaacactagggcttggattagggccttctttagggcctggaaagccacttctgcttcaggtgtccttcttactaaatgggtattcactttctgagtttccttaattagtgtgtataatggcctggctatttcactgtacctgggaatccatattcggcagaagcctgttatgccaaggaaccctcttaattgctttatggttttgggataaggataagccagtataggctggatgcattcctcactgagggccctggtgtgtctggataattttagccctaagtatttaacctgctgtgagcagagctgagcctttggtctggaaaccttgtagccacaggtggccatgaagtttaagagcacttgggtggcttgatggcacaaggtttctgaatgggtggctaaaagtaaatcatccgcataccgaaggacaagagtgcccaagtatgagaactggctcaagtctcgggctaatgcctggccaaatagatgggggctgtccatgaacccttggggtaaaacagtccaggtgtgttgagacattagattcaaaggatcttcaaaggcaagcaagaattgagagtcaggatgtacagggatgcagtaaaaggcatccttaaggtccaggactgtaaaccactctgcttcctctggtatttgggaaagcagagtgagtataagattaggtacagctgggtatagaggaacaacagcctcattgataatcctgagatcttgcactaacctccactgtccattgggtttctgtactcctaaaattggagtattgcaggggctattgcatggttttactaggccttgggcttttaggtccttaacaatcttttggagtccttgttgggcctcgggtctaagagggtactgcctttggtggggaaaggaggcggaatcctttagtttaacttgaacgggacgggcattcttccctcatccatattgtccttctgttgcccagacttcaggattaattccttcctcaagtaggggacagcaaacggtgttccttctcccatgttcaggtgtataatggcccctgcttttgctagaatgtatctccctaacaagggtgtgggggtttcaggcataattagaaaggcaagtgaaaagaatgaagttccccagtcacaacttagtggctgggagaagtatctagtgactgcctatcctaggacccctcgggtagtgacagatctggaggacggttgtccaggaccagagactaagactgagaaggccatgccagtgttcaggagacagttaaccttctggcccccaatggtcaagcatacctggggcatgggctggcgcttgccccgggcaccctcagtcctgctgctggcttatctggttagtggcttctgactgaaaggaccttcatcccctggggcagtgggccttccagtgattcccttgacatgaggggcatggatgaggggcagcttatttctattcagacaatcttttttaaagtgtccttgtagaccacactggaagcaagccctatcaggcatttgatttgcccagcgtttcccttttccagagcctccaaagtaagatgctctcctcccccaatttctacccagcttacctcccctgctgcgatacaatctccaagccttggctccttggccagggccttagaactgatgacccagtactttaacaactggagctatgcctacaacaacacaatagatcaggatgaaagcgaattgagtaaattaaagggaggtgcatattcctatagtggcaaatgggggcaagaagtgaacttctgcttgcctgagggcccgtttgtcctgttctgcctgctcctcctgatctctattgtgaaaaaaaccgaggttgccaagttcattagagtttctatgttttgctctgggcctaaggtggacttttgaagtttttttcctaatgtttgcattacactgtttaactgacaacaaagtggtattggagtgttatagggtcatagagaagatcttcaattatcaattataggttttaaatttaccctggcttttaaaggaatagggtacactgtttttttcttaactacttatatatctctctctttctttctctctttgactgtctctctctttctctttgactttctgcctttcttcccccctctctctttctttctctctcttctctctctctttcctttctctctctgtttctctttccctctcattctctctcttgatagatggattttgggaacacagcggaagaatgttcgctcgttgcccccatttgcctctataggaatatgcgcctccctttaatttactcaattcgctttcttcctgatctattctgttgtcgtagacacagttccagttgttaaagtactgggtcatcaattctaaggccctggccaaggagtctaggcttagagattgtattgcagtgggggaggtaagctgggtagaaattgggggaggagagcatcttacacaatgggagagcaatcctcctagccatttacaaacttggggccctggcaagggtggtaggtcccacataacttcccatgtcgagagctgtatatctaaattgggagggacaccagggacaagactccctgggttcataccctaggtgcttaaggacacagcgtagagcttccttagatccctttggagatacaacttgctctaatacttgggagaggaagtgagtctgaagcattagtacctaggaggcagggatcagaggaagtagattcagaggtaaggagaattttggggctacactttcaagaaagtcatggttaggacccaggaggtatgggccagaaggagagataggggtgcacgcatgggcaactgttgagtagagacttctggctgcgccataatcttgaccggccaatgccgggaatttgggacgacagctttctgcctctagtcagccctcagcttccccaagaaaactgtaaaagtggaagctggttccaggcagaccaatgctcccaacccaaaagggttggggattgttagaaagccttttcccagaaagcctcacacctgagtcttaagtccggtggccacattaatcatttttaaccagccaacaggtgcccagtattttcctccaattctaaggaagggtaggacagaatagcaagtgaaagtggttcaatattactcaccgctttggagaatccccatacgagcccagcaaatgttaccgatgagtgtttgctcccagagctcccaagatggtggtgggccgcttccaaaatggcagcaaacctcttgctctctgacctggggttcttggcctcacggattccaaggaatggaaccttgggccatgcggtgagtgttatagctctattagaagccgtgggtcatggaagagaactgtggaacccagggactagtgttcagctcaattaggacgaacccaggcacttagccatgcaggaacaatggtgagcctctagcccgattgggagcagcaatgggtgcctcactggatcagaagctcagtggacaccctgctggatccggaggggtggaagtcagtggtgggtctgcgatggcgatgatcagcagtggtggacagcaagtgatagctcagctcgagctggaacaaacatggaccagaagagtgtgcagttgcaagatttaatagagtgaaaacagagctcccattcaacgggggggtacccaaagggcgttgcctgatctggctcgaatgcctgggtttatatcctgatcattgtgcctccccctgtgctctcaggggataggtgatttaattatttctttacctcctgtttttagcctaattggtattttagtgagctctctttactacctgattggtctggtgtgagctgagttacaagccccatgtttaaaggtgggtgtggtcaccttccccagctaggcttaggaattcttagtcagccttggaaatccagctagtcctgtctctcagcatcactgtattatcacccccaaggtgcacagatcttaggaaggtcacccagctagaaagctgtaacattgagatttgaacccagacagtctggcttcacaatccttatctctaacagttgtaccataatgcagtaaggttggtgacttcaagtggcatgggcccataggtacttgttaggatctggggatttggagccagctgtgcttgataatagttgtatgaccatggtcaatgtctctaagaagctccagtttcctcacctggaaaaggagactactgatagtacttgggcttggtgggcacagttgaggtctatgtagctgcttaacacagtcacctgcacacagcaccagctcagtaactggaggttgttatgagggttttatcaggctggagagaaatgagaagattccgtaaggtgttagagatgcactgtggacttggtaatgtactgaggttatggcgcatggagaggggaattccaacatgacactggggtttgtaattccagtaatccttgggtgactggcagtgtggaactggggtgcaggaggcgaagctgggtcagggctgagaggctgaattcagtgttgaacactcagtatgggcatctccagaacatgagaggtggggaattgccgttgactgccaaatgagctcacgagtctggaggtgtgaatcggggagccttgcacacattgaggacgtgatgttttcggttctcttgcgtacatacctcagagtggaattgctgagtcatgtggtcactccatgtttaatcacttgtggaactgccacactgttctccagaatggctgggtcactttacattttcactggaagggcatgagagtctgatttctccacatcctctcaatacttgtgattatttttctgtttcttttttctttttttctttttttttttgagacagagtttcactctgtcacccaggctggagtgcagtggcgcaatctaggctactgcaatctctgcctcccgggtttaagtaattctctgcctcagcctcccaagtagctgggactataggcacctgccaccatgcccggctaatttttttgtatttttagtagagatgaggtttcaccatgttggccaggctggtcttgaattcctgacctcatgatccacctgtctgggcctcccaaagtgctgggattacaggcatgagccactgcgcctggcctatttatctggttctttaagagataaggtcttgctgtatcacccaggctggtctcaaactcctgggctcaagctgtcctcctgccttagcctccccagagtagctgggaccacaggcacgtgccactatagccggcatttagtatctttttgctcattgccatcctagtggatgtgaagtggtctctcattgggtttttggtttgcattttcctggtggctaatgatgttgaccatatttttctgtgtttttgttgttgttgttgtttgtttgttttgttttctttgagaccgagtttcattcttgttgcccaggctagagtgcaatggcacaatctcagctcactgcagcctctgcctcccggttcaaccgattctcctgcctcagcctcctgagcatctgggattacaggcatgcgccaccatgcccagctaatttttgtattttcagtagcgatggggtttcaccgtgttggccaggctggtctcaaactcctgacctcaggtgatccgcccgtctcggcctcccaaagggattacaggtgtgagcgtgcctggcctttcctgtattttttggccatttgtctgtctttggagaaatgtctatttgaaccctttgcccattttttaattggttttttgtcattttattattgagtcttaagaatttttttttttttttttttttgagatggagtctcgctctgtcacccaggctggaatgcagtggtgcaatcttggttcactgcaacttctgtctcccaggttcaagcgattctcctgcctcagcctcctgagtagctgggattacagccatgtgccaccatgcctggcacatataatcttttttatatgttgctggattcagtttataaaatttcattcaggatttttgcatctgtattacaagagatgtttatttctagttctcttgtgatgtctttgtctggttttggtgtcaaagtaatactggcctcatagaatgagttgggaagtattatcttctcttctgtttttgggaagagcttgaataattgatcttctttaaatgtttggcagaattcacaatggaacccctggtttttcttcgtggacagtttattgattgctaattcaatctcttcagtcattatagatctgttcagattttcagtttttcataaggcagttttgttagctgtgtcttcccaggaatatgaccacttcatatcatttgttggcataccatggttcacaatattcccttataatcctttttatttctttagggtcagtggtgatgtcccgtctttgattcctgatgaggaatttgtgttttctcctttttatttggccagtctagctgaaagtttgccaattgtgtcagtctttgcaaggaaccaacttgatcgtttattgatttttctctatttttctgttctctgtttcattcacagttgctctatcttttattattttcttccttctgctttaagaaggaaggaaataatttaagtttactttgtgtttcttttccagtgtcttaaggtggtacttgaaaggcatgactctgaggttagacattgctgggcttggagcccttctccccacttctcagcggagggggtttgggaaacacagcctctctgagcttccgtttctccatctttcatggggggcagtagtacttggctcacagctgttggagggtgaaataagataagactatagaaggcaggattcctgccgccgcccaccaacaggtgctcagacctgcggctcccacctccctgcacagaggggagtcagcatcctgagcggccagactcaggctccagcaccgcaggctgtttcagctcaaaggactcaaaagttcctctttcctctaggccttaaacagtgaaggtgggcggcccacgcccaggactcagacagacttgggttcaccagccattcccttcaatgccttcatcagccaagccacttggaaaaggacccagtctatccagaaaattccagaatggttatttggtcaagagagctgagttttgggaggcctgctgtgttagcgggaagccaggtgtctatatgtcgaggagaagccagtgcagaagcctgtgatcagaggttctgtgctggaggccctgtgtccaggtggaccggcggtgggtggagacgtgaggtaccattgtgtgtggccagagtggaccagctggcactggctggattccagagggaatgcttcctgaccctgggtttagtgagccttggggatgagtctggatgtccggggtgctcccaagagggcagggtactctcaggcaaggctgtgtgacagaaaacaagactctgacaaaccctctgccctgtgtgcctggtgacccccaggctgtgcctggctctcttctgtgtccttggcatctgtgttcaggagtggacgagggaattcttctcgccttttcttctgggaaaatgatgctagccattcacagagtgattctcttttgccatccttttggatttcaagtttacttttctctgatttgtaaggtgttgcgggctctcctgttggtgggggtagtttgaacccatagatgggagagcatggattcaggttgcatgttttgtgcaggctcttatcacgcgatggcatccactgtggaaggaggcgacacagctctgctcccagaattccccagggggcccctcgatgcctaccgagcaagagcgtccttcagctggaaggagctggcgctgttcacggaaggggagggcatgctccgctttaaggtgaggcgtgcggttgtgcgcagcttgtcttttttcccagtggggtcttagttcgttagcagaatgggatttctggctctcacagctcctcctctgccgggcgaggctcatcccaggcagcgcggcctctctcctctctgcaccccaggacaggcctcagggaattgatgaggagtctggaaatgaacacggattgttgatgtttcttaagcctccagtcctctagtccattgggaatgatagtcatatctctgtctgggtgtctccgggtcagactgtgtcccatgaagcctgtggcctggaggtcaactatataagggcacatggagagtccatcttttactccaaataagccttacccatctcctgcatttccagaaaaccatcttctcagctcttgagaatgaccctcttttcgctcgttcccctggagccgatctgtccttggagaagtatcgcgagctgaacttccttcgatgcaagcggatcttcgagtatgacttcctcagtgtcgaagacatgttcaagagccctctgaaggtccccgccttgattcagtgcctgggcatgtatgactcttctctggctgccaagtacctcctccatagcttggtgagcatgcggcctaggggagagggaaacggctttcatgctgcgctgagccttgagggatgcctgtcccagggccaaccaagaggcagagaaacaccagtttgtccagctatatttgcaaattttaaaaattatcttttttttaatgtttttaaaaaaatttcagtcccccttttcatttttttattttcaagcccatccaccatcatgtatttgtaaatttgcacccataagtccttgaataaaatacaatgtggtgaagcttcaagtcccatcagaagaggagctgttgggactttttttttttttacctcatacaaaaaaagagacaaatgattaaaaaaaaaataaaaaaattaaaaaagtaggccaaagggagaaacctgtgtttttccttcctttgtaacataccagcagagctgagcttgggcaaaatggctttgcccttagccttgcctgcattgtttgatgggctggtgggctctgctctccttacagctctccctgctgtcctcagacccccaggactccttgcaggcatcttaattcccaggtgatttctgtgtgccttatacaaggtgctcggcacagagatgtaggtcttaccactcacatgaactcagggacccggggcagctgtgtgtcaggagaccctggccttgggcatccaggctgctggctaacctctcagcacttgttctccaccttggggaaagtgcagtgtggcagggaaccagcgtgggcatggtgttgagtgccgttgtctgttgtgatgttccggaagagcagtactcttcttacctgccccctgttgataggacgatgttatactttcaggtttttggatcagcagtttacagttctggttctgaaagacatctcacatatattcaaaagatcttcaggatggaggtaagttctggttcatggtaaattgtgagcctggttctcttgcttgatctctgtagagatttgtgaaaagagaagattgtagaagggggtgcccagggggcttatgctcttcttgtttcctagtgttctcaggcttctcaccaaatagctagcactgttctttagcaaacacaggcacattgacttcctagcaccaggtgaattgtcactgaggccttccactgtcttttcctgatgagcagttcctgccaccttgctgacgtggagcagctgcggtcagcttggtttaggctgctgtggttgccagctgagtgtggcagcatgactcagtcaagtcactagttgggtagatggaaatttggggctttgatatgtggtttcatctttaaaggaaagatggcagtgaggtccttctgggaatgtgcacaaagaacttttcttgctttccatcattttgtgctttgacatttagatttttggatgttttgctctgaccgaattaagccacggcagtaataccaaggccattcgcacaactgcccactacgatcctgccactgaggtaggtattaccttcccccgggtccctgagtttggagcatatgagacgtcatgagtgcaaatgccgttgcccagaataagaaaaaaaaaacattaaagcaagaggcctgtccacatacacttgtgtagaaatacccactgagattcatcacactgaaaagtggggcccaggagatcaggcattggaggacaaagcctgtgcccaccatgaactttatggggaattgatcgtggtttggatttgtgtgtaatttgagtgcagtgaagaagccctcattctgtaaaatttattgccttgtttacctggctgcctatgcgtagtggattcataaaccgttctcatggcccgtggtttctacggtgggccccatggagacaacatgctccctgccctctgccctttgtggctgtccctctgcgaagagcctgccttgtccatttccgccaccgcagtctgactcctcgggtccttgccatcctcttgacctctctggtacctgcattgtggctgctgcctgggagttctggtgtggtgcagtgagacgggccacagatggatgccctggggctgtcagtgctgtggaggggcacggggtgcagtgagacgggccacagatggatgccctggggctgtcagtgctgtggaggggtggaggggtggagggagatgggccacagatggatgccttggggctgtcagtgctgtggaggggcgcagaggtgcagtgagacgggacacggatgccctggggctgtcagtgcatggaggggtgcatggagggttgcggggtggagggagatgggccacagatggatgccctggggctgtcagtgctgtggaggggcgcaggggttcagtgagacgggccacagatggatgccctggggctgtcagtgctgtggaggggcacaggggtggagggagatgggccacagatggatgccctggggctgtcggtgctgtggaggggcgcaggggtgcagtgagacgggacacggatgccctggggctgtcagtgctgtggaggggtgcggggtggagggagatgggccacagatggatgccctggggctgtcagtactatggaggggtgcaggggtggagggagatgggccacagatggatgccgtggggctgtcagtgctgtggaggggcgcaggggtgcagtgagatgggccacagatggatgccctggggctgtcagtgctgaggaggggtgcggggtggagggagataggccacagatggatgccctggggctgtcagtgctgtggaggggtgcaggggtgcagtgagacaggccacagatggatgccctggggctgtcagtgctgtggaggggtgcgggttggagggagatgggccacagatggatgccctggggctctcagtgctgtggaggggcacaggggtggagggagatgggccacagatggatgccctagggctatcagtgctgtggaggggcgcagggcagcgagggaggatggggagggtcctcacccaccctgttctgttccctggccctgcctccctgccaccacatgactctccttggcctccgcttgtccctgaggcctaggtctccctgccagtctttcctcacccgccttccaccctcccccattggcagtggtcagggaggactgttgtgtggcaggaagtgaagctctgcacctgcggatgtgctcaaccagtcatccatccatcattctttcatccatccattcattcttccatctgtccattcattcttccatccatccattcatccttccatccatccattcattctctcatccatccattcattcttccatccatccattcattcttccatccatccattcattcttccatccatccattcattctttcatccatccattcattccacagcctgggctgtgtggactgtgcctggggtactgcatggaagagcccaggaatgaactcaagcggacccgtagcccagcagggataagaggtggtcctcgcacagggtgcccctgctgtggggccttgggagtggggccaaggctccttctcagagtggggctaggagaaagtagggcatgaggttcttttcagaattttcttttaagccataagatatctttatctgaacccaggtctttctggccccatggctgcttctcctcctgctgtcctctttgcctgtggcctgcagtgccaggaggtggggccctttctgacaggcagatggacaacagcacccaggtagccttggggtggggcatcagaggaccacttcccatttccacctccttctttttggcatttgatccctaagtggaggtcagagtgtggcatcagatccgtagagttggggtgcccaggatccaggctgggctgctggctgagcatttatttggacagcaggcattgctgggtacctgttgtgtgtgaggcacagctttccaagactgggctggaagtggcgagcacagcagacaggtctctgctgtcctgaagttgtgggctggggggagacacagacaccaacagaaagaagtgagatgtgctgggcaccatggaggccctccagagagcaaagctggtatgccggggcgcagggaggcagccagacagtcgagacagtgggaaagatctgtgtggagcagtgcaggccccgaggagccggcttgggccggtgttgcagtgcacacctgcactgcggagaatgagtgacaggtggaggtatcagaactgccgcgtgctgaagaatgaatggggagggcctggctgagactgggagccctccttaccctcgcaggcgaagagctggtggtcccctgagagaagagaacagaaggcatggctggcagccaccccacctcctacttctcctcagtgaaacttcaggatctataggatgattgttcactactctgtttacagaatcccactggttagacaggaggaagccctccccggcacgttattttgtagcctcccaccctgcaggggctggaaccagaaccaaaacttagccacgacagcccctagcagtgactggcaagctccgcgtggaggatcagtgtctcccgaggcggcccagggcagctctgtgggccacctgcgggctgtctgcctgaaggcgctcatctttgtccccttgcggatcccggccacattatgcagcactgctggtccgcatcctccctcccagccttactcgaagggctcccagcagacgcccctggggcaggcccagccccagcggcccagctcctgcctgttcccacgtgctcttcgcttctgacccatgcagcaccctcagtgttccttggggatctgtccacaccccttctagccaaacaccgaacgctgtgatgccacagcccatctgctagttcacgcatgcgttccttccttccttccttctgatgttctgagcggctgccttgtgctcggggcatttgggatataactgtcaatcacggagctgtggatgggagagacagcaagggggcagcagtgtgttgtgaattagaggtcctaaagaactgagtggactgcacggcattcccacagccctgcccacagggcacagacagccccgcccacagtgcacagacagctccgcccacagtgtatccacagtgtttctacctaaggggcgtggttagggactgaagactatatgataatgaaaactccctggaagcgtttgccagcctgcggagtattttgcatctgaaggttctttaagtcataaggcccaggaataggctgtgtttaaaaaataggcctgcctgtgccatacaagaactaaaatgtgcgattagtttcaactcttgcctcagagattttgaacgtagaaaatggaatctgtctaaaaggaaaacaccaattctgcatgtgctttagttgctaattataactaacctaaattttcccttgtgcaggaattcatcatacattcccctgatttcgaagctgccaagttttgggttggcaacatgggcaagacagccactcacgcggtggtgtttgctaagctgtgtgtgccaggggaccagtgccatgggctgcatccctttatcgtgcaggtaggacgctggggtggccctcagtgggggcagtgtttacccccaggaagcactggtaatgtctggagtcatttttgtcataacaagggtggggcatgcttctggcatctggtgagtggaccagggacactgcccaggaccccagtgcatcccatagccccgcccacagtgcaaacagccccgcccacagtgcattccacagccctgcccacaatgcagatagccccgtccacagtgcatcccacaaccctgcccacagtgcacagacagccgcgcccacagtgcacagacagctccgcccacagtgtattcctacagccccgcccacagtgtatcctacagccccaccagcagcgcacagacagctctgcccacagtgcagacagtcctgcccacagtgcacagacagctccacccacagtacagatagccctgcccacggtgcacagacaggcctgcccaaagtgtatcccacagccccgcccacggtgtatcctacagccctacccgcagcacacagacagctctgcccacagtgcagacagtcctgcccacagtgcacagacagccctgcccacagtgcacagacagccctgcccacagtgcacagacagccccacccacagtacagatagccctgcccacagtgcacagacaggcccgcccaaagtgtatcccacagccctccccacagtgtatcctacaggcccacccgcagtgcacagacagctccacccacagtgcagacagtcctgcccacagtgcagacagccccgcctatggtatatcccacagccccttccagggtgcataggcagccccacccacagtgtatcccgcagcccctcccacggtgcagacagccctgcccacagtgcacagacagccccacccttgccttagaaagaaacatccagcccaatgtcccccagtgacacagctgagagggcctggccaaggctcctggccacaggagctgcaggcctctgagaccatctggttgatttgatgcacaaagtttttcaatttcgatgaagtccagttttacgtttttttcttttgttgctcatgttcttatttttcagttgacctgacgtttgagctgttgcagaccagagagatttttttcattgtaaggttacaggacaaaaccaaagtgtttttcctactgtcatgcagccatcacaacgcttctgacattagatgtgtgtgggtttctccccaccagcaggcagctctgcagcagaaagcagctgggcgtcctctaatttaactccatactgatgctgttcacctggggtgagcctcagtaccgcccccaccccnnnnnnnnnnnnnnnnnnnncccccccagtgagggctcagtcccacaagaagctccccaaccctttggatgccaatggcaagtccaggttgtggcctgtgcctctgatcaatcccctaattgtaccttggtcttcatcctgaagctatttaggggtctgcaaccatctcatgagcacacaaaagactgtcaccactgcagagagtccagggttttaggagtcgtgtgctgggaagcagggacaaggccaaatatgtatttatcacagcatcatagttacctgaggccagtgtgccttgtttctgtgattatagatttctacctggagtggacttcttgcgggagttgcctggactagaattcagcagctttcggcgtgtctgattttggggacatagagccgcagtgttttagacttgtttatgttgtgctaaaaacactccgcaggattgtgtcgcccctctcgccactgcaccaagtgctcagggcacctgagtccacctcccagagccacggcctcctgcctgataaggagggatggaaacagtggtcttggggttatttggacaggattgtgatctgcgccccagacctgagctggtgggcggaggggcaggcatcttttgcaggtttctttctttttttctttttttttttttttgtgagacagtgtctgaatctttactgggccttgctgaaagattttagaaaaggagaggatgtttacatttgggttttagccctttttgagtgtttctttattttaaagttcagtgaagttagatggtgaattgacagacataaacagaagccagctagcaggtcatgcacatagctaaattccccgtagcaccacctccatgtgtctctaaagcagcttttccactttggcactgttgacagtttgggctgggtagtactcactggggcgccctgtatgcccagggctgggctgagcacttctggcgtctggccattctgtgccatagcttcctgcagttaacacaaccagaatctctccagacaccacccgtgtcccctggtggggaaggggaaggtggcacgtctcatggttgggaatccctgctgtaacagtgcccaaggatgaagctccacgtccttccgtcgagttcccacagtgcgcagccattagctggctggacctgtatcttggggagcggtgattgaccagaatattcatagccgtttctcccactacacctatttgcacagccattttgtcactttactaaaatctagcagggagtcctgtgtctaaaacgtgaatatgaaattcccgacgtcctcccggcagcaccggcccccgtgttagtctctcatggctgccacagcaaagcaccacaaagcagggcgctcgaaacagcataacgtattctcccaactctggaggccggggtctgaaattgaggaatctttagggcggcattccctttaaaggctctaggggaggatccttcctatctctttcagctcctggtggccccaggcctgtggccccatgtgggcggcaagccacccaggtgccgaggcaagagactgaggacacgagctgttccagtgtaataaaatataaaataagaataccagatatagatcttagatatgattatatatgaatatcaataatcattagtttgtagcaattactctttatcccaatattataataatcctcgctctataatcataacctaggaaaaaccaggccatacagagataggagctgaggggacatagtgaggagtgaccagaagacaagagtacgagccttctgttatgcccagacagggccaccagagggctccttggtctagcagtgatgccagcatctgggaagacgcccgttgccaagcagaccgtggtctagcggtagcataagtgtcaaggaaaaacacctgctacttagcagactgggaaagggagtctccctttccctgggggagtttagagaagactctactcctccacctcttgtagagggcctgacatttgtcaggcttgcccgcagttatccggaggactaaccgtctccctgtgatgccgtgcttcagtggtcacgctcctagtccaccttcatgttccatcctgtacacctggctctgccttctagatagcagtagcaaattagtgaaagtactaaaagtctctaataagcagaaataatggcgtaagctgtctttctctctgtctcctctctctctctctgcctcagctgccaggcagggaagggccccctgtccagtggacatgtgacccatgtggtcttacctatcattggagatggctcactctccttatcctgcctttgtcttgtatccaataagtatcagtgcagcctggccttcggggccactaccggtctccgtgtcttggtggtagtggtcccccggacccagccgtcttttcttttatctctttgtcttgtgtctttatctctatgctctcttgtctccacacacggggagaaacccactgaccctgtggggctgatccctacagccccagcgctgtactctgtgcctccgtctccacatggccccctcttccccacacccactcctcttctgattctcataggacacttgccgtgggatttagggcccacctgggtgatttgggatgaccttatcttgatgctcttaaattcattatatctgcaggaccctatttccaaataagcttccattcccaggtcctggggttaggacttggatgtatcatttctggaggatggtttaacccacagccgcccagcgttgagcccatggcccaccctgtgggtttctgaacacatttgttttgatttttgtgtgattgtaacagttgctgtttgctgctttctgtggctttgtatagatccgggacccgaagacccttcttcccatgcctggagtgatggttggcgacataggaaaaaaactcgggcagaacggtctggataatgggtgagtgacagaggctgctgagccctgagcttcctgccaaggcccaggctgcgttgtcgctcatgtctgagatctcactggccccatggatgccatgccctgccctcttagactcaaatgcggtggggacctacgcctagcccccgtgcatgcactggccacgtcctgcttgaactccactttgggaggccaacttgatcagagacctcagcaaaccagcttcaccttggcaggcggctccacactctcagatcagacccagacctctgtgtacagctggtggggcccctgcctggggggctgcctcctctgtgtgaggtcctcctcagcatcctgagcctcccccggctcggcctctgcacacatccatgctgatctcgagggacccatatctgcagtttctgcctccagagtaggcttgctcctttccgggtaatcccagtgtcacagcacttagaaagagaattccgctggcttatttgtttaatcagcccacatatatctatttagcagcacacatgtgacaccgggttggtgtggccaaggcctggctgaagggttggatggggcgtgcagaggggaggggcctagaaagactaatgaatgcttgatggccacatggaggcctgggtggccggggagaagtggccagtgattttggaatgtgcagcgtttcaggtggaggaagcagtgggaagtgtcaggcccaggcctgtgctgggatgcaggcggggtagggaggccaggccgcaagggccttgagggtctttgagggattggattttggagctccaggtcattagcagcatgacttttggaatgagacagatgtgcagccggccctttgtgtcaccttgaccagctttcttggcatttcctcatctgtaaagtaggtgacaagagaggtccctgtgccagggccctgccaggccctgcctgagcaggccgggcttgaacttcctggccactggcccatttggtgcctccctcactgcgaatgctggactccacacgctgtctcccccgagagcctgatccagcagggtgtagacccctctgtgcccacgagatgatttataacttgggggtagtgggacaaggtatgaccatgcctgagcctgatagcctgaaagatgtctcaggagtgtttctagatatgcgtgtttcatatagtgtttcatagcgaggctggtggagaggagaggagcctgccttacaggagttggaaataactggttatcatgaccaggttgtctccagagggagaagatgggccagtgggcatctgagcgctcagcgatggagaaacctccttctgcctgtctcttctgagaagtcagggtgatgggcagggagtgtcttaaatctctgcttggccctttaaaacaggcagggccccagactgtactaaagaggaaaatcttgattgatttttatacagtgtcaacttgagaagaaagtaaaaggacattgttaaaaagcaaattcttgtgatttcaggcaaaaaaaaaaaaaaaaagcaaaacaagacacatatgcacagccctcctaactccacctgtcctgcagagttctgggttctcactggcttatactaaaataatacaaggaacctgctagttaatgttggagctggcagggaggagagcgccaccccgacctgcggctgtcagttctcttgaatgactactttcgcagggtgcctgggaggcgcttggcatggacggtgcccgtgtagcaggtatggagggtcgctgttcaggcccttcgccctcagggcagcgggaagccccagccatctggaggatgtaatgcggcttggtctgtttgagaaggatggctctggcctcagggtgagaagctctgaagcgctgtgcaggaaatggggtgtaggaagcactgtgttgttctggagaatctgcatccttttattagacccggctgatccctttcagggctctgcagccacaggcactgttacccatctactgaagtgtcctatgtgtgcacgtaaggcccgacaggcatctccacccgggcatatggcggtggtgaattgtcacatccagtgggtggcctcgggtgtgagcaaggctcttcttcactgctcattcagtttcatgaatgagaggctttgacattattttgggacattgcagagaaaccctgcacttggttcccccctaataaacgtatttctagagattgaatccacacctcttactgggataatattcaaaggagcattagatcaaaccattaatgattaatacatcacactgatatggtaaagcctcttgtaagactcagaaatacggtctcctataggatcgccactaacacaataacgaccgccctttgacgctggttcagagctgctccaccaagccaggtcactgagcccccagagcctttccaccgtgtctctctgcagggtgacagggatgcagtgggattcgtccatctttgatccctgagcctttgaaggcctaggttgggctgggatgggagccagccggggtgatgcaggcggcctgctctccgcccctttccagaaatgcacatttcccatccagggctggagggtctgggcagggcacccagcagggggcgcagtgataccagtgttccctccgggtttcccagccagtttctgcctggatgtctgtcttttccaagatcagcattataatttagtgatttttgttaccaatgttgaaatcatttatcttgaaaaaagtggttacaatttgtaggttagattttgtcactttacaagaactcctgagtatgtgggatgactgcctacaaatccaaggtaaacgtaaattgtgtggattaattttagccaaatagctctaaaagcaaaatcataaagatcttctcaagtgatagtttcagccagactcttaaggtgggctgcaccttaagggtctttcttcgtgcgtttgccctgagctgaggcggtggctgggaggatgcctgccgaactcaacggcctgctctggcggcttggctgggctgggcttggggggcccttccaggccccaaaggaggaaggaagctgctgcaataagaagcaggatgtccagggcgcggggtgtgtgctgaggtctgggcgcttctgggattggagtgagggtttctgtgccacactcaggcctcccgtgccacgtgcatgtccagtgacacacacacacaactcctgtgctgtgcacacacacacctgtgacacacgcacacgtctcccgctggagacactggatctggcttgtatttgagttggccacatgtgaccaccactgtaatagcttttgtggaacagaagggatcccctgagaattcgtggaagtttgctttcctttgaaactcacgggaatgtttttgcaagtataaatatattctgtgtggtgagaatgggggaataatttccactccttaaaaagggcgctgactgtgaccggatcatactggaaaaggcattccttggctttcaagtaacaggctggagcacgctggggccattggcaccgaggcaaggtttttctcacgaggtggggtgttctgagtgtgcggctgtggcatgggggaagctgctaccaaactgggcagctgggcctagggctttggaggagctggcccccccgctgcccttcacttcctgcaggtgggcaggggcctggcaaagcagccgagagctcttccctcaccaggtcacccaggtttccctaaggagctccagccccgtccccacccggccccagggccttgctcctcctggtagtgtggaaactgtcgctgtgtctttccctcaggctgtcctgggagtcaggatcatggcctggcccttgtgcctcagaggatgtcgtctgccccacctgacttgttcataccatgccacttacgtgcccgtcccttaagtctggcaggccccatgcacggtggccccctcatggaggggggtgagccccgggagactgctgagaggcagctagctcacccaggaaccaggaacgttgatggttgagggatcccaccctggggtccgcctcatacccttcccagggtggggcatagaattcccaggtgggccgagggctgcctggtgtcaacagtgactgcatggagggcatgaggccaggagagaacctggtggacggggcaccacaggcaggcaggaccacctcatggcaaggcggtgatgctgttagaggggcagatggggcaccacaggcaggtgggaccacctcatggcaaggtggcgatgcaattagaggggcagatggaggtcagcttggggggatcctccacattggcctccgccattccgaaggcctttgggaaacggcccagctcccacagggaggatgggctgaagaggcagagttaggaaagagccaatatggttgctgcaggaaatcagcccaggagagctgagtagggatggaggtgctgggtcctaggtggggatggaggggagaaagtgaatcgggccagcacagcagagctggcagcccaggaccgggtgacaatgggggtgtgggggcatcctgagcaggactcaaggaagagcccacgcaggaaacgggtgcctctggttcccttccagcatgtgagattattctttatagatgagtcttctgtggtttagtaaaagactattctgtaggcaggggtccccaaccccgtggtactagtctgtggcctgttaggaactaggccacccagcaggaggtgagcatcgggtgagccagcaaagcttcctctgtgtttatagccactccccattgctcacatgactgcctgagctccgcctcctgtcagatcggtggcggcattagattcttataggagcgtgaatcctactgtgaactgcgcatgtgagggatctaaggcgagcgctccttatgagaatctaatacctgatgatctgtcactgcctcccatcacccccagatgggaccatctagttgcaggaaaacaagctcaggctcccactgattttgcaattttgcattatggctaattgtataatcatttcattatgtgttaccatgtaataataatagaaataaagtgcacaataaatataatgtgcttgaatcatcccgaaaccactcccacctccccctcattcgtggaaaaattgtcttccataaaaccggtccctggtgccaaaaaggttgcggactgctgccctaaggcattgcaagtgatcttaggaatcagacaagttgctataggaactattgatattttgaagtttgttttggggggtttttgcacagtttatgtaatattcttaacctagcatagccttattccctagactgttgtgtaataggttttcctgaccagacaaccataacaggtatctttggttattaatacatcatgatccataacaatgtgtgtgtaatcctatgctcagctgttcaaaagaagtgaatttccttgccgagggagcaccaatgccatcacaccagttattttgtttgactgaagagttttaaacctcattttgccaatattattacactgtgggttctggtttaagattgaaatatgagaatcagagattccaatctttggaaacacagttcccgtcttttctgttgaatatctggagttctgtacttggagtacaacttaccatatacacaatgcttttattattattattattattattattattattgaggtggagtcttgctctgtcaccaaggctggagtgcagtggcgtgatcttggctcactgcaacttccgccgcccgggttcaaacaattctcctgtctcagcctcctgagtagctgggactacaggcacatgccaccactcctggctaatttttttttgtatttttagtagagacggggtttcaccatattggtcaggctggtttcgaactcctgacctgaggtgatccacccacctcggcctcccaaagtgctgggattacaggcgtaagccaccacacccagcctattttttaacctacatttttttcttttttagaaacagggtctcactgtgttgcccaggctggtctcaaactcctgggctcaagcaatcctcctgcctcagtcttccaaagagttgggattctgggcgtgagccactgttcctgactagactacttttttgaatagaaagttggttgaatgttcctgtctacttgccctctgccattttctttgtcctcggggattgcatcagcttttaggctgcccttggagaagagaagagcctcagggcaggacccctgtttaacagaagccctgctgcttccccacagtttcgccatgttccacaaggtcagagttcctcgccagagccttctgaaccggatgggagacgtcacccccgagggcacctatgtcagcccctttaaggtacaggcatggggggccgttcgtgtgccgtgcttcccaggtgccttcctctgcagggcctggctctgtgctcctccctgcacctggaaaggagacccctccacgtaggccaggtgtcgctggggcatacttctcctggctcgggttctggtgctcccactagaaggggactcttggggcagccacagcaccaggtgctggtgtccagggggtgagtccgggccttacaatgcccactccccatcgggggctgcgattagaggactgctcgcttccagtgatgcttccctgaggatttgaaggagacgggtctcctggcgaaccgtccacaaagggggacgacaaacagagttccccggtgtccagaactcacgcctggcttaagttcacggagagcagaagagagaccgtggtcctggggagcgatggcccaggtcatagctgatgaccctcaggaatcatgagctcacagcaggtgggccaccccgagcatgcacccttggaataacagtccccagcagcatgcagcatctgacatcaggaagcacggatggaaaaggagcatgatggggatgcccagagacacacagggtgcgcagagtgggaacagcaacacgagaccaggagctgctcacaaacagagatgttaatccaacatcaattaaaaataaatgattggaagaacaggcacagcatttgggataactatctcaggaggatgaattagggattggaagcttgtcctctagaaggcagaaggagaggattaaagaaaatgaaggctgggtgcagtggctcacgcccgtaaccctagcactgtgggaggccaaagtgggcagatcgcttgagcccaggagttccagaccagcctgggcaatatggcaaaaccccgtctctactaaaaatgcaaaaattagccgggcatggtagcgtgtgcctgtggtccgttacttggtgggaggtgggaggatcactagagcccaggaagtcaggctgcagtgagctatgattgcatcactgcactccagcgtgggcaacagagcgagaccctgtctcaaaagagaaagaaagaaagaaatgaagtttagagaaataaaggagagaaatgtctctaaatgagaggggaagaaggcttttggttgaagggactcttggaggaccaaagaggaaaagtaaggaagcacctatgcacgtacccagacacacggtagagaaattgaggaatttctaagagaaaattctagaatcttccagatctgactccagtggaataaaaaacacttgaacttcagatttctcaaacatgacagtgaatgcatgaagacagtggaatcatattttatacccttaaaggaaaatcactttaaatatatatttatatatattttttgaggtggagtgttgctctgtcacccaggctgcagtgcaacagcacgatctcagctcactgcaacctctcctctgcctcccgggttcaagtgattctcctgcatcagcctcctgagtagctgggactacaggcacccgccgccaggcctggctaatttgcgtacttttagtagagacggtgtttcaccatgttggccaggctggtcttgaactcctgacctcaggtgatctgcccacctcagcctcccaaagcattgggattacaggcgtgagccgccgcacccggcttaaatacatttttaaacacaacgagactgtgattcctatgtgagagtgtgattaatacgctcagacacacaattaccatgctgccttggaagaaggacctagatggtcagaggagtggcccgatggggcagcacggggcagggcaggaaggacggtcagatcacgtggcaagggctgtagattagatgtgcccaccgcagcctggacaggccttagcaacagcctctgctgacgccgctgatgcgtgcgaggagatagtggacggaagattccagctagacgcacgtaaaggaactgcctgttcacaggcacacaaggatcaagaggtgtccgtgaaaccccctggaatggctgcctgtaatggactccgcccctgccctctggcagtacaggccacatctgattcttgccaaggttaaaggtgggccttggaatctccaggcagatggtttgcaagtccccacagtgggagcaccctcacccagcgctgtcataccattccctctgctaggactgtaccttctccaggcagctgggtgtcccctccccggcacccccattccatccacggttcatcagtgacatctctacccgcctgccgcaccgtcctgtgtcttgggcgccctggggatggggcctgggcaggtgggcacaggtctactttggatgaacaaacgagggcaccttcgcctctgagccactctgcccaaggtggccgcgcagccgggcttgagcttatcatctgtgtccctcccgtaggacgtcaggcagcgctttggagcgtccctggggagcctgtcctcgggccgggtctccatcgtgagcctggccatccttaacctaaagctggccgtggccatcgctcttcgcttctcagccactcggcgtcagtttggacccacagaggaggaggaaataccagtgcttgagtatccaatgcaggtatgaggttttcaagcatcctttcactgtctctctattttatatgcaaattcacttcttttacatagttgccgtttggttactgggagttgatcaaagctcttaaggcaattaacaggatgattagttagcgggagtgcggcatctcaggccgcaaggcttccagcaaatggtttttaatttaaaaagagtagatacgaagtagccaaaaaaggaagatggaaagaagcaagtcttttttttttttttttttttttcccagacggagccttgctctgtcaccaaggctggagtgcagtgggcatgatcttggctcactgcaacctccgcctcccaggttcaagtgattctcgtgtctcagcctcccgagtagctgggattatgggcatgcaccaccatgcccggctaatttttgtattgttagtagagacagggttctgctgttttggccaggccggtctcgaactcctgacctccagtgatccacctgcctcagcctcccaaagtgctgggattatgggcatgagtcactgtgcccggccagaaagaagcaaggatggggcggctctgggaggtgggtgtgtgcacggccgcacgttcaggtgaggccgccacagcttggcgggtagtggccttgcatgccctgtgcacactctttgacactttcatcccatccctaagaaatgattcctggcaggtgatctggaagaagcagcagctgagcgtgcagccctgttcactgtgatggcatttagaacagtggcgtgggcacagagcgttggccctacacgtccccagagatggggcagctgttgacatgcacagatgcagcccaggcagcagcgtggaaaagcacagacattgttacatggaagggggatgaactgtcacagcgaacgtgccctgtgctctgggtttggtcttcacagctaagagggttgggcttagtcccactttacaggtgagagaactgaggatcaaataagaaatccagttaaagtgcacaggctaactcaggcccaggtcccaggccaagctgtgcatgaataaaggtagatttgggtgaaacttccaggaaattgtaacagaattgcagttgtttctttccacatcctttgaccagggctatgagcctgtttagtaagtgttgccattcatgcctgtgtggcacccatcccctcccgtgtgtggtcacagcactctgggtgccaagggcagctcggcggtcaagagagcgcactggggccaccatgcctggccttaccaccaaggtccacccccagctggctgtgtgcccccaggcaaggtccttagcctttctgtgctcttgctttatcatttgtaagttagaactgatgataaaacttcttcctaggatcagtgtgaggattaacaaagttagggcatggaggcagctggcgccatgtctgctcagcactcttgacacgttagaccatggtggtgatggcggtttcctcaggatcctctcaggcttgtcctgccatgtacccagccacccacccacccatccatgcatccccccacctgtccacgcatccccccacctgtccacgcatccacccacccatccatctacccatctacggattcatccatccacccacccacacatccacctacccaccacccaccatccatgcatccatccacccacccacccacccccccatccaacaataggtggaccctatcctgtttcagacaaagtgaaaaagacatgcactcagcctttcgaggggctgccagctctgtgtgggcctcagctttcccatctgtcccagggtgacggcctcatcctcacaggctcatgctgtcagccagtcagtccgtgtgccggggagttggcccctagcagtgctgccttcttaattcacagatagactggcactttgttctgtagtgactttgatgggacagctgtgaatagcggccatttagcgaattgcgtttgagcttgtctgtcaagggctatgggtgaaagccgaactggctgagttgagagcgtgtcagggtgaaggctttctgatgtgccgggaagacatgtgaagaccttcagcgctagtgggtgtgtggccctgacggcctctccctgcactggctttcatggtccctgggatgggctgcccttcatgggaaccacgatgtgttcacgcaggtgtcttgtctgttctagcaatggcgcttgcttccatatctggcagctgtctacgccttagaccatttctccaagtcgctcttcctggacctggtggagctccagcgaggacttgcatcgggagaccgcagcgccagacaggtgaggtggtgtctgcttcctcagcagcatcgtttaaatctcacacggttggagcagcatagattcaaccttcatttcaaagcaaaatcagtcctttgatttgcgaggacagagcattcctccagttgttcccacccactcggagctcttggcctctgccgcgattgaacgggctgggcacgcgtccacacccctgcctctcaaggatgtgctgacacgactcccggttccagtctgtgagttcagctgttggtctccttttgagaacatgacggttttgcaaaatccacgttacccgcccctcagtggatttcatggttctgagccttttgtaaacagctgcacaaaggtctgaatcccactgactggatttgagttgacagtcagaggatttgtgccagaaacgagcgtgcaaatcccgagatcagcctcggcataaagagacatcgggaacggatttctttgtagatgattatgaactgattttccattgtccctcctgctgcctcctgagcaagagtgaaatgtgaatcaaaagaaataaccgtgtttgaaagcagaggagaaacgccacagattgctgttatgtacaacatcagaaaaagcctgtatctaattagcatatcttgaaatattatcggtgtccacattcacggcagatgatggcgaagggatgacctgcaggattgatggcagagcaaaccccaggcctggaggcctgaggagggagcgcttctgaccactaaaggggttaagcctgtgttttccctggagcgtgagtcagtggagcttttgccagctgacacttgcattgttctcctgtgaataatgttgtaaagggtgaccaggctgattctttctgaaactcagtggtttaacccaggcagaggagggcctcagctcagccccttatgtgaagttgaaaacactcataaaatgggtcactggacttagcatgcgtgtgtgtgtgtgtgtgtgtgtgcgtgtgtgtgtgtgtgtgtgtgcgtgtgtgtgtcttcctcttaattgtttttcctttttaattgtctttcttttttaaaattaaaaattcttcttttactctgaatcagtctcttaagtttttgtttgtttgtttgtttgtttgtttttgagacggagtctcgctctgttgcccaggctggagtgcagtggtgcgatcttggctcactgcaatttctgcctcctgggttcaagcaattctcttgcctcagcctcccagactagctgggactacaggtgcccgccaccacacctggctaattttttttatttttcagtagagacagggtgtcaccatgttgcccaggctgttctcagactcctgagctcaactgatctgcccgcctcggcctctcaaagtgctggcattataggcgtgagccactgtgcctggcccagcctcttaagttttcatcattagatatcaagcagaagcaaaggagtcttctttcttttttttttccccttaaaaaaaagcctgcagcacctgctattcccaggcggtctcccatccaaatactaaccacgcccgaccctgcttagcttcacgagatcaggctcattcagggtagtttggccatggacagcaaaggagtctcaataaaacatgttaggcctgagggaggcacggtgagcccccacacagagcagaccatcagttaccgaggcgcttgcagccttctgggaatggactggtcccggcccttccctgtcctgggagcgagcactgtctgcggtgctgagtctggttccctggcctttcttcatggtttccctgcaaacaattgcaaccttccatggtgtgtcattcactttgacgtttgtgaactttatataaagtgggccatgacgcacattcttctgcagtttgcttctgggacccgtgttagggccctgagagctatttgctgtgtagagctgtgttttcattgttgtgaaatggtatgagcataccacagtgtatccatacttggataaagacccttttttatttctaattacaattaggtttcctcttctgtcattttcgggatgtcttgtattagactagaggtgatatggtggtttgatgctattgctgacttatgactttttggtgtctaaagtctcttttcacctgttcttgttggattccctcacccaaaggcagagcttggacgtgagatccacgccctggcatcggccagcaagcccctggcctcgtggaccacccagcaaggaattcaggaatgccgggaggcgtgtggaggacacggctatctggccagtaggttttggagaagcgcatggtggtttcctgtccttagccctgctgtttgactctagaccaggggtcggcagactgcggcctgaggaccaaatccagcctgccacctgtttttgcaaataaagttttattggaacacagccagccacccccgttcatttgcacatttcctgcagctgttttcgcactgcaagggcagagatgagtaatcgcagctgtgacagagaccatgtggcttacagagctgaaaatatttactctctggtccattgcagaacaagtttgccaacccctgccctagatagatcccactgctttcagatgcctgatgcttcttggccaaaatataggcagagagcagctgatctgctcatttgaattttaactatttggttaacagcttggtagtaaactagcaccatgttttgtttgaatagaaaattcttacacttagataaagagttagttatatcggcattgatgatgactgaggcagctgttatatggttaagagcggaggccaccagcttgcctgggattgagtcctggctccatctaacagcctggtaactgtgggcaggttgcttaacctcactgtgctcagttttcttatttttaaagtgggggtgataatagtgtacccacaacataggttcttgccagaattaagtgaattaccacgtatgaagtgtaagcatggtatctggcatgtagtgcgtgcccaatgacttttttatttgctaatgctgttattattagaattatcatcagcattatttacagcttacctgcaaaacttcccgtgtgctaatcttaaataattaactggcaaaaactggttgctcaaagaaggccatgtacacactcaaaacagccacagcatcagcaaaactctcttgccctccaggagcacttggtccttgccaagtttgtgagagtttttgtgatgctctatctagaactacacacacactttcagcgatcatccgcccaccactgcagttctaactcgcacctgttccagcatgggctgttagcaacgtggcccctcactcccaccacaatctgtctttgtcacttactgacatgcgggtagccatggctgtacacaagttactcatttgcatgctttgtcctctgcgcaatgcccttagtagtttttgtctttgtaactcatcgggattctataaatagttgaataaggaaattgaatcttgcagtactgcagacaacaaagacgatggaatcaagattaatacatatacatatacatatacatatacatatacacatacatatacatatacacatacatatacatatgctgggattgagaccaatatgaccgaggctccatctaggtttagaaaatcaattgcaaatgtttctgctgaggcctctcccagctcttgttcagtggccaacctgttacgtggcaggaagctcgtggcatgatttgacagtaagtcaggagaaaatcaggtgttctaggtgatcacaaggctaatcacaagcgtgttggcagtatggctgcaataggactcctttcatgctctcaggatccatcagtcacagtacgtgagtgtgagaagtcagctccactcccttcctgctaggcccatcccagcctcacattcagagaacactttccatcacagtaggcaggctcaagtgtgtgagggtctggaaagcaagcctgacaacatatgtgaaggcatccagctaactgataggaaagacaaaaaacagttatcttgaaatttcctgtgttaaaagaagagttcattcagttatggacggaagaagggtagccctgggggcatcagctcgctgagatggctccctcctatcagcgaccccatgccagggggggctctgcagggcttgctgacagcagtgaggagctggaggtgggatatgaagcacaggtggcagttctttgtgtctggtcaagctgagttcagggcttttttttttttggtcagagtcttgccctgtcccggaggctggagtacagtggcatgaccatggcttacttttgcctcaaatgcctgggctcttaagcaatcctcccacctcagcctcctgggtagctgggactaaaggtgcgtgccactatgcccagctaattttttttttcattttttatagagatagggtctcactatgttgcccaggctggtctcaaactcatggctttttttttttttttttttttgttgagacagggtcttgctctgtcacccgggctggagtgcagttgcgcaatctcggctcactgcaacctccgcctcccaggctcaagcgattctcctgcctcagcctcccgagtagctgagattacaggcacacaccaccacacctggctatttttgtatttttagtagaggtgggtttcaccatgttggtcaggctggtcttgaacacctggcttcaagtgatccacccgcctcggccccccaaagtgctgccattacaggtgtgagccaccgcacccagcctcttaaggctttttaaattctcacatagtgacaggctgcttctcaaatatgcgtcttaaatgatggtactattgtggctttgttgcagtgaaccggttgggtgtccttagagatgacaacgatcccaactgcacatacgaaggtgacaacaacatcctgctgcagcagacaagcaactatttgctgggtctcctggcacaccaggtccacggtgaggctctgctgcacactggtgggggcgctggaacccaactggggcaggggtgggttctcctggcctcactgattcagctgttctgtgaatgcatcctaggtttgcagaaggaaagaaatgttattagatagtgccgaccaactccccaaggcatgggcaaaggctggggtggggagggtccttgagacccagaccctcgcctgtgggtctgtggccgtcgggtcctctggacactctctgtgctttggggtgcccccagcttggggttcccaatggtttgggttcccgtcttccaccaaagtcactggaatgtgtgtcctagatggagcttgcttccgcagtccgctgaagtcagtggactttctggacgcctatcccggcatccttgaccagaagtttgaggtctccagtgttgccgactgcttggactctgcaggtaaacacacaggtggagggctcccctggcctcctgattttctgtcattcccaccaggaaacgcaccgtgcctcggtgaggggacccttggcagttccagccggggcagcagtggtggtgggaggccccgcatgcagcttgtcctgggctggctcatggactatctctttgtgcctgacgccgagttaggcgctgactccacagatgaattgaaggatgcccacttgccaccttataccttgcctcttgccttcccctcccataggataaagggcgtgagaggccacctggcctggtctctgtccactaagcagcctctgccccctgccctggtgcctgggctgctgctgtccctgggccctcccagccacctcacctgtcagtcttccccactcccaggccctgctggctccccaaacagcagatgccccttcccgccctggcgcacctcccgcacctccttcactcggcccctgtggcacaggctcatctcctgtgggtgcggtggtcggggtggggcgtcctcccagggccccgcacagagctggccacggacagcctcctgcaggtgtgtcatgggagctgctgcaggctccgcctcacccacacggggtctgtggctcagagaggtgggagcgagagctgggaatgaggcgcctggccgtgctggcagcatcgaaagcaaagcagcttccctgtagactgcgctggatcctgacaggggatccctctccggagagcagctgctctcgcgttcctgggttaattctgcacgtgctcgttatgtgctcactctgcagttctggggctggcggccagcatgatggagaacctgtgcctgccctcatgggactttacagtctagaccagcagacacagaaacatcccaaggcctcagtcttagggcagcaggaattctgcaaagcagtgatcctggctggtgaggtggagcgtggctggtgaccaccttgcaggggccttggcctttgaattgaggtcagtgaaaggcgggggcagccatggggacccccgatggacgggtgtgtcaggaggcggaggcagcagggcccagcccatgccgagctcatctcgatgtgagcatgcatctcgttcccctgctgtgaatgacgggaggtgagcgcaagaggcctggtggaaaggggtgtgctgtttgttttgatgattcatatttttaaaaatgttcctcatgggaaaaggccactctggctgctctgtggaaatggaggtgagaggcggctgggacaggtgagggggtctgccctgcgcccccacacagaagcacccagccgagctctgcgtgtcctacagggcactcctgaaggctcccttggtgccagctgcctgagcgcagggaggggcggagcgaggattcaaacccaagcctgtgggaccgcaaagctcgggatctctcgttactgctcctggatgcttcttgcccagtggtctgggtgcgatttgacagaagagcagggctggagctgcccccacctccatgccacccgtgtccctgtcaaatgccttcctcccaccacagcccccgtctgtaaagccgcgtatcacagagaacagctcaaagccgcagcaacgcctccatctcgccatcgcctcactcagcagtatttagtgaatgtcttcactttgccaccaaagcacctatttgtgcagaagagaagggccgagaggggtcccgatgccctgtcccggcgggccaggtagaaactgactgctcccgtgacacccgagacgtggaagagtagcccaccttcctgagtgagagagacgtcagctcccgccaggctgccggggttgatcccggtccctcctcctgctggccgtggaacctacaccaagtccctcagccttcctgcctcggtttcctcatctgcagcacggggacggggatggtacccccttcataaggtgtttgtaccgtggactgagttcatgcacgtaaagcacttagtgcagcacttggcgccacatcagtgctcagctcagcagccacagagtttggacaggaaccgccctcgaggtgccacacgttcaactgggcagatagagcggggacttggagatggaggatgctcttggctttgcattcaggagaccagaatgtgaggcttccctggggttctgggaggcccctggatcctcgggaggagggagcactggcctccctcatgcaggggacaggcacacatggaggacgcgttccagccatcaggaccgacgccgtggatgtgatagcagcccccgagcgtgtgtccttgtccgtctccagccctacaggctacttccttgttcacacggcaaagaacaggacaacagccgtggccgaagccggtgtggagcctgggccggtccggcttcccggcgccttcccctgcccgcaccgtcagcatcgtcatcaggaagcgtctgcatcactgcttgctttctcgtggtcactgcgctgggttacagcttctgacggtaactaaccgtgcagatcttagcctgcctttttgggtgccagtgggaaacggggacacgtttgatgacctatttctgatgtttgcaagtcactttctttttttttttttttttgagacggagtctcgctctgtcgcccaggctggagtgcagtggtatgatctcggctcactgcaagctccacctcccaggttctcgccattctcctgcctcagcctccggagtagctgggactacaggagcccacaaccacacccggctaattttttgtatgtttagtagagacggagtttcaccgtgttaggcaggatggtctcgatatcctgacctcgtgatccgcccaccttggcctcccgaagtgctgggatcacaggcatgagccaccacgcccggccgcaagtcactttctaagcttcccaaatgttgccacagaaagaactagaaaatgacctaatcattgtggtaacttcaacccaaccaatacctttttcctaaaaccatcactccttatattaataaaatcaaaacataaatgggacagccagcttctccatgtgcccatcacgctctgctcttccctccccttcccctgagactgaaagcaaaagcaattttacagtctctccatcatcaggaaagacaccaaagtcatctgcttttctgcaactgctctaatatttacaagatgcaacaaagtgaaaacgttttccggagtaacaaaggcaaatggctttcacttgttcaaagtggtatgggagagagaccgccattatccctcacgccgcagggaagcttgtgggttctgccagccccatcgtctcaagggcatttggtcacagatcccaggtctcagggctgactgcagcctgcgtcatgtggatctttggtaaaagctgtttaagtgatgtggggccctcaggctctgcaggactggagagacacaggccccttccggggttgcgcttgcctgtgaggaagggtggaggatttgccaagccaatggcgggtccttcaggggttcgattctgacttgggtaggggaggctgggttttctgttgagttcctctgatttttgcacaggcatttttgcactgagctgagtgtcacagccctgtgccttgggggcctgtgctgttgcttcctgcagtgggccctgttgtttagctggctcgtatgcattcatagtaagcagttgcagtgttcactactcggacacgtgtgtatttgtggactgcaaggtcatgggatgtgggccagaggtgacatagggtcatgtgtgagcagtggggtcacatggggtgagtggtgaggtcacgtggagtgcacagtgaggtcatgtgaggtgagcagtgaggtcacaggtgagcggtggagtcacgtgggggagcggtgaggtcacgtggagtgcatggtgaggtcatgtgaggtgggcagtggggtcatatgaggtgagcagtggggttcgtggtgcagacagtgctcccagagggtgggagcacaggctattgggtcagcactgccccccgctgtgaccttgagctaggctttaatctctctgagcctgttttccttctgcgagacagtggggagggaatgcggtcaccccatgccacctggcaggggccaggccatggtgccctcggtggggggctgctgcgtgtggggggccacagtcctgaacacttccttggaaacaacagatgcaggtgaggtctgccttggtgggtcagggaatgtctcccacaaaactggcacctgagggtgtctcagagggtccgtgcgttgtgcttttggggagcaccggccattcaggagcaccagagcggcgggcatggtcagacccgggcctgtgatctggctgaggagttggggccgctgtccaggccttgctttccagggcttgcctgggtcagaatccgagttaggagtgctctgatgctgacgcagaggggactggacccagagacgggagaggaaaccgagacccgaaaggcaggcagtgcatgcgaagagctcaccatggggtcaaggacagagccccagctggggagggggcagatcgaggggcagtcattgggtgcacagggcggctgggggcaccttcgagagtccttctggtgtgaggcacatggaaaggccgtggtgacccaggattctgggagagtcttgaggacagaggttgttgacgctgggtgtgtcctcaggccgccagcagccgcattccgagcaagagaattcactgcccgtcagtgcccgttttcctgcctagtttgtttcagcgatactttttcacttccacattaactctgaaaatgacacacacaacacccacctttcattgtttgctttcatgtgctttttggggatcttctcccctgcacatgaacacatcagactgacatgatttattttttcacgaaaaaccaagaaccaaaagtagagtgtaaggaaaaaacacagtgcaaacataactcatttctcaagcgtccctctcacttgaagcccacagcacagtctaactggccatcgacgtgaagcctcatggattaattctggttgcagagacagattggaaaactcgggtaactgccgtgaagtgtccaccgcagagggacacctcctggggcagtgtttgggaatggccaggacaggctgggagggaagcccagccatggctgatgcgtggtgggacacgggggcctctggtgtggtcagaaggaatttgcacaagtggtttctggccggaccgtttccttggttttgttgctgtgtaaataagtcgtgggaagcacaactgtacggcgtctacctttccttgctgttcgtgaccatctgccctgctggggagagcttgggatgttgcagagcctttaggaacaggcggtggtcacaagggcctcccctcagcattggttgcaaaatggacctgagttttccagtaaagtcctgaagggtagcatgtgaggctcaaggatgacccctgggcagcctgccagcagcagagagccacggcctgggcactgaagacagcagacagtgactctcttggtgcagaggcagaaaccccaagtcaggatggggcagggctacccgcctccctctcgtggtgggggggcttttcccgcccaggctcctggcagctccaggagttcttggctgtgggtgcatcatgccagcctttgcctcctctgtgactttgctgtctctgcatcttgtaaggacacgtgtcattggatttagaatccatcctagtccaggagtccctgatgacctcacctgaatacctcaacttcatgacatcttcaaagaccctcttcccaacaaaggtcacattcacagctgtgggggtcagttggggccaccattcagcgccccatgcctggcaggacttggcgaggggagccttggctccctgaagatgcctgcatggaggaagcctccgcccaaccctgcctgtgccctgcctgcggggtcagcagcacccgtctttccatcccactccctctggggagctgagacctccggcaagccgcctgacgtgtgagcctgggaaacggcctgctctggtttgtgacgggcttctcagttatgccgtgagggtgaacagatgtaacagccgaaagcagtcgggtgtgctgtggcaggaactgcaacgttgggtattttctttttttttttttttttttttgagacggagtctcgctctgtcgcccaggctggagtgcagtggcgcgatctcggctcactgcaactccgcctcccgggttcacgccattctcctgcctcagcctcccgagtagctgggactacaggcgcctgccactgcgcccggctaattttttgtatttttagtagagacggggtttcaccgtgttagccaggatggtctcgatctcctgacctcgtgatccgcccgcctctgcctcccaaagtgctgggattacaggtgtgagccactgcgcccagcaacgttgggtattttcttcccagtgacctgggctgtgtgacatagaaggaaatcccaagccccactgagttcagcctttgggctcagactcagtgtggctgatccccattctcctgcctgggatctctgagcaagaccggctgccaggcagaaggcccctgcagcctggaggtgcctcgtgtctgggcgccaggccctctgtgcctgggcagggggtgggtgtgagcgtggcctccacatgtgggtggtctgcacccctccctcacatgctcgccatgtacctgggtccctgggcccgtgtcctcatcagtggggtagtagcagtacagcctggtggggtctcaggaccatgcctggtccatacggagtactgtgggaggccagctctggctgtgctgtggggggccccgcagatgtgggcaccactgccaggggaaggggaggacgaaggggggtctccagctgtcctgcctgacaccccaccccggggcctccctgtctgcaacatctgctccctcctgcccttttgagctttgtggaaggggccacgcagggggtgaggccttaggttcccccctcccccaccatgtcagtccccagttccacagctccagcatgcggtgaggtccaagggccaggcagggggaggcgaacggaagcaccccttcctctcgccactgggcgccaccgccggccagttgtcctgctgcccatgcagtcctggctgatgctgtggaggcagcaccacgcttcacacagaccgagcctggtgcgtgcgagaacgtgcagccgtcccactcgggggcccactctagcggcggcaccgtgttcctgtggcctccaggctgctggaacagtgtagaactcaggacagccctgggctgagccaggaagtgcctccagccaggggggccctgggcaggtgccctccctgtgcttcagtttccctacctataaaatcagacccaccccatacacttggttgtcaatgaagacaacctggtacctgcaggatgctggcagtgccttgtccctgggggtgagttgtgacaaatgctgtgttctctattgttactttttctccttctgtttgtcattccgaagtcgccctggcagcatacaagtggctggtttgctacctgctccgagagacttatcaaaaattaaaccaagagaaaagatcaggaagcagtgactttgaagcaaggaacaaatgccaggtaagtatttgttttcaaaattcccttttgtattatttgctcttaattccccggccgttgtgtccctgggagtttgaacatcctggcaattcaggccccagaccccgagctcccgtgaccttgggcagatgacttgatgactttgctgcttgctcagctcctctgtaacacagggatggcagcacctgtcttgctgggctggggaggtcatggatgttacatttaccgtgcctgacggttcccagcccgtaaaccagagcggtgaagctctgggttgtgagagccttggatgcacagagtggcggagacaccattgcgggcactcagagcactccctcctgactcgtgggagtgatgccagcgccctgcttggttttccacaagttgctctcgccttcccgaggggctggggtggcaatggtgagtgggtcatcgttggccttggaaagcgctttggttctcacacttggacagggctgtctctcatgttccaggaagccacagggaaaaaatagcctgttataaaacaccttgtcatgccaggaaccttccagccctgtcccagccatctgccctagagcagagcccagcccccaccctgtctagggggcagccggtgggggcagtagggctcccggatgtgtctgtgggtgccatgagcactcttggctggagtgcgccagccctaaccatagctgtggggagactcaggccatgagtgttgtgcagggaggccgtggatacggagagagctgctgtcaccccttctccctagcgtcggttcatgaggttatgggtcaccttcagtaatgaagctgctatggggacccaggtccacatctgcctgtctctgggaaggcccagcacctcacagcctgctgctggggggcagccccgcccctcaggccagctcctctaggaacctgctagacacacctgccctgggatgaggagagaaggcaggaaggatgggctcctgtcaagctcaaagaaacccagattgggccaggtgcagtggctcacacctgtaatcccagcactttgggaggctgagacgggtggattacaaggtcaggagatcaagaccatcctggctaatacagtgaaacctggtgtatcctaaaaatacaaaaaattggccaggcatggtgtcatgcgcctgtagtcccagctacttggcaggctgaggcaggagagtcgcttgaacctggaaggtggaggttgcagagagccgagatcgcaccactgcactccagcttgggtgacagagcaagactccatctcaaaaaaaaaaaaaaaaaaggaacccatattgaatttataactgaaaagaaatgaagtcagcaggtggccagggtctgtaaaacttgtagtttagggccatggtgaccaaagcgtgaagtgacccttccagaacaggccgccttgtttacccaccttgggtgatacacagcaggttgggtcattcagaaaccagtggatgcctgtcagcttccactgctccctcctctgcaggccacatccttgcgttaaggtggaataggctgctgcactggctcatgtctgtaatgccagcactttaggaggctgaggcaggaagatcgcttgagcccaggaggttgaggctgcagtaggccgtgatcacatcactgcactccagcacgggcaacagagcaagaccctgtctcagaaaagaaagaaaacatttttttaatggaatagagattctccaaagagttatgaaacaagaaccccagagatggggggcacaaaaggacccccttcctaacaacacctgtgtctcttagaactgcccggtaggtccttagcacccccttccagccccgatctatgctggggacctggcatgtgtgaccccacaacaccccgagtgtgtggctcagctgctgagaaacccctcctcacctgtagcttttccttcgagaacttggtagcagaatttcacggagggctgcggcagaggccaggaggggtcctgggttctgatccggctgagacggtgaccctgggctgagctgtggagctgacagacacccacagacaccagccccaaggccttggagggaaaacagttgccagggcagggcttcgtgttccagacctgccccgggtcgcggagcttttaagagcaggggacatttgtgatagctgagagcccttggggccctgggctgaatgctaagggggcccaggggagacgcagccccttcccctgcaatacggcataccaagaaagcctcagcctagaccagccttttcaggaagatgggaaccggaagctgttaaaaaaaccatcggatttggctgcataaaggttcagcatttctgcattgcaaaagacgctctaaacaaaatcggaagacacacagcagcctgtggaagcccacgtaacatgtcgccgacggagaacacccccaggaaggaaggaattccttcagatagatgccagcctggtcggaaaccagccccagcagccactgacctggagccagggccaggagctgcaggtcaaagccacacttccacaggcatcaggctgggcttgggcagcagcaccgttcatggagagggtgatggctgtgtcctttgggaaggttactgaccatttttgttaaaaatgtgcttactctttgacctggtggagaaaatctattaacttttaaacattttctggctcctgccagtaactgctatccaccatttacccactgtaagcctggcatgcacagaaaggtctttaaaaatgcatttctctcattttttggctgagtgacacctttacatgttcaacagccagtagatacaaaagatgggtggtggcgtccctcctccctacctctagcctgggagtaaaaagatgggcgatggcgtccccgcagcctgcctccagcctgggagtaaaaagatgggcggtggcgtccctgcagcctgcttccagcctgggagtaaaaagatgggtggtggcgtccccgcagcctgcctccagcctgggaccaacccctgccacaagggctcgaggtttccttcagggatttgcacatcagaaggcggacaaggacgaggacatttgttctccctgagccacacgctggattctgtacctgggtcatttcacgttgtctactttgggagtgaaggaagttgaggccaagagaaatgcccaaggtcccccagctcgcccgtgccggggccaggattgcacccgggccagctgtcacagagtccaaccctttccccaggctgcatggctgcagtctgaatttggacagtttggggtttgtttttttgcctgaagtatgcattgcctcttaaaatgtacttcaccaaccagagtgtaccagactgggaccctctcctctctcctgtgctgaaggtttacggacagctgaccttagctgcatcgagcctgagaagtgcctgtcacagtcctagctggggacagtttggcagctctggaggggcagctgaggtggtccagaagatccccctagagcagagcccagccccgccctgtctagggggcagctggtgggggcagtggggctcccggatgtgtctgggtgccgtgagcactctcggctggagtgcgccagccctaaccgtagctgtggggacactttgtccgtgggggagggactgcacctgaggcattactgtccccccgggtcgccagagtccataccgcatgggatgcttcctgggccccagcccaccttggttaatgctgtggtcagctctgctggttgccatggcagacactgtttagggagcccatccccagagcctgtgtcccccccggtgactgctggccttacgtggacctttcctggaagaacagcgcagtatcatgcaggcaaatcctggggactgagatgccgttgagtacagtagagctgccatcgcaggcgcttcctgtgagagagccgccctgaccccagcagcaccacgcaggagacaacgctgaggcttggagccatgacgccttttgctcacgcgcagagctgcagagccgagtgacgctgtgtttcaaaactcactggcactcgcgatgcattatttgacagcagcaaggttccaggaggggctgtctttctggcccccgcagcatgtctggcctgtgccatcgctgtatcaagctgtgtcactttcatggaaaaacactgaagcagtgccgctctaacacagcaactgtgcaggcgacggggagagtggtgcggggcacagggctcactcagattcggttcaaggacggcctctctgtgcctgggccctgctgggattggcctcatctctgggttcgcagaggacccatggcgagaggagaggccctcgtggtgtgggagcacgttttggggtgtgggcaggattcaatggaattatcgtgttctcgtggacacaggagcagcctacgggggtgcagatgccgtcacccgcttgtttcatggaaggtggaaggaggaagggctgaggcctggagctgcagcaccacacctggcagctcccccacaggcctgtattatcagcctcctgccagaggcctcaggtgggagcctgagggctgccccacctcactcggcagggctctgggaaatttgggtgctagtcctacctagctggggtctgtcaggcagtccctactgccccagagcaagtccagatcctgccaccagccctcactcaccaaaaccaaggcccagagctatagcgcatgtgagatcagaagagggcaggaagccccaaggccccatgctggcatgctccatgctcagacagcagggagcaggacgggccttcctggcaccgacaggacggcccacccaggagtgtgcggggcccagcgggggtcttgggacaggaccagtcagcctggcatgaagcacagcgggaaaggcgcttctcccggtttctgttttcccgaggctcctgatcccagcagggccctggaggacactggctttgtgactggagaccctgctgccgtgtgcttcaccctgctgtgttctgggaagatttggggcagcgtcatagcagcgtcataggccaggcatgcagccgggtcctcctgcagcagtcagtcccccatacaccatatttcatcacttggctggatttttttttttttaattttaaaagtagcacctgctcatcctaacaagtcaagcaatgcgtgtgttgttttcctaatttaaaaaatctggtaagatgataaatgggagacagggaaagaaaggctaataagtgaagttgatgattatcagcaaatgtttttgatattcattaaaaaagaaaaataacagatgctggcgaggctgtagagaaaagtgacacagatacacggttggtgggaacgcagattcgttcagccaccgtggagggcagcttggcaatttctcagagagctaagagttgcccttccccttgacccagtgatcccattactgggtatacaccccaaagaaaagcaatcatcctgccagccagatacatgtacctgtatgtccatcgcagcgctattcacaatagcaaaaatgtgaaatcaacgcaggtgcccatcagcggtggactggataaagaaaatggggtacatagacaccatgggataccgtgcagccatcactacgaacagtcatgtcttttgcagcaacatggatgcagctgcacgccattatcctcagcagactaatgcagcaacagaaaatcaaatgctgcatgttcacatgtacaagtgggagctaaacatggggcactcatggacataaagatgggagcggcagagcctgcgggggccttacggcagggggagagggagagaagcctgctttggaggctttggaggacggggtggcagatctttggagaagtgaagtcaattctgagctcagggaggagcctgacaagccccttctccagctcctctgtgtcttcccgtgtggaagaagccaggtcctgggcccttgggggcctcctggtgggcgcccactctgtagccgcagagcatcccgaggccggctccaggctccgtatgcagtgctggtgccaaccccagtcccagacgggagctgagctgagactgaggccttggagggcgtcggtggagccagagcagtcccagctccatcttcataggcctcttccattgtgttctggaaacatgtctcgtgctgcgccgcatctgtgctctgcctcaccttatgttactgtcctaggacatgcacgggaacgcagacccgcgttcgtgtttcctgagaacttcctcccccgggaatctgggcggggctgggaccctcacggtcctcacggtgccgtcctgtgttccaggtgtcccacggccgtccgttggcgctggccttcgtggagctcacggtggtccagaggttccacgagcacgtgcaccagccttccgtgccgccctcgctgcgggccgtgctggggcggctcagtgctctgtacgccctgtggtccctgagccgccacgcggccctgctctaccgaggtgaggcttctgactgcgggcttgctgtcctccccagagtcagggcccccgtgttgtatctaggaagctgcttcctgcaccatcgtcctccttccacgggactcactgagcacggcggatggcgctgtggacagatgagaagcccagttccataatgagaagcatatggggcagagcagcgtcagggtggtgccgagaaacccaatttttctttcacttggggttcggttcagagaacacttccagaaggccccctcatgccaggcagcctgccgggctctgcagagagcagaagcccacccactaggtcccataaggcacagacagacacgagccaggagtgcctagacttgggaatactggaaggcttcctggaggagggggtgctggggctgattcctggaggattggtgggaataggctaaaccaaagtttgtcaactttttgttcgtctttgccccccaggaagctttttaggtggtttttcccaatggctggcacccatgcatctttggtactaggatacactgcatatccattcatgtcctgtgtctctgggcttgtgaagaataagatcctccccaccccaagagccagcgtttaccccctggagggtggtgctgaccccgtggaggccttgacagtgctcaggtgcaccaaggaagggacacaagtgtctgccagagagggcgggcacagggcaggagccccactgctgcctgagaaaaaccctaagtgatgagacacagttctctccagcggaaatcacagcaaacgcagatcccaccacagatgtgctcccgaacgcacaaggccacagccttggacctcttagggccctgccagaaaccacagcggctggaggtgacaccaaggaccaagtccccctgcggcctctgagtccctgcaggtgcccaccgcccccaactcccctgggtggtcccaggcaccccctcgcccctgcgccccctgccatgcacccctgcttcactctgcccaggagccccttcctcactttctcccgaggaaggaacccgcccagcctccctgaaccccagcaggtatgagcccagcggccacctgtcacctctgagcctgggaccttgcctccctcgctgccgcgggccagagaccatcaatgcctgagtgggaaaagggtctcagaactcggcccctgagcagcacattccttgggtcacatctgggctggggacagcaatgacactgatgtgttcacccaaaacaggcctcctatatggccgatttggaaagtgcactcagggcatgttggtattgggggtggttttggactggacccagcccccatgtgaccgaggctgtgcttgcaggaggatacttctctggtgagcaggcgggagaagtgttggagagcgccgtcctggctttgtgttcccaggtgagccgtgggtgctgtcgcgttctctacatccatgttacacaaccgcccagagcgacacgcatccccttagcatcacccagaccgacacgcaccgccttagtatcacccagactgacacgcacccccttagcgtcacccagagcctacacgcacccccttacccagaccgacacgcacccccttagcatcacccagagctgacacacaccgccttagcgtcacccatgagccgacacacaccgcctttgcaacccaaacattcacgtgtgttcggtgtttagtaaaaactgtaggattacaagaaaatatggctacatcagaaatttttgcaaaagaaacctgtcggggcgtctccagatctgcacacacccaggccctctcacacaccttttgcagctactttgagaattctctgagcattcgggggactcagcctccaatttaaatttgtttcctggcagtttccttgtttattatattcttttacctatgtcacccaggaaatcagagggccccaaccccacattctgatccggcatctctcttccatccggggacagaagctgcagtgctgtgctgtttagcacggcagccgctgggttgggggaaggcggctgtgtgagtgagggtctccgatttcctttcattgcactgattttgaggagccacttgtgctggtgctggtgctgctgcggtgggcagggccactgtgtccgtggagacgtcattccacttttgctgctaggaactggactgagtgctgctgcattttagcacaatgtctcaggtgactgcagacgtggcctttcatctcccctgtcactgctttcacacttgatctgggaccagtggaacgtccctgtgactggctctgagcctctctcgggattcgttgtataaagcccttccctgagcctgcggttccggagaggggcgtgtctgattgtggcgcacgtatgtggccacatttactcgtcttaacatcgaactggccacagggaggggttttccttggctcctccaagagccaaattttacccccttggggcagtgttgaccccatggaggccttcagagtatgcaggtgcaccaaggaaagcacgggggtctcctcgccagagaggggggcatagcggggaggtgttgttgataaaaagtgtccgggtgtggtggctcattcctgtaatcccagcactttgggaggccaaggcaggaggatcactggaggccaggagttcgagaccagcctgggcaacgtagtgagacttcatctctacaaaaaataattttaaaaaattagccaggcttggtggcacatgcctgtagtcccagctgctcaagaggctgaggtagggtggcttgagcccaggtgttcgaggctgcagtgagccgtaattgcaccatcacactccagcctggacaacagagcaagaccccgtctcaaaaaaatgaaagccacaactgatttcccagtgaggctatggccaaggctggatgaccgttgtgtgccactctgtgtgtgcccatccataccactgtcttggggaggccaaggtcagccaggtggagaagttgccagcgatccactagaccagggccagcaaactcagtccaatcctgccgttcacctgagtgtcgtctgtgggtgcctttgtgcttccacggcacagtaggcagttgccagagaccgtggcccgcaaagccggtaacatctcccacctggacccttacggaacacgtttgtcgggctcagcgcctgtgctctgccgagagcttctctccgggagcagtggcatttgtctgcggcctctgtgctgaggcacgtggaccaggaccaggtggccacgccctgcagagcgcggcgctgaagcgcagaggtgcactcagttcctccattgtggcctttcttactctgtactgactgattgcctttgatccatatcattagcggtgtctcccattcctgggttctatgcagtgtagccacggcatttcatcatattttaaggataatttttgttttgcatcttaagaaaattcttgagagtccactcatataaatttcatgtgtcatattgaagaataatttgtccagtggaatgggagagtaataaaaccaccgccaaccgaggaggcttcatatgcttatggcttttccaagtgctcataaatgccttctctattacatgttttctgaacatattttcctttactggaacagcagttgcccagataagccaaggcttagaaacgagcctctgaatgcagttgctaattcacgagcttcagggtcgtcacttttaagggccttttctaccttgttgggaagaaacaagccctagaagtcctgagtgaaaagcagcatggtgagaacattccagtgcacagcaagggcctcgaatccaggccggtgaagagatcacgcatgggcagcagagccgcacgtgccgctcaggtgacccgttgctagtgggtcctggcaaccacacacggggctgttatgctttggtcaccatggaaattcccgggaggtgccaagtgtctgggctttgttttccaacagctgaaagacgatgcagttgccctggtagacgtgatcgctcctcctgactttgttctggactcaccgattggcagagccgacggcgaggtaaagggaggacagggcctcacgggagtgccccaagggttgatgggcatttctgcggagctgagatgctcctgtgggtcaggggtctggtgtcttctggaaagtggtcacacatggaggagcttcttggggagggcccgggacaagtcaggactgtctcactctggtgcttccccatgctggctctgtggttgcaggggacttgcccatcccctgcctgccttttcctcccgagatggggtggtggcactgcccgcctgcacaggcagaggttggaggtccacacactgtgacctctgccctcctcccactccccccggcctccccggtcccaggtcttacccccatctgaccatgctcctggccctgcaggcctcttcccccatccctgtcctggaatccccaggcccctctgtcccctctgaccatccatggttgtcaccggggttactctcccctgccccgctttcccccaaccgcctccctgtggctcctcagctctcctcctgccccccatgttccataatgattccttcatagcagatggggtcaggccgcccccctgagggagcctccaccagcctcctcgactgcctgccacgccccagccccacgcagccactgaatccttccaaggcccttcaccccacgctcccctcctgcccaccagatctagccttactggcctccccgtctgtcgcgccaggcccatgcccaccccagggccttgtgcctgctgctcgggctgcctggagtgccttccattctttcagtataagctgactattgctgccttggagaggccttctctggcctccagctgaggcagtgcccccaggcactgtagtgctgcccttgctggcctcatcactgaccttgtgtctccctcccacctgatgatgccctcgaggagcgatgctcacaggtccactgggtgccttccagcaccccactgcttatggggctgtgtctgtcttctgctagagggactcggcgtgtcaatgctcatgtcccgtgcctgaggtcccctggctgtgagtcacagaggggtttgaccccatccctgccccctggccccgcaactgagttatttctgctgaagcacctgctgaagcacctgggtctctgcccaaatggagattgagccttagtgggcaggaccctccctcagtcctcagggaatgctgaagtctgtacatgagcccttaccggcttagccagggagggcccagcgcctggcctcagcgcggcccaggctacacctgggttgggctaggtgtgccaagaggcaggtagtgccaggagccgggtgggcagggcaggaggtgagagttccccgtagtaggagaggcagggatggtcatctctgcagagggcctgctgtcctgcatcggggactgaccactgaccatccccagagcccatacagcccagatgatgactgccgctgagagctgagagccagagaagcccagtgggtttcccagccagggagtggcagagccaggatttgaagagactgtgccctgctgtagggagagaagacttggcgggagccttgggtcctgggggagcgcataggagagggacttgccctacccaccttcctgggagaggcagtctccccaggaggtgggggctcaccaggcagacaggcattcgaagggacactggagccagacccgccatggaggacccccaagcacacgggactgtctgccccgtgcaggagaagccggagcggccttgagcgtctacctgctgcgccttgctctgcagaggcaggcccgtctctgaggcagggaacgaccaaggaaaggagagaccttgcccatgatggaggggccccctggctctgggttccatagttaaaaccagagccagctggaggtgtcgctggcaggatggtttattaaacgtgcattcctggctgagcatggtggctcacacctgttatcctagcactttggaaggctgaggcgggcggatccctttagcccaggagtttgagaccagcctaggcaacatactgaaaccccatccataaaaattacaaaaactgaggtgagaggatcccctgagcttggggaggtcgaggctgtggtgggcagtgatcgcgccactgcactccagcctggccaacagggtgagacctcatctcaaaaaaaaaaaaaaaagtgcattccttccagttgcaaggaactggtgtattaaccaggagctgccaggtgagaaattcactataagcgaacaaacagagctgcaggggagttgagaccatccttaaatcaagcccgctgctccaaactgtgaaacataagctggaacctaggccctgtggagcagcagcctgggtctgtgtctgtggagcccagagtagcagagtggggaggaggggttgctaagtgcatttagcgggtgcaggcagaggggtttcttctcaataaaatgggtcagcgtaagctggatgcaaaatagaccacctccccaggccctggagatggtctgggctgcccctttccaccctgcacgggtgaagtgtctgctcagctgcccttcgcccttcatttgtacaaccttcctccaagacaggagcgtctctccccatcttcccagtgaggccacttaggctgagagcagtgaagtctgcacctcccgtaggggagtgctggcccggggcaggaccagaggagcagggtgtggtggcccaggtccagaaatcagccagtaagggccactcggcgagggcatcctgctgctggtggccacgtgccacctgtgcggcctgtagcggcctggggtgtgagagcagatttcagagcagcagtcgatgcagccttgcagcatcctgcggtggctgcagttactaagaaacagcgtgtccactgccacgatcagttctttttttttttttttgagataggatctcactctgtcacccaggctggggtgcagtggcataatctcggcccactgcagcctcaacctcctgggctcaagtgatcctcccacctcagcctcccaagtagctagaactacaggtgaactcctccatgcccagttaattttttgcttttttttttttttttttttttttttttttgtaaagatggggtttcgccgtgttgcccaggctggtctcaagctcctgagctccagtgatctgccttcctcagcctcccagagtgcagggattacaggaacgagccacctcacccagccaataatttccaaagaagagggcgaggggtgattttcattataaatgtgttttatagtactttataattgaattgtcctaattgttttctactagaaaaaaaaagaaaatattcatataaatttaaaccattttaaaatttctctaaaaagtgacagagaatttcctgtgcttttttgttattgttgttgttgtttgtttgttttgagacggagttttgctcttgttgcccaggctggagtgcagtggtgcaatctcggctcactgaaacctctacctcccaggttcaagtgattctcctgcctcagccttccgagtagctgggattacaggcatgcaccaccacacctggctaattttgaatttttttttagtagagatggggtttctccatgttggtcaggctgatctaaaactcccgacctcaggtgatctgcctacctcggcctcccaaaatgctgggattacgggcgtgagccactgtgcccagccgaatttcctgtgtttttaacaaaaactttgaggagttgcatttgcacactcagccatctaggaatcttttccttcttatttctttgtcttcacttgctgtgtacgtgttgtttgcagctctacaaaaacctctggggcgctgtcctgcaggaaagcaaggtgttggagcgggcatcctggtggccagagttttctgtgaacaaacctgtcataggaagtctgaaatcgaagctctagtgggactggcacacattcagccaagtctaatgaaacgaagggaactaatcagacgtggacctcaacttctgattccagaacacaccggagattgctgctgctttctgagcccgcacctgtgcgcctaaactgctgattggcctcaactgcccaggcggacgggagggaggcacccggccggctggactaatctgggatcgcggtgatttgcagcgtggaaaagaaatgcagatgatcatgtctacctgatgcgccgtgggttttttgataattagaatttcgcacattcagttttcagggttcagctcctttctctaaagtaaacagcccattgtcagggatcttctggtcagacaacctgtgattcatctagattttttaccgagctccacttcattgagaagtcaatgatgccagtctggttctttgtcaactctccctcggctttgtcacataattgaattatgtcataaccttattaatttgcacatagatcatctgaatgtcgtggtttaagacttaaggaggaacatctgtttgattactttcttttgtggaactggaaatttccatcgaggaaatgtttttttaaaaagtctaatgatttgaatgggcaattcagtctccaaccgcccccctccccctgccgccagttatatacaaatcactttattggtaacatgtatgatctgtttgtccctgcagagtctacccagcaagtccttgcacacatgtggcctgtccccatggcgctggccacagcctgactgcagcagaccggggccatcagtgcacgcctcccccggtcactcctgctccctgcagggccatgggcttggctgcccttcccagtgttaggttcccggagcagttctgtctttgcatctgggtcctgcttcttaacctctgatcagctcagggcacggaaggccttcgtcttcagtagcagggagttgggtcactctggtgccccctgacccccgtggccacactcgtatcaccacagcccatcaaacagatgtaacccagcatgtctcaggacggtgccgaaccaaataagaccagttcttatttttccaggtagcccagagaacttttgagcgtctgaagggcatggtccagaatgtttttaaaaactgaatttccagcactggaaatcacttctgaagccattttcatgttagaaaagggtcaggacaccacccccccaccacatcccacccgtctggggctccaggggcatctgaggggtaattagtgacttctttgatgatcacctaccgcctgccagcaccttactgagcactcaggattcatcatctcgtgggacgctcagccaaccgcgtggggtgagctgtgccgtttgctgcatctgcagagaggagactggtcccaataggctggacactgccgcaggcagacagcaggaggtggccgagcgggaccagaagccatgggacctccctggtgcctgagtgccccagcacagggctgagacgcaataggtaggtgctggtatccattgtcactcgaacccaggagcatccccacctgaattcatcttactctggtttagaagcttccttgggtttaaacaaactcttcgtgggttacatgtgttttgtctatgatactcttcctgctttcagagagaatgggaatgagagtgctcaggcccttgcgaattagatggagcagttccgagtacaaacccagagaacacgtcagtggtgcctgccagtgtcggaggggctcattccccactgaggctgccacccacaggcctcacgggcccggggtccccagccccactgcctgggggtcccagcccaagagcagttgggcctgcgtgggctgtcaactggggtcatgcagatttccaccaggggtccccctcataggatgcctcaggccgtgtgtgtgtggacggctcctttacctagacctgtagcttttctaagcgagaaggaacaggctcccaagtcctctgatgtgcccgcagctagattctaggtggtggccagcctgagttagagtcacggtcactcctgcctcaccaccctccagagcaggccccagctgtccttgtctcccaagtaacagctttgggcatctccggaggggttttcatgttttgccttttttatcacttgggaccttggtttgtggtctcgtccagcctttggtctgaaactacctgtttttctaccagcaggtcacagaagttgttcaaggtcaag

SEQ ID NO: 12250 - DNA, 28864 bp, Human
actgccaagtttatttcttcaccctgaactataccccagaccaatatattcatctgtttctttgacatcatcacttgcatatcttggacttgattattgttaacgacctcccgataatgaccaccaggaacacaactatagctgagcaacttggatgtattgcttgtttcagtacgtgagaatgcacaccatggggaaccatgggatgtcttaggaagagggtgttaaaaaggacttgttatagaatttgagtttgtgttaggagatttacggaagggtgcaagaaagagggactttggcctggattggaagctgtaaggaagcaaggataattctataattgggtattttaataagtattatgtagaaggaaggaagactagactgaggttaaaactataattggtaaagaagcagcaggcactcatattagctaggataaggagatatttgatcatttttatggcttgggcaatgttgatgttgtgtctgtgttcacatatgattatagagtgatcttacttttgtcttgatctatcacggtcacaactctgtcttgtctgatgttctgtgaaattgtttatgttcaacagaagaataccaatgcttggctgtgattgccaggccagctcaaagcaacagcaaaccaagctggtagtaccaggccatctcctggatgtcaaggtccgcttttctctttctcggtatccacactagaatccttgatttactctcttccacctcactcaatcaaaaaccattacctcacagacttcccttctatgtggcactaccacccacacatatgctagcccaaaacctaagattcactgttgatgatgcccttttcttcattttccatagccaatcaccaaatcccattgtcttctttcttttatttcttccgccattgttctggtccaaactaccattatgtttctcctaaacataaagtgcatcctatttcctctgcttccacacttgcccctctacaatccattctcttcataacagatagatcatattactcccttgctttaaaactttcaaatagcttccaattgtactcagaacaaacactaaacttcttaccctggctttcaaggaccctggtctggcttctgcctaactctccaccttcatctatctgggactatcttgcggctcactcactatgcttcccccacactggcctttcctgccctgcccctgcaacataccaagttcctctttctctctgcatttgccctatcctttctttgccaggacaacagtctccctaccagctctttctcatccaggtctctttgagagggcttccctgaccatctagatgccaccttcctggtcagtatttccctcaagtagtaatcaatgccggaaagaatactgttcatttattcatccgttattgtcatcgcttcattggaatttagcttcctacagggatggtgtttatcttgctcactatgattccagcccctagaaaaacccacctacctcatagccaagggctcagtaaatagtatacactgccttcctgccactgtgctaatttctactaacacagccacaaacaatcagcaattacattttctgcttgtttttaacggggaagtagggcactcaacgaaaaggaaataaaagcagagtcaagaaagtgccttttatccatggagtgcccaatgtgttgtgcggccggccacgtatatagggatgtgtcagcacctgagatttttccttctctgagctagcttctttcctggaaatcatgctgggcccttagccttatggttcaccctgttttttaagatcatccacgggcttcattcccgtaaccgctcttctagctggccaaggcggcgggaagaaaccccaccctcttgcgcaaacgcccagtagcggaatccgcggggtcgagggctttagtgtgcgcatgtgcaaccagagcggcggcgggaagtgttgcgcaggcgcatccgatcgactcggtaggtggggatctcttggagacggcgacccaggcatctggggagccacagaagtcgtactcccttaaaccgtgagtttccgacggtttgttccatggcgcgggattgtgagggattaggaacgaattctggatcgtgacttcggttttctcgccgtgcagttccttttcccgccccccttcggatccctccgacctgcggcgggaaagtcgcgcgcctgcgcactaagcatctggttcggtctctggcccgagggaagccggtccttcccggctgagctcgcggccagcgctggccggcggattcccattcattcacccttctcctcctccgcccagtactcgtggccagggtcgtatcagttctccgtcaacttgcttggggccttggacgagcctcctggcgcttcctgtcagtggcgaaaaggttttctccctcagttcttttcctgacttcaaaccgcccccggcgctcggcccctcccccacgcggtcccgctggctgtgccggactggcagcctcgccgtttcccactgcgcctgctgctgcgcgggtgcccaagccgggaaattctccctgcagccccctgccggtgtttctgataggtgaaaataaagcacatggaattccttagacaaggccacagtatgccctactgtggaggtttggacacatcgtgcgtttgaaaatgtttgcccctttggggggcagtagcatgtttttagtgcgtggtttagcgagtgatctaaatttctctagtgttctaattttcacagctgctttgctccccctgtggatgtaaccccttagctggcattttgcatctcaattggcttgtgatggaggcgtctttggggattcagatggatgagccaatggctttttctccccagcgtgaccggtttcaggctgaaggctctttaaaaaaaaacgagcagaattttaaacttgcaggtacgtgtttaaatccaaagatgtacagttataaagatttttcaggcaacaattctgtgttttcaattcctctcaaaaaataagattgaatcttataaagtgaattgtatgtttctataggacagtgttaaaacagagcttcgtatgatctaaatgtaggactgaattgcgatttggaagactgtaatacaacctgttttacggttgaagttgctatggtctcagtattggtaattaagaatgcagaaatttgatgatgcccaaattaaatttctcttttgtatctgtgttcttatctctactcaccacattgccttaagcttaaatgtagaaattgacactggagatcatcacttaagtattcaaaagcagaactcacagacaaaaaaatatgaaatgtttgtagcaataataaagcaccatatctcagtgtacagcatgaaatgttctttgaccgtaaaccagaccttagggtgaataagacagggtcaagcagtgcctgctcttgtacactcgcatgtgtaccttcatttctgctctggcacaggacctgggacatagtaggtatttgttaataataaatatttgttaaatagaggaattctagttgactgtatttttttttttctgaaagggtagccagatcatctttcccatctttgtcttaagtgaattctgtgcttgtctaaaagatacttattttgaccttttgtccatatattctttataaccccaccctagaaaaatatgacatcacatactttctgctttgatggaagtcagttatcccacttacctaaacttgaaactttaatcttcagctgatgctttttatttgttccccatatcgtcacctagctttatttctttttagtaagtatggcattgtgtcttctttccattcccatttccaccacattaattaatttccttacactttgttcctgatttacaacagtttctcacctatgctgcctgcttgcacttttccatccttcagttcatcttgtatgttggtgctagaataatcttaaaatgccactttcatccagtttcatggatactgttcctcttcctttccatttttccagcagttagctgtttttttagttcatctttcccttactagtcactggacacataacacagtaacacagtcattgtagtattctttttctattgcttaggactctgcattttgtctccactgtaaaccccttggcggcagtatctcctctggtttctaaagtatgttgtgacttcagcagagtatctgaatggatgactctgaattggttctagcatcatgtttaggagaatgccactattctaatattctgaaaatctgctgggaagtaatgaatggggtgaattttattacggatttcaaaagttttgtagcgtttatgtaacagaacattggacattataatatgataaattataaaacgtgctaaaactttactcttatggttcttttttaaatatgatcttaataacagctaaagttatataaacataacttcaatagggagcaaagctgatgaggtccaggcacataacagtctagtaatctaattgggaaagtaaatcaaattagatcatgagacaggtatatgcctgcacctcatcaactttactccttattgaagttatatttttgattggatgttttatatatcttagcattcccagagcttaacagtgtccagcacatagtaggtgcttgaaaatatttgaatgaatgatttaatgtaaggatataaagtaaaatacttagtgtaatggatgaatagcatgtctctttattttgagatatttgtcagatttttataacatttttctgataaacatgattattgaaatttttgaagtaaagaaagccaaaataaagtcttttcccattattgaaatattgccactgttgacattttgttatattcctttagcctttctaggcatacataggtacattttttagaaactaaattgggatcttgttttgtttttgtttttgaaaagagaaccagaatatgggatcttatttctgatctccattttttttaatatatatcttgaatattgctcatgtagtaaatattctacaactggatttaaggtccattgcatattatattataatatattcaatcaccttttactattgaccctatagattgtttctattttttcctattaagaaaaatgctgtaatgcacaaactatctggcataatattggtcaaatgtttattctttcactgttttggcaagcttttttttttttttttgagacatggtctctctgtcacaccactgtcactggagtgcagtggcgcaattacagctcactgcagccttaactcctgcactcaagcaatcctaccccctcagcctcctgagtagcttggattacaggcatgtgccgctacactcagctaattttaaatattttttttagaaacaggatcttgctatgttgcccaggctggtctcaaactcctggcctcaagtgatcccctcctatcttggcctcccaatgcactgggattacaggtgtgagccaccatgcctggccagtaagcttttatttttttttaagtatctactatatgccaagttttaataagtgagaaagatctgttcagtgaaagaatgatgtataaactctatattgaaagtctcctccatactggtgaactctactggaaggaaggcttgcttcattctgtttgctacaatgacacccttagccatgcttctaaaatgggctatgggtaccatctttgtttgcctgggacagatctagcttacggctattgtcacaatgtaattattattcctgctgccttttcactcaagagtgtcccagtttgggcttatattatgtattatcccctagttccaggaggtataaaccagagagtacatgaagccccagaataaccatgactatatgcctagagtgtcagttttaatccatgacaagatattgaaaacgtttcatttatgtgatgaatatttattgtctgttatatacatgtacttttttaggtgctagggataaatcaaaccataaaacagaaattaacactgtggtagttagacaatagacagagagtaaacaaaagaagtaaatactgtgctcaaaagtgattaatgttactaagaaaatgtaaaagggaaggggagataggaagtattggggaaggagattgtaattttagtgagtatggttgctcatagccttctgtaacatttgagctaagacttcaaggtggtgaaggagtgacctgtgcagatatttggggaagagcattccaaacagaggaaacggcaagtacaaagaccctgaaacggcaagtacaaagaccctgagatgggagtgtgcctagcattcaagaatagcaaggaggtcattgtggctagaatggggaaggtaattggaatgaagtcaaagagagatgtaaagaggctttctaatggagtgagatgtgaaaccattagaggttttgagcacaatagtgacaaggtgacttagctttatcagaatactctgtttaaactctgtttgctatgttgcaagccgactggctactatgttacagatagactccaggctggcaaggagtgtagttaaggagactattggtatattaaaaccaacttggatatattatgcagcagaaaacaaaagtgacttaaaatgtcaaaatagaagcctagaccttcatgtataaaatagaggcatttaaataatttttagcatattatagattttcgggatcctcctccagtcctcaaagtctgtttcatttgtctgtctttagtactgttttccagcttttgacatgaatgcacttttctgctttctgctgtcatttcccacttcagaatttgaggatattgcattcactttggttgccaggaagttttactgttgtttaaaattgttgaagttgttctgaagtgacaggaaaccttaataaacattttgatttttgtaaagaggagtagatgcataataagtgagtagtggtgtggaagtacccttaatgtttctcctccctttcacatctgttctccacttgtcatttttctgcttaaaaacttcctatagctttcatgtgcattctctcttgtcttcctcagccacattctatttctattattgttattattgttattattattgagacagggtctccctcttccatcacccaggctggagtacagtggcacgatcatagtttagtaacctcaaactcctgggctcaaggtatccttctgcctcagtctctgtagctgagactacaggcccgtgttacaaagcccagctaatttttgtttgtttgtttgttttttagcttttttaagagatagggtctcaaacacctggcctcaagcagtcttcttgccttggtctcctaaagtgctgggattacaggcctgagccaccgccccaggccacattgtatttcattgtctctcagccctccccctaccctaatcatccaagccttttttttttcttgttcctgtctttacagacgtagttaatttttcctaaaatgttttcttccactttcactacttggtgaatgcttcagaacaaaacttagctgtcaactgaaggcttcctatcaccttcagaaatcctccccaacctagtagtatatacattcttttattacaggtgtcaccttgtattaagaatgataacatgtttcctttactagaccaagctcttagtggctgcatcaaatttattggttttttttacatacccattgctgagcattttttaagacagcgtttatttaaatgaattagttctagccaggtgcggcggctcacacctgtaatcccagcactttgggaggccaaggtgggcagatcacttgaggtcaggagttcaagaccagcctggccattgtggtgaaaccccgtctctactaaaaacacaaaaattagctgggcgtggtggtgcgtgcctgtaattccagctgcccatgaggctgaggcatgagaatctcttgaacgcaggaggcagaggttgcagtgagtggagattacatcactgcactccaacctgggcaacagagtgagactccatctcaaaaaagaaagaaaattagaaaatatatataatcagcaacacctctgtgaaattgggcaaatgatttaacctccctgaattgagtttccttatctgaaaaatcaggataatcattcctgctctgccaagttcacagtactgttaggaagacctcaaaagatactgcatgtgccggtgctttgaaaatgtcttaaacttatgctatatagggctagtagagcctagatactgtaataaaatctgaagacttatctagttctcttctgtatccagtagtttactgggttttgtattattgcctccccttgttttaactatgtacatttttataaagaactgatacttatttaaaagtagcaatttatctgcagtcaaggatagaggatactactggcaattgggacaaatttttaaaaatacttttttacatgcttgagagctttagtaggccttctctctgaaaatatagtgtgaatatttaatacataaaattttaccaagcctttaagattttgtatctttacgggaaatagttttcaagaacatcgcaatgtgtccttgtcatgccatctagtgatcacagcacaaattgtttagttattttaaaaatttggtgctttttcatgttgtaatctctacagtaacaatgtatctcttagtatataattccagtatagtagaaatttggtgtatttaattctgggactgtcatttttgtctgttcaagaggtgtgtgtgagttatagcaacttgatgggttttaatcttatcacaatgttattaaaacttatgtataattaattactcatattttataatttatttcattgagctttttaaattttaagaaactgtaaaatatactgtcattgattaaaactctaaatttttgtttccttgaaaggtgttaaaaaagatattgagaagctttatgaagctgtaccacagcttagtaatgtgtttaagattgaggacaaaattggagaaggtaatctggggatatgcttttactatttttacgaggtcttttttccattctattttccttttttagtcttggttttcattactatttcttattgaaaaatataccactttttagactattaagaccatagttttattactaattatggtaacagcttttctttttcaaccttaaagaaagaataaataataaatatttactgtaaaatgaagtcctgttttaatgtattatgccattgaaacagtttttacaatctatcttagaattgtttcattaacatttttaaaaaccagatattgaaaaatttaataaattgttttacaggcactttcagctctgtttatttggccacagcacagttacaagtaggacctgaagagaaaattgctctaaaacacttgattccaacaagtcatcctataagaattgcagctgaacttcagtgcctaacagtggctgggtaggcaatttaaacatattttaattgaacttgtatataatttataagattttaaagtagatatttagcagggatgaggggattatatgtgaattaaatacatttttcagtcaagtgtttgcaatttgctagcactttccttctaaccttgcaatagttagttaaatttatagtaattcttttagattggatttcccttgaggctcgacctgatttcctgtcttttatcactgctttttgtaaccttcctgccaaatcataaaccttggctttcatggtttacattattttgtaaatgtagggaactcacatttcacatttccccagctattgacgacctcatctaatattttatttagaataacagaatcatctggtatggtttctctctgctaggtcatttctgtcaacatatggacatgatttagaatcttaccctcctaaactgccctccttcttccacctgctccatcatttctttgttcccccttacagccagacttctcaaaaattatctgcatacattgttttcattccacacctctctttcactaaatacctattgcggctgttcttctctatgctaaactggaaactatagagtcaatcattactctaggcatcatttaacacaattgacgtgaacccttgtcttgacttctgtcctgccacaccctccttgttttcttcttccctcatttggcctttcattttcagtgtctttgctagctcttccacttctatctgacccctaaatattggagttcctcgtgcttgctcttaggtttctctgtattcttagtgtcctccatttccacatgatctaaagtaatgattcccaaaagtatatagttaatctcagaccttttatcttaactacaggtttgtgtatatccacctgcctatttaacatttccacttggtgcctgataaatatctcaaacctaaaagacaaaactaaaccttaacataccaaaaaaaaaaaaaaaaacaccacaacaaatgttcttatccacccgtctctgcaaatggcccatctacacacttgtttgggccagaaacctagaaatcatcctcattttctctatttctctcctaaaccacattaatcactaagtcctagccattttggctctaaagtatatctagaagttcatccatgtctttctgtcttctctgccactacctcagatgaagcctagactacgactgtagcctgcttcttccttctccccttaattctgtctttacacagcagccagaatgatctttaaaatataaaatatatatgtatataacttaaattgggtcattagttccaccacttaaaatctttcagtggtttccctatgtactttgaaaaaaaaattcaaccttctcatgcctatcttcccacctccctcactgtgctccatttctttagtttatcaaatttgtctcaagagctttcttacctcagggccactgcccagactgtttccccattcaggaagacctctcccagtcattgcttgctgacccttcatcttctgatctgagcaagagtgaaactggacgcagtagttcatgcttgtaatcccagcactttgggaggattgcttgaggccaggagtttgagacctgcctgggcaacctagcaagaacccatctttacaaaaaacttaaaaattatccaggcaaggtggcacacatctgtagtcccagctacttgggaggctgaggtaggaggatcacttgagcccaggagtttgaggctgtaatgacctgcgatcactccattgcactccatccagcctggtcaacaaaacaagaccctgcctctgagaaaaaaaaaaaagagtgacattgcttgaaagatgtcttctctgaattaaattagattctcctatttttttttattgtcatagcatctttagatttctttcaaagcccttatcgtattctgtcattataagttaccttgttattatctgtattgtccactagatagtaaactccatgaggacagaaattctgtaaattttattcactattgcatcactaatgtctataatccctaacagcaaataacagtgccaactaaatactgaatgaatgaataagcctgtttgtttcagccttctgtgtattatagaagacaagaaaatgagatggcctctataaagaatgcttgcatacattcttgtaccctaaatatgatcatttctttttctatacttttaactgtctccctctaccactttttctttttctgtgcttaaaaaagtacatgctaaaaatgccttcatctgatcttacaatgcagtcaggcaaattgtcttcaggctcagcttccattgtgttatattttccttccttctgttttgtttcttcctttccacttaaattgctgtcttaaaaattaccagttaattattctttgcctaactaaaagccttccctcagttgttattctctttgacttccatgctaataactcttccttcaaaattcctttcttatttggctctctaacttggcttcttccaagctcagttttcttttctcgctattaattttcatgtctgtaggtatcacttctctgcaagtactctcactgacttctcacttgtcttctcacttaaggcttagtcccttgtctagatatctctatcaaaatgatgaggtctggttttagatgcttcttttactggcttctctactcattttttggtatctctattgttttcttactcaggctcaaaatcatagaaatcacctttgtcctattttcctcttttatgaagcagtgtaacatagtgattaagaacatatatctggagcaaaatgcctgggttcaaatcctggctcattgatctattagtttagtgaccttgatttatttattactgttaccatcttatctgctaagtcttattaatcttttcccttttttctcattctgctgcttccccagtcacaactataattacctcgtttgaattattatagtaacttcaaaactggtgccatttttgttttaaaagaaaactttaacacgagaacacaagtcacttgtgtttatattatgtgatgatgatttaagtcagttttctagcaatatgtatgcattgctaaaattgcggtttttaaaattaggcataaagtttcagtccctctgacctttcttctaaaagttccttgtgcatttttccactagggggcaagataatgtcatgggagttaaatactgctttaggaagaatgatcatgtagttattgctatgccatatctggagcatgagtcgtttttggtaggttttaatatttcttgaatttttattagctaaatatttaattgcaaacaatatttgtaactcatttcatttgtaactttgttttaggacattctgaattctctttcctttcaagaagtacgggaatatatgcttaatctgttcaaagctttgaaacgcattcatcagtttggtattgttcaccgtgatgttaagcccagcaattttttatataataggcgcctgaaaaagtaagtatgaagagttactagaaaatatttatcctatttcttttaaaaaacaattttattgtctatatttaaggtattgaacatgatgttatatatagtacaaaagttactattgtgaagcaaatatttatctcagttacccatcttatttttgtttttacggcaagagcagctaaaatttactcatttagtatgaatctcatatacagtacagttttattacctgtaatcttcagagtgtgcattaggtctagatttatttatcctacatatctgctactttgtatcctctgacttatatctcttagatataatataacatactgcaatagccatgcacagattatttctgtttcagtttctttgtgattggaaagggaaatttggtgatgaagaagataaaattgtattagtggaataatgtacattattagatgtactatggttcagtggaaatagcatgaactaacagacttagagtctaataatttttgaccttagacatgtctcttatctctggacttcatttttcttttctagtaagtgaggggattggaccacatgatagccaatttcctgttttaacacaaaagttttatttttatgtatactttttaatgctgattataattatagagaaattataagctaaaaataacataaatacctctatataatggatcatattaaacataataatattataacttcttttttgagcttttatatgcctgactttttaattttctttaattggatcagattttaaaaccatgattttaatttttttaagctttcttaactagaaattatctgctatgatgccatctctgccaccatcagagaacaacggactgtgtttatgttatgtattcctcttctgccttattaacacagaccactggaaaaagaaaatttgattgtgggacaactcttaattttcaatcctggttagctgttaaattcttactttgtctggaaaacttatttttttttcttttttccagaatgttataaattcctaattgatcccaaaaagaattacagtttttatgaggatggtttgagagtattacaatgttactaagctttaattgctacagataagtaaaaatgcttaattttgtctcttaggtatgccttggtagactttggtttggcccaaggaacccatgatacgaaaatagagcttcttaaatttgtccagtctgaagctcagcaggaaaggtgttcacaaaacaaatcccacataatcacaggaaacaagattccactgagtggcccagtacctaaggagctggatcagcagtccaccacaaaagcttctgttaaaagaccctacacaaatgcacaaattcagattaaacaaggaaaagacggaaaggttctatctcttttatttcttaagtaccgacactgttttagaaatatactccttcaaccaacagagggagatagaatactaggatagtacttataatttaaaaaacttttttttgcatttgttatatgtattcatttgattaaattttcactaagatttgtactgaatcattttggttactattttaaaactaaaatttactttgtcagtttataacatctgtcattaactattatgaaatcatattttatgacaaaaatggaaaatattaaattttccctgcatgttaaaaagttcagattaattatcctttttaaaagaaagcattagttataggggaggaattctgaagtgtctatctccattttagctgcacagcaaaatgtaacatccatgcaggtggtttttgaatttttttttagttatatatatttgtggactatgataacattgtatgggtgttgagttctgtctagactattttctcctttcacagaagtggtttggtgcctgagaatgacttggatgcagctgtttttgtttcatctcacttaactctttcaaaactatggcagagtacagctggcagaaagtgttacagatataatccttattttccttgtttttgttggtattgtaggagggatctgtaggcctttctgtccagcgctctgtttttggagaaagaaatttcaatatacacagctccatttcacatgagagccctgcagtgaaagtaagtaatgtagcttaatagcataatggtcagtcagtcatacactgaagagaatttaggtaataactagattaacatttattatcagaaatttttttaaactagagtttggctttggcagaaggtattactgctttaagcatttagtcaaaacttgttttctccagtttttttctgaacttttctggtggaattttttctcatttttggttagctattactgtctttctctagaggaacatttagaacattaagggctttctgtcattgctagagtgtgagctccatacagttagctaactattctgacacatagttgatagtgtaaagatgtttgtaaagttaacaaaatcatcatcaatgtagatgatttcagattgacttatgatatcttgtgacagctagacagcatgagcaacaaattaaaactgtgattttagccaacgtacttgtgcagtttacagttctgaaatggagttagacactagaacataactgttttatacttctgtaatatatcaggaaaagttctaataaagtataactcaaatattggccaagctaggactaattagtaaattttaatataaggtgactttacagaaaaacccaagaagaccttaaacattttaatagacaacagtttatttacagtccaatagccattcagcagtttttaaagttatgcttccgctattgctttttgccatactagcattttaggacatcatgtttaatatcatgaaaatagaaaaatgagacttttcttttacagctcatgaagcagtcaaagactgtggatgtactgtctagaaagttagcaacaaaaaagaaggctatttctacgaaagttatgaatagtgctgtgatgaggaaaactgccagttcttgcccagctagcctgacctgtgactgctatgcaacagataaagtttgtagtatttgcctttcaaggtaatgtgttttgatggtgttataaaatcaccagcatgctgccattagaaattgcattgacttgggtggataattttgtgagtgcaagggatcagttcagatcagtgaactgcaatgggccttgatgcagagcagtagtatgttgaagagcaaatgataacagttttcatatattatttatttaatatggatatactctggaaaacacatttgctcttatatgcaaataagtgggacggggtggcttttagaagcttagaatcacacattttgattgctgatgtagtcttttctgttttctctttttattcccgcttatgtggagtaaccagaaccaaatagtagagctcctcttttactcccacctccaactctttgactcataaatttcttcctttccttcaaggcttggctttcataaagcctttcttgattaactcaaatatataagtgtatctgtgatcaattactccaaacaaatgaatttttatacctgtgaattgctattgggttctattttttctattatggctcttattatccactactgctttttattcttggaggttattttaaacctttctggagtaagtccggggaactagtagagggggtaaaaaacagaagaagaaaaatctaggatttttatcacactagattatcatttactttatagtaacacttattatataggtatcaaggcaaaatttactgtgaactaaattgatgaatgttattttttagacttacatagttcaactttaacataactagagaaatcttatttcatcataaggcgtcagcaggttgcccctagggcaggtacaccaggattcagagcaccagaggtcttgacaaagtgccccaatcaaactacaggtatgttgtactggaaatacagaacctagttaaaatggattgttccagacgtattttattttatgatctttgtctatttataactaatatttgagttcttctgcttttaattatgtaagcagttcttgcagtgtggcattcctatttttgagctaatgctattctttatgaaagtttttaatcctaatgttgcctctctttttttgtttaaacagtttattccatagattacattttgcgtatttatttacaagatgatcttaccatcttgtaaataaatacgcaaaatgtaatctgtggaattttgctgacatcacctttgtgggggaaaaaattatgtttaatagtttttgccagccaaagacttaaagcattttatttgcttgcttaatacctcaaaagtttcctgtgatgtagatatatttgtgtttgattaaaattacttttgttattatataaacaatataatagcagttagaaggttttgaaaaagaaaaatgtcttccgtaatctaaaaacttaccatggagctggaatccaggaaacatcttgaatgaatagatgaatcctgctattcacttggattatgggctttgaagaaatgtattcattcattgaatgtctgttcttgcttgctaatgataacaaataaataaatgagaccatctgttcacactctagtcaggacaccatcaaataattataaaataacctgttgagtatggtaataaaacttattcagggtatttaaggagtatctaactatcctaacccaaagagattatgaaaggcaattcatgaaagaaatgacctcttagaatgtaaattgggctgagaagttagcatagaggcatgagccaaggaactcaagaaacagcatacaggaaactaaaaaagtttcattttggccagacgcggtggctcatgcctgtaatcccagcactttcggaggctgagatgggcggatcacctgagatcaggagtttgaaaccagcctgaccaacatggtgaaaccccatctctactaaaaatacaaaaatcagctgggtgtggtggtgcgcacctgtaatcccagctactcaggaggctgaggcaagagaatcacttgaacgcaggaggcggaagttgcagtgagccaagatcgcaccattgccctccaacctgggcgacagcaagacttcatctcaaaaaaaaaagtccaattttgctagaatattaagatgcaagttgaggaatggtgagagataaacctggaatgaggtagacaaggtcagaccacagttgttacagtttggactatatactgtagatattggaaagttaagtgaaaaaagtgacaatggtatatcctagatggatcattctggcaggcgtgcaaacagattagcttttggagagtggtggcatgaatttgtccgggtgagaggatgaaaatgtgaatgagggtattggtaataggaatgaaaagaaaagtgaagggttagaaaggcagagcttggtggataattggatgtagaattagggtgtggtatggtgagggaaaaaggcattcaggatgtttaccagattcctagcttgggagacttggatgtgtaccagtaaccaaggtggagagtaaaggagaagtaactggtttataggggaaggtaaggttagtttggggtataattggtttgaggtatttgtgggacatccaaatagagatttccagcagaatcaaagttaagtctgatgctcagcgaaggagctgggctagaaatacagatgaatgtcatcattatataaatgacagttgaagccatgaagtggatggaccaatcagggagagtatacagagggagaagttaaaactctgaggaatatccgtcagcacttaaggcttggagaaaacattgaaggagcaggcagaggtaccaaaggagctaagaaaggcaagtagggccgggcacagtggctcatgcctataataccagcactttgggaggccaaggcaggcagatcactaggtcaggagttcgagatcagcctggccaatatggcgaaatcccgtctctactaaaaagtacaaaaaattagcagggcatggtggcacacacctgtagttccagctactggggaggctgaggcaggagaattgaacccgggaggcagaggttacagtgagccaagatcgcaccattgcactccagcctgagcaacagagtgagactcagtctcaaaaaaaaaaaaaaaaaaaaaaaggtgatacagtagcccaaggaacagagagcagataacctggtgatactaggaagtcaacaattaagagagatgtcaactttaagaaaaaaaaaaaagagctttttaacatcaagttgagctagtcgtaatctttaactaccagaattcagaagattaaagtttctatagtgggaatgtaaattagtacaaccactatggaaaacaatttggacgttcctcaaaaaactaaaaatagagctactacatgatccaacaatcccactgctgggtatatacccaaaagaaaggaaatcaatgtaccgaagaggtatctgcactcccatgtttgttgaagcactattcataatagccaaaatttgaaagcgacctaagtgtccgtcaacagatgaatggataaagaaaatgtggtacttacacacaatggaagtactattcagccacgaaaaagaagatcttgtcatttgcaacaacatggatggaactggagatcattatgtcaggtgaaataagccaggcaccgaaagacaagagttgcatgttctcactaatttgtgggatctaaaaattaaaacaattgaacccatagagagcagaaagatggttaccagaggctgagaagggtggtgggagggtgtgggggatgtggggacagctgatgggtacaaaaaatagttataaagaatgaattatccagcactttgggaggccaaggcaggtggattgcttgagctcaggcactcgagaccagcttgggcaacatggtagaaccctatttctaccaaaaatacaaaaaagtagctggatgtggtagtgtgcatccgtggtcccagctactcaggaggctgaggtgggaggatcacttgagcctgggaggcggaggttgcagtgagccgagatcacactaccacactctagcctgggtaacagagccagaccccatctcgaaaaaaaaaaaaaaagaatgaattaagacctagtatttgatagcacagcagggggattatagtcagtaatttaattgtgcagtttaaaataactaaaagagtactttgaggggctgaggcaggcagatcacttgagcccaggagcttgagaccagcctggccaatgtggcaaaacctcgtctctactaaaaatacaaaaaaaaaaaaaaaaaaaaaaaaaagagctgggcatggtgacatgcctgtaatcccagctactcaagaggctgaagcatgagaattgcttgaacctgggaggcagagattgcagtgagctgagactgtgccactgcactctagtctgggccacagagggagaccttgtctcaaaaagaaaaaaagaaaagaatataattggattgttcgtaacacaaaggataaatgcttgagggaatggataccctgttttccaggatgtgattattacacactgcatgcctgtatcaaaacatcttatataccccatcaatatatacacctactgtgtactcagaaaaattaaagtcttcacagtcacaaaaaaataaaaaagtaattttttaaaagtttctatagcagtagttggtgctagtgtcagctgaagaagagcttctaatgttcattacttttcactaaaatgaaagcactttgaccagtatggtatgtaattctcaaggatcattcagattttttcccacatagctatttttggattccttttgatcctataaaatgtgcgtttacttagtgtttcctagtgattaaatatccttttaaatttaccaacacgttgctcaagaaagaaaacatattttgcagtgaggattctcagtcctggttgtacattaaaatcacctgaggaacttttttaaaacattgatgcctgagccctacttcagaactgttcaatcaaaatctttgggtctgggcatctgaaatttttaaggctcccaaggtgattctaatgcataataaatgttgaggactattgatttagatgataaaattatagatttgaaatttatttttaaaatttgtcttctgttgcagcaattgacatgtggtctgcaggtgtcatatttctttctttgcttagtggacgatatccattttataaagcaagtgatgatttaactgctttggcccaaattatgacaattaggggatccagagaaactatccaagctgctaaaacttttggtaagcagttttgtattatagaaccaaacaaaatgcctttgattatctcctacaaatcacttaataaattattgtgaaattttctttacaaataaacattcagtcttgataaagttctctaatattaagtagaaaattcttcagttgcttgaaaataaatttatcacctctctatacatataatcatttaatcttattaagcacaaagtaatacactgttgcagtatttaaagtttacctttataattttataagaataaggagtaaaatcttaactccttttagttatggtttgacttttattacataaatttaccttttattaaaggcatgttttactttgtaatatgttttacttttttattgtcttttaaacatcagatgcactatgtcttggtacttagagtgtccttgccttaaatgatcttaggctatactaacaagtaaacagttaattattaatacagtgtaataaggactagggaagagaatggaaatgtgtgttgtcaggttgtgtaggtttacggtagcagagaagcagaatgcatagaaggccttaactgatgggatattattgtaagcatatattggacttggatgtcatctccttagccacgcaagttcttcaagactgggatgtgcagtgtacttcatagggcacataagaattatctcagccttgctctggccaacaatctgaactcaagtgcccatttaatgtttattttccacgctcagttatagttaatactttccaaggaataagtgggattgactcagcttactaccatacaatacagaacacctcaggagacaaagtttcagccagcctacctcaagagtagctgggctgtcttgtgctcaaccccaggatcagtgggtcttaaccagagttgcatgtcagaattatctgagaatctttaagaaatacatatgcctgcccactcagcctattcttggaaaatatgattcagaaaaacaagatacttaggaaggctccagccttgttagtttgaaaaagcaagtgattctgactaagaaactatgggtgtttaagaaccactgcaaaaattactgcccttgcttatgcactagtgctatagtctaatctacaagaaaaacttagtggtggttgtgaagaaagcctcatcttaatagaggcttgccaaaatatgtttctacagtaaagtcagtccacgatttgtaactatcttgtacttattgtaagaaaattttatttgaagataataggatgaaataatacaagggaaaaaaagtgaccatgagtggaaagcaagattgatatcttagaaatggcattcttacataataatataacaagtatgtttattctcaactgagaaaactttcatctactattgaataacttcgtgagaggtttatgaacatgaagtttatcagccaataccaacatattttattgaagagcttgaatctcccccattgtaatccaagttataatcagggccaacaatggaaatacaacatctgacccaaaaatactctagatcaagtgccatgatagcaagcaagagcttttagagatttatcattgtaatacttctcatattaaaaaaaaaatagggccagccgtggtgactcacacctgtaatcccagcactttgagaggcttaggtgggcagatcatgaggtcaggagaccgagaccatcctggccaacgtggtgaaaccccatctctattaaaaacacaaaaattagttgggcatggtagcatgcacttgtagtcccagctactcgggaggctgaggcaggagaaccagctgaacctgggagatggaggttgcagtgagccaagattgcaccactgcactccagcctgacgacagagcaagactctgtctcaaaaaaacaaataataaaaataatgccataggacttgtctcagttgtattagtatgacatctgtagttattttagtcttgatcttactataactttggactgagtataaaagcctcaaaatttcaacaaacacaactgtgttcccctttgtaacctaaagaaatgacttggctgagattagcagtgagagcacctttacttctcttatctgtcctcaacccttaaacctggctccattgtgggttgtcattaagtactcagtgaattgtgttgaataaattaaaaagaaaagtcttgagctgaaacaaattcctgacacatagtagtctgtaataaaatatgttgactgatagtgttacttgaagttatttttcctgaatattgtaaatgaaccctctttttggtcatataaaaaaaagcatattgtataacttggggacatgctataacatatactattagttattttatgacttcagaacaagctaataaaggaataaaactatatgaatattcccccctggctataattttctagagagaataggaatgatagaatcagtttaaaagtaaaaaagcattggcatattgtactctcaaagaatttggtcttcagtaattgtttgtttcctccctttccctcccccatttttttccctggcttagtacaccagtccagtagttagttcagaatatgtaaaggtaactttttatcatccacagtcagattaatgactttgttgacaatctacattctcagaaaggcatctaaatgttgtggtacttgttgtttcgtacatttagtatatttctgtttaataaggaaatgtaaggcaaaaataatacatgattgccatttgtgtgattaacttttttttgcacatctgataataaacccatcaggaagttatttcaaatacatttatatttttaaaaacagatctagtttgtttatttgttcattcagaaacatttattggggctttatgtgtgccaagtactattgcgagtctctgctttcacagagcttaaattctagtgagggagagaacataaataaatactatgagaaatgagtggtactgagataaaaggaaaaggggagggaagaggcttatttaggataggttggtcaagaacagcatctctaaggatgtatgtgtcatttgaacagttgttgaaaagaataatgcctttttgtctagtccaacagacattaactgactacctaatctgtaccaggcataggctgggtttggggggttcaaagataaataagacagttcctgccttcaaagagctcagtctactaggtgggacagacatatataggatagcaaaagtaatagtagaactctcaagatacagtagaaactgaaattgatcagttctctctgagggtgtcaagcctcagaggtgattcttgatctgagtggtgatgtcagtgagagtgtcctgggcacacaaggggtgcagggcatcctaggcaaagacaggagtcatgtagtcaaagacatagaagcatggaaaggaagtagagtgggggcgtgggagctgcagctagttaaagattatagaagggtaagatgaagcttgagaaattggcagagtcaagtgagtgcctggcatagcttagtaagtcactgctttgtacttactatctcccactttatctcccactatgcaattcaaatacaacttaaatatagcatgtggtgctctatctcatactgtgtgtgtgtgtgtgtgtgtgtgtccatgtctataaagcatatgtttgaactttcatgtttctcatgagagaggcttctgatatattcaaataataaaatgtttttttctgttgttgttttttcttcttttgcttttagggaaatcaatattatgtagcaaagaagttccagcacaagacttgagaaaactctgtgagagactcaggggtatggattctagcactcccaagttaacaagtgatatacaagggcatgcttctcatcaaccagctatttcagagaagactgaccataaagcttcttgcctcgttcaaacacctccaggacaatactcagggaattcatttaaaaagggggatagtaatagctgtgagcattgttttgatgagtataataccaatttagaaggctggaatgaggtacctgatgaagcttatgacctgcttgataaacttctagatctaaatccagcttcaagaataacagcagaagaagctttgttgcatccattttttaaagatatgagcttgtgataatggatcttcatttaatgtttactgttatgaggtagaataaaaaagaatactttgtaatagccacaagttcttgtttagagaccagagcaggattaataatttattttaacattttagtgtttggtggcacattctaaaatatagattaagaatacttaaaatgcctgggatagttcttgggactaacaacatgatcttctttgagttaaacctacctaagtagattttaggtgggttcctattaggtcagatttttagcttccctaattacctttcactgacatatacagaaaaaggagcagttttagttttaattaattaaaattaacagatgtgatgaggattaaatgaatcaaaagacttaatttgtagattcttttagagttatgagctaggtatagtttggggaaactcaacctggtgctggtgctcttaacaattttgtaaataaagaagataatttccttttctagaggtacatattaggccttttatgaacactaaaacaatgaggaaatgttggtcatggggcaaagtatcacttaaaattgaattcatccatttttaaaaaacacttcatgaaagcattctggtgtgaattgccatttttttcttactggcttctcaattttcttccttctctgcccctacctaaaacattctcctcggaaattacatggtgctgaccacaaagtttctggatgttttattaaatattgtacgtgtttacagttgggaatttaaaataatacatacactggttgataaagggaagctgcaggaccaaggtgaagattgatagtccaaatgcttttcttttttgagttgtatattttttcacaccatcttagatataattaggtagctgctgaaaggaaaagtgaatacagaattgacggtattattggagatttttcctctctgtagagccatccagatctctgtatcctgttttgactaagtcttaggtgggttgggaagacagataatgaagtaggcaaagagaaaaggacccaagatagaggtttatattcagaaatggtatatatcaatgacagcatatcaaacttcctatgggaaaaagtctggtgggtggtcagctgacagatttcccatttagtagtcatagaatacagaaatagtttagggacatgtattcattttgttattttgagcattgataggtcagtatatctacctaatctgtttggtaagtataggatatataaaccattaccattgatctgtcttatgccataatcttaaaaaaaaattgaatgctcttgaatttgtatattcaataaagttatccttttatattttttatgtcagactactcatttgaaaaatagcttttttttttaattgacaactgggaatatttttcttttgagatgggtgaatggtgatattctttcagcaaatagtatgttaatgaaacagtcatgttaacatatattcagaaattaaagaggaagaaaaatttacccaaagggtagataaggagacattctctaagaaagtttaatattcagggctgttgttttaactttcattaatggcaaagaacttggttgatattgagggggaagtaaaagggagctagtgtttttaaatatacccagtgttacaaattagttctcggggaatttcagtcccactgaagaatattgcctcaattttggacaaatattcccaatgtgctaaatcagaattggcagggagcttttatatgcgtattctttagatttttaagccttctgaagaccattttaaataatgggaaatgtctctaaaatatttgaatttctaaggatagactaagaaggtaactagttaatgccatttcctcttaatcagctatttttcactgtcagtttttaaaaattcctagtgctcaggctcgataaaactgttaagggtattttcatttaaaaagccttagacatttagaactattaatataacaagctacaagtattggtttttgaagcaggctgagctctctggcatttttaatgaaacttccttataaggagatgattatagttgtcttaatgacctaaatatgtggctcaataatggttattccaaagaattaatcatggtttacttcaagataatgagcaagtcatcaagtaaaacgttaatatcttactgttcctggcatcagcattttagggacaaaatggtgttacagatgtcagaatattgattgcataaaatcttgaaacccacaaaactcgtaggcttaagtcttagtaatttctgttgtttatgtaatttcagccctgcacgtcactgaaaagttatttatcttaacaaactggccaaatttggcgggtaatgctgtctgccagtatctgcagatgtattgtttccgcctacatttgtgcatgttgtctgtggtctttaaagaacactaacaccagatagaaatgtcaactctgttcagattttttcctatgttcgaagaactgatgttgctgattcctaattttgtcaaattatgtgtctgaactgtcttcctttcttgaaaggtagatattaccaaacgtataccagataagtaatcagaagtagttaatattgtgtcaagttacagcacagttttcaacaaagtaaccacaaaggtcagtgctaaggcaaatatttagtaaacgatgttttagctatctaaagtaaaaaggcatgatcttaggaaagtgattgcaaattaaaagagagaaaattaaaaaactgaagtttggaaaacaagtaattgcaacagtttcaagagtttaatctgacctgattttttcttctgtagaagacaatgaactaaaaggacacaattgttctcgatctctgttttgagtgctttaaaaaattaatatatggaagagttcaaaatgggcaaaataaaaacttatttggagagcatacgcatagtttttttataaagcaagaacgatgaccagaaaacagatgtaaatggtttagaatttctatttaagcataaaccatgtgcaaaattactcttccgaatttaacacatcatgtgttagccattagctgattccatcttggaccctactgaagcaattctttaaggaaaataacaggcttagcactagaaaacaacatatgaaggaaaatagggaataaatactttatagatacatctctctagttctagatttagagaatgccagtgttactccagcaggcaaccaagaagatggatcaaggaatgggcttctgacagacatcctgaagaaactgaacactgtcagctgtggagtgagtagtacaaatcagaaaatgaaagatccattg

SEQ ID NO: 12251 - DNA, 4675 bp, Human
atgtggcctgtctcttgtgaatttaaaaaggtcacaatccacttttcagtgttttgagattttcaaaatgattgcattagctcttggcaatgctaaattatgttccttgcgaaccactatccagtttctcttgggccaagtccacctcctgctccgcaagaggaacaactcccagctggtggtacctggcggcagtgctggagaaacgccattttgtgactggcagagtacacctaggctttagaaaacaaaagctgcagaacgctgcaagtttaggattcaaagagcataatcaagagaaagacgtctcatagaaaatgtttctgagtaatagtgtaatcctactatgtttgagatgctttgtagatttcaataacactcctaagtcaattaaagcattacaaaggaatccaattcttgtgaaaggtttcagaaattcccgtaaagggtacatttccggagaggaggtgagcagtattccctctttttttttttttttttttttttcctaaagagctgaaggttatacggaattggggaattataatacctttggaatcaatgccttgttttatggaaaataaacacagccttcaggttatgaaaaccagatgtagaagaggacaagtttaaaaaattaaagtccaagccggcgcagtggggctcccctgtaatcccagctactctggatgctgaggcgggaagatcctttgagcccaagtttaagaccagcttggggaacaaagcaaaagtaaaataaaataatagtagtaataaaataccacttaaataatcatctgtagagttggaatagaatatagtagccggtgaaactgcacgattgttgctggcttaaagatagaccaatcagagtgtgtaacgtcatatttagcgtcttctatcatccaatcactgcactttacacactataaatagagcagctcatgggcgtatttgcgctagtgttgggtgttccgctgtgctgtttttccgtcatggctcgcactaagcaaactgctcggaagtctactggtggcaaggcgccacgcaaacagttggccactaaggcagcccgcaaaagcgctccggccaccggcggcgtgaaaaagccccaccgctaccggccgggcaccgtggctctgcgcgagatccgccgttatcagaagtccactgaactgcttattcgtaaactacctttccagcgcctggtgcgcgagattgcgcaggactttaaaacagacctgcgtttccagagctccgctgtgatggctctgcaggaggcgtgcgaggcctacttggtagggctatttgaggacactaacctgtgcgccatccacgccaagcgcgtcactatcatgcccaaggacatccagctcgcccgccgcatccgcggagagagggcgtgattactgtggtctctctgacggtccaagcaaaggctcttttcagagccaccaccttttcaagtaaagtagctgtaagaaaccaatttaagacaaaagggaatgcattgggagcacttttcgttttaatgctactgaaggcttcaaaaccaatcgatttcggccggtcgcggtgactcacgcctgtaattcaagcactttgagaggctgaggcgggcggattaccagaaatcaggagttcgggatcagcctggccaacatggccgaatcccgtctctacgaaaaatacaaaaacacgccgggcgcgacggcgagcgcttgtaatcccagctacactctgaaggctgaggcaggagaaacacttgaacctgagaggcagaggtttcagtgaatcgagatggctctaatgtactccagtctgggcgacagagagattcggttaaaaaaaaagttcgacttaaaataattctggagtcagaatgggtttacatttaattcttaacccagttcctcaaagcctgtagctctgttaagaaaataaaggccattggtcaagcctgcttggtcccaccctcatctccccaccctcccccaatcgctgctcccgccatttcctggggcttggaggaggggttaaaggagcggactgtaggcgtcacatttcccgcctgcgcgcttttcagtctcagtgtccgctggaggtgggggcaggggtaacgtagatatataaagatcggtttcctattctctcacttgctcttggttcacttcttgggaagtcatgtctggacgtggtaagggcgggaagggtttgggtaaggggggtgccaagcgccaccgcaaggtgttgcgtgacaacatccagggcatcaccaagccggccatccggcgtctggcccggcgtggcggtgtgaagcggatctctggtctgatctacgaggagactcgcggggtgctcaaggtgtttttggagaacgtgatccgtgacgctgtcacctatacggagcacgccaagcgcaagacagtcactgccatggacgtggtctacgcgcttaagcgccagggacgcaccctttatggctttggcggttaaggttgctgatttctccacagcttgcatttctgaaccaaaggcccttttcagggccgcccaactaaacaaaagaagagctgtatccattaagtcaagaagctcaatgtgtaattaagatgaatgatactgagctgacatcctaaaaaggaaagattaggggaactccaagtttgccctccactcactacatatgggtaggggagcaacgatattccaactctgaagaaagagtggaaaaaaagtagtgttaaaaatttgtattagtttccaagggacaaagaagcgctgcccaatcaatgagggccattcgtagctgtcaaccaatcagaactgatgagctaatatttcctgaggcaagccagggagccggaggggaagctaagaagcttattgagaaaaaacaaaaaccctgttttaggaaaaaaaaaaaccatcttttagcgattatgaaataaaatcacagagacatttaagtatccctcaatcatgtactgagagcaatactaaatttatcgccaccaatacagttttactctattaaaaagaccctgaaaattgaaaccctattcagactcctggaatacccaggacactaaattcaggggagattaaaatctgttttagagagaaaaggcacctttttcagtgttaccgcggccttcagcagttaacctttttttttccccctttacgcagaaatggaaatttgggtgatagaaatattccgaaattaaattgtgatgatggttgtacaactaagaaaacacggtaaaattcattgaactgtacctaaagtgggcaaattttgtggtacattaaatatcaataaagctgattatatacatacacatatatttttatatatgcagagagagaaatgatgcaagcagggtggtaggacatgaggttggtagcataggcaatgttggtctgtgaagggccacctgtgctaaacctggaagcctggggtttgtccagtcaagccatggtagccatagttttaaaggatgttcctgatgcagttatgtgttccagttaagtacatctagcttcagaactcagctggaaaagggatgtgaacttcaggttagctgatagggaaatatcttactctcatctgagtaaatattcacaaatgcctctcattgtgctctttttggtaccattgttataggactgatttcagcctcacgatgttagcttcagtgatggatgtctctttattttgaggtcctgttttccacctgacagttttcatccaggatttcttgaggaattacacaagtacccagcttggcttaatttaaaactgacaatggagagaattcatagctgcattctggatagtttcaggaatcagaggagcaaaaatgagcctggtatggagggtgggtcattttatgtctttcttagttggtattttaaagatatttattgatctcatatgccagatattgttgaaatcattggggtacataagttagaaaattttaattccctttcctgaattccagagtcaatgtagaggggtgtgtggatatcgattacccatatgggaggtatagtcgttgtaacaataagccacgactagctcctgttacgttttgcctggcctttcatagcattgctatgttcatagcattgctgatatgtcatactcatcttaggcatacccaccaccaccttgggccttcttcagtcctaacactcatgcagtccttgttcagaacaaagataatgttgcttaatttgcaacccctagactatcccccagattttctaaagagaaactgcacgctgattgcttcaggcagtggcaggtcaaggaatgagatggggaattgattgtgttagcattctggtgggcttagtggagagcctggagacttacatagaaaattcacacatcctttcattcaacaaacctccataaactacctgttaaacgtcagccctgttcaaggtgctagggatacttctgggacaaaacaaagtccctaccttcaaaaaatatattccagttgggggagagagaacaaacacaaaataaaatatatctagttatatgtattttttgttaaatatattattacatatataattctaggtggggaaatgttatatatatatgctattgaggatagtcaactatatatatatatgctaaatgagcagaaaa

SEQ ID NO: 12252 - DNA, 5329 bp, Human
tagaaaataaagctttgtgttagaatcaaacgtgttcaaaaagtccatgagaaatcacatcgattgtaaccgtctatgaggtagtcttacctgaggacactggctccttgaaattcctcttcaagtacaacagtattgtgttaattttatttcctaagaaggccactactatactcaaacttacagttttctctttacatgtctcaggcatccaccaaactccctcctcccttctagactggattagaagctcttcagaagaaacccccttatcacagatacagcccaataaaactttctgcgatgataaaaatattctgtattaacactgtccaataggtagccactaaccatatgtggctactgagtaccgtaatgtggctagagtaagtgtgcaaattaatttttaatttaaattaatttaaataaaaatgagcacatgttgctagtggctaatataggacagcagagctttaaaacaattattctcaaacttggaagagcatacctaccacccacttagagatctcattaaaaatgtaatatcaattccattgatttggggttgggcccgaaattctgtatgtctaacaagcttcagagtgatgccagtatagctgggatatggctgctccgcccttaaatacctgacagtaagtagaagtatgctggtctgatatctgccccctaaccctgagtgtacttttccctttactaaacttttgagttctttaagagaataaatgtgattatctttgtaaacctggtatttgtacactattcttggcatgtagtggacattaaattgttgaatgaatgaatgatgcttgtttggtgcctacctcaaaaaggagagcacttgagatccttgtgtctattcctacaggtaactgaacctaagccaaaatttaagtagactcttaactccacaaaatgaataatcttctcactgcttttaggcaccagcagagacgggatttttaagttacccttgcagtatataggaggcaatgaatgtgaagcagtagactgtaagagttaatgttgaatttttctactacacataccctatgatctgtgtgtagaacacttcttccggaatcttttattaggacagtatttcacagaatttattagtattatttttgttaatttacaaacctttattcaccatgatttaccatgtatgctttagtggcatgaaagcagtggtaggtagcaaggtagtgagactccagaatcgagccaacaatacaatgccatttattagaggataatgtcttcaagcctgggattccttatctttacacctcagatattgcattatacattgaaaaactaagaatgaaacttcaattaatattggtttcccttactagaggtctttctttattaggaatgccaaaaacgatgtgaatgtatatgtctctgccaaacgctaagtctcatgattggccaaatttaagaagtattgctacattttaagaattaataaaaatggccgggcgtggtggctcacgccagtaatcccagcactttgtgaggccaaggtgggtggatcacctgaagtcaggagttcgagaccaccctggccaacatggcgaaaccccgtctttactaagaaaatacaaaaattacccaggtgtggcgacgcgtgcctgaaatcacagctactcgtgaggctgaggcatgagaatcgcttgaacccagaaggcggaggttgcagtgagccgagatagcgccactgcactccagcctgggcaacagagtgagaccccgtatcaaaaaaaaaaaattagtaaaaatacattttcaaagaatcttcacatttaaaaattaaagctaggcgcctgtaatcccagaactttgggaggccgaggcgggtggatcacctgaggtcaggagttcgagaccagcctagtcaacatggcgaaaccccatctctactaaaaatacaaaaattagccgggcgtggtgacgcgcgcctgtagttgcagctactgcaggggctgaggcagaagaatcgctcgaacccgagaggcggaggttgcagtgagccgagatcacgccactgcactccagtctggggcagagcaaaactgtttcaaaagaaataataattttattctcttgtctatccattcggtagacaagtgtagcgttactgcctcctttttgcaaataataaggattttaggagacagacattatcagttcgagagcccacaggcactggactagaagacacagaaacctacactcaagacccaaacaaggaaacaggaaggagtcaaatcaacttgcatttcccctaccctcaccgccccctttccttcccaaggcaatagtgtaggggacgcccagtaagttacggaaaaggcggagacagaggtttcgttcccgcccctccaattcagtctccaaaaaggtccgcataattgatatataaggggcttcagtgtgtagcaaagttgcaaaagttaagagttgttgtttgtcttcgatcatgtctggtagaggcaaaggtggtaaaggtttaggaaagggaggcgccaagcgccatcgcaaagtgctgcgtgacaacatacagggcatcacgaagcccgccatccgtcgcttggcccgacgcggcggcgtgaaacgcatttcgggcctcatttatgaggagacccgcggtgttcttaaggtgttcctggagaatgtgatacgggacgccgtaacctacacggagcacgccaagcgtaagacagtcactgcaatggatgttgtctacgcgctcaagcgccagggacgcactctgtacggctttggtggctgagcctcaccccggctttttatttaacagctcacccataaaaggcccttttcagggccacctccttcgtcacacgaagggctgtaactgatgacgacttgggtttcgttttgtaaatttgggattctaactgagttaaaccgagccgtttttagcgatcttcctaagatggcggatgtgctaaggagaaagggaaggcgaaacattagaaacttgttcaggtatttcgatcgcaaacattcacaggaaaagatggtggaaatggtttgggaataccagcagccttttatgacgtatgtgatgtgttttattcccacgtttctgaaatttactcctatgttaggtggctgggacttaactacactagcattacatgtttagtttttgagatggagttgctcttgtccaggctgtagtgcaatgacgcaatctcggctcaccgcaaccaccccctcccgggtttaagcggttctcctgactcaacctcccgagtaactggggttacaggcatgcgccaccacgcttggctaattttttatttttagtacagaaggggcttttctgtgttggtctggctggtctcgaactcccgacctcaggtgatccgcccttcttggcctcccaaagtgcagggattgcaggcgtgagccaccgtgcccggccttagtgttatttattaggcatagaacgtgagtaatcttagggcggctgtggacagatcaattactggtaaacttaatccactacttgtgtccgggcgcggtgcctcaggcctgaatcacagcaccttgggagaccacggcgggcggattactagagctcaggagttcgagactagcctgggcaaccaaaatggtgaaactccgtctcaactaaaaaagttaaataggaaagttagcccggcgttgtggcggacgcctgctgtcgcagctaatctgcaagggctgaggcaggagaatcgcttgagcacgggaggcggagatttcagtgagctgagatggtgccactccactcctgcctgggcgacagagaccatgcctcaaaaaaaaaaaaaaaaaagtaaagtttggccgggctcggtggctcatgtctgcaatcccatctgtaattccagcagcttgggaggccgaggtgggtggatcacttgagctcaacgagttcgagaccagcctggctagcactgcaaaacctcgtctctactaaaaatacaaaaattagacgtagacgtggtgacacgcgcctgtagtcccagctactcgggaggctgaggcaggagaatcacttgaacccgggagactgaggttgcagtgagccgaggtcgcgccactgcactccaggcctggggcacagaacaaggctccgtctcaaaaagaaaaaaaaaagcccaagtttttgtcttacccagtgaattctttgttggggcacttactgtgatttcaggtcattgataattttactgctttatttctcaagtactggtaatttataacccaaagtgtttctccttgtgctttgtcaacctacccggttatcacccgcgatcctgactcctaacgttttcattttttcaccataccgaagaagtggcttctcatctgttctttttttgtcaatggtaattcattacatacactgttccacaaatattcttcaacttggggtttcctcttcaagaagcctttacctgattcctatgggcaaaatcggtgtctggggtttccttacaattcacgaagcacactctacacatgtccctagccctacttcagaattccctatacgacttaggagctactgcacacttaaatagttgggagtaattcttgccctcttcccaagatattttcaggtcttgaacaatgtctttaatttagtatcctcaggatgtagtatttagttcataaatgtttgtgcaatgactgaaggaatcaatgaaattaagctatctgggccatcaccaatataccgttataaaaatcattcccctttaattaagcaatatctctactcccacagaaccatcttctctattcacctttacacaaatgtcaatattcatggctgccaacaatttatattacagactttttaaaatgcagattgagatccattcacgggtaatgaaaataatttagtgggtcccaaccagcatataaaacgtaaatagaatccaatataacaactagaaattatcaaagtatcccatctagtaagtaaaaatattgtgtcataaaattttagtttcaaatagatgtacttttggttttactttggaacttgaaggagaaaaggttcaaaagatactggtccatttatttaatgtatatatttgtcaaattctcaggttaggacattgcctcacttccctgggtttcagaacttcaatactcagcctcatttgcagctggaatgcagatctgtaacctaggcttcaccaatgagtcacaggtttaaaagacttatcttcaaaaatgggacccaggagagaagagactgcctaaagcctctgtttct

SEQ ID NO: 12253 - DNA, 4745 bp, Human
ccatatttcattcctcatatcgaatattctgagagagttagtttgtggagggtagttctggacaatttatattttcataacacctctggttatttttttttaagtagagatgaagacttgctatgttgcccaaaatggtcttgaactcctgagctcaagcgattctcccaactcagcctcctgaagtgctgggattacagccgtgagccactgcattaacctctgattaatatcatagattaacctctgattaatatcatagatttatttgtttgaatgcttcatgtatcctctcaaccacaacttgtttgcagagttttaatctgaagggcttaggtctcttgttcaatgaatgagtttgatctgatgggtgagaggaaggtgaaatggaaagcgaacgagaagccatacagattaggcgagtgagcctaatctctccctaaccataagattgagtatgcctgaattcttcccagagtggaagaatccattttaaatatatatatctacatgtacagatcctttaaatatttgttctgacattcattgtttttgagtcactgtcattgagaaaagtttagaaaggagatattaggagcaggaaatagaaagtaaataaaatatcaaaataaaaatggggttttataaatgatataataggcaaaataaaggaaaggcatcctagacctctggttaaaatgaagatggcacttggcgagatgtgttccagggtagttcacatgatgtatgttttcagagaattgtcatattgcatatgctgctatattttttattttcatgaattaaaaggcatgttgagatttcagagttttacttatgatctcagactctgcattttttctctgtaatgtttgacatttcttcctagctaagtctctagttataaggtctgtgttgtggcatgtggacagtgagtggaagaacctaagaactcaatttggggcagaagaatgtaatcaattatttcagaagtgatacaaacaatatgacatgtagagcattctggcctttcctgggtcttttttctccattcctggatttcttctcttcatgtgagcaagtctgaggttactatataatgtctctcacaggccacagccccattctaaatattcccaatagaaattcatttattaaccagagagtggtgggtggggttgtttttgttttttaaacaaaagtggatcttatgggcattctggaaagctcccgcaggaagctaagaataaaattttgaattgagaagtccctttcttcaaaccacattcagacccaattctgctattctatttatttttcaaggggattagccttattttaacaccaataatcttatcacaaaaacctcccagaggaagaccctgtagattttgtaatgaccttaatcaagtattagccctacacttcaattaatccccaactgtacaaaacgtatgttcttttctctaaagctgtagcaagttgaaaggggattaaaaacggagggaagggaagagtgtttggaatttcaggcacagcaaacaggcacagcagaccaggaagagcgtcccgggaaaacatattatccagacttaagtttatattccctgtctctctcagacttttgcagaaaaatgagtcattcaacaaatatttgaatcgagatagggaaagtgacgaggaagaagtttgcacttatgaggttttaatttgcaattatttggctacctttttgccttcccaaaacatagggtctttaggagtgaaacttcatagccaaacttataccttgtccagcacagagaaggccatcaaaatgcctggtttaaataaaaatattaaaatgattgggagggtaaatcccttgacctataaatctgacctcctttaaacattatttgtatgttccccaataaactattccgtaatttattagttagcaagtggaaataaaaagaaatgtggaatggggctatgcttagcgtcattaagctgacaggaatacagcgcattcaacttgcaaacacccttccactcccacaaagagcaagctgtcactggccaatcaaaacaatgaaccataatgaaacagtttttcttgctccacccactcggtgaccaaatttgaaaaaaaaaaaaaaaccgcgccaacccatgttgttttcaatcaggtccgccaagtttgtatttaaggaactgtttcagttcataccttccactgcgataggaatcatgtctggtcgcggcaaaggcggaaaaggcttggggaagggtggtgctaagcgccatcgtaaggtgctccgggataacatccagggcattacaaaaccggctattcgccgtttggctcggcgcggtggcgtcaagcgcatttccggtcttatctatgaggagactcgaggtgtgcttaaggttttcttagagaacgttattcgagacgccgtcacctatacggagcacgccaagcgcaaaactgtcacagccatggatgtagtatatgccctaaaacgtcaggggcgcactctgtatggcttcggcggctgaatctaagaatacgcggtctcctgagaacttcaaaaaacaaaaacaaaaaaacccaaaggcccttttcagggccgctcacaaagtcgtttaaagagctgaaatgcgttgcgagaatgagtttggatgacagaaataaccgtgacagcctgcataagaatgaattgtgtttgccatgaccggccacactgtgacaaaatttcaaagcataaagtaggcatagagaggtaagcgctaataaagtgattggctccacaaaaagcattttgctgggcgcagtggctcacgactgtaatcccagcactttgggaggccaaagctagtgtatcacttgagatcaagaatccgagaccagcctggccaaaatggtgaaaccccctctaccaaaaaaaatacaaaacttagccgggcgtggtggtctgcacctgtaggcccagctagcccggaagcagagattgcagtgagccgagatcgcgccactcccctccagcctgggagacagagagagactcctcaaaaaaaaaaaaaaaaaaaaaaaaaattatgtattttagagcattctaagaatggtactttggacttaaccgaagggctggaggcgcgtgttgaacaaaggttatcaccttttggctcatgcggcacacagctatgtaaataaagcatctttagggacaagctctcatttgcggagggttctatggctgttgtcctattggccaaaacaaagtggtctaagtccgggcgcggtggctcacgcctgtattcccagcagtttggtaggccaaggtgggtggatcacgaggtctggcgttcaagaccagcctggccaagatggtgaaaccccgtctactaaaaatacaaaaattagccgggcgtggtggcgggcacctgtaatcccagctacgtgggaggctgagccagagaactgcttgaacccaggaggcagaggttgcagtgaaccgagattgtgccactgcactctagcctgggtgacagagcgaggctccatccaaaacaaaacaaaacaaaaaagtggtctaataatccccagaactggaggaagaaccataacttattgattttgtttttaaccttatgtatgccaggcatgctagccttgtatacatacaaggctagaggagcaaaggtgcaggaagccatcttgagggagtcccatattattgagagaccggccagctgctgggagaggctagttgttcatcctcactgtatgtgatgagaatctggtgacagtccattgctgggcacagcatttaggcaaaatggctctctgctatgtcaggcaagtgaggcatatttttgcacaatcctagtaattccgaactcattgggaaacaatggcaattacatccaagcaaggaaaggtctgtggttgattttatctatacaaatttaaaacataatgtttacaacctttcattataggacacaatttttaaaaagatgccaaactatacaaataagttcagaaaagtgaggtactattgaaccgtctggaaaacataaatgtatgtgaaataatgcaatgcatagttttgcaggggactttgttcaaagtttctcgaaataccatggtccaaagtagactaacattagcattggttatttatgatgatcagtaagaatactaaatcaaaaatcaaaggaaaattaaactatgtctgtttaaagagaaacgtagtttacctcagactgagagttaaaacaagtttgtgattcaggaaggtggaattcagaacctaattgggcagcctccaacatttccattaaggtttggattcttaaaatttttcagtcttcggtatgctctggtagtctgatgaaacttacagattcttttcataaataagatacttaaagtaattcatagggttacaattgtattagaccaataatattaaaataattatcaaaccacttgaccgtaatatgtgtgtttttgttgatatacctaatagtacttcggaaataagcaagcacgatttccagattcttgcaacaactataacctacaaatttgttatttctatcagtcacacacaatggaagaaaattctaaatttcagctacaggataatgaatagatgaaaaacaacaacaacaacaacaacaaaaaaactcccctaatccatattctgggacaccttgattcctatttattgatcccttgaagtcagtggata

SEQ ID NO: 12254 - DNA, 83617 bp, Human
cgtggtcataccccattgtgtcatcagagctcatttcagtgacccattcatcagctgtagacatttgggttgtttcactttctggctattacgaacattcaagtacagatatttgtatgagacctttttttttcacttctcttgagtggaaacactgggttacatggtagctctttcttttttaggaattgccaaactattttccatagtaactacaccattttacattcccaccagcagtatatgaagattccggtttctctgaatttttaacccttattatgatgtcttttttcttatggttagcctcgtgggtgtggagtggtatcttaaagtggatttttttttttaatgactgcatgatttttcattggatggatataccataatttaaacaatgacttattgtgggacaaaaaattatttccagttacattttatgatcttcattgtttatatcagtagtagtttatttttttaatgggattttattttttatttcaatagtttttggggaacgtggtgtttgattgcatggaaaagctctttagttgtggtttctgagattttggtgcacctgtcacctgagcagtgtacactgtccccagagtccattatatccctcttacacctttgtgtccttatagcttagcttccacttataagtgaggatgtgagatgtctggtttttccattcctgagtttcttcgcttagaagaatggtctccaactccatccacgttgctgcaaatgccattatttcattcctttttatggctgagtagtattctatgatatatatatatatatagagaccacattttctttatccactcggttgatgggcatttaggctggttccgtatctttgcagttgcaaattgtgctgctgtgaacatgcgtgtgcacgtgtctttttcgtagaatgacttcttttcctctgtaggattgctgtctcaaacggtagctctactttcagttctcgaaggaatctttgtactgttttctgtagtgattgtactagtttccattcccacgagcaatgtaaaagtgttcctttttccaccacatccacgccaacatctgttattttttgacttttaaattatggccattctggcaggattaaggtggtatctcactgtggttttgatttgcatttccctgataattaatgatatttagcattttttaaatcttatgtgctttttaatttgtatttctcatggctaacgtgtggaaacgtcagtggctgcatagaacagagacacaaacattacagaattagttcagaaaagtcatgaaacaagtaaaaaacaactacagctggcagcaccagcagccagccctggcaagggcagagaatctgattccagagttgccgcaaaattcggaagacatgcaagaagcaagaaagtataattcatacatggtggagaaagcaatcaatcagtagaagcagaatatcaataaaaagaaactataaggagaaaccacatagaaattctacagatgaaaagtacagcaactgaaatgaaaatttggtagataagctcaccggcatatttgagcagcagaagaaagaatcagcaaacctgaagataggtccgtcaggattctccggtaaggggaataaagcagagagagaagaaaaatgaagacaggatacgtgctttctccacttctgttcagcattgtgctggaggctctacccaggacgtttatgcaaggagaggaaatagaagacatccagattggaaaggaagaagaaaactgtctctatttgcagaagacatgattttatacattaaaaaactgaaagaatacacatttacaaaattattagagctaataaacaagttcaacagagttgcaggatacaagatcaatatttaatattatatttaatataagataatgtttaatattatacgttagcagtgaacaatctgacaacaattattatccccagagatattttgtctaattttctcattggcattttgctttgtttcagatgctacagaaacaagcccagtttccttgacagttgcactatttttattacaaaacctcactagacatttcacatttgaaaactctcagtcgtaaattaaccatggccatcaagtctctgtgatctgtggacagttttttgtttgcctctaatgcttgtctggaagttcggcatgctttaggctagatgctcggtcttaagcaaaggccagtctcagaatgaatattagccagagatttcctgagatacctagaactggtgagtccttgatgaggagctccggtgcacgctgggccaggtggtggccactctgcctttgccctcatttcctgcttgctcagagcttcaaggtgagcaggagggagaacccagggccttcacaggcctttccgagcctgtgcgcaacatgcacggacatggccccttagaatctcagtccccatggacagctcatttcttagcttttctgtgtcagcgttctggtgagtcttttgtttgccactgctgtcactcaggcatttgtgatgttgaagtggttgacagactcattccccaaccaagtttttgccctgggagagattaggggaggtgaaatcaagacaggactttctttcttttctttttttttttttttgagacggagttttgctcttgttgcccagtctggagtgcagtggcacgatcttggctcactgtgacctccgcctcccaggttcaagcgattctcttgcctcagcctcccgagtagctggaattacaggtgcctgccaccacgcccagctaattttttgtatttttagtagggatgaggtttcaccatgttggccaggctggtctcaaactcctgacctcaggtgatccacccaccttggcctcccaaagtgctgggattacaggcgtgagccaccatgctcggcctaagacaggacttttaattgggatcttaaggtagtaagtgacccagatgggtcaagtaataactcttctttgggaatggtattttgagagatgccagccccattctgttccctctgtcctgggaatgtagagtgcgatttttcttttttttttttttttgagacagagtctcgctgttgtcgcccaggctggagtgcaatggcgcgatcttggctcactgcaacctctacctcccgggttcaagtgattctcctgcctcagcctcctgagtggctgggattacaggcatgcgccaccatgcccggctaatttttatatttttagtagagacggggttttaccatgttggtcaggctggtctcaaattcctgaccttgtggtccatgtgcctcggcctcccaaagtgctgggattacaggcatgagccaccgtgcccggtctagactgatttttcaaggccaccatggagttgtggtgtgggggctgggaccagggtgagttaaaatgccccaggcgcactcttcttgagagccacctgattttcttgaccaaacgttcccggattgctgtaagcctttggttagttttcagagttcaaaaatctgattctgaccgttttagtcactcttctgttgcttttatggtggagtgaacttccataggctcttactctgacatttttactgagatcttaatggtgttttggatgagtaaaaatttttgattttgatgaaatccaattcatcaattttttcttttgtgatagtagtttttcttttcttttcttttttttttttttgagactctgtgtcgcctaggctgaagtgcagtgatgtgatctcagctcactgcaacctccgtctcctgggttcaggtgattctcctgcctcagcctcccaggtagctgggattacaggcgcccgccaccacacccggctaatttttgtatttttagtagagacagggtttcgccatgttggccaggcttgtctcgaacttctgacctcaggtgatctgcccgccttggcctcccagagtcctaggattacaggcgtgagccatcgtgcccagcctaatttctgtgttttaagaactgttccatttcatggttgcaaatttattttatgttttctacctgtacatttgggtgaattcccctcttcttgaggtcctcccagtatcctgaggttcctgtctttccagcaagtggtcttaaccatctggaagatgggagagttttgttgctgttggctgcatgtgcaccgccatctttgacccttcagagtagtttgtcatgctttattgaatgagcattgttctcagatgacacgcaggtaaggcactggttgtacggtttgtccaattctatcacgttaaaaaggaggaaaggttcttattgaacctactgctgtgaaaattaaggagactcagtaagagtttctgaattctgggataccagtgaaggtcaaagatcatttgaaaatatttcgtttttatcaaagctgagttcaacaaattgttgtaggttaaatagcttaagaagaaaaggcaatgacttccccttgtatccagaaaatagaacataaaaccagcatccacaaataacctcagtaaaacttccctcttcagttcatttagttctgtgtaattaattcttatcctgttagatctagggtttataaactcatgaaaccattgcttcttgcctaaagtgaatttggaaatgtggacttaacctcctggtgtgtttgaaagtggtgtaagggttgctcttgcctccagagcctgtccccacaggtgtcagtcatggcgatgtcggctgcagtccttctccagagccactgagactgcccttcttgttgaagatgcaaactctggcctgtgagtttatcccgagctttcaggcaggcgtttacagagtcgagcagaaacttttcacagatgacaaagacttgatggcaatggttaatttcttactgataatttttaagtgtgaaatgcctgatgaggttttatataattttcaaacatgaaatgtctgatgtggttttaatagtaatgcaactaatgaggaaattgggttgtttctgtggcatccaaaacaaagataaaaaggcgattaaaaaattagacaaaatattactaaggataataattcagcctgtttcaaagaagtcagtggatgttaacatctgattcattgaaatgggtgaacataatttttatgaagaaaacagtcttgagatgtacaatgttgagacaaaatattcccggaatataccaaagcatatcaaatgaagagactgggtaagtctgagatagagtgaaccatttttaatttcataaaacctcatgaatacatctgctgtacatgaatgcatagcactaggccacttgagaaccagtggcctagaaagtgccagattcaaattaaagaagtaatgtggctaatcattttaggtcattgaaattgtggctgtaacactatgttgttactgcctgatatcagggagagcacttgaaggactcggatacagaaaaacttgaccagactatttcataagcattttggtctgtgtttctcctgacattaaaacatattatggaatgtgaaggcattgacagatctccagggatttccactgaagcgcaccatttctgaaatacgtcttttaataacatattagcgattcacagttcacctggagaaggctgggtgtctcttctgatttcacaaccctggccacacagctcaccaagcaaacagttattactagcgtatgttttttagaggagctcttgcctatcttttgataaatttaatcctaagaattttgtattattgatgataatttgagtagaattttgaagactgtcacctttccaatatttgctgttattgtatagacacagtatagtttactatgttgacagtgtcctgtgactttgctggattctcgtgtatagagacagtatagtttactatgttgacagtgtcctgtgactttgctggattctcgtgtatagagacagtatagttttagtgttttgacagtgtcctgtgactttgctgaattcagtcttagtgccagtaaatttttttttttaagattccttaggctttttttgtataaaaatagtgctatttgcaaataaagacaatgttactccttcctcttgagctttataccttttgtttcttttttatcacattattacattggccgggacctctggtacgacgtgaaatagcagtggtggtagcagatagcttgttcttatttttgatctgggggaaaatgttcaatatttcactcttttatttatttatttttttcctggagacggagtctcactcttcacccagtctggagtgcagtggtggaatctcggttcactgaaacctctgcctcccaggttccagtgattttcctgcctcggcttccgtagtagctgggattacaggcatgtgccaccatgcccagctaatttttgtattttcagtagtgacgaggttttggcatgttggccaggctggtcttgaactcccaatctcaagtgatccactcaccttggcctcccaaagtgctgagattacaggtgtgagccaccgcacccagactcatccttagactcgtatttaattaaagaaaatgtacaatgcagacaggatggctgatgatagtccttttttcctgcctgattttggttatttgtgctttttctcttctctcttaatatcttcagatgtctgcaactttattagccttttaaagtaactgatttttgacttggttgatttctcaccgttgtagtttttccatctgtttttaatctttatttcctgtctttgggtttattttgcatgcttacaaaacttcctgggtgattgtgtgggatggcctggacggaagggaccagggcttcaggaggaggatgagccccaccctttctgtggtgggaatgcctgagctctgttgggctgcacatggctcctactttggcagtcattcaacaagcctgaggaatgtggcttactggtaaaatagaaaagtatgttgccagagtttttctaggaccagtttgggggatggagaggatggtagattgaatacatacacctacctttttctttctgaaacctcatactgcagtgagaagtgtggtgggttttttttttttttttttttttttggcaaaggttcatgtgaataaggagaaagtaaagtcatagcattcctatttcagaagctggaatgtaattggagagttggtgatggacttagctgacttgagaaaaccaaatgctaatttgggagtggggaaagctgagagctagcttgatctgtgctgcagagttttgaccacgcttgggagctgtgactgcttacttccagagtggccacacgaggacataagagtgtgttgtgagccggctgctcagaggccctggtccttgctcagcccagtgcagccggggcgggcattaggcgtgctgagcaggcggtaaagccgatggtcgtgcacttggcgcttttcgggacggggtgccttatggactacggtaagtgaactctgtgtgaccgccgagatgaccagctttgtccccactcagcattgagtctgggctggtggagcgttgtccactaagcaagagtagaagggcctcctgtggggactgagactatccagagggaggacagaaaggtactgaagtcgccacctcacaactctgttgccgtgaaacttacaggtggccgtcacagtcgctcattcagagcctcctagacatctgaaggagtctctgatgtaaaaggtatagaccaagcaaacagaaaaacagtgtagaggaaatggaaattatgcaaggataaaacttccaggaagaaacctctcataagcatcctcagtgagataaaagtggttattttaacaagagaagataatgaaacaagaaaaatgtcctctggaagaagcacattcagtgaacaagaagagttctgggaagttaaaactacatgaacagatatggggaaaaaatcagtgtaagtgttggaaaagttaaggagatccggaaagaaaaaaaagatcaaacaggagaaacggaatacactctgaggatcgggttctgtggaccacattcaacaagtaccgcaaagaaacggcggggaggacagcataatgaaacaattgaaaaaccctctcttgagcgtcatcctcttctagactgaaggagccaccaagtacccagtccagtggatgaacgtctgtgatcaaagaccattgccatggcatgttgctggaccccaaatatcagggtaaagacagcatcctacacaccttcagaaggatgagaataggttacatacgaagcgggaatcaggatggctttgtgcttctagacagcagcattggaatttagtgcacagtaaagcaatgtggtctagagttgcaggaaaataattttcagcctttgattctatacccagtgaaactaacagtcgcatgagagagcagactaaaggcacaatggagatttgcaaagtctttaaaaaagtcagtcatcctggccaggcatggtgcttcatacctgtaatcccagcactttcagtggctgaggtgggaggatcacttgagcgcaggagttggagaccattatgggtaatggtataggagagtgagaccccatctgtccaacaacagcaacaatagcagcagcagctgggtgtgctggcctgcttgtagtcctaggtactcagggtacggagggctgaggcaggaggatcgcttgagcccacgaggtggaggccacagtgagctatgaccataccactgcaccccagcctgggtggcagagtgagaccctatcttaaaaacaaattatctccctcaaatcttttttcagaaagctactggagggtgcattgtactaaggaagagagagactgatgactgaggaaggattggaacgcagggagcaggatatccgtcactgggggagaagcagctgaagatgatgcctgtgcccgggcagatggtgctcagtcctcagagcaggaagtggtgccgagaaagtctccccaaagacgagattgccaggcagcccgatgccgggtgagcatggacatctccagaggagatttgaacagtttaaagagccagggtggaatgagcgataaacagacagctaagcaagtgaaaaaccccttctcctgttagcttgaggggaagcacaaagtaggaaggagttggaagtcaccatggtttcctttgtggcctcagtgtgagtggttgagcacccagctgtgctcagctagacgcggggctcagccagacgcggggcagctagagctgtggtgatggtggtacctgcggggcggcagaggggtggtgggagcaaagagccatggcctcctcttccatcctgagaagtcacaggtaatgccccaaactgaagaattaggaaagtggcaatgaaagcctatcgtctagaggaagggaggtccgtttcaacataattgactcaaataacttagagtgtttgcttctgaggctgggaactgggccaggagatgcagagtggagttggggatggctgcttgccataacaagccttgtagtttgactatgtacactttgtttatgtaacttcacgaggaatacgtatacatggaagaaaaggagattcgactgggaatgccaggggcatgctagcaggtgctgtagtctcagccagaggcatgtgtgcagggtgcctggcaccgtctggggtcttctgtgcgcacagaccgcggtgtgcacgctcccaggagccatctgatggggcagcctcgagcacctctgacttctgacttcgccccacgggagcccatctggggctccagccttgacctggcagccagcagggctgggatgggactgcggccagccacgtgggttctcagctggttagggcctcggtcctctatcccttacctctgtcccacggagacccgtgcgagggcccatcaggcactcgagctggcaccacgaggactactgacggctttgctggatgctgctgggaagttgagccggccaaggtggcgagtggctgcgcctgggctgccccgtcctggcggcggcgccctcccgttttctgttctgggaagcacacggtgcaggcagtgtttgtgccttttcccagaggagccctttgtcctgaggaggcgtggatgttctctggagacccggggcctttcgcagcggcaccgtgacttcctgctgctgggccctgggccctgtgtggagtcgaggcctgcaggggcgagagtcagacgagagttggagtctggggttcacatgggattctgcagcttcccagcggtgtaatcttgggccagacatgtcccacccgagcctcgtgtgcttgtctgttgaatgggaagggtcgtggtgtctcgcaaggctgtgaagaatgaaagctgtgtggtgaggaataatggcagagaacactcaccaggccctttccaggtgctgctccaagcacttcctgggccttcactccagcagtcctccctgccaccctttgaggtgggggcactgttgtcatactcattttatgagtgaggaagtacaggcaggagaggttagcagctgtcctgaggactcacagccgatgagtggctgggatctgaacccacacagcagtgttgcattgccgtgtgctcttcccatcagacttaggcctcgtggtgatgagcttgtgtgtctatcccagggaccctccagatgtggctgatttctggcatctcttacgggtctggtcttgggctgcgtggtctcatggcccctttggcagcctgcatggtgccctcttactgggcacggtgaggcctcaggaacacagcagctccaccctccaactgctgggcttctctgctgccctttgcatggcggaggtgacccatatgtgtcccatctccaccctccagctgctggacttttctgctgtactttgcatggcggaggtgactatacgtgtcccatctccaccctccagctgctgggcttctctgctgtcctttgcctggtggaggtgacccatacgtggcccatctccaccctccagctgctgggcttctctgctgtccttctctgctgtcctttgcacggtggaggtgacccatacgtgtcccatctccaccctccggctgctgtccttctctgctgtcctttgcagggtggaggtgacccatacgtggccctgctgtaatccgccaagcacttccgggggtgaggttgaggaatctttgtggggcatgtgtgcacgtgtgtgcatgctgtggctccagcaccacagtgttgacagtcctgtgagcctactgggtaagagcctaggttgaggcctgctgcctcctttggttgtgtggcctcaggcaggttatggaactgcacccatgttttcatctttaaattggggagaatgagagtgcccttcgctctgctggcacgatacgcaggaaacgttgcttctcttcagcagattattaggattctctgaaagttctccccagttctcttttctaccccattcattaatggcagccaccagtggcgtagcagcaaggaaaattgggccgttttgaagcactatcgagttctgcctgtcttgctaaatcatctgtgttccaactgtgctctttgaactgttgaaggccagaagttgttttgcgtttgatcacctataaccgccaaccccccatgtgtttctgcctgtgtttaactggtcacagggagcttggggctcctccggttcccatccttgggagaggcaggcccatccactcagtacccacggcaggcacctggttctcatctctgacgccccgactttcccttctcagcctgtgtcgcctttcctgtgatttcctctccttgccttcctgggatcctgctagttccagcccatccccactgccgctacgccacttggaaaccctttctcgtgcagtggccaccttaccgtccctggcttcacttttgcgtcttgcaactattcttcactccagcacttggagggatctgcctgagatgaagcaatgaccacgagaccctgctcaaagctgtttgtctgtccctgccgatgtcacgatgaagtcctcatgtctccatgtggctgaccagaagcctcctgccattgcctggctctcccgcttctctgtcaccctcgcctcagcctctgcaccagccacaccgaacatgagttctgtgctttctcccactccctctgccctcccacttgccctcccctttccctgttacggcccactccagccccgaacacttagtggctttgaacagtgcttggtaatttttcaggattctgcaggttgcctggggccaatctggtggcagttggggatgggacatccaggatggctttatgtgcacgtgtgctgccttgttaatggccaggaggcagggctgccttctttcctcaggggctctctctggctaggacgagctgcttcacgtggctgccaaagcccatagggacaagccctggcatgcaggttccttaagcctgttggttgtggttgcagtagctgtggccagagcctggcccgggtgtttgtggaagggacgacctgagggcacgagtccgggaggcagggccccttcggatgcattcatcatttagggtttatctgcatcctgtctcgtctcaggaagccttccgcaacccctccacccagactgtggtccagcccctgctccaagtgcccccggtgggcctttgtgctctcagtcctggccgacccctccacccagactgtggtccagcccctgctccgagtgcccccagtgggcctttgtgctctcagtcctggccgacccctccacccagactgtggtccagcccctgctccgagtgcccccagtgggcctttgtgctctcagtcctggccgacccctccacccagactgtggtccagcctctgctccatgtgccccctgtgggtctttgtgatctcagtcctggcaccttgacccgctgcttgttctgctctcctttaaactccatgcacctgacctgttaattgcacgcagcgcggagcctggcacctgcagtgtagacacactggccaccgctcagtgcaagagggcccctttgctaatgtgcacagctctttatgccttttttcctatgcctttttggattggagcaagagattttttttttccaagtaaagaacaatttatgttcctaaatactttttttccttgacatgacgaagttgagcaaggtggctatagaactttttttcttaattttattgcacaagtaatgttctttacaaagtagggaaatacagatacataaaaagaagactgccaatcccccgtaatcccaccagtcgcatccctacccgctcttaggagattccggtttacctttgtagattttcactgtctacatgcggactttaaaaggtgcagtcctgcaggcgaatgtgtagccgcctgcgtttgcgtcataggtcccgaatgtcctttctgccacacaggaggccatcccacgcttgtcctgtcacggatcgtttgcctcctgtgaatattcaggttgtttccggttcttcctgttctgaacagcgccaggacaagcaccgggtacacatttttgcattttaaaacacatttagtaactcattcttcagctggggaaaagcccacgtaagagcccatcagcaagtccgagcgcgtgttcctcccgcttcagccgccatccctggctccttagcgtgttcctcccgcttcagccacaatccctggctccttagcacactcggaataaaacctgagtcctcccggtggcctctgggccccacgccccgtgtgtctgccccctgctccaggcttgtgttcttcctccaccctcccagagctccttggtgttccggcctcaggaccttgacctcgtggcgccctccacgcgggagtatcgtcctgtgccttctcgcggctggttcacccacaccagccacatcatcagaaggaagagattcttaggcgatttttgtttgctgaaggagaatcacagatcaggatgaggtctcctggtcccttcctcccttttaaggacagataactgaagttcaggaaagcccaggccacacagcaggccagggaccagctggggccacagcccaggcctgcaggtgcatggctgttgcctttctagagttctgaggccttttctctccctttattgctcagcaagttcaaagaacatctcgctaatgatgcacctttttctgagtttctgttcgttaaagtcctttgttcccacattgcctttgattgtttctctagaagccagatttacttgattttcaattcactgttctttttttttctttttttagacagtctcgctctgtcacccaggttggagtgcagtggcacgatctcggctcactgcaacctctgcctcctgggttcaagccattctcctgcctcagcctcccgagtagctgggactacaggcacccaccaccacgcctggctaatttttgtatttttagtagagatggggtttcgccatgttggccaggctgttcttgaactcctgacctcaagtgatccacccgcctcggcctcccaaagtgctgggattacaggcgtgagccaccatgcccgtccaatttactgttctttactctgcaatctgctgcctctttgccaaaataaatctttgcaggtaagataggtgcggtggggagtgtgaaatttattacagaatggttattttgcttcttaaaaaatttttgttttaagaggcagagtcttgccatgttgccctggctggtatcaaactcctggcttacacgatcctcctgccttggcctcccaaagtgctgggattacaggcatacaccatcatgcctggtctaaaatattgtgtttttttttttaatttttttaagagatgaggttgcccaggttggagtgcagtgatgtgatcatagctcactactgcctcgaactcccgggctcaagtggtcctcccacctcagcctcctgagtagctggattacaggtgcccaccaccatgcacggctaattttaattattattattattattattattttttgagacggagtctcgctctgttgcccaggctggagtgcagtggcgtgatctcggctcactgcaagctccgcctcccgggttcacgccattctcctgcctcagcctcccgagtagctgggactacaggcgcccgccaccatgcccggctaattttttttgtatttttagtagagacggggtttcaccgtgttagccaggatggtctctatctcctgagctcgtgatccgcccgcctcagcctcccaaagtgctgggattacaggcatgagctgccgcgcccggcctgctaatcatgactaaaggtagaacagtcaggaatgtcacctgttatctctgaagtcatagtcccttggttttccctgacctgcctgctactgcgcccacttgcagcagcacctccgttgcccagtgaagcatgctgccctggtcttactgtttcaccggcactctcctatctgcgatgccactgtccacagcggggttgctttagggtttcgagctcacctggggccttcctgggttctagccccgtgagctacaggcacttctttgtaaaaggggattccaccagttaggcagattccggttcagtctccagcagcccggggcccttcctggaagagtgctttgtgagcggagtgcgccgcccaggtgtgtagtggtgcttctcaggcccatgggctgcccttccctgggcctcttctgtttgaggcccttgtcactgggttcgcctggcatgatgatggaggccctgcagctccctgccaggcgtggttccgcccaggtcattctcccggcccagctgctgtggacagtggacacacgctgtcacagcctcaggccggccgggccacgcctcccggaagcgggcctgcttgtgtgtggttgcatcccaagctctccacttgctgcccctgttctgagcttcttgccgaagttgtgtttggggccattatctagctttctttttgaacgtttaaagcattcaaaagatcagcttttccaaagagtgaggaaacagggagagaaaattatggcatttgtttgaaaggttctgagggcttttttttagcttgaacagttcaaacagcgcctcttgttaatcaggaatgttctggcatccctggggtggtcacacgggcttaattggaacccaggctgctttgaagcccttgagatccttcctgagctgggagaaagagtgcgagggcagcaactgtaaagccggcatttcttcattttatttacatgtgtctggggacccttgtaactcatgtccctgcagcagttgagccaagttgctgacttgtggacagctcagagagatgggggccagtttctggcaaaagagctgtaaaacatggcctgggtccagggctgcggcgggatcccctcctgggaggcgaggtctggatggaccacgtcacagtcgtggtggcgtggactttgctgctggcggcctgttcttgtcagaagtttccacatgggagaacgtgtggttttactgaagtcacttaatgagtgaccctaatagctctaagacgttcatcagtatggaccccaggacttacttcctctttcgcagagcatgtggacccacagtaaccacactggagttccaggcacaggtgtaccctgggggccggtcattctgcgtacacagacctgcctttgtcagcggggctgtgggcagcatggggtggccatccagccatggccatgttgctccaagccccaccgtggtcctcaggggcactctgtctcgccctgagcctccagccaccttgcccgtcagtctttccctgtacctcttggggatggggagtctgccacctagcaaagcacccacttgtcccaccccttccattctgttgagctgagacgcgtgttttggtcgtttcgtgccgtggacaccaccttggtttagtgaaacacggcgcagagtcccctctcccctggaccacgtttccccatttcagctccctgctgtgcacggctgcttcttcccgctctgcagagggtggtcctggtggctggagtgcggcaggcagcagcatcctcccatggtggctcgcatcccagagtgtgaccgtgggttcatgctgacggctcaggcatcccctgagcctggacactgaagtgtacagattgaggtgtgttgttggatgagtcatgacaagtggaacatgtgcactcgtccagataacacacttctatcagtccagagttcccggggtccccccagtccagcccttcatccccggcagctgtagcttagccttgtttgttgtagaacttcctataaattcttccctttctattttttttctttttctttttttttttgagatggagtctcactttgtcgcccaggctggagtgcaatggtgcgatctcggctcactgcaacctccacctcccgggttgaggcgattctcctgcctcaacctccagaatagctgggatgacaggcgtgagccactgcgcccagccgtatttgtattgcccaccttttgtttcgttgaatctgtgctcaggtgtcacctttccctagctagagccctttcctggccctcccgggtcaacatgcccccttccctcagcctcaggctttccactcttctccagatccggccactggatcaagccactgtcacctcctctgggccttggggatgtcacctgcccactcttgtcatggtcggcctcctcagcgagccactcagctctagctgccaaggactctgtctgtttgtccatgtagtgtccttgctgggcacacagtaggtgctcagttaaatttgttcactggatgcagattctgcaggcatcttcacagattatgctgatggagcaggtgtgccctaccaccatatgtttctacaattgatttttttttggtgcaactgtcaaaaaatttatttttcctctaccacccgcaacccccccccccccatttttcctgcttcttagtgtggttttagactctgattctgtcacttaacatatctgctgtctccatttgatgtgacctacaacctgataggcatgccgtctgcccctgctcgggcgatgggcgtgggcaccagcaaccgtcacaggggtccagggttttccactgactgccgggtgccctcagcgcagagctcctgcaggagggtcgaattgtctgtttcatagaccagaaaactgaggctcagctgggcccttcacctggctgcctccagagtgcgggctttctgctgtgccaggctgttctcttgcctctcccattcctttgcatcagtcggcactctggaacagtgcctgaggatgttagaatcaccttatgtctcctctggaaagaggccagtggatagagaaatatttatttctgatcttgtagtctctgtttatacagcggttcgttatacaagtaacctattgagaagaggacataggtgtctgcatgcatccgcttctcagtgagtccatgctggactgtaactgttcccattttcctgaggtggggggttgaggtttggagagctcagagtcacagattcgcaatgaatggacttagaattgagtgcttgactgactgcagacactaaggtgttaactctgctgcctctttatgcttgggatggtttgcagaacctgctttttgaaaacaagactatttacatgcacgtttctgttcccagtaattcttggcatggatgagggagatgctttgtgtcagattcgcatggtgaggagggggcagctctgagaggagccaggcccaggctgcctccagggcgtccagtgctccccaggcttgcctaggagagtgtcgattcctgctgcacagcaactctcatgaccaagtttaaaatgcattatacgtagaaaagtgtgcttctgtggctcacgcctgtaatctcagcactttgggaggccaaggcgggcggatcatgaggtcaggagttggagaccagcctggccaacatagtgaaaccctgtctctactaaagatacaaaaaattagccaggtgtggtgtcatgcgcctgtaatcccagctactctggaggctgaggcagaagaatcgcttgaaccgggggggcagaggttgcagtgagccgagattgtgccactgcactccagcctgggcgacagagtgagactctgtctcaaaaaacaaaaaacaaagaatacatactgtcgcctgtgtgcccattctcaagaaaaaggaaagtttctttgaaaacatgtggaccttccctagttccatcccattacgcccccaacccacactcccagagcaagcccctgggctctgtgatcactcctgagttttgtaaacactgtggtgctcactcagtcctgctccctggaggccttggccgcccatccttaatgtgccggtttgtgcctgttgcacgtcattgtaattacatcatttaattaaatatggaagctgatgaaaaataattatgtgtagagcaatgtttctgtgaagacaaagctgaatgctttggaaagtcccaaaggaaaattgctaaaaaattgctattgaataaagcaaatagtgaaagattatgaggaaaagttgtaaggtctgggaagatgacagggatccactttaaagaaacaaagctaacaatcatgagcggtgtgtcgtggacatggttcatgcaaaaaaaaaaaaaaagatgaaactccaattaatggactcatgttcgaagaaaaagtttgcagcttgaaagataattgtgtgtttttctgttttaagttgaaatgtttgagatacacgcatcatttgattcctcacttagccaacttctgggatccattacgtttttttttttttttttttgtgagtggtggattatagataactttatttttattctttgtgttttcctcttttaatggattttttttaagatatcatttacccctttaagttggttttttgtttgtttttttttttagtatttattgatcattcttgggtgtttctcggagagggggatttggcagggtcataggacaatagtggagggaaggtcagcagataaacacgtgaacaaaggtctctggttttcctaggcagaggtccctgcggccttccgcagtgtttgtgtccctgggtacttgagattagggagtggtgatgactcttaaccagcatgctgccttcaagcatctgtttaacaaagcacatcctgcaccgcccttaatccatttaaccctgagtggacacagcacatgtttcagagagcacagggttgggggtaaggttatagattaacagcatcccaaggcagaagaatttttcttagtacagaacaaaatggagtctcccatgtctacttctttctacacagacacagtaacaatctgatctctctttcttttccccacatttcccccttttctattcgacaaaaccgccatcctcatcatggcccgttctcaatgagctgttggatacacctcccagacggggtggtggccgggcagaggggctcctcacttcccagacggggcggccgggtggatgggcaggggccgccccccacctcccggatgggcgggggccgccccccacctcccggacggggtggctggccgggtgggggctgccccccacctcccggacgggctggctggcgggcgggggctgccccccacctcccggacagggcggctgctgggcagaggggctcctcacttcccagacagggcggccggtcagagatgctcctcacctcccagacggggtggcggtggggcagaggcactcctcagttcccagatggggtcgcggccaggcagaggcgctcttcacatcccagacggggcggcggggcagaggcgctccccacatcccagacgatgggcggccgggcagagacgctcctcacttcctagacgggatgtcggccgggaagaggcgctcctcacttcccagactgggcggtcgggcagaggggctcctcacatcccacacgatgggcggccggtcagagacgctcctcacttcctagatggggtggcggctgggcagaggctgcaatctcggcactttgggaggccaagtcaggcggctgggaggtgaaggttgtagcgagccgagatcacgccactgcactccaggctgggcaacactgagcactgagtgagtgagactccgtctgcaatcccggcaccgcgggaggccgaggctggcagatcactcgcggtcaggagctgagaccagcctggccagcacagcgaaaccccgtctccaccaaaaaatacgaaaaccagtcaggcttggcggcgcgcgcctgcaatctcaggcactcagcaggctgaggcaggagaatcaggcagggaggttgcagtgagtcgagatggcggcagtacagtccagcctcggctcggcatcagagggagaccgtgcaaaggggagagggagggggagggggaaggggagagggagggggagggggaaggggagagggaggggaaggggagagggagggggagggccagggggagggccagggggaggggcaggggctccattatcgtcttgatgattctgggtaggaaaccttgcagtgatatattgctgccccatttatagtgccagttatttgcattgttatgcatagctgagcgtcagttaggaatgatagaattgttttgttacaaatgtttataattagattttctctgcattaatttgttgtgggaattatttttctttttataaaatttttatgtagtacctgattctgcaatataaggttgcaatactaggctttgaaaattacttattgaacagctattgtattttcttggtacagaatattgaaaacattcaaaaagtatccagtggctagcccggcatggtagtgggtacctgtaatcccagctactctggaggctgaggcaggagagcggagattccagtgagctgaggtcatgtcactgcactccagcctgggcgacagagcgagcctctgtctcaaaaaagaaaaaaaaataggccgggggcggtggctcacgcctgtaatcccagcactttgggaggccgaagcgggcagatcacaaggtcaggagatcgagaccatcctggctaacacagtgaaaccccgtctttactaaaagtacagaaaaattagctgggcatggtggtgggcgcctgtagtcccagcccctcgggagtctgaggcaggagaatggtgtgaacccaggaggcggagctttcagtgagccaagattgcgccactgcactccagcctgggccacagagtgagactctgtctcaaaaaaaaaaaaaaaaaaaaataggatccagtggcaagcctcctgccatgttcttgttctccagcaggaggccattgttattttcttgtttatcttttagattttttttttttttttgagacagggtatcattctgtctgtcacccaggctggagtgccgtgcgcgatcatagctcactgtagcctctgcctcccaggctcaagagatcctcccgcctcagcatcctgagtagctgggactataggcactccccaccaggcctggctaattttttgtattttttttgcagagacggggttttaccatgttgcctaggctggtctgaaattcctgggctcaagtgatctacccacctctgcctcccaaagtgctgggattacaggcatgagccactgcgcctggccagacttcttttgtgcaaaaatgaatcaacacagccatgcaggttttgacttttctgcacacggcagcatagcatacttatagtccgcttcttgtgtctgtatttagcactgcctttttggtgatctttcatgttaatataggaaaagatgtgtttttttcctcttacacaagttccattgtatggatagactacgacatttaacctgttataccgaacttttaatccagtggtctgagttcagtagaatgacttgcgtagcatttagtcggatagttactgttctggaatgatatgattttttttgctcattctcttagtatttattgaaaacgtattattgggccagtggaaaaaaacagaacaaaataaaaaacagtcccatgcctttctggagcctgcattccagtggagggggaaagacactaaataagcaggtagaaagatgcaggatctcagctggtggtgttctgtgaaggaggagagcaccaggaggagcggccaggagccagggctcaggtgacattccattgaagactcaaacaagtgaagagggggcaggccacgcaggcatctaggggtgcggtgttgtggaagagggctgtgcagaggacctgaggtgggaatgtggctcccgttgtgggaggttttgaggcagtgacgtggagaagcagatgcctcctgcacccctgtcctgcacaggcagtgtgtgggacccacatccccgtaggaaagtggttgctccctgtgggagtcacagcgtgacgagggtttgctgctgcgtgggcctttgggcttatggatggggctggagagtagtggtggagcagccaggcctgaaaccacaccttgcctgggtccctttccatggggtaagagtgacctttcctctgtctgctgggaagagtgtgagtggcatcgtctgccatgtggccagggtgtcacggagcggcccaggctcttggtgagagggactggtgccccatgtgaatcccctgacttggggttcctctgatcttgggaccagagagtctgagctccagcttagtggcctcaggctgggtgcagcaggtgcagcaggtgcagcctcaggcaggtggctcctgcagaacctgacccagggccgggtactgcacagcatggcattagtcccctgtcttcaggaaaacaccagctgctcctcccgtgttctggggccatgcatctctcccaacctggcgaccccacctttccacacaattgtgttgcatcagccagaaaagtccggctgacatgacgccctgttgcccttgtgactttgcagttgtgaatgctgattgtcctttggtttgtagcactgaggttttgctgtctaatgtattttattcctatttctgcatacttttcgcaaaacaagccctgcagagacagcctgtgtcgcttgggttgtgttccctgccttccgcagggctctggctggagccccagcctcagcagttttggactgtggtcctaggccctgtggatttctattctttgaaagcttgaggtgtcttgtttgctaattagtttgatggctgttgctgtttcattcattttccacctcggagtcctctgggtctccagtttttcagactcggtgaaactggcactttgggcttcagctagagccccaacatctgctattagccccaaaatagctgtggcttgggctggagctgctctcgcctcggaaggaaagcagtaggccggactccccacagccctctgctgctctgcgtgcagctgggcttgagtcaaaattcagctgcagatagaacaaaaagactttcttccccttgaaaacccaccagttagaatttaaaaggcttcgcagctgaagcccgcgtgttcagcagcagatgtcacagcttggactgcagttggaactgtcactgccgtgtcatctccgagctgaggctcctgaggcctctgaatgccttccactttgtagttggtgaagtgcgggtttcagaatggactgtcgggagttattcttaggccgtaataatacttggcacggctcctcctggttacgagcacttagctaatccccagagcacccttggtaaacatctctgagtagctttaaccacacacaggtcaggaggcttctggaaaataaacactcttcctgccagttggaggtgttggggctctggtcttggatttgatgtgtggcgaaggctgcaattgtttaataacccttcatgattcaacagctcttcaagaactttcctctgttcttgtgtggagctcgtgacagccagtggtggtggagctccagccctctcttcccacaggcacaagccgggttcctgagtcccagggcttctcgggaggtgtctgccctcctctttcagacaccctctgccctgtgtcccagggccctgggcctgtgctgcactgagcagagactgtaggggaccggctctcccactcctcccagatgggcagcgtcttccgtgtcgggagcatgctgtgctgcttttctcttctcagtctcttagtttttgcgggttcttacgcatgtgaggtgtggacttgcatggtggggagctcaaatggtaacatgaaggggaggagccctctgagtgctgtgatttgttccatcattaccgcttcctgatcacggtgacctgcactgctggagtggtcagtggagccaggcctccccacaacagtgttcccatcgccttcttactattgatttctattcttaaaatattgtattacttagcactcttttgaagacgttccagtatatatcaaatgatcaaaagtccataaccttgtcctacgtagaagccaaaggtgtcatgcagtttcaggtgttcgagtttccagaattcttgtgatgacatttgtaggattcttcttttagacttggaccaaattctgtaacctaatatttgtccttcagattgacagagaaccgcaggcagtgttttctctgtcacacgtgtggtgggtggcatcctggtgacataaagaattgcctttggtaacttgcccagaaggctgtagggttattttctgcttagactttcccctatttctttcttttcttttcttttccttttctttctttctttttttttttttttgagatggagtcttgctcttgttgcgcaggctggagggcaataccgtggtctcagctcactgtaacctccacctcccgggttcaagcaattctcctgcctcagcctcctgagtaggtgggattacaggcacctgccactgcacccggctaattttttgtatttttagtagagacggggtttcaccatgttggccaggctggtcttgagctcctgacctcaggtgatccgcctgcctcggcctcccaaagtgctggcattataggcgtgagccactgcgcgcccagcctcccctctctatttatgcagatgatcggtagttccggaagtagttgtgtgtaagaatcaccagggagtttgtgtgcagcccctaagccccgccttcaggggggtcttgattcagtggggtggggtggggcggggcaggctggagttgcctcagatgactctggtgcaggtggtccatgccattagcccgacgtcatgacgccacgcaccgtgaaaccatgcatccactgccctcgccacacgcgccgtgaaaccatgcgcccgctcccctcgccacacgcgccgtgaaaccatgcgcccgctcccctcgccacacgcgccgtgaaaccgtgcgcccgctcccctcgccacacgcgccgtgaaaccgtgcgcccgctcccctcgccacacccgccgtgaaaccgtgcgcccgctgccctcgccacacgcgccgtgaaaccatgcgcccactgtcctggttagagccgagcacatcctcgtgtcctgcgctttttgcagcaactgcctgaccacctttttgcccagcatcagctttaatgggtgttcagtgctcaatgttatggctatgaggacttgcttattttttttattgttgagcttttttttaaattaaaaactatgagatggagaaagtaagttggtgcagccacagtggaaaacagcctgtggtggttctcggaaaaaccgaaaaggggatgctctgtcagtgccgcttctgcgtatccacccgagatcattaaaagcagcgtttggaacaggcattggcacacccatgttcctagcagcattattcacaacagccaaaaggtgaaagcagcccaggtgtccaccgacgggtgagtggataaacgttgtgtagccacacaatggagtattactcagccttcaaaaggaaggagagtctgccacatgctgtaacatggatgagccttgaggacgtgatgccaagtagagtgagcccgtcacagagaaatgctctatggctccactcatgtggctggagtggtcgcattcttagagacggaaggtagtatggaggtggctggggctgggagcagaggggctgtgggagttcctctttaatgcgacagggtttcagttttgcaaaattaagagttctggggataggtgtggtgctggttgcccaataacatgaatatgctcaacacgacagaactggggacttaaaaatggttaagatggtatattttatgttaagtgtattttaccacaattaaaaacatcccaacacggtggcaggatgccaccgtggccaggtgtggtgcttgtcttgggtttcctcaggatgtcctcttggaagagcgtggcaggtcagcaggtcaggcctgaggacccccctttgctcgctctcttagcctcgtccttttggagggtccagtcttcctcaggtagcaagccttcttgccaggccacagaagccccaagccggaggagcggctctccggctcccgtgctgcttctccgtgcaagcctctctgagagctcacagtccacccctgtggactcctccgcgtgcccagagcctcctgggctcctcctccccaccccgcttggttcaagggtatgtcctttactccagatggtggcctccgtccttctccacaggctgctgttaatacgagaagagggcgccggaatgcttcctgtagagttcaggaggtgacctcctgacccgtttgatcggattccaccttgttcttgatgggacctcctttgtggcctcagaaatgtccacatgttggcaaaaccatttcatcttttctttttctgatatggagtgctctgaaaccattgccttaaacccattctgtttccactagctaaagctcatacacttcatccccagagagcccattttcttttatttatttatttaccatttatttatttttatacataatattttacatatttatggagtacctgtgatattttcttacgtgcacagaatgtggaatgggcaagtttagggtatttggggtaaccatcactttgagtatttatcatttccacgtattgggaaaaattctggttctcttctagctactttgaattatacaatacactgttaactctagtcaccctcctcttctgtggaacaactgaatttatacctttcatctaactgtatgttcgtacccattaactcaactctcttcatctgtggttccgctcacccagacctttcaatccactagttcctgtcattctactctctgcctttaggaggtgaatttccacagctcccatgagtgaagacgtgcagtttctttctgttcctggtggtttcacctgacacggtcacctcccattccagccacgttgttacaaatgacaggctctcattctttctttttttttgagatggagtcttgctctgttgccaggctggagtgcagtggcgtcatcttggctcactacaacctctgactccctggttcaagtgattctcctgcctcagcctcctgagtagctgggattacaggcgtgtgccaccacgcctggctaatttttgtatttttagtagagatggagtttcaccatgttggccgggctggtctcgaactcctgacctcctgatccacctgcctcggcctcccaaagcggtgggattacaggcgtgagccaccgcgctcggcccagctcttgttctttcttacggccggatagcattccactgtgtgtacatccccattttctttatccattcgtctgtcgatagacacaggttaattccgtatctttgccatctttgctgtgataaacatgggaatgcaggtatctttttgatacagtgatttcctttgagtaaatacccagtggtgggattgctggatcatgtggtggtgttctgttttcagctttttgagaaatctccatactgggttccatagcggtggtactaatttacattccttccaacagcagctgagagttccctttcctctgcatcctcaccagcatctgtctgtgtgttttttggtctgtttattagccattttaagctgaggtaaggtggtatctcattgtggttttgatttgcaattcccccgatgattagtgatgttgaccattttttcatatacctgttggccatttgcatgtcatcctttgagaaatgtctctttgtgtcctttgcctactttttcgtgggattatttatgtttttttaattgttgttatttgagtttcttttgagttgtattttggatgttagtcccttattggccgaagagttgacagatattttcctgcattcaagaggctgtctcttcactctgttgattgttttcttggatgggcagaagctttttactttgatgtagtcccatttgtctatttttgtttttgttgcctgtgcttttgaggtcttagctataaaatctttgcctagaccaatgtcctgaagtgttttccttgttttctttagtattttttatatttttgggtcttaggtttcagcctgtaatccatctccagttgatttttgtatatggggaacacattttcttttgattgacactgccgaacaaagggtatacaaaatttcacaacttttaacatgctggttgatgattgtacttgaagtgttttctcctcatgtccccggcgacatccagacaccgcctccacggtgcatgtcctctcccggcctcccaatgccagtgtgaaaatgggcttggattgcacaccctgaaaacagcctccagcctccctgtcccttccacatccataaagttaacggcatagggattgtcaggtaatagcagtgcactgtacctgtgccgtagggttttggaagtgagccttaggaagcccagccgagcaggtagggagttgagcctggaggggtcagggctggggctgagacccaggttttctcccatgggtccatctccttttcctttaaggatgtcctggccttccctctgtctctgcaagtagagtagactggtcccgtgtgacgttcttgaaggctgtcatcgagctcactgtgcttgtgcttttgagtggaagctgaaccctggtcatgagcaagaatggccagacagggctcgtgaggcttggtttagccaaagtggtgactgcgggtttttcagcgcaagaggctgcgaagggagggattccttctggtgcccctgtgccctccagcggcttctgcccgtgggaggtgttgggcacggctgcccctgtggttggagggctctggaatagcaagccctgcagcttcagtcctccctatgatgggggcctggtcgcatggggactgagagccggcagggatctgggggcctagggatgtggccagcaagtatccaggctgagagcccatcacgtgacagtgctcccgagggctggggtctgtgtgggaccatccgcctcaggcgccagccttctgcctcagggcaagccatgctctctgttcctgcctggggcaggacaactccaggtcacacccacctcaggcaaggaggagcgtgcaggggagccacccggaagcagcctcctgcagagtcggtgggaatgtggagagccagcctgctccttgggtgatggagatggatgccccggggctccagagtactcaggtttctcctgtggcccatcagtgccagaatgaggcgttgaccccatgacatgagacagaggccttcctgggtgacgtaggagactgcctggtgcgtgtgccatctgtgggcgcccagcacttcagaagagagctctgtcactgtcacttttcagttgatttgaaccactcccatttcccccctcattgctaaatggttgcatttatcatggtcttggcatcactgggaatcgcagaacatggttagcagagcctggccctctgagatcttaccccagctcccagctttgctgggtgggttcgtaccttggggcaagaagcttgtttctaaatcggtgtcaaatgctcctgaccctgccttctgctctgcaggctgcagggaggcttccccacagagggaggtggcaggcagtgtgccctctggtgagagagaaccatcccagctgggagaaccctggggcctggtactgcctgccaaatgcctctccactggcctcctgctgtttcaggtccagtgacatgtgaggtccctgaggggtgtgaggcggggtggtcttggctgtgtaggtggagcctgtagcctgccgcctgtgaccaccccacctgccgctggttctgggcacaggggctgggaggcgccgttgcagatgtggatatatgcgatttttatttatttgttgtaaataaattctttgcactgagttagtgaaaatttacaagcccctttgattaatgcaaaacaacttaaatatctcattcaaatgtttcagaaaaaatatctcttggcttggaaaggtttccttactttcgtactgatatttttaactccctgaggttggaagctttgggaaactggagagaatggtcacggcgttcaagggcagctgcacctttcatctctgtcctagagttcagtttctcttccaaggtctttcagtcataaatggtttttccacggagctgctttctaaccccggtttgcctgtgtgtgtgaggacagatggggtctccccggtgccagctactccttctgcacccatcgctgtccccactagatgttcagcaaggggcctgttctttgggtgggcagaggaggcctctctgggggacgtggaagggagaaggccgtggcgtgctctgtgtgaattggctgtggtcagagggagggcttatgaccggccctgggtgtgtgtgagggctcagggcctgggccaggccgcaggacatctgctcacaggctcttggtagctttgttccagtgatggaagacactccagaaacaccaaactaatgctgggcaaggcggcctccagctgtcctctgtgccgtgcaaaacaggcatgggatggcgaggggcgtgggggtggccagagacactgtaaggaagtggcccttcctctgtttggaggaggagctgggtgctggaagaccgggggaggggctgtgtgagcgctggatgagctgatgagggtttcgggggcccatgggtagggtgctcaagtgacaggaaaggtcagtggctgtctcagggcagagtctggtcgggcccagtgcgtgaggtttgcagcgtgcgcgttttaggcagcaggatggcttctgttaggggtccgtggttgcagtgtgcctctccgtggccgtggctgactcgcagagaggagctcccgggcaggctgctgggagggtgtgcccgggatccacccgaggctgctctgggggcctggctgacagagtgactgggacctctccttccaggggtgcaggtagcctccttggccaatgtcggggtccccgttgctcattcagtggtgcggtgcgggctccctgagtggggctgggtggggctctcacagcattgccagcgcctgctttctatgtggacctgcgcttggtccatgacaggtgaagagaagaacaaggatgggtcctcgggcctgagctcacatgccactgggtcagtctagccagggagccttggctttgtgccccaggttgtgaggctgggaatgctcacacaccactggcgtaactttgcatgcatggctcagatccttgctgtgtcctccggagtcccagcgttgagttagaagatgtggctcgggccgagctcagctgttgctgatcatcggggtgcactttgaactttgaagcggctgtttcacattggagtctgagtttcctcgtttaaaaaatgaaaacggtgaacaacagggttgctggggcattcactgagacaatctggaatcgtcctggaaagtagaaagcgctacacctggagatcgctgattttactcttgttgttatatgtgggtcttctgaaggagaggtgaggaaaggaacttaaaactcgctgagcacctcccctgtgccaggggcctggcgggtgctttttaaacatgatttcgtttcctctgaagagtgacactgtcaggtcgtgtctctgtttctacaggtgaagtaaaatcggggctttctaaggtcatctccccggtgttgcataggggtgggggctgtggttgaccccaggctgtagtgcgtgcatgctgccctggacctgggtccacagagttcacacatcctgggtcccagagcatcagctacagaggttgcttttggccttctgttttgtgtgcagaatcaggtttacttctcggggacagctggaactgagtgtgccttgtttatcctgcaggactccagaagacctttccagattcgtggttgagctgcagcagagggagcttgccttgaaggacaagaacagcgccgtcaccagcaggtagacctggccgcccagggtgcttgtggggatgcgtttgctttggagagttaggggtgagtgagagtgtgtgccccctggctcttgggggatggctgtccttcatcatgtggttggccctggtctgggaggagatgggggagcagggatttgagggaagggtttgccccatgtttccaccatgtgctgtgagcctccgctgaggcaccaccgtccatcgttctgacaatgtgctaaactgccatggggtctgggggttggcctcctgttgtggggtccctccttggatcaggagggttcttgtcttcccagcagggttggggcctcatgtggtcttgggaaccagcccgtcggtcactagcgggcccaccctgagtcttcacgtcagcatgaatgcaggcgtgattggaaggggctcactatgaataccaagagacatgcccctcactcaggaagtcccaagggcttcagggaacctgggatgacgatcagatatgtatttcttcttatcccacagcccggctcttctctggtttcgctcgtggctgtgaggggccatccaggctccggcatcacacccagaggcggaaatgagaggcctcttttttggatcttttctgtacaagaaagcgtttcctaggacccccactgccagcaagggccccttatgcctccttggctaagaaggggtcttatgcctgcccctgaccagaaggtggagctaccatgagggactgaaccccatccggtgggacctgtggggctggtgggcagtggggtgggcttgcggcagagggaagggccgtgcaacggggccccaggggagctctgcgccctgcacggctgaccaggccgtgggtctgtgcggagggcctgaagctcacctgtttgccattgatgatcaagctcagccttgtcctcctgtggagagagtgttttaataatttattaatagccagaaggaggtttcttattttgggggctgatgtcactttgaaaattggcttttagaagcatctggttgtgttggacataatcacatcaatttactgaaaaacctcaaatgataaagattgccttttgctttcaaagccgctgtcagatgaaacaggcattaaaagtgatttgaagttaaagcgttcacactttaccaggcgatcctcatcattttactttggaaatgaaacagaatgaactattaaaggaaaggaaagttgcctgtacttttctcccaccaaacagggaggtgcttcctaaaattatttgccttgaccagcagcagcaggcccatctctgtgtccagggccacacggaagggaacattcgcatctgcatgctgcccatgttgccttcgctgtggtcagagatgtggattgagcccatggggggattggtttgggaatggggtctctgtctcagggagcagcctctacagtgggcaggtggtcctcacaaccccagctgtggctggcctctcaggacctgtgggctccctctgagagctggggcacccgccctggggaagggtgagtcttggggcatcccatggacgcgcttggtgctccgtcctgttctgtgaaatggggtcttgggggtgagacgaggtcctcagtactgcgctggtctgggaggccaaagggagaagctgccctgaaatcctgggttctcacaagcgtttccagcttgctttcatgtgtgtgtctgtatgctggcttctgtcccacgtgtggcttattgccctgtgtgggcttctttagccaaggtgcaggctccagatggcgctggtcacccgtcgccaggagcgctggagacgcttccctgagatggggcagtggagaggcgcaggaggcctctgggcgtgaggttggagctcccggtccctcttgcctgcaggtcctggggggcggctggtctgctccttgctggtcatgtgacttgggcaggcacctggtcctctcttcatctctgtgagctgaaaggtactggcagtaacgactgggttgctgtgaggtctgagcctcctgaactgcgcctgggcactgagccgtccccgggtctcagtgctgcttgctggtgggtggacacttcccgaccaaggctttctggggcctggtgacgctgagtgcctggcccttttgtgcacttccaaggcccaggaaggaggcagaccctaggacaggcagcgctggcagtggccaatgaggtgtggatgagtcccgtcgtggccttggtgcttgcgttctggcctctgggctgctgctctcttccgtggcgggacaccgtgttcgtcgcggcctgccgtggcggggtcagggagcctcgcacggttgaacagctgagcacatttctacaagtctcttacaggcagttggacagaaattcagatgagcgtgaaggaggcggcatggcagaagatgggaggccacggtggcccagatccccgagggctttgccaggcgggcctcattttaaagtcacttttgtttgtttctcattgaaagtagcttgtagtcactgaagaacagagccctggtccagctgaggtcacgggtcatgagagcagctgctgggcattttccctcgtctgtgcggaccagcgggcacgtgcttgtgaccacgtatgttctcctctgcagtttttaccaagtatgttggccgtgtccatctttccctggtagtgaacgctgttctcgccatctgaggagcttctcagggtgcggctccactgccctgttcctcgtagcccagtgcccggtgctccctcttcgaggcggtgccctgttcctcgtagcccagtgcccggtgctccctcttcgaggcggtgccctgttcctcgtagcccagtgcccggtgctccctcatcgaggtggtaccctgttcctcgtagcccagtgcccggtgctccctcttccaggcggtgctgctgtgacggtgccgctggggtagctcacgtggcagcatctcggaatgcttgtgcctcaggccgagcttctgaagtgacggctgggtcattcgtgtgcctgttttcaggagcttggcttttagaagatgaatgttgcctatcagccggcgtagtgtgccgctgtgagcagcctacaccacgcagtcttgatgcacttcctgggtgttgtgtaactttccttctctgctgatctgatgtgcggaacagagcgcccttcccacagtcgctgtcttggtgacttggtgttcctttcaccaacatgacacatgtccacgtccgtgaagccagaagccagcaggtacctcagcaggtcctgtgggtcgggctcctctgcggagttcctgccgttgctgcctttttaaagtttgcctcagtttctctccatagttactgcagtagcattccagcctgtttcagggaggatcctggagctctcccacccagaggagttccaaggtagggaaggccgcccagggagggtctgatgtcagcttgccgtgcaacctggtgcaggaaacagatcatcccgcagtgagcagatgccgagccggaagccatcacctcccttgtttgaggaagagaaaatgacaccatatctcggagttagctgctgggccaccaaccagcctggagcaagaaggaattttcctagcattgagctatagttttgaccccttttactggtgaagcacagttccaaacgctgctgtgagctggactgaagtttctgtctgaatgtttctgcgctcttaggactggaggctggaagccccacggtggcacctgtgctgcattctggtcttggggctggagttggtagaggcaagaagcttctggaactctcagtgtaggacttactgctttccagggttgcgaggagcctgcttgttagctttatgcgggtttgctcaggtgctgcactggaattcctgtcttacagcagagagagtgtctgtggggctgcttgaggattcagcgggatgacgttggtaacgtgcctggtgcagcagctctcggcagtccccgggacgtggtgctgtgacgaagggtccggggctggctgtggagccaggagcaggcagggctctcagtgggcagcggggcagcctacagggcactggccgtaaggcgctccaggagggtggggtgcttgagtgcattgcagcctgggggttgggtcagaaccaccaaaccttgcctcctgtgtgtttctcccttcctttagccgtggacagatggggcgtcattggtcactggtgtgagcagagcgtgtcagagatcctgggcctctttaccttggagcaggagcttcatggcagtgtaggggagcctggcctggtttacgctcaagcctcgtttcggctcttagaatctgagaatggacctcctggttgtggggctgaggacagggcatactgttcagaatcagtgggtggatctggtgcgccctctgctcacgcttcacacagggcaccccggggctgccctgtagcctcccttccctttccgggccctcttagtctccttggcccttagggacccaagcacccctctgcctggcgtccccagctctgccgtgggaagagccgggacaggaggctgcagtcctctgtggcccagcccgtggccatgctgtcatctttcagatctgggggggaataggccagcgtgctctgagggctcgtgaagaacagggctgggaagctcgggcagggatgcgtggggccatgctcttggcggtttctctgctgtgctggaaataagaccgtgctttggagagggctggtggcgggagcggggcctctcaggaccccgtgagggctccagggttcaggtgtatcatctgtaatcccggcgatgaatgacgatggggacgctgagagcagtcagtgtttgtctcgcatctgccctcaccatgcgctgcgctgtgcttcatgcgcagcctctcacttgagcctcacagacgctcccagctggaagctcttatgattccctcttttgcagggaggaacttgagccccgggctaaacagctgggaggtggtgaaagcaggacgtgcgtccaggcctgtgggtctccagagctctgtgggatgtgtttgcaggtggctcctgggtccctgtgggacacgttgtgtggctgccgtctcggctttggccttgcttctctgcctcagcagagaccctgggtcatggatcctgcctggtgctgttttgcctgtttgaagccccaggcatcctcctcgatgctgacttaaggtagagccggctgagaagtccacagaggggagcccctgagggccgtggatgcagatggagctcttcatgttggggtctgccctggcctcccctgcctcccctctgtgcatcggctttcccagaagtgcattccagcctgggctgtgatcgccgcagtttgttttgaagatcccaccttgctgcctccaggcagaagagcccttggcctgaagccacaaggctggcatgtcctggagcacctggccgtgtggtgcttccaggtgcctgggcctggcctgtttcatctactgctgccatcaggggcctgggcagcgtcaggaggagtcaggcccttgtcaagcataagggactcgagagtcattgggtgtgatgagtggatatcaccatgttttctgtcacagacggtgcttttctgagcctcttcctgcctcaggtttctgtcacctcccaagagtgagtgaagatcagtttactagttatgagtctttcctgctgttggtcccaggtggttaggccgtcctctcaaggacgtaacaaggccttgtcacctggcatctgaattatggtgcacttgagtcatccagagaccagcaaggcatacgagatccatggtggctgggctgttcccctcttgcacttgaggggcctcccgctggagaagccaccactggcccaggttcctggggcctgtgtttgcatttggctctaccaggagtggctctccgagcgagtctttctggtgatggtgactcctgttgggggttttgaggctcagtgcagtcgcctctatggagcctgtggacggtgctggctcagggtgcaggtttttagctagtccttgtcatcactggcaccgtgtcctgctgtcactttttgaggtaatgggaaagtacaatttctgggagccttcagggcatggcaggggtaagttttccaggggactctgtggggcaggatgtctcctgtgtgtggccagtggtgatgatcagacgggttaggcggtgggggcatctgggaggtcaaggtgacggaatttgccgtggatcagtgtgggtgagagagcacatcgggatggccagttctggcctgcccttgaactgaccatggcctcagccatgtgttcccagcaagtctcatgctcaacctgaccacctgctctcggcataagggggcccctggggtttgacatggccagaggccttgttgcgtccgttcggctttggcgccactcgatgtaaatggtctttggcagaaggtgtggaatcagcctgagtctaatgggctgtctccatgtattccacggtggcagcctgccatgcctgtctggtccagggctgtggcagggcacgcgccaggagctctgggtggcaccgtgcccttcaccgtgggctcagtggcagctaggggcgctccgtccggcagcagagaacccgcgtgatctgtctgtatcctgctcctgtccccctctgccccttgtgcgtcccatgtggggctggtcccaagagtttctcccgcagccccggaccatgcctgggacgcacagtgcacctgcgccatagaggcctcagcccccaacccagccctgcaccaggggacagccttttgaggctccttgtctgtctctagaacggggcccttgatggcatctgctttcctgtggtggttccagtgcggatgctggcacgtgcctgccttgttctttggcgaaggctgctcgggttagtttggctagtgtgggccctttgaaaagccgtctctctcgtgagtcagttgtctgtctgtaggatagccccagtgagcgggtttttggggaaatgtgagggacatccctgtgcctggggtctggcaccatgcacttgaacatggacccctcagtgagtcaggtgccccagagtgcgctgctcaaggtgacaggggagcaggcccattctgtgctcacggctgtgcggtccacctgctggccggtgatggctgccccggcgaccctggcctggctggtggcctctgcctgtccttttggttctcagtccccctctcttctccactgggactttagtaggaaaagaggacttggcggcacctgtcccgggagccaggccatgtggaggagctgggccttccccaggctgtctgtgcggcacctgcctgcagtgcccagacttggacgtgagatggtgcctgtggcatgtgcagccgcccgctcctctgtgctcagcttagaacctcctcgtggggcctcctcagcgggggtgggtgggtaccaggcctgtacattttgtggccaattagagggagagagagaaggggggcatggcatggagatgtctgggtgagcgggcgtctgtcttggggcctccctccctcatgcggtgccttcttgttcctccagtcctttcctgatcagggctagtgaagtcccgggttgggggacatagacccggtgcccatcctgccaatgccgggttctctgtggccccccagtatggtctgggggcctgtctgaggcaccatcatgtttcaggctgcagctggctgctgggcctgagatcgagccccatctctcctgagagggggtccagcccatcctggctccaggggaaagcctgggtcatcagcaggcatggtcgggtgtcatggctgtgccccgcagcacgcggtgtctgcctgcttggaggggcctccgcagtggggcactgcgtggccctgtaggatgcaggcaggctttggcaaggctggccctgctctaggtgggtgtctgaacctgttccctccccaggcagagcccgcaaggcgagcacacgctccttcatgacggggccgggtccagcgtccgctgccgctgggctctggggtctgtccggggtgcctccgcctgctgctttagccagcttgtgttgcttctttcagcaagatgagctgccgttaatatttcacacccagactgtttccctgaatgttttgcatttccatatttaaaatggcatttacatattcatggctttttaaataagtttttattgttaagggatgtggaagtggatgaaatgtgaaactcccccttttattcaagcactagaaaaaaatttcatcccaaatgcaatcactttctgagtgtttagctctgtggcagttgccataggagattgttccagaagccagtgggtcccagggccatggagccgccctttctggcatgcagggactgggggaaggcaactgccatcagcattgctttccagccgaggttgggcatggaggcctggttgctccttggggtttctcctggcgggggcctggcctcgtgctgggatgcggggccggctcccacccacatccatggctcttgttttggaggaagtgtctaaggcagacgaggctcttcatcttggaagtggctaagccagggatgcctggcttcttttctcccttctccctggtcactcggcgtccctgccctggttggcctcttgctcccggctttgcggctgcggctgcagctagggcctcggagggccattcggccctggtgcactctccgattctgaggcgtggagggtggcaccggcacccttcacccttcagggtcctttgagggtcctgtgtaagaacatgtgcagggcggacgggggctgctggaggggtgctggagtcactgttttacgtttgggcagtggtgaatgtggctgagcctttgcctctgggacactggcctggggaaggcccagaggaagccaccaaggattgacaagagtgggaggccttgggagaggcgtctgcaggggccacctgggcttggacgctgtgtaggtgatcttgagccaagcacaggtcacagaaggatgcacgtcctgcagggaagtagttgagggctttggaagcctggccacctggcctgtggcgtgctgtgctgcagtggagcagggcagggactgggggggggcggggtccagatagtagaccataaaaacagggaaactgaggcctgtggggggaaagagactctacttggtggagtgaagcctagagcatggatttttctgatctgtattgttactttttaatatttttaggcataaaattgttttttatcatctcaggcctaaaccacccacaaaaccttagccttgagggtcgggggaagtgtggtccgagctgcagctggcctctccacgcagagcccctcacactggcccctgctggagccatctggacgggggtctgccgaagcccggcttcctcccccatcagccttgaaggagagtggcgggtgtcctctgtggctgtggagttctcagccttgaaggagagcggcgggtgtcctctgtggctgtggagttctcagcagtctgcctttggccccagcccctggcagcttctcccagcatgagtgttgtattttccatactctcagggtgctgggtcattggtagtgtctggttcctcctgagaccagaggcaggacacagagctcagggctgtggccctgggggcatggctgggggagtcaccttcactgctgagggtggggggcatctcagtgtgcgtcctggggcccgcagcgctcccgccttggcaagccctggactgcagcctgtgagctcagagggagggtggtcccgtgagctagggtggggtgggggtgcggggagggtgctcccatgggttggctgagagtacattgctggctcagggggtcgggccgtgtgatccccgtggcagccagggcttaggctgtggacatggtgtggggtgcttcctgggggttgggccctcctcacagtcctcgccctgtctgggtgggctggccacacaggagggtgaggctgaggcagcctcgcctgctcttcctcctcgcctctggcctcggtaccggggcgtctgctgaggaggaagaccgcttgtcctgctgggaccttgggcctctccgatgcatgttgactccagctgagaggtgttctccttgcctgtcctgcttttcatctggaaaatcaggtccaggactcttgctttgcaagatgagtggagaattgaagatttcagaagttcccaacatcaagcaggtgctcagggaatggcggcattgtttgcaggagtggggtctgtggtctctgtcactgggtcctgctcacttgacccccgagcctttctttcctcatttgtattagggtcagttccaccctcaatgggtttctttgaagggtatgtgcagcctgcctgggggaaggcagcggagtgctggccttcctctcagtgcttgcttggcccctgggcctggggttctcagagtgaggtgctgcaggcgatggcggtgtggccttgagagcgggggaggccccatctgctgcttcccctccggctgacttctcctaacaagccggaagtgtgcgtctggcattcatgcccccaatccccacctcttgatgtggttccttccgttttgtcagtaggatctgttttcaacctctgcatgctgaagtgctcatctctctaggccacttggtctggcgcccacctcgtcgtggttctcaggatgcctcatttcattaggctgagtggctctggactaagtgcacctgcagagctgaccgccccaccgccagcctgctgagcgctgccgcagccaggacggtggccagggagcacgtcccctggggcagcagatgcatccccttcctttctccttccctttggaccctgtatgcacccctgcattctctcaccctctttagcaagttaaaaaaaagctggcatttcctcccacccccatgaaaccctttgtaacagcagtctcaggtccgcagtgtcaggggctgcccagtggtggtgagagcgcagcgtgggtgcagccctggtgaagggcctgggactcacagctctgtgctctgatcatgggctggcccgcgctgtcagtacagaaacgccctgtgaacttcagctgccatcatggcctgtgtcgtgtggctggtgtcgtgtggccctcgcatagttatccgacatggcaccgtcggcacagaaacgctctgtgagcagcagctgccatcatggccggtatcgtgtcctcgtgtagttgccccatacgtccacctcctgcttggcttcccctctttggagcctccagggccagaggagcacagttcagaaactgctggtcaggagacctttcctggagaagtttctgttccggttgtggatctggcctgtgtgggagcctgaggtggcatctttgaggtgacccgggaccatggggaaagcgctctgtttcctggctgaggttttcaggcagtgccatggcacaagcctgtctgcacctggggctagaggtggcacgtgcaagtcacagaagggaaggaggagacagcctgggcccctcactcacctgggccagaggtggtgtgtgcaaggtgcagaagggaaggaggaggcagtgtgggcccctcacttgcatgggccaagcagaccggtaacatgcctgccgctctgtgacgtttctgttagagagcggaaggtgtctgacctcagctccccaaatcagaaaacggcatctggagtgccatatacgtttgagaagagggtgcttgggtcagttctgtcctttgcaagcgaacatctttcttggcccccaaaaggtggtagtagaatgtagatttcctcaaacatttggagaaaacacagaaatgaatactacttgaatgttgtttattgttgcttcaggaagagaatagggagatgggagaagggcccttgctggggttggtccctaagtattttggtgccctgaacttctgtttccttgcttattttgaaggggtttgtgtgagcctaaccccaggagagcagcccacaccccacagcggagcctagagcagggtcagggctgccaggagctgctatctggggagactgaggtggggtcctcgaggcctcctctctcatgcccggcactgccaagcccagggcatcatcagtggacttgggagcatcctcttatgaacgcttttcttgagtttccctgtaacttgttgtaaactttgtaagctctgagccaagagcttccttcttagccttgaagctggccactgccggctcctttccatgccgagctgggattcttggtgtgcaggtgtggagagcagctccggtgccatcaggcgattggagtacgctttccttccttgtttggcagaacataaaatcagtctcaggccctcccaccatggcctccactgctgagccccgaggagatgccaagagatgggaagggcccccaccgaggaatgcagctggctcagagtctgcctgtggagaacaggagcccctggaaggggcaggctttgggcaggtgagtgcacttggtctgagggagggtgttggtgttgccagcatcctgagctcgagttggtgccatagacctgggagggtctctcgatcctgttaggaaacttgggtaagagagtcggaacaaagaaacatccactgctaggcacctgtgggtaccaggcactccacacgtgtccccctgccctggcactgatcctgcctgctggcggggagcctctcgctttgccccagtttccccaaggttgtggagccactcagcctggagtctgcttgtgagctcagggctggctgtctcctaagcctgtgccctctcaccacgttgcctctcatcagggcgatgctttttcaagctcagatatcacaggtcgcttccgcagggcatgaagcctcttaatgctgacccttttttaatactgtggccgagaaacacagttgcgcagagtctgcaggaggaacagtgtggacgtggctgtgacaggcatttttggtcagcgtggggcaagtgcggcttcctgtttctgtctcattgagcttggagtggacataggggctctaggagaaggaaggctgtgacccctgccctgaaggagctttccctctgcctgggaagagaaaccagcagtgaatcccttaggggactagagagcgttgggccgcgtggtcctgatcatggccacgcttcccaaatgcctggctgcttgtgagttatatggcgaaaagagcctgaaaatagagatccttggactcacctccaaaggctcagattcaggtctctgctgaggccgttgctcccttcatgagtgtactttcccttgggcctgggacatgtgcacacacgtcaccatgagaggtggcaggcaggactcccatatgtggccgtgagaggtggcgagagctggtgggcattgtcccgagggtcgctgtgagagctggggggcaggaggcccggacattgcccaccacctgagccttcctctgcaccagcattgccctcacttgtcagtccaggcccctttaatgataaacaattaccgaaaacaaagagtttttatttgtggggaatcataactatcagtatttaccatctttggaaattaaaattaaaattaaatcattatttacaattatatttataatctcattaaaaacaattcattatcacttaacaaaatatatttatgaaaaatgcattttctaacacaaaacgagacagtgagaggaatggcattgttttttactttttacaaatctcttcagtgtctggtgaaatagaagatgggagcatctcgtgtctgcgtccatctgccacggtctcttcttttggagtctgtggaataagtctggccccgcacaggtgtgcagttggaagaaggagggcctagtggcctgagggccccacacacaggttctgctcagccttgcctgctgggtgggtgagggctgaaggcaggtgcgctcaccgttccttcacacctttcgtggctagtcttacctttctgggtagtgtttgctcaaaattctgattagattgtagggggtgttttttgtgtgttgaacatgaacatcattaatgaacgtcagtcattgaatgtctgggaaggtgtcctcagttctggtttttctggaaacggtgactcatgtatcctagaaaaggcccactttgcagcattccgggcagttgaaggaagatggctcaacccataagcagcagagctgacttctttcaggtgttcttgccctagatgagcagcaggggtgtccctggggcctggagatcatgcccacctgatttctggtggagccaggaacttgggcagccacaagttgctctctgagaaccccacaaatccaagactagtccttaagagagggtggcctctccagagacgtgtgcagctgctggacacaattgggctctggtgactggtcctgtttaaatgggcagatttttctttttgttgtcatagagaagctaatttcttattacttgtcaactatttccgtcttaaaaccaagtaagaaactagaagctttctcgctaagatcaggcacgaggcaaggagtcccactcaccactcctattcgctgtcgtactggaagtactagctatagtgcagtaagacaagaagagggaataaaggaaggaagaaataaaactgtctttgtttgcagatgacatgatcgtctatgtagaaaattctgagaactaacaaaagaacttgtagaataatgagtggtgagagagagcagggtatgggccatacacgccgtcagctgctttcctgtgtaccagcaacaagcagagggaatttgaaatcaacacccagtactatttacattagcaccaaaaaacagtgtagacacagagaccggtacaggttatgtgtgaggaaatcaccagacctgatgaaagaaatcaaagccgtaaatcaatgcagcggcattctatgttcacgggtaggaggagtcaatatattatcagttctccccagagggtctgtgcagtcccagtcagaatcccagcaagttatatttgtggatatcaacagattctaaagtttatatgggaaggcaaaagatggcaatggccagcacaacaccagtgaacaacaccggaaaactgacactccccgacctcaagacttagcgtaaaaccacagtgatcaaggtggtgcgctgttgatggaagaatggacgaacaggtctgtggaacaggtcagagagccacgagatagacccacacagatatactcggctgatcgtggaccgcagagcaaaggcagctcagaggaaaacggtcttctcagcaaatggtgctggaacagcggaacagccacaggggaaaaatctagacacagaccttacaccttcctcaaaaatcaactcagagtggatcacatacctgagtgtaaagcacaaaactttaaaactcctagaagatagcggcggaaatatctagctgactctcaattaggcagtgacttttaacgtacaacaccaaaggcacagtctgaaagaattgatgagatggacctcgttagagttggaaatggctgctctgcgaaggaaactgttgagaataaaaggagaagccccaaatggagaaaatatttttcaccgtcatgcaaaagacatatctgataagggctgttatccaaattatacaaagaactcttcaaactcagtggtaaggaaacagaccacccaattaaaaaatgggtgagctctgaacaggcgcctcaccaaagcagacacgcgggtgacggagaagcacgtgcggagatgctcagcattgaaaatgggtgagctctgaacaggtgcctcaccaaagcagacacgtgggtgacggagaagcacatgaggagatgctcagcattgaaaatgggtgagctctgaacaggtgcctcaccaaagcagacacgtgggtgaaggagaagcacatgaggagatgctcagcattgaaaatgggtgagctctgaacaggtgcctcaccaaagcagacacgtgggtgacggagaagcacgtgaggagatgctcagcattgaaaatgggtgagctctgaacaggcgcctcaccaaagcagacgcaggaagggggagagcagggagacgccaggctccctgtaacaatcatctctcctggtaactgatgaagtgaggactgctcttcagcatgagccgtcatgagggacccacccccatggcccaaacccctcctctcaggtcctgcttccaatcgtggggatcagttgtcaacctgagatttggaggggtcgggaaccacacagtaacagtgtccttccatgggtgaatggataaaagatggtatgtccattcactcaaatactgttctgagctaaaaagaaatgagctaccaagctgtgaaaagacgtggaagaatcttaaatatatattgcacagtgaaagaggacagtctgcaaaggcggtgtactgtgggatttctcctccgtggtattctggaaaaggcagaactgtggacacagtaaaaagatcggtggttgccagggatggacaagagggatgcgcaggcggacccagaggatttttggggaatgaacctactcttcacgcggccgtgatggtggacacgcagtcgcacgcagcagtggaccgactgcacgcggccgtgatggtggacgcgcggtcgcacgcagcagtgaaccgactgcacgcggccgtgatggtggacgcgcggtcgcacagggactgcagacatgcgttcgtctaaacccgagaatgtaagacatgacaagtgagcccacgtgtccactgtggacttgggttcatcagttgtaatgaatggactgcagtcgtgcacggtgcaggggaatctgcctgggggctgaagggtagatgagaactctcatttctcctcagttttcctgtaaacctataattgcttgaaaaaagaatatctgtaaatttaaaacaaaaattagcaagtaagatgaggctagagagagctgtcccaggggtcagattgagacaaaatgcagttggggccagcttcctcctgagtcagcctcactgactgcttggagaagagagggaccacgctgagcgtcaggaggcagcgccgcggcgggtctacgaggcacatctttcaccagcctttccattagaggcacctgagcagccctccatcatttcacgtgtgcatggtcaggcccttgtggggggctcacaggacttgtgtgactgccagttgccgaaagaaggaagcaggtcccttgtcatgaccagagagaccccaggtgcaatggctgtcacatcctgctgaccttcccagcctgagccagctcgggccagggtgaggacaagggctgatgggggctgaagggcacagagcacccctggggaggcgtgtgggcctgggggacacacctgagctgtccctgttgctgctctctggatgagaacctgggggcccagctggtgcaggcacgaatgttccagcacatttgtgaggatgagctgggaggccttgagcaaggacaccatcagtgcctgcgcagaggtcccctgggactgacaagctcgtcggggaacagaaacagcgctttgaattttaaattggttaaattccttttcctgtcacagtctcagctgctccctgtttccttagagagccagggagtttagtgtcctctcatctccatgctctgccaattttactgcctttccgtatttcctcaccatgaatagaactgattttatggtgcgtaagccatttttaatgtagcctctcatcacaaggtggagaagtgagggggattgtgcctctccagaccatagtacatgcgtcccttctgtttttaagcatttgggccaagactgcctttgcagattcctgaagtgcctgggatgagtgtttatcgtgtgcagggtccgctctggggcccgaagaaggctgacacgctgctcatccatctcttgaaggagctcatagtgcagtatgtcaacccaaaatactccaaagcgtccgaatctagtttaaagagagcttattcaagtgcaaggttcttccaggacggccaccagggaagcacagattccaaagaatggaagtcagtgttccgaagcgtggaagttccggatcatttatgtagacaagtttagggaagcttagcagatctcagcatccttctgcgagaggcttaatgcatcattagaaagatcggattcgatgcggtggcctttatctttccgggaaggttgatttggcattcgcactgaagatgtagcaggcatcttgtgccatctggtctgtaggtgcaggacagtgaaagaggcagtgaatccatcacaaagatcggtgactggaagtgggagaggtgtggtgtttggtctctcctagttatttacggaacaagagctaagaggaagagagagtcgcggacacgctcccagcttcggcctccggggcttaactttttccccctggcataataaactgagagggtcctgacattttattttcttttacaagtaggagtgataggacacacctttggaattgagtttatgtttggaatcattggggtcccagagagagagagaggcccaagactatgtgggaagctggtctcctttcccagacctgccgcagacgacgtagagagttaagctctggcctctcaattgcttccttattccaaatttctcggtctgttcatctggtgtgcccctggggaactcctgggagttgggggctgtaatggcgtggagagagctctgggcttggggacttggcctcgaggtgctgtgtgtccaggctagcttttctctagccccaggacgtggtgactgaaatatttcagcggggaggcacctgaatgctgctggcacagctccctggacctctcaggtgagctccatggctgcgcccagccaggcacctgctgcgggccgaaggcagggcagggaaatccaagaggagggcatttgcctcctgacatgtggaggtgcttttgatgcagtgaggcgcatcggggcagccaggtggcatttcctgcacccacttggtgctggagtctgtctgcctgcccaggtgcttttaaccccatccctgcccctctgttgggtagtgttttcttcacccttctgctgggccccagaaggacagctttttggactggttgggagcttcctggcagcgggtgccatgggaaccatgagtccgtctgcacctgctgacccagctgcctgcctgtgtgcccctccgacggtggtggctgtgttgtgcaccttccttgtgtgtagacaggatcctgggggaggccgttggctcgagcctggggtgcagagagcactccttggactgtctctgacatgcgtgtaaaaataactgcatttgtttttctgatctctgggcagaagctcgagcctgcgtgtccagctgtgtctgtcttgccaccttgctctcgtcagggagaccatctttgttagacaggcagcctccagagggatgggatcgtgtgtgtgctctctcctcatgacgggaggcacctggggttcctgtcctgctgcctcgtgtgtgactggactctgagaagcgcgtgttcctcgcgtcctcgtcactggcaggtgacggattcagacccacggcaggaggggcgctgcctagcaggagccgtgtggacaggagccgccgtgagcctgctgggtggcttggcctgctcgtgcctgtccacattcacagtcccgcggagacagaccttttactcttctatacctgccacagcacattcagatgtccacaggcaaaaacctgggctttccctcttccaggcgtcttgttctttcactccctccctgccccctggcctgcctggtgttggcctgctgcacatgtgagctgcctggcggtgggttagccctggtggccccagctcccccgggatcctgcgggcccctcatggaatgcgcctgcccggtccctgccccttccagctggctctgggactggaaggaatttccgatcagagagctgcctgcccacaaacccaattttgtcctcgtggtggggtcgtgcaccacctccactctgcccagttggtcagcgccagcagcactccccatctcctcaaggtccagatgccctgaagccttgggaaggtctgtgtccccctctggcttttctcctcctccctgtggtccgtgtgcctgactgccgcgtgggaagcctgaaggtgtgggagcagagagactgcagtgtgagctgaagatggggccttgtgctcctggggaggcgtggtgtggcctgacgggcttgagggtggccgaatgaaccttctgagggcaggtcccagcagccacctgtcctgtccccagggtgagaagggcagagggagccggtttcagcccctctgtgtccccgccaggatccctgcaatggccaaggccccagctgagccttcagccctcttgcagacacatcgtgttttctgctttgccgctcatccttccatgttacacagcctctggtggcgtgcctgtgccctttgcgaggcctctgggtgtagggactcccgtcagggccttccctcaggcagggcaggtcacctggcctctcctgaacggccatcttccagaagcagccttcctgttcgtgttctgtgctttttgtgactcccgtgctgatgagcgagtgtttcatgaactctgaactgcctaggtctttcacggtggtctggcctcctccgccctctctttctggcaccagggctgcgtttcggggactctaggcatggatggccctgccaggtttcagtagtgctgtttgggagatgagaggtggctgagctgctgatgacaaatgcgattcagtgacagaaaatgcagaataattagtctgggaccagagaactctaaagaatgtatgcaaaccaggacaattgtccggcttcatgagaaccatgttaatttagaaataatctgggagggcgtcagcagctcctcaacaggggatgaggccggaccagagcccgagttgatgagttgtaaccgacgactgtgatttaaaaagcgttttatttatcgaatgtctctcagtgtcagggcctttcatccatttgttctcatcatgaagttccgagaggtggacactgtcttaatctctcaggtgcgagcagaagtctcttgcttgaggtcacagccgctggtcggagtcagttcagaccggctctggggccattgccagctgcgtgcctgcgtgggtagtggggttctgaggccccagcaactccaccctaggctttctcattcctagcaggcgtctgctcccctgacgcccacagtgccggctgctcttgcacgtttcccggagtgcaggggtctttggtgggcgtgagattgtaattgcaggtgggttcctgcgggttcctcctctccgcaggtgggttcctgtgggtccgctcctctctgcaggtgggttcctgtgggtctcctcctctcttgccttttttccccaccctagaccccaggtcgtttctgctccctcattgcccacctacaccaggttcctgacgtctggaccttggtctttcctaccggtcggtgtggtcgggcccgctcccccgtgtgcagctgctcctccgtggcacagcacgaagcagcttcccaagaggctgtgtgtccattgccctcaggagaatcccctctggagcaagtgtgctgggctgtccctgctgccctctccttgccccttgggtgctccatcaggggccccactctacagcctcctgtgtcttgctggggctgggtgagttgccgctcctttgtgcccctctgatcacttcagattttcgtccatctcccccttgtcataagtaggggagggcggggacgtcttctctgtggcactcccatgactagcaaaggcccgtgggctcatgccagccctgagcacctctcttctggaacaagcgggtcaggccagcactgtggaagactgtccccaaagtggggtcactgagaggccccctccaggagagcgttcagatgtcttcatcccacccgcgtctgctctgttcttccctgggaacgaggcctcggatgtgcttcgtgactgaactcacacctgacttggcccgctggctttatcccaggttctcagttgtaatctgccgttgtttaaaatgccctactggatacatagaagcattgctgatcagctgatttgcctggcagtgtgagagggggttattcattctgaggtctgtggtttctaatgaagcccgacccatggggacagtgtcagtgagcacctgcctggcggaggctcgtggctcactgcagggttgacgacaggtgtaaagctgcccagcggtcactctgcttccttgcagaaggaacctactaagctgcatgtttaaaaactctgagtgacagaagaggccggtccccagagatgctcctgggcctcctcacactgcctttcagagctgggctgggcctgggttgtgcttggtcccaaggaaggctggcggcatcggcctgtgtcgattcttagtggccatatggtgcacaatcattgtgcctggcctgggctgtcaggtcaggtgtccccgctgccccccaggcctgaggggggaagatagctccgcagctgtgcacaggacctccaggctcctggggtccaggctgggggcctccagtggtctggtccacatctgctgccctggggttctgccctttctgtgcatgcccgagtgcctgtgtgtttattgaaaatggaattcgaagctgcccttgttaccatccccttctaggtggagtcttcaacctggggccctccgagggttgcactctgtgggcgtcccccgtccatgggccgcgcactgagccttgcctgtgtctgctctcggctcccgagacgctctccttcatcctgcccggtctttgcaggaacctaggccatatggcagaggtgccatccctcgcttcacaggagggccgcctggcaggaagtggcagtgaggaccgaagcctgggtctgtccccgagtccactgctccagcgccccgggctgcagccccacctgtggaaagcagcccatggaagatgacccctctccaggaggccgcctggccccactcactttctcacctgtggcgctgtaaacgtgaggaggcccaggggccaactggctgcttcctcagatgccagtgctggctcaacgcttaaaacagacgcgtaagctgactttcaggtagtccgttctcctgattttaaagcgggacaaatgtcaggagtctctcttgatattgtctcctcagtttatttttcagagctgtggtaaatgaccccaggaagcccttagctggaggtgggagctcagtctgagctgcagtttctggagcactcgtgctgcttggtgtctgggcgcctgcctctgggtgagagggccagtggctcactgccctgtttggagtcgtcagaaacctcgagccagcctcctgccggtgaggtgctgcctcacctggtgggggttgtagctagaattgggtttgccacagcaggccctcgctcacctgggcagatgagaactcgtaaatattcaaaggatatctcagatgccctgttacagtctcatcctgagtgtacggtggagctcgctcaccaggctgcggagacatcactacccattgttttgagctgtcgcccgggggacacatggggccagcatgaggaggaaggatgcgtgggtggctcggctcagggctgctgcttgtgtcctctttgtccccacctgggcatctgtccagtcatcagaaggggcaccacccccacccaccttgtcagcacctgcctcgtggcgccgcccccacccttgggtccaggacctgctggagtgcacctggcaacagtggcggtgacttgccctgctgctgctgtgccactgtgggctgcatgacccggggtctgacgcaacctttctgtggcaggtcctgtgtctgtaaagtgcagccctgacagcagggacttcctggggtcgctgtgaggaccggatccttagtgtgggccgggagcccagcagggaaggggcccgggatgcagagcaggaaccacctgcatccctgtgccctcagccatgcccatgtgtgtcctccgtgctcactggtgtctcctgccctggggctggaaggccgcctgcagctcctgcacccttctcaagctccagggaggcccgctggcatcactggccgagcccctgcgtcctccttcacccggaggtgcctctgttgtatgtgatgtcaccgtgcttggcactgagcaaggctcctgaattcagagtttctcccacaagcgccgggcacccaggtggaatggctgtctcctgacccagaggagggtggggcagggtgggcctggccctcccggggtgtgtgagaacccagcaggtctgcccctggggaggcgtggagccccatacgctccttgccgagctcagagcgggggcttcgtgacctcctctctgccagagtcttcctagccatcctgccctcactgcacccctgggcagtctgcctctgttggctggggtgggccacatgcaggccggctgtcccctcaggctgtgggtgcagctgtttcctcactagccctggtagcaggcaggccttctgcccactcatctcccaggtcttcttactctctgtcctgggggagcctgctcttcctttcggcacgttgggctcttcccaaatcagttccacgccccgtggtagttccacacccccgtgtctgtgcgttttgctcctgggcgagggtctttggagccctcgtgcccctggagtcttggaagaggcctgtctgggtgggcttgcctcctctccatgtctcgacccttgtgggtcctgcaccgctgcccgatggcctgcccctcctgccttgctgctctgcgaggtgagcaggggcgtggcgtggcctctgacctgtggagagctgggggctcccggctgcatctgtactgggggtactgagagccttcgccttgctcctggaggtgtttgcccggcttccccgtctagaggaggagcctgacctggctacagggggcttcccaggaagcagagttcttgcccccggggcctaagcccccgccccttgctgcctgggctgcctttgcttgtgtgcagccttgcaggactctggtgtatttggagaagctaaaaagcccttgccagagcggaaaagggcgctggctaattggcagctttatttatttatttctggcttgagtggtaaacagcgctgattctttgcacagcaggaacagattgggaggcatttacctgactgattcctcacctgcagcaccacgccgccggaggatctatcgattcagcgccgcctgcgaagtgcactctgaaacaggcttaattgcctccgactcgcttcctggtatcgcatgtccccgtgagtcctcgcttgagggctgctgccctccagcggattgacgcctcccatgcgtgcccttggcggggctggctcctcctgggtgctccctgggtggactggggtgctctcctgcttgacagggaaggaaaccctaccgtcaccagctcaagcgcaaacagagcccaccgggtgtcagccgccctcacacacaggaccagggcctcaccagcgccctctctccgtcctgcaccccagcccagtttcgcttgctgggagccctcccgcaatgtctccaagctgtagcgtgcagtttcatctcagtccctgagctggctgagctcccctgctgcttttttttttttttttgagatggagtctcgctctgtcgcccaggctggagagcagtggcccgatctcggctcactgcaagctccgctttccgggttcatgccattctcctgcctctcagcctcccgagtagctgagactacaggcgcccaccaccacgcctggctaatttgttgtatttttagtagagatggggtttcaccacattagccaggatggtctcaatctcctgacctcgtgatccacctgccttggcctcccaaagtgctgggattacaggtgtgagccactgcgcccggctcccctgctgctttttaagccagactcagcagaagggaggcaggtgaggtaccggtcgccttgataatacacttctctaccagggcaggatgggcagacggtgacggggaagctcacctgggaggggcgctgggtggacggcggccgtcaccacccacactgacgccatggcctgcacatgtgcagctctggacagatcctgcgccttgacttcccagctgcgcctgggggtgagctttagcaacccttcacccgtgcacctgcacaggtggcagtcgtggctctggcactggggctgacttgccagctgcttggaccaaggctgcatccttcctgcctgagtctcacctgcctggagcaggccagcgtcaactccctggtttgtgattctgggacctggtgattggctgtttttttttttgaaacagagtctcgctctgtcgcccaggctggagtgaagtggcctgattttggctcatggcaacctccgcctcccgggttcaagtgattcccctgcctcagcctcccgagtagctgggacctggctgattttgtatttttagtagtaacggggtttgtccgtgttaggctggtctcgaactcccaacctcaggtgatctgcctgcctcggcctactaaacttttaggattacaagcgtgaaccactgcacccagccagggattggctgttttaagtaacagttatcaaggtgctagataatattttaagacactttgaggtatgagattaggcaaggcacacgaggtggacaggtctgacgcgggcagtctgagcatttctccagcccccgcgggtttcctctgtcccagccctctggccacatgcggggtggccactgctccgacctctcttggtgatggcttttctgtggatgacatgagacagtggcagttctgcttgtccctccagacaagccaggaagacacttttaaaactcaaggccttttcccaagagttcctctgtccctccagtctccccctccccaccccagaagctacttttaacacccagggtcttttccccagtgtcttggtgcgtcttggctctctagcccttctgtgcgcctttgccggtccctcaggtgtccacgtgtccccacatctggctgctgcacgggtctgtgttcctgctgtgccagcccctgcccggtgctggagagggtggagagcgaggcagacacacctcaccgtctggagggacagtgagacagacctcacaggcctgcgagggaggtgggacatcatcaggctcgtagaaaggtgtgacctttccctccccacccaaccctcgaggactcctggcccccaggctctagtgctggaggctgagtttggccaccttggctctgggcccaagcggcctcctgctggcaacatttccaggatgccgtgatctgcagcatagtcctgccccactccctcccaggagcccagaggcctgttattctgaggtctgtggtttctaatgaagcctgacccatggggacagtgtcagtgagcacctgcctggtggtacacctctggccaccgggactctgttaacgaccctcccgtgggggctgtgaggtcgtgcctgccactgcccgggaggctccagctggaccgagtgtgtgtggcgtatccgcagcctccctcatccctgcctgtccccacggtgcctggcaggtgctgggggcctggtgcagagcctcgctctgacgctgaacagaggttgggagaggcggaggagccgcatctgggcttgtcctcttggcagcacccagcgcctacacctcacatggaaatggggctcaccagtgagtggagactcagatcgtgaggcctcaggcgggaagggccccagagccacctggtccagctcgtcctggtgaatgctgtggcggggcgcctgccctgggagcctgcgccgggagtgtccttgcggctggggctggtgtgcctctgcaggagccctgccgtcaccgtgcgactccacttgggcccatctccctcgagtccacctgtgctgtgatggcagccgcctgtcttccttgctgggcctccccacgtcaggtctgcgcctgccctagagcaggtgcaggggtgaagaccttcctcgccccgccctggaggccacaccagcctgttgggatccttttctgatccctgcctgcagccttggaaacggaagcagctcctgaggccctgctgtcccccgagttcctcccatgggggctcgcaggctgcctcccgcctcctgtcccgcaccccctgtctttcttggcatatactcttgtttacaagtctctctcgaagtgatactctcagataattattatgtttctgaaacgccttggttttgtgttgttggggaaacagagcaacagaagacacagttcctggctctgaggaagcctctgggtggggtgggcaagagtcagacccgtgggggcacggggagtctggcagaaggcagcgccctgggtgtggggcttccgcttggttcctgcactgcgagtgcctcctccctgtgccaggctctggaagccgtgcagattgcagggtggtgaccccaaggctgcgcccccaggctctccagggtgtggcggccagtcctaggctttctcagaaggtggtgctggctgtggaggcagaggctgctgcagcgcagccttcgttatcagctgggaggaagtggtggcgggtgttgagctgggtcagactttaggaggtgccatttgctgtaacatacaggcggggctgttggggtaagcacacgccgcagccagtctgtaaggaatggtcctgaaggacaggcaactggggaagggagactgtgttgggcaaagccagcaggtggagagggccaagagagggggaggtggccttaccatagacccagtgtggggcgtgggactgcaggaggctccacttcatttggaggagtgaaaaggcaggtgccacctggtccccagggagagctggagggcctgatctgaggatggagagcatgaactggggctcctccacctggggcattgctagggatgccttgggcgcatgctgggaggaggtggagtgaggaggatgctgagggcggctttcagggaataaggagctcctggttggatgcttggaaggaggggagatcccagatcagagtcctggaccccagcgaggagccagcaggaaagagcctaggggtctggaacagttgtcgtgggacgtgtgtggctgccatctgtgtgagctgtatgggtgcagccaggactgtgctgaggggtcccctgctggactggcaggctctccctcctcaggagcactctgggtttcggggtgcattgtcactcagcacaggttaccctccagagctccagccctctgtcctgcagctgtagcccacctgccactaagtcaagggcttggaggcctctgatgtctgtatgtgggtcagagctcgggcacgtgctgtccccacagtcgggacctgagagctgcctggggtcaacttgcacagggccaggaggatgtaaagagctgctcttgtggcgtcgtccagctttggccagctacagagagtgtgcgccccacgacagctcctgctcatcgcatctgggtgggagatggaggactctcaccccgtcctaaaccatgtgggccactgtcagaaagggtgggtgatggagatgcgatagggaaggcgctgcggagagccatggcctgggagcttctcatgtctgtgaaccaggggcggggcactcctttggtcacttgttttggggggataatggagagggagaggagggcactgggacaggagaaatgtcacagtagatgaaacacagcaggagtccaggctgcctggcctgaaccttcttgctttgtggaaacacggcttcaccaagagcaccgggcagcagtcaccctgaagccctggagctcgagcccagccgctcctgcttgtccgcgcaggggtctgggaggcagaccgtcacgtggggctggaggctggggcgagcccaggcagctgggcgtgtggagcttttggccttgatggaggacgtctcagctccaggtctgcactgcaggtcaaggagagagacgggaggcacaatcgcggggtggcttctcctctgagagcaggctgtgacccagacggctgtggaatgctagggacgtgtctgcgcgtgcctcacgtcacctgtgaaatgcctgtgagatatgacgtggcttttggagggatgtgcttagctggtggtagccccttatccggaaggaagactgtgagccgagcctgctccttggcggcatgaacctgccatggaggcagtgtgtgggcagcagtatgtgggcaggggctgggagggacggccctgttccttcacttccgtcacctgccccagggaacttggacatcgagggcctgtcaccaacaacagccttgatagtgcttgctggggagaaaatgctggcccagtgtgttgagtagtgtgtatcttgccgcgttcatgccacgcactacggatgctgggcagacccctgtgtgctcaccgcgcccacacggccaagctcccgtggctctgacacaccactcagggctgacctcctgcttctgggagcctgatggcagcacagggggaggtcctgctggtcaggagggagggttcacctgcacagtgtgccgtgtagatctgtgaccgccaaccacgtcctgcgtgtgtcaggctcaggccccgttctgcagaggagcccccagagcagggctggcactgtgccctggatgctgccccatccactccagtggagggtctgacaggctgtggctgagtggcacccctggcagcacagcgtccggcattgtggtcaggagtggccggctggcggcttgggatgagtgtcgggtgcacagggtggagggtgggtaaggggcactgagctggcctgatgggctggagcctcctagggcagttgggtggcctgatcctctcctgtcctgccccatgctgagggacactagggaacatttgggggtgtacttgaggggccattgctgtgcaagggactggggccagggatgctgagtgtctggcagttgttgggatgtttgtggatacaagtgagttgctttgcgccaaaggccagtggggccctgtggatacacacacttcatggttgggtgcttcctgctgctgtcctctccctggcagggcttctctcttctcttacccctgtgttagttcactctcacagtgctagtgaagacatacccgagactcggtgatttataaaggaaaaaggtttaattaactcacagtttatcatggctggggaggcctcaggaaaatgacaatcatagtggaaggggaagcaaacacgtccttctttacatggtggcaggaaggagaagtgccgagcaaaagggggaaaagtcccttataaaacagtcacctctctcgagagctcactatcacgtgagcagcagtatgggggtaactgcccctgtgattcactcacctcccatgacatgtgggcattatggaaactacagtttcagatgagatttgggtggggacacagtcagaccatatcatatcatgcctcctccttgtgaatgggcagctgcctgtctgtagagaccacgaccatgtgggtggcctctgtttgtgggtttctcccagcctctgtgccgtccgcaccagcagtgcttgtggagctggactgcctgttagtttgcacaggggttgacttggcttgggaaggtgcccttgggaatggggtgcagcttccctgcagagccttgctcctccctgacggtggcccccagggcccgctagactgttcaggaaggaggggcctggggaacgtggatgttgcaggagactcttagctgcttctggtctttcctgcccgctttggctgcctgcctggctgcctctgccaggcctatctctagaaaaggctgtgttcccagcgttagagcctggatccctctcctgctgcattgggagctccccaaggtcgggtttccttgtcttcgggtggtgcccagtgctgtgccatgctgggtgtttgctgtgggccttcacttgttcattgcaaatacttctttgtctccactgtcctctttaccaagggcacacttcaggatctcctgggactttgtgcagcaccgcccaggcctgcagaggcagggtgcagaccacctcgtacttggtgatgtgcctgcctccttggctaaggccctctcactaactctgggacatccagacgccttcctccccgttgggtctggtggcctgtcctgcttcttcctcaggcttcttctctggtttttctgctccagtccgatggacctgggccccctgcaacagtatgacacatggcctgttactgcttttccgctgaccgccacctcctgcagccctgtgtacacacaggagccccccccccccccaaccctctggcctgccacgtgtgggtacctgccttatccaggccctgcccacctggggtcttgctggggacacctcggtttccctgccctggcattcatcgtctgcgctggctctctgggggctccccagtcctccctggcaaggctcttgtctcttagaggacagaggctccttgtcgctcccgttcaggaagcgtttgttcaacacctgctgtgtgcagcccactttaggtgcttcaggaatatgagatgagtcaggcctgagtcttgttcgtcctcccggcacttggcacacacacagccgcctgccctccagctgcacccacgcactccgctccctgggcctggctctcgctcccttctgtgctgggaaggggcacaagaggatcctggagctggggccactgggagcagcagccaacacgtcagtgtggacagtgaggtcctgctcacgcccttcagctttttctgtggtcaccttggcccttatttagtgttgaggaaacagagggatattcgggttagggagtgtggttaagtggtgggcagtggggctgggccccattcccactgagccttatcccccctccaccgtctccggcagcgcagccgcattctgtgtttaggtggtggggtgctggcaggagagggtgtgggcctggggcaggaggaaggggaagtgggacagcccgccctgctctgagagcttcttcccgcagggcccgccaccgttcccctcctgatggcagcacctcagtgcgttccctctgctccgagcgctccatgcaggtcatgcgcggcaggtccttctgtttggccaggaatagtcctgaccttgggggcagggccgtggcttccctggatgtggccatgcgggaaccatgcagactgagtgtccacaggcccggcattgacacgccatgtggagcctctatccagcctcctgtgaccggggaacacgcggggaccctgtccagcgcctcctctgatcccggaacacacggggaccctgtccagcgcctcctctgaccccggaacatgcggggaccctgtccagcgcctcctctgaccccggaacacgtggggaccctgtccagcctcctctgaccccggaacacgcggggaccctgtccagcacctcctctgaccccagaacacgtggggaccctgtccaccgcctcctctgaccccggaacacgcggggaccctgtccagtgcctcctctgaccccggaacacgtggggaccctgtccagcctcctctgaccccggaacacgcggggaccctgtccagcgcctcctctgaccctggaacacgtggggaccctgtccagcgcctcctctgaccccggaacatgcgggaattgctgggaagggtcctgagccagcgccccgtggtgtgaacgtggcctcatgtcctcctgcgggagtgcttccgcagtgtgccagtggtgggccccggcttctgggggagccttgggtcgcggggcggggatacagactgagctggcgcctccagctgttcgggctctgatgcaggtctcccaggcgctctgctcttctctgctgcactggcccgtcactgtttctaccctgggaacagattcttccggaaggttccctgctgctgcagcggtgctcaccggaaggcggggcttcgaggcccttgtgtttgcaaagcagattcttaccgagatcccagaactacctgtgggcctcaaaagatgggtctgacaagtgtcttgtgtgaagggccagaacggactctttggggtttgccgggcaggtggtctctgtcgaagacgctgaactctgccatcgtgctgtgagagcggcagcggcgattcgtatttgattctgggtggctgtgctccatcaaaactttgttaaaaaaacaaaagttgtttacaaaaacaggctgtgggtgggatttggccacaggctgtagttgttggaccctgttaagaaaccaccgttcaagtcgtagccatgctcatcttcatgaagatccttctgccacgtgacgtcggcttgggccttgctgcagggaggtgacccgcaagattgatcccggcagccaggctttcatttctcgcaattgtctctttcaggaaagatgccctaggaccatacactttgtggccttaaggaggatggcgtcctctggtgttggccccggctgggcggtgctgcagggtgggagctgtgctctgtgtagggaaggccccctggttccctgctcagaccgtgggctggctcagggctctcccgcccgaggtgtgttgagatggcctttgggatgagtcattaccatccggccatttgcccttttgtctttctcatgtgtctggcatgttcttctgggaacttttcattttgacataatgttacactgacaggaaagttgcagaagtcgtggagaatgtttcgacgcaccctccgccagctttcccgagggtaacgtcttgtgagcccgtgtacagttatcagaagctgtaaggcctgggtgcagcaggcgcgggtcctgactgcgttcaggtcttgccggctctcccactgagctcctttttctgtgccaggatctggcctgggatccccatggcgtttggtggccctgtcctgccctgcactctgggacaggagagaatctgctcctcggtctttcctgtcgtcgtgaccccgcctcttcgagagcacgggctggtgttttgtggatgttcctcagttggagcgagtctgatgttatacatgattaggttgaagctatgcatttttggacagaaaatcttaaaagggatgtcatgtccctctgggtgtgtgatgtcggggtgtgcgacatcaccatgttctgttgcgggtgtggtcactccggtcacctggcgaaggcctccctaaatgcatggctgcggcttttgttctgataataagtatcttggggaagatgctttgagaatatgcaaatatcctatttattttattttatttttttgagatagagtctcgctctgttgcccaggctggagtgcagtggtgtaatcttggctcactgcaacctctgcttcccgaattcaagcaattctcctgcctcggcctcccaagtagctgggaccacaggcgcctgccaccacgcctggctaatttttgtatttttagtagagagggggtttcgccatgttagtcgggctggtcttgaactcctgacctcaggtgatccacccacctcagcctcccaaagcgctgggattacagctgtgagccaccgtgcccagcccccatttcttacaaaaacttctcctcctagttcaagcatctattggtgcatctcagctgcggggcttgtcaccatggccccagggcggttttctgtccgcccgtctcttccgtgtttcctgagtgggacgctttgctgagggaggctctgcccctcgtccccgtttcctgagtgggacgctttgctgagggaggctctgcccctcgtccccgtttcctgagtgggacgctttgctgagggaggctctgcccctcgtcgagtaggttatttgtgtcagttgcttccttctctgttttacttcacggccgtgacccagtgctctgcggattcggttcattcacggtatttcagccttggtcactgggagctctcacagttgggctctcgtgccctgtgatttgccctcatctttttttaaagccttttttttttttcaaactatctggcactgcaggatgctctaaacttagatgtttttcctgcccttttcctgcagtccgccactttcccagtgagccctgtttcctcttgttgccgagtgctgcttagagatgagatgtgggtgtggggtgctgcctgctccgggtgcgtcagggccccagggcccctcggtggacaccctgacactggctccatccagcacccctgggctgtcctcgcctcctgtgctgtctccttggtcttgagaagcccaggtgtcagcacacaccatgttttacttacccatccagtcctcacgtgcgcacagggtctttctggaattgctaatccatggctctgtgaggagaggttgacttgcgagggtgcagtgtctgtggacaggccgttctgtccttggcctaccgttcccagtggaagtggcgttttctcagcaccgtgggtgccgttgtgtttcccactgcctggtgttgtgttctttgtttgtggttcccttaggtttaccgcttagagctggtgtttcattttgagtctttttcattctggttgattaaaaaaaactgtctatacagcctcatttgcccttctgctgtgcagctgcgcattttcacatgcctggggctgacttgcggccccaccaccccagactcccctccctggccaccccagcatgctttctgtctggtgattttgccttttccagaacgtcatacaaatgtggcatctttggctcatggaggtgcatttgggactcaccgcgtggctgtgtgaatcgcagcgctgcttttcgttgctgagtgatgctccaggcacggctgctctgggacttgtttattcgttcactggttgaaggacatctgtattgtttctgggtttggtgaaatggagtaaagctgctggaaatgttggctttgtatgatctaaactcttacttttccttgagcacatacttaggagtgggactgctggatcctggcatccttttaacttcagaagacattgccttgtgggtctccacagcgggaagcatccggtgtgtgcgttcgcggtgtgtgcgtttgcggtgtgtgcaggtccactccgcacaggcctgctcctgctgggccacgccagggttttgggcttagctgcccccacagggctgtgtgggctgtgtgttgcgttttccagcgtgcggctgctggccccaacctggcgtcagacagttgctgtggtgctttctgcagcccccagccgtgttggcttgcacagccctctggacttgtggtcatcatggagttgtagccccttttccccacctgatttcccacgtatcgggatcaaatctaagctggtttcgttttgcttcctctcaagtcttttgtctttcctcccttcctcctttttcattgatctctgttctccggtgactttagggaaagactgtacctcattcattccgaggcacgctccttgactagagcagagagcaagggctgagcagccacggtctcgaaagctccttgccgcctgggaggcttccacgcctgggactgggggctgggcagccagcgtgcagaggtggaggggtgcatggaggcgcctgcgggctctgaggcctggcttcccgagcccctctagtcttcatctgtgggacgatcacacagaccgcatggtgtggggggagcgaggggcgggcacagtggacgctcggtgtgtgtgctcctcctctctccctgtttcttctttgttcctcttgtctttaatttacttttcgtcggaggacttggccgcagcgtgccctgtggacttgagaccgaagctctcttctgctctttgtaccctgctgcttcctgatccgttcttcctcccctcacttgtgtacaggactcgagggagggatggggtgagagcagagcaagccagggatgtagtgagctttgtttggacaggaagggtttgcccgcgccgtcatctcctcggctctgctgggaaactgtgtttgagggagatggtggggtctgagcgcagacggctgttgtcctgtgagatgcagaaagcgcttcttatgggcgtgcaccatggaattccctgctcggaccgcactgggggcaggcggtgagtatcggtatagaagtagcttttattaattggtgaagcccgtcacagatccgaaagcatcttaatagtctgaaatgatggctcttcagcaagaaaaatttgatttgggacaaaagggagacacttgagacccaaaatgacttggctgtgttgaggatgggaaggaggccttcatctgccgcacgtctgagtcactccagagttttctccactgccagtgtgagtcagagcgaatcactgttgggttgtgacttcagaagaagtgaactctgtctcaggctgtattaatagaagtagatgcttcacaggagaggaggtgtctgtgcgagtcacagccctgcggggtctgatttccgctttgggcgtggcttctgagccgggacctcgaggcgccaagggaacaggagcagccgggcagctgctcgcttggttgtgcctgctgtgtactgaggcgtggggcatggcggcacggctgtgagcgcacagtccagccacagaaggaggcttcaagaatctttgcggtgctgccatctggacatctgtgtcattgaagtcacaggaggaggcttcaagaatcttcgaggtgctgccatctggacatctgtgtcattttgataacgtgtgtgagatcagtggaggggagccttaggaaaatcggctgtggtttaataaactgaacttcccgctgctttgagccggagcctcctggactggaaaggcgtgggcctcatggccacctccggcctgcgcagctgggtctgcactctcacaactgtgctgagcccacgcttgtgcccttactagtggcctgacctctgcgctgtggagaagggtggatattgtcgccaactctcagacttcttgtgtgtgttcagaaagtacccaaacggattcaaaggaataattagcgtatcctgtaagatatgaatcttaattcctaaattacatatttagcagattgtccaaaatagcacttgtaatggcaacattcaattagtttaaaaaatgtatattattgcaacactcgccatgagttttatttagaggtttctaaatataatgctataaaaacacagaagtgtttaaaactatttagacccacgcagccgcagtgagctcttgctaaacttcctacgttaaccagctcttgacaatcttggattgtggggaagtcttctgatgtagtccctaaagctgacacgccagagcatctcgaggctgttgggggctgttgctgggatcctgaggccgcacacctccctgctatgagttctgacgtttacaaacataggaagtgagttgaaatgacagagtccttggggccccactcttgagtgtcctcctggggttggcgggcgtggggctcccgctgtgccgggttcggctcctgtgttgccgtgttccctgcggctgctgcagccgcttctcgtcacctgattgtgtgtgcgcctccagtgctctcatgggctgcttaaggcagggactatccatgtggcctgaagaagaagccgaggcccggggaagttgcatgtaattgacaccagagggctggcctcatttcaggaggagcagagctcgggttttccgtctaggtgggagatgggatggtgatgggcccacaggcagggcctgtcctctgatgggaatccgaagtgggtgcggaggacccagagctgagggtgagcagctctgagctgcagagcgggtgcggggaggctgtgtgcgcagcacagggaggcgtctggaatggccgggtgggggtctggaacccatacttggtagcgcctgtttggtctgtcccgtgctcttcctgcgagccctcgcgggggccctgcacttccccaggagctgcctcagagatgtgccagtgaagaagggatggaactgatcgtggatcgggccggctcctggaggccacctgggcccatttctgacagccgctcctgccgcgtccctagctcagaaggagctcgaggctgagccgtttccccagggctgctgcctttgtttctcccattctgaaaggagatgaaagtttctactgaccttagagagaaagccagagtgaaaccccctctgccaacccctggctccctgtgaaaagccttcctggtaatcaagtgtttacagaggaaggctttgttcagaccctttctggggctctgtatgtttaaacaaagagctttttagacctaaacacagatgttcatttgaaaatgaaaaatcaaattaagcagaaccagcctttgaaagttaatgccctatagcaagtaaaacaaagggagaaaaacactgtgttgtaaattttacttaaataactttttattttaaataaagttttaaactaaaaaagtataatttgaaagccactcatcttcctctctgtcctccagtagaacatctgtgctgattctgacgcggatgaatgacatgaattaaaccaaaaccgtcggagcgctctttttaccataattacaccttgttcgtttgtgagacacaatgtggggatgaaatgccaattaagcctgctatgataatgaggtggggcctgaatagtgatcagcggacatgaatcccaccggaattcatttgctacagcccccaagtttgttctcttctgatgggaatgttatcgtacataatgaaaatctttagtgctccttgtatttaaaaatgatccattttggggtttttggtcagcaagttttaaaacaggtgttttccgagcacctggatgggtttcatgtccccactgagcatcctgttggtggggggtgggggggtgccggtgtctcctgccccctgcctggactcttctgtggagagctatggtgtcacagcccgggacacagtccagcgacatgtgccaggcaccatccccatgggtgcccttgcaggtctgggtggcagctgagaaaccattttcacccatcactgtgtccaagcatttaccatctccgaccctcaaataccctctaatgttttgaaacataggaagtgcgttgaaattattgaaagcactgtgaaggaaatgctttgggtgttgtggaatgacagggtgggaaagacgtcactgggggccaggcagggcctcaccaggaggcagcatctgagcagaggcctgagggcagccgggggctgggcaggggtgaccaagcgggacagacgagctgctgggacgccagcagggctggcacagtgcggggatcacagcatgattgcagcgggcagctgttgaagactggaagcgcggcagtggcatggttacctcacacagtcggaagagcgacctggagaaagaggccttcgggatggggagcaggaagtgtgtcggtgcgtgaggatgcaggggtccagcgaggaggctgtgggtagttcagggggaggtggtggggtggcaaagaccaccctgcagtgaccacataatcctcgagggccagccccctctgccccagggctgctgtggcttgggctgcagcctctggactgggcttcctgccaccggatgctccggcagcgagacctcaccaactctgactgtcccgccccacacactcctggcttaccgcctgcagggaaggtgcttgcgactcctctgtgttgctagggatgttggccctgcctccttccacgcctcccggtgcgctgccatcctcaggccctccggctgtcccaggcagccaggtgctgagtgatgctgtatgtgggtgcccttcctgtccttgggagccaggctgtggggccgggccctgtgagaacacacggcgtcaggagcctcctggctctttcacactagactacgctcctctaggggactgggccagctgcgttctggacccccgggcccctgcccaggtctgcactcagctgtctctcagccagggccaggagggtctccatcacgagtcctcctgggggctgaagggtgactggctcccagctgagagagccggctgcagcatggactcatgacagctggggaggggcagccctgcagaagggactgaatggtgactttcctctctcaggtttcgtggaggccctacagcccatgcgggacaacacgttccagtgcagctgcaggcgtcttttgcgggatgggccgagagtgtgacgggctatgctagcctgggtctggtgggctggagaggagggaggcggtctcctaggagggatttgtgcccctggcctgccttctccccccacccctgggagagtggagctcacgtgtcctccttggtgttaggcagggttggagagggagcctcggagagcctgctggcttggcacaggtttccaggagcgcatgtgggaagggcagggtggggccgggcctgggaaagggggagagtgagtgaccatggccgtctccagggatgggcatgtatatccgatagagaaggaagggcagggtggggccgggcctgggaagtggggagtgtgagtgaccatggccgtctccagggatggacatgtggatccgatagagaagcggcctgccgtgctcgcacctttcacgcaaggcaccgacgcagtggaggggtgctgccgatgtgccagcactaagggcccaattcctagcctaggcgtaatggggcaagggccctgtgctgggggtgggaggcgggactgtgtgctgggcagggtggaggggcggggctgtgtgatggctggcgctgtgtgtgatagataggtctggggggtggggcttcgtgctgggcagaatggaggggcggggccatgtgtggggcaggggcggggccatatgtggggcaggggcaggggcagggctgaggtgttggtgccctttggttgtggggccgcagctggatagggctctgggactgtgctccagaaggtgttgctaggtggcatctgtgacgatgggggcctttcctgctgccctaccctggagctggggagcggggtgggtgaggagcgttgaggaggagagagctggagctggtggtactggggttttggctgggcgtctcacgtgcctggactttctggtctcatctggaaggtggtctcttactggaccgtgcgggggtgaggagacaggccgaggccaccaggtaaagcagggctgtggtgagagaggccccattttccctcagaaccttcacagtgcgtggctggccttggcaaggctgcatggctggtcccagggcttcctggcctcgttacttcctggcttcagggcagtgtaggagcagccacaaagcagacatttgggttgtcctttatgaatgcctcgggtgatgatccacgctccctgccttgccccagcgcaggctgtgcccgcccaccctcccgtggagcccacgctttgctctgcctgctgctgccaggccagcagagaccgccccgtagggcactgcggtttctgcggcctgttctgccctgagtggccttcctcccctgctcttagctgggccccctcactccacctcgctgctggctttgttgcctttcaggctgtgaccacctgaagccagctcgtgtgttagtgccctttgttagtaaccaaccccttgtcggcagagaccttccctttctgctcactggaatatccccaagcaggacggtgcggtgtttgtggcctcagagagtgaggctctcccgggctgcagaggcacagccagtttcttcccggcagacctcttttcagaacagcccctcactgcggtgtccggcccctggggaagccgggctctgactgggtgggtcagccctcaggctgtgccaggaatcccatctccaggcgggctgtgcgtagttcccttcgtgttttaacatttaggaggtgagcggtttccttccctgagctccggaaagagtccccagggcttgcggggggacctaccctgcattgcacgttggaaggagaggcagctgcaggctgagcccacatggctgtgcacggcctggcgtgggagctgcagtgatttatgtgacctgtgctcagataattaaagtgggatttggcagtgaggtctttcatggcaaaggcgttagggatgtcacaatgaggcatgtaagtataaaacagttatgttttcaaaggcgttagggatgtcacaatgaggcatgtaagtataaaacagttatgttttcaggttaagaatttaacgaggagtaaattcatttaaaccgaagagctggcttaaggggagctttcgtggaagatctgtagttgctggcatttcattccttctcatttgagcccagcctgtctctggtggcagagcgcgtgttccgagtgtccaggtgccgcagccgccccctgtaggcaccagcgtgtttgacatgcgggtcagggatctgacgcaacaggccgcctccacatgccagactgcgtcccccttggcctgctattgcgccgccgtgacggctctccttcgcggaggggcggggctgtgggggctgtcttcctgtgttttctctccggggcctcatctgccttcaggagcctgtgcagtgccactcgggctgagcagcctccgccagtgcacaggggactccgggcttgcctctgtggaggagtttgccgctatctgctctgcctttgtcctggttccccaaatggaggcccagcctgccgtggttctaatccaggtttctggtcatcaaagcagcatgcctttaataacagatatggcctgttgtgcagttggcccggagagctctgatcattacttatctgccacgagatgcttttgctcaaggcaggctgctgaggagcacactccttaccttcattgaatgatttccagacaccggctgcatatttgattctctgccatgtgtctgggggcctctttctccgacgtccagcggggtggagtgttgtatggcgtggcatcagaactggtggtctccccgcattccttgccttttcccaccccatctccagagtccggacaccacctgtgagactgtccctctgcctggggatgcggagggactccgtgcacagtggttcagggggtctgcttatgccacactgctgggatctgggcagggaggaggacagcacctgccctctgagtagccgcctccctggctcctcctcgtggccgctccctccttctcccctgtgggatcgagtctcagtgttctggctgtgctgcccggctcctgagaggccttcgcaggggctcccagggctgcctggtggtgggctttgccccagtgctggcccatctgcggttgccccgcccaacaaagagcacggtggtcgagagccccgccgctgtgcagtggcctcgggggcgggtgagatctgctgcactgctgtatcgcctcaccctctgtcctctcaggtgctcacccacttcttccaaacagaaacgtcatcactaggcatggcgatgtcccatgtgccgtctactgagcggcggggcaggcaggcccaggccttcactgagtgcaggagcgcaggtatgactgtgtgtgcagggcccgtcggggcagccatggcttgggctgcgacccggccctcagcgtggccggatggacggcctccctctggacacaccatgtgggctgagagctgaagcgtggtcggagctgcccctttgtagggtgcaggggcaggggagagagcccgttccaggcagaggcagcagcaagcgcaggggccctgaggtgggagaggacgcgcgtctccagcaggcaggcagcgtggccaggcctgacccagcgctgacccaggtgttggcagcatcacggaggctgcctcctctgagttgtggagctgatgtcctgagaggggacagtgccacctctgccgaacctgttttctccgtgtgccttatacacctgaggagaggcccgctttaggagtgggtaggagaagacgccatctctgggcattgtctctggagtgacaaggatgcgtctcatgctgaggatggcgtggagagtggtcctgagagtgctggtgacggtggagacggtgacggccatgatggtgcgagggtggcggtgaccgtggtgtcactgatggtgacagtggtgatggtggggacgtggtgagagtgctggtgacggtggtgatggtgtggagagtggtcctgagagtgctggtgacagtggagatagtgacagtggcgatgatggtgcgagggtggtggagaccgtggtgtcaccgatggtgacagtggtgatggggatgtggtgagagtgatggtgacagttgtgatggtgacggtggtggtgatggtgacgtgagaatggtggtgatggtggttattggtgacagtggtgagtggtgacagtagcagtggtggtgagtggtgacagtagcagtggtggtgagggtgacagtggtgatggtgacatggtgagagtgctagtgatggtggtggtgatggtgacggtggtgatagtgacggtggtgatggtggcggtggtgatggtgatggtgacggcggtgatggtgacggtggtgatggtgacagtggcggtggtggtggtgatagtgatggtggtgatggtgacagtggcggtggtggtggtggcggtggcgacggtggcggtggtgacggtgacggtgatggtggttgtggtgacagtggcagtgttggtgatgatggtgggtgcagtggcaggacttggcatctgttgagagtctgccctgtgactggtgccaggacctagcctgcgttttcaccttatcctgtgctctcagcctcttctgctggggagactcagtcctgagtcagacaggagggtccaaggtcagcgaggctgtgtgatctgcccactcccacccatggcagattcagacctccagtcagggtcttcccagctgcagagccccctgtgtgcactggactgcactcctccttctcctgcctggtatgtgtttatccagcatgtgtcaggcgtgggccagcttgggctgtgatggtgactgagacagctgtggccctgtgtgcacggagccaacagtctagtgggtgagcagcatagaagctgttcactttggtgagcatggagccggtagtctggtgggtggcagcatagaggctgctcactttggtaagttgagggaagaagcgtctttgttctttactggctctcagggtccaggtgcacagcctcctggatggaggccctttaggaatggagccccagtctcacgccaggcacccggatggagaccctttaggagtggagccccagtctcctgccacccacctggatggagaccctttaggagtggagccccagtctcatgccacccacctggatggagaccctttaggagtggagccccagtctcatgccacccacctggatggagaccctttaggagtggagccccagtctcatgccacccacctggatggagaccctttaggagtggagccccagtctcatgccacccacctggatggagaccctttaggagtggagccccagtctcatgccacccacctgaatggagaccctttaggagtggagccccagtctcgcgccaggcacagtggctgtggcccttccccccagggcagaccccatagcacaaaagcccgcatcctctttggtgtatgaatgttcccacagtggaaactagggtttttccagtcccttgtgacaaaggattatgagttttttcccattgaaggggagcaagtttctgagggtgggaaggaagccgttgaaaacaaattggcagcactccccccatcctcttgctgatggggaaagtggttaattaggtgatttttctcttcccctgacacgtgcaaatgaggcttcgttaataactgcactgttacagaaatgatacgactttaacaccaacgtcaagttgtcaggcgtgtctgcagagtggaggtggggggcactggaggcccctgcgcccctcccgacaggagtcatgctggagccgcgcctccagtcgctggggcttggccttgggcaacgagctgttcccctcccaccctccaacccccttcagggccagcttaattatttaaaactgatgataaaaacagaatgagctgccaagatgaagtgatgatttgcggccaggacctggggcttgggtggacgcggctcccactctccctgcttgctgtgtgctggcccagtgcggccgtttccaaggacgccttccggtttgcagccagggcccaggacacggacagcatctctgctctcaggtgtcaggaggcctgcagatggtgcagggcccgctcagggcttgtcctgccaggacgaggcagacgcgccgggtgggcaggtgggtagggtaaagcagaagcaaagcggcagtaccacagagcaaggcaccagcattgtaatgtctggagtgtggcaccccctccaggaagcaggtgcttcacgctcagaagcgcctggctgtggcatgcttcttactatctgtcagaaggctcaaggtcaaaaggccgtgctttctgccatagagtttcaagagtaaaggagaacgcggagatctagtcagctgggattcctagctctgctcagaaacaggctgggctttgagaccttttcctcctcattttccctgctggtctggaacagaaagtacttgcagctgactgcgctggccgtcgtaaagcagtgtgcacctgtctctcaaacctcaatggttgcctgggatttgcttctcacctatgtccttatccatcaacaggtagttattaaatgcccatgtccctgagacggttttgggctttgtgtggctgggggcgaagtgtaaggaatgacctctacctgtaaggagctcacagccagccccttggcttgagctgtgagaagtttgaaaatccatgtgctaggttagcccagatgacaccaagagcattggtgctggttcttctgagtcatgcctggggcatcgagggctgggctggtgggaggtgactcctcacagtcggcagccagtcccactggggatagtttcatggccagaatggcctaccaggggctcctccctgcagggttgagagctcacgcctgaggactgttcacaggaagccacggcccgggtgcttcctgggtctcgggtaggagtacctcttctgaaccacgtctaatgggttttttgaagagaagagaaatgaatctcccagtgctgacttctgagattcggctgtctcccagcccgatgcgctcacttccgtccacgctcccgcctggcctctgggtggcgggttgttagtacagtaaagattgctagctgtctcttttgcaaatctaaaatgagatttcatttttttaaataaaaagaaaaaagtgcttgaacatttgcagctgggagatagcacagattagaaacattacttatctctgctgcacaaaagaaggcagcgagagaggaataaattgctgttgaatgctaacgaagccaaggcggcaggggctgcgggaaacaactcctgttgaggaacagagcgagcacctgacctgcaccctccacagtgggccgggcgccggagtgcacagggcaggcggggctgtgggtccaggtgagacaggctgtggctgctgcatgttgacctggcggtcggggtggagtctggtcaccagtgttagcggtgcgttgggggatgctccttcctggaccatgggaggctgtgctaccactgcgcttaggagcctcagtgaagctcaccctcttcag
